United States Patent 7,745,391 (HUMAN THROMBOSPONDIN POLYPEPTIDE) - sequence listing, part 272

SEQ ID NO: 806913 - protein, 454 aa, Homo sapiens
MPEFLEDPSVLTKDKLKSELVANNVTLPAGEQRKDVYVQLYLQHLTARNRPPLPAGTNSKGPPDFSSDEEREPTPVLGSGAAAAGRSRAAVGRKATKKTDKPRQEDKDDLDVTELTNEDLLDQLVKYGVNPGPIVGTTRKLYEKKLLKLREQGTESRSSTPLPTISSSAENTRQNGSNDSDRYSDNEEDSKIELKLEKREPLKGRAKTPVTLKQRRVEHNQSYSQAGITETEWTSGSSKGGPLQALTRESTRGSRRTPRKRVETSEHFRIDGPVISESTPIAETIMASSNESLVVNRVTGNFKHASPILPITEFSDIPRRAPKKPLTRAEVGEKTEERRVERDILKEMFPYEASTPTGISASCRRPIKGAAGRPLELSDFRMEESFSSKYVPKYVPLADVKSEKTKKGRSIPVWIKILLFVVVAVFLFLVYQAMETNQVNPFSNFLHVDPRKSN

SEQ ID NO: 806914 - protein, 454 aa, Homo sapiens; identical to SEQ ID NO: 806913

SEQ ID NO: 806915 - protein, 345 aa, Homo sapiens
MPEFLEDPSVLTKDKLKSELVANNVTLPAGEQRKDVYVQLYLQHLTARNRPPLPAGTNSKGPPDFSSDEEREPTPVLGSGAAAAGRSRAAVGRKATKKTDKPRQEDKDDLDVTELTNEDLLDQLVKYGVNPGPIVGTTRKLYEKKLLKLREQGTESRSSTPLPTISSSAENTRQNGSNDSDRYSDNEEDSKIELKLEKREPLKGRAKTPVTLKQRRVEHNQVGEKTEERRVERDILKEMFPYEASTPTGISASCRRPIKGAAGRPLELSDFRMEESFSSKYVPKYVPLADVKSEKTKKGRSIPVWIKILLFVVVAVFLFLVYQAMETNQVNPFSNFLHVDPRKSN

SEQ ID NO: 806916 - protein, 454 aa, Homo sapiens; identical to SEQ ID NO: 806913

SEQ ID NO: 806917 - protein, 454 aa, Homo sapiens; identical to SEQ ID NO: 806913

SEQ ID NO: 806918 - protein, 494 aa, Homo sapiens
MPEFLEDPSVLTKDKLKSELVANNVTLPAGEQRKDVYVQLYLQHLTARNRPPLPAGTNSKGPPDFSSDEEREPTPVLGSGAAAAGRSRAAVGRKATKKTDKPRQEDKDDLDVTELTNEDLLDQLVKYGVNPGPIVGTTRKLYEKKLLKLREQGTESRSSTPLPTISSSAENTRQNGSNDSDRYSDNEEDSKIELKLEKREPLKGRAKTPVTLKQRRVEHNQSYSQAGITETEWTSGSSKGGPLQALTRESTRGSRRTPRKRVETSEHFRIDGPVISESTPIAETIMASSNESLVVNRVTGNFKHASPILPITEFSDIPRRAPKKPLTRAEVGEKTEERRVERDILKEMFPYEASTPTGISASCRRPIKGAAGRPLELSDFRMEESFSSKYVPKYVPLADVKSEKTKKGRSIPVWIKILLFVVVAVFLFLVYQAMETNQVNPFLPGSSNFPASAETGFHHVGQAGLEPLTSSDQPTSASQSAGITGVIHCTRPAL

SEQ ID NO: 806919 - protein, 107 aa, Homo sapiens
QLGTSATPQTGISASCRRPIKGAAGRPLELSDFRMEESFSSKYVPKYVPLADVKSEKTKKGRSIPVWIKILLFVVVAVFLFLVYQAMETNQVNPFSNFLHVDPRKSN

SEQ ID NO: 806920 - protein, 454 aa, Homo sapiens; identical to SEQ ID NO: 806913

SEQ ID NO: 806921 - protein, 454 aa, Homo sapiens; identical to SEQ ID NO: 806913

SEQ ID NO: 806922 - protein, 181 aa, Homo sapiens
MPEFLEDPSVLTKDKLKSELVANNVTLPAGEQRKDVYVQLYLQHLTARNRPPLPAGTNSKGPPDFSSDEEREPTPVLGSGAAAAGRSRAAVGRKATKKTDKPRQEDKDDLDVTELTNEDLLDQLVKYGVNPGPIVGTTRKLYEKKLLKLREQGTESRSSTPLPTISSSAEKEERTQESEVH

SEQ ID NO: 806923 - protein, 167 aa, Homo sapiens
MYEAGCEIGDDEILGFISEATPLGGIQAASTESCNQQLDLALCRAYEAAASALQIATHTAFVAKAMQADISQAAQILSSDPSRTHQALGILSKTYDAASYICEAAFDEVKMAAHTMGNATVGRRYLWLKDCKINLASKNKLASTPFKGGTLFGGEVCKVIKKRGNKH

SEQ ID NO: 806924 - protein, 454 aa, Homo sapiens; identical to SEQ ID NO: 806913

SEQ ID NO: 806925 - protein, 215 aa, Homo sapiens
MPEFLEDPSVLTKDKLKSELVANNVTLPAGEQRKDVYVQLYLQHLTARNRPPLPAGTNSKGPPDFSSDEEREPTPVLGSGAAAAGRSRAAVGRKATKKTDKPRQEDKDDLDVTELTNEDLLDQLVKYGVNPGPIVGTTRKLYEKKLLKLREQGTESRSSTPLPTISSSAENTRQNGSNDSDRYSDNEEGKILNDVNQMYVIFSHSKFSDHEESKI

SEQ ID NO: 806926 - protein, 218 aa, Homo sapiens
MPEFLEDPSVLTKDKLKSELVANNVTLPAGEQRKDVYVQLYLQHLTARNRPPLPAGTNSKGPPDFSSDEEREPTPVLGSGAAAAGRSRAAVGRKATKKTDKPRQEDKDDLDVTELTNEDLLDQLVKYGVNPGPIVGTRLLLKAPRPRLHSSFPSVHLCCCSTPPRPGQSCFCTLPDSPCQPTLSPRSYTGCSRSALIPGQRPAWRPPPTPPRCNPYAL

SEQ ID NO: 806927 - protein, 345 aa, Homo sapiens; identical to SEQ ID NO: 806915

SEQ ID NO: 806928 - protein, 694 aa, Homo sapiens
MPEFLEDPSVLTKDKLKSELVANNVTLPAGEQRKDVYVQLYLQHLTARNRPPLPAGTNSKGPPDFSSDEEREPTPVLGSGAAAAGRSRAAVGRKATKKTDKPRQEDKDDLDVTELTNEDLLDQLVKYGVNPGPIVGTTRKLYEKKLLKLREQGTESRSSTPLPTISSSAENTRQNGSNDSDRYSDNEEGKKKEHKKVKSTRDIVPFSELGTTPSGGGFFQGISFPEISTRPPLGSTELQAAKKVHTSKGDLPREPLVATNLPGRGQLQKLASERNLFISCKSSHDRCLEKSSSSSSQPEHSAMLVSTAASPSLIKETTTGYYKDIVENICGREKSGIQPLCPERSHISDQSPLSSKRKALEESESSQLISPPLAQAIRDYVNSLLVQGGVGSLPGTSNSMPPLDVENIQKRIDQSKFQETEFLSPPRKVPRLSEKSVEERDSGSFVAFQNIPGSELMSSFAKTVVSHSLTTLGLEVAKQSQHDKIDASELSFPFHESILKVIEEEWQQVDRQLPSLACKYPVSSREATQILSVPKVDDEILGFISEATPLGGIQAASTESCNQQLDLALCRAYEAAASALQIATHTAFVAKAMQADISQAAQILSSDPSRTHQALGILSKTYDAASYICEAAFDEVKMAAHTMGNATVGRRYLWLKDCKINLASKNKLASTPFKGGTLFGGEVCKVIKKRGNKH

SEQ ID NO: 806929 - protein, 454 aa, Homo sapiens; identical to SEQ ID NO: 806913

SEQ ID NO: 806930 - protein, 454 aa, Homo sapiens; identical to SEQ ID NO: 806913

SEQ ID NO: 806931 - protein, 454 aa, Homo sapiens; identical to SEQ ID NO: 806913

SEQ ID NO: 806932 - protein, 169 aa, Homo sapiens [sequence omitted]

SEQ ID NO: 806933 - protein, 337 aa, Homo sapiens
MPEFLEDPSVLTKDKLKSELVANNVTLPAGEQRKDVYVQLYLQHLTARNRPPLPAGTNSKGPPDFSSDEEREPTPVLGSGAAAAGRSRAAVGRKATKKTDKPRQEDKDDLDVTELTNEDLLDQLVKYGVNPGPIVGTTRKLYEKKLLKLREQGTESRSSTPLPTISSSAENTRQNGSNDSDRYSDNEEDSKIELKLEKREPLKGRAKTPVTLKQRRVEHNQSYSQAGITETEWTSGSSKGGPLQALTRESTRGSRRTPRKRVETSEHFRIDGPVISESTPIAETIMASSNESLVVNRVTGNFKHASPIPPGFKQFSCLGRDGVSPCWPGWSRTPDLK

SEQ ID NO: 806934 - protein, 423 aa, Homo sapiens
MPEFLEDPSVLTKDKLKSELVANNVTLPAGEQRKDVYVQLYLQHLTARNRPPLPAGTNSKGPPDFSSDEEREPTPVLGSGAAAAGRSRAAVGRKATKKTDKPRQEDKDDLDVTELTNEDLLDQLVKYGVNPGPIVGTTRKLYEKKLLKLREQGTESRSSTPLPTISSSAENTRQNGSNDSDRYSDNEEDSKIELKLEKREPLKGRAKTPVTLKQRRVEHNQSYSQAGITETEWTSGSSKGGPLQALTRESTRGSRRTPRKRVETSEHFRIDGPVISESTPIAETIMASSNESLVVNRVTGNFKHASPILPITEFSDIPRRAPKKPLTRAEVGEKTEERRVERDILKEMFPYEASTPTGISASCRRPIKGAAGRPLELSDFRMEESFSSKYVPKYVPLADVKSEKTKKGRSIPVWIKILLGLQV

SEQ ID NO: 806935 - protein, 440 aa, Homo sapiens
VRHEKTYRRELISLSFKKLNSCLLQEKSSHDRCLEKSSSSSSQPEHSAMLVSTAASPSLIKETTTGYYKDIVENICGREKSGIQPLCPERSHISDQSPLSSKRKALEESESSQLISPPLAQAIRDYVNSLLVQGGVGSLPGTSNSMPPLDVENIQKRIDQSKFQETEFLSPPRKVPRLSEKSVEERDSGSFVAFQNIPGSELMSSFAKTVVSHSLTTLGLEVAKQSQHDKIDASELSFPFHESILKVIEEEWQQVDRQLPSLACKYPVSSREATQILSVPKVDDEILGFISEATPLGGIQAASTESCNQQLDLALCRAYEAAASALQIATHTAFVAKAMQADISQAAQILSSDPSRTHQALGILSKTYDAASYICEAAFDEVKMAAHTMGNATVGRRYLWLKDCKINLASKNKLASTPFKGGTLFGGEVCKVIKKRGNKH

SEQ ID NO: 806936 - protein, 454 aa, Homo sapiens; identical to SEQ ID NO: 806913

SEQ ID NO: 806937 - protein, 248 aa, Homo sapiens
MPEFLEDPSVLTKDKLKSELVANNVTLPAGEQRKDVYVQLYLQHLTARNRPPLPAGTNSKGPPDFSSDEEREPTPVLGSGAAAAGRSRAAVGRKATKKTDKPRQEDKDDLDVTELTNEDLLDQLVKYGVNPGPIVGTTRKLYEKKLLKLREQGTESRSSTPLPTISSSAENTRQNGSNDSDRYSDNEEDSKIELKLEKREPLKGRAKTPVTLKQRRVEHNQVSLVLLPPCTGINNLLTTLIHVLAFNG

SEQ ID NO: 806938 - protein, 127 aa, Homo sapiens
LQCCLPAGWYCYLVGLGDLRNRRRSHNGLGPDCATASRETWALGTFLVPDSGPQAVPRQQDHRTSGWTLPGKLCYFAAAGPCSSLTSVCPLSHHIISLWWQGLSSEFCIEKAPGSQSFNGFKTTRSA

SEQ ID NO: 806939 - protein, 114 aa, Homo sapiens
MSLPIGIYRRAVSYDDTLEDPAPMTPPPSDMGSVPWKPVIPERKYQHLASLSKVSGVSIAEGGGCQLLQVENEELSRFFLFVSKDHYLNLGSSGPQGVVLGPAASVTPGNLLER

SEQ ID NO: 806940 - protein, 305 aa, Homo sapiens
MASRQPEVPALEASAPLGKMSLPIGIYRRAVSYDDTLEDPAPMTPPPSDMGSVPWKPVIPERKYQHLAKVEEGEASLPSPAMTLSSAIDSVDKVPVVKAKATHVIMNSLITKQTQESIQHFERQAGLRDAGYTPHKGLTTEETKYLRVAEALHKLKLQSGEVTKEERQPASAQSTPSTTPHSSPKQRPRGWFTSGSSTALPGPNPSTMDSGSGDKDRNLSDKWSLFGPRSLQKYDSGSFATQAYRGAQKPSPLELIRAQANRMAEDPAALKPPKMDIPVMEGKKQPPRAHNLKPRDLNVLTPTGF

SEQ ID NO: 806941 - protein, 244 aa, Homo sapiens
AAVLPARWVVLLPSGSWGPSKSPPLSQWLGSRLRHSLSGDVGPRNLFSAGLRAAGSPAAAGSQVAGTQLGILYRKSTWIPVFQWLQDNQKCLKLKLQSGEVTKEERQPASAQSTPSTTPHSSPKQRPRGWFTSGSSTALPGPNPSTMDSGSGDKDRNLSDKWSLFGPRSLQKYDSGSFATQAYRGAQKPSPLELIRAQANRMAEDPAALKPPKMDIPVMEGKKQPPRAHNLKPRDLNVLTPTGF

SEQ ID NO: 806942 - protein, 179 aa, Homo sapiens
HSNSVTLVVECFGHSKVLGLLGGEALHKLKLQSGEVTKEERQPASAQSTPSTTPHSSPKQRPRGWFTSGSSTALPGPNPSTMDSGSGDKDRNLSDKWSLFGPRSLQKYDSGSFATQAYRGAQKPSPLELIRAQANRMAEDPAALKPPKMDIPVMEGKKQPPRAHNLKPRDLNVLTPTGF

SEQ ID NO: 806943 - protein, 286 aa, Homo sapiens
MSLPIGIYRRAVSYDDTLEDPAPMTPPPSDMGSVPWKPVIPERKYQHLAKVEEGEASLPSPAMTLSSAIDSVDKVPVVKAKATHVIMNSLITKQTQESIQHFERQAGLRDAGYTPHKGLTTEETKYLRVAEALHKLKLQSGEVTKEERQPASAQSTPSTTPHSSPKQRPRGWFTSGSSTALPGPNPSTMDSGSGDKDRNLSDKWSLFGPRSLQKYDSGSFATQAYRGAQKPSPLELIRAQANRMAEDPAALKPPKMDIPVMEGKKQPPRAHNLKPRDLNVLTPTGF

SEQ ID NO: 806944 - protein, 286 aa, Homo sapiens; identical to SEQ ID NO: 806943

SEQ ID NO: 806945 - protein, 286 aa, Homo sapiens; identical to SEQ ID NO: 806943

SEQ ID NO: 806946 - protein, 286 aa, Homo sapiens; identical to SEQ ID NO: 806943

SEQ ID NO: 806947 - protein, 286 aa, Homo sapiens; identical to SEQ ID NO: 806943

SEQ ID NO: 806948 - protein, 156 aa, Homo sapiens
MASRQPEVPALEASAPLGKMSLPIGIYRRAVSYDDTLEDPAPMTPPPSDMGSVPWKPVIPERKYQHLAKVEEGEASLPSPAMTLSSAIDSVDKVPVVKAKATHVIMNSLITKQTQESIQHFERQAGLRDAGYTPHKGLTTEETKYLRVAEALHVSS

SEQ ID NO: 806949 - protein, 286 aa, Homo sapiens; identical to SEQ ID NO: 806943

SEQ ID NO: 806950 - protein, 91 aa, Homo sapiens
AAVLPARWVVLLPSGSWGPSKSPPLSQWLGSRLRHSLSGDVGPRNLFSAGLRAAGSPAAAGSQNLWMDSSWEALLLCSSWTMFLINICLSA

SEQ ID NO: 806951 - protein, 305 aa, Homo sapiens; identical to SEQ ID NO: 806940

SEQ ID NO: 806952 - protein, 286 aa, Homo sapiens; identical to SEQ ID NO: 806943

SEQ ID NO: 806953 - protein, 286 aa, Homo sapiens; identical to SEQ ID NO: 806943

SEQ ID NO: 806954 - protein, 224 aa, Homo sapiens
MTLSSAIDSVDKVPVVKAKATHVIMNSLITKQTQESIQHFERQAGLRDAGYTPHKGLTTEETKYLRVAEALHKLKLQSGEVTKEERQPASAQSTPSTTPHSSPKQRPRGWFTSGSSTALPGPNPSTMDSGSGDKDRNLSDKWSLFGPRSLQKYDSGSFATQAYRGAQKPSPLELIRAQANRMAEDPAALKPPKMDIPVMEGKKQPPRAHNLKPRDLNVLTPTGF

SEQ ID NO: 806955 - protein, 215 aa, Homo sapiens
AAVLPARWVVLLPSGSWGPSKSPPLSQWLGSRLRHSLSGDVGPRNLFSAGLRAAGSPAAAGSQKLKLQSGEVTKEERQPASAQSTPSTTPHSSPKQRPRGWFTSGSSTALPGPNPSTMDSGSGDKDRNLSDKWSLFGPRSLQKYDSGSFATQAYRGAQKPSPLELIRAQANRMAEDPAALKPPKMDIPVMEGKKQPPRAHNLKPRDLNVLTPTGF

SEQ ID NO: 806956 - protein, 124 aa, Homo sapiens
MFCSFFPRGWFTSGSSTALPGPNPSTMDSGSGDKDRNLSDKWSLFGPRSLQKYDSGSFATQAYRGAQKPSPLELIRAQANRMAEDPAALKPPKMDIPVMEGKKQPPRAHNLKPRDLNVLTPTGF

SEQ ID NO: 806957 - protein, 286 aa, Homo sapiens; identical to SEQ ID NO: 806943

SEQ ID NO: 806958 - protein, 286 aa, Homo sapiens; identical to SEQ ID NO: 806943

SEQ ID NO: 806959 - protein, 66 aa, Homo sapiens
VTAAGLPKCWECRPEPDLTSVSQCYTSFNLISTHGLPCSPYSSHQCPFRRSLNNIAVHFFLQDIFS

SEQ ID NO: 806960 - protein, 286 aa, Homo sapiens; identical to SEQ ID NO: 806943

SEQ ID NO: 806961 - protein, 766 aa, Homo sapiens
MKTPWKVLLGLLGAAALVTIITVPVVLLNKGTDDATADSRKTYTLTDYLKNTYRLKLYSLRWISDHEYLYKQENNILVFNAEYGNSSVFLENSTFDEFGHSINDYSISPDGQFILLEYNYVKQWRHSYTASYDIYDLNKRQLITEERIPNNTQWVTWSPVGHKLAYVWNNDIYVKIEPNLPSYRITWTGKEDIIYNGITDWVYEEEVFSAYSALWWSPNGTFLAYAQFNDTEVPLIEYSFYSDESLQYPKTVRVPYPKAGAVNPTVKFFVVNTDSLSSVTNATSIQITAPASMLIGDHYLCDVTWATQERISLQWLRRIQNYSVMDICDYDESSGRWNCLVARQHIEMSTTGWVGRFRPSEPHFTLDGNSFYKIISNEEGYRHICYFQIDKKDCTFITKGTWEVIGIEALTSDYLYYISNEYKGMPGGRNLYKIQLSDYTKVTCLSCELNPERCQYYSVSFSKEAKYYQLRCSGPGLPLYTLHSSVNDKGLRVLEDNSALDKMLQNVQMPSKKLDFIILNETKFWYQMILPPHFDKSKKYPLLLDVYAGPCSQKADTVFRLNWATYLASTENIIVASFDGRGSGYQGDKIMHAINRRLGTFEVEDQIEAARQFSKMGFVDNKRIAIWGWSYGGYVTSMVLGSGSGVFKCGIAVAPVSRWEYYDSVYTERYMGLPTPEDNLDHYRNSTVMSRAENFKQVEYLLIHGTADDNVHFQQSAQISKALVDVGVDFQAMWYTDEDHGIASSTAHQHIYTHMSHFIKQCFSLP

SEQ ID NO: 806962 - protein, 766 aa, Homo sapiens; identical to SEQ ID NO: 806961

SEQ ID NO: 806963 - protein, 766 aa, Homo sapiens; identical to SEQ ID NO: 806961

SEQ ID NO: 806964 - protein, 766 aa, Homo sapiens; identical to SEQ ID NO: 806961

SEQ ID NO: 806965 - protein, 83 aa, Homo sapiens
FGGNGINPAEDLQHVEYLLIYGTADDNVHFQQSAQISKALVDVGVDFQAMWYTDEDHGIASSTAHQHIYTHMSHFIKQCFSLP

SEQ ID NO: 806966 - protein, 766 aa, Homo sapiens; identical to SEQ ID NO: 806961

SEQ ID NO: 806967 - protein, 766 aa, Homo sapiens; identical to SEQ ID NO: 806961

SEQ ID NO: 806968 - protein, 673 aa, Homo sapiens
AGIILICLKRKWKLRKKLASCYTVKACIQQWRHSYTASYDIYDLNKRQLITEERIPNNTQWVTWSPVGHKLAYVWNNDIYVKIEPNLPSYRITWTGKEDIIYNGITDWVYEEEVFSAYSALWWSPNGTFLAYAQFNDTEVPLIEYSFYSDESLQYPKTVRVPYPKAGAVNPTVKFFVVNTDSLSSVTNATSIQITAPASMLIGDHYLCDVTWATQERISLQWLRRIQNYSVMDICDYDESSGRWNCLVARQHIEMSTTGWVGRFRPSEPHFTLDGNSFYKIISNEEGYRHICYFQIDKKDCTFITKGTWEVIGIEALTSDYLYYISNEYKGMPGGRNLYKIQLSDYTKVTCLSCELNPERCQYYSVSFSKEAKYYQLRCSGPGLPLYTLHSSVNDKGLRVLEDNSALDKMLQNVQMPSKKLDFIILNETKFWYQMILPPHFDKSKKYPLLLDVYAGPCSQKADTVFRLNWATYLASTENIIVASFDGRGSGYQGDKIMHAINRRLGTFEVEDQIEAARQFSKMGFVDNKRIAIWGWSYGGYVTSMVLGSGSGVFKCGIAVAPVSRWEYYDSVYTERYMGLPTPEDNLDHYRNSTVMSRAENFKQVEYLLIHGTADDNVHFQQSAQISKALVDVGVDFQAMWYTDEDHGIASSTAHQHIYTHMSHFIKQCFSLP

SEQ ID NO: 806969 - protein, 717 aa, Homo sapiens
MKTPWKVLLGLLGAAALVTIITVPVVLLNKGTDDATADSRKTYTLTDYLKNTYRLKLYSLRWISDHEYLYKQENNILVFNAEYGNSSVFLENSTFDEFGHSINDYSISPDGQFILLEYNYVKQWRHSYTASYDIYDLNKRQLITEERIPNNTQWVTWSPVGHKLAYVWNNDIYVKIEPNLPSYRITWTGKEDIIYNGITDWVYEEEVFSAYSALWWSPNGTFLAYAQFNDTEVPLIEYSFYSDESLQYPKTVRVPYPKAGAVNPTVKFFVVNTDSLSSVTNATSIQITAPASMLIGDHYLCDVTWATQERISLQWLRRIQNYSVMDICDYDESSGRWNCLVARQHIEMSTTGWVGRFRPSEPHFTLDGNSFYKIISNEEGYRHICYFQIDKKDCTFITKGTWEVIGIEALTSDYLYYISNEYKGMPGGRNLYKIQLSDYTKVTCLSCELNPERCQYYSVSFSKEAKYYQLRCSGPGLPLYTLHSSVNDKGLRVLEDNSALDKMLQNVQMPSKKLDFIILNETKFWYQMILPPHFDKSKKYPLLLDVYAGPCSQKADTVFRLNWATYLASTENIIVASFDGRGSGYQGDKIMHAINRRLGTFEVEDQIEAARQFSKMGFVDNKRIAIWGWSYGGYVTSMVLGSGSGVFKCGIAVAPVSRWEYYDSVYTERYMGLPTPEDNLDHYRVRDEDLYLFYNLFISGLRTFLIVSILENTYFYF

SEQ ID NO: 806970 - protein, 380 aa, Homo sapiens
MEDGGQREEETRRNATCGAAAKSENRGKRHASAGKKGAGGTSPTAPSTKRPLPGLSAPLGAGSASSPPLRAPVPRSECPGRRRPVLAARSDALESSPISLPATPVRRPLLSYSAPTHLGTPGGARGHLQGEGLRGQGKPPVWRVRRALPPGWTQQAEAQEQGSATRAGLGARRGVGTASWGWTWATCGRKGARNRKRSDERPRPPKAPPQPSASHSHACKPLPEGPRRSPELKPRRQRRQPPRSTPPRSPRSTASPALSKLRLSLQVGATPGWGRALPGPALLPRPRLGGFGAVGADPGTCVRPGRSAPAARSHPQDPVGVLTMVVLMSPMMLGASLSTWCMRRISLRPCACSADSPISVFCSPREYKLASSSEKMNSLV

SEQ ID NO: 806971 - protein, 420 aa, Homo sapiens
MGTQALQGFLFLLFLPLLQPRGASAGSLHSPGLSECFQVNGADYRGHQNRTGPRGAGRPCLFWDQTQQHSYSSASDPHGRWGLGAHNFCRNPDGDVQPWCYVAETEEGIYWRYCDIPSCHMPGYLGCFVDSGAPPALSGPSGTSTKLTVQVCLRFCRMKGYQLAGVEAGYACFCGSESDLARGRLAPATDCDQICFGHPGQLCGGDGRLGVYEVSVGSCQGNWTAPQGVIYSPDFPDEYGPDRNCSWALGPPGAALELTFRLFELADPRDRLELRDAASGSLLRAFDGARPPPSGPLRLGTAALLLTFRSDARGHAQGFALTYRGLQDAAEDPEAPEGSAQTPAAPLDGANVSCSPRPGAPPAAIGGAVCWLREKGPRRWGLPGAPGEAGLCGTNSPEGWPCPAPPGTPRLRVLPRATGL

SEQ ID NO: 806972 - protein, 446 aa, Homo sapiens
MGTQALQGFLFLLFLPLLQPRGASAGSLHSPGLSECFQVNGADYRGHQNRTGPRGAGRPCLFWDQTQQHSYSSASDPHGRWGLGAHNFCRNPDGDVQPWCYVAETEEGIYWRYCDIPSCHMPGYLGCFVDSGAPPALSGPSGTSTKLTVQVCLRFCRMKGYQLAGVEAGYACFCGSESDLARGRLAPATDCDQICFGHPGQLCGGDGRLGVYEVSVGSCQGNWTAPQGVIYSPDFPDEYGPDRNCSWALGPPGAALELTFRLFELADPRDRLELRDAASGSLLRAFDGARPPPSGPLRLGTAALLLTFRSDARGHAQGFALTYRGLQDAAEDPEAPEGSAQTPAAPLDGANVSCSPRPGAPPAAIGARVFSTVTAVSVLLLLLLGLLRPCADGAVCWLREKGPRRWGLPGAPGEAGLCGTNSPEGWPCPAPPGTPRLRVLPRATGL

SEQ ID NO: 806973 - protein, 347 aa, Homo sapiens
MGTQALQGFLFLLFLPLLQPRGASAGSLHSPGLSECFQVNGADYRGHQNRTGPRGAGRPCLFWDQTQQHSYSSASDPHGRWGLGAHNFCRNPDGDVQPWCYVAETEEGIYWRYCDIPSCHMPGYLGCFVDSGAPPALSGPSGTSTKLTVQVCLRFCRMKGYQLAGVEAGYACFCGSESDLARGRLAPATDCDQICFGHPGQLCGGDGRLGVYEVSVGSCQGNWTAPQGVIYSPDFPDEYGPDRNCSWALGPPGAALELTFRLFELADPRDRLELRDAASGSLLRAFDGARPPPSGPLRLGTAALLLTFRSDARGHAQGFALTYRAEEGVRTRGPEVGQTRGPRGHVR

SEQ ID NO: 806974 - protein, 67 aa, Homo sapiens
RPQRHLHEAHGPGVPTLLPHEGVPGTAHGPRPVTPDLDLKTTLNSQHSVAKPRHRFLNLQPDSHPDP

SEQ ID NO: 806975 - protein, 399 aa, Homo sapiens
MGTQALQGFLFLLFLPLLQPRGASAGSLHSPGLSECFQVNGADYRGHQNRTGPRGAGRPCLFWDQTQQHSYSSASDPHGRWGLGAHNFCRNPDGDVQPWCYVAETEEGIYWRYCDIPSCHMPGYLGCFVDSGAPPALSGPSGTSTKLTVQVCLRFCRMKGYQLAGVEAGYACFCGSESDLARGRLAPATDCDQICFGHPGQLCGGDGRLGVYEVSVGSCQGNWTAPQGVIYSPDFPDEYGPDRNCSWALGPPGAALELTFRLFELADPRDRLELRDAASGSLLRAFDGARPPPSGPLRLGTAALLLTFRSDARGHAQGFALTYRGLQDAAEDPEAPEGSAQTPAAPLDGANVSCSPRPGAPPAAIGGEAGARDGSESGSRPLAPILTAAVCPQPGSSRR

SEQ ID NO: 806976 - protein, 400 aa, Homo sapiens
MGTQALQGFLFLLFLPLLQPRGASAGSLHSPGLSECFQVNGADYRGHQNRTGPRGAGRPCLFWDQTQQHSYSSASDPHGRWGLGAHNFCRNPDGDVQPWCYVAETEEGIYWRYCDIPSCHMPGYLGCFVDSGAPPALSGPSGTSTKLTVQVCLRFCRMKGYQLAGVEAGYACFCGSESDLARGRLAPATDCDQICFGHPGQLCGGDGRLGVYEVSVGSCQGNWTAPQGVIYSPDFPDEYGPDRNCSWALGPPGAALELTFRLFELADPRDRLELRDAASGSLLRAFDGARPPPSGPLRLGTAALLLTFRSDARGHAQGFALTYRGLQDAAEDPEAPEGSAQTPAAPLDGANVSCSPRPGAPPAAIGARVFSTVTAVSVLLLLLLGLLRPCADGAGRWGRA

SEQ ID NO: 806977 - protein, 289 aa, Homo sapiens
MKGYQLAGVEAGYACFCGSESDLARGRLAPATDCDQICFGHPGQLCGGDGRLGVYEVSVGSCQGNWTAPQGVIYSPDFPDEYGPDRNCSWALGPPGAALELTFRLFELADPRDRLELRDAASGSLLRAFDGARPPPSGPLRLGTAALLLTFRSDARGHAQGFALTYRGLQDAAEDPEAPEGSAQTPAAPLDGANVSCSPRPGAPPAAIGARVFSTVTAVSVLLLLLLGLLRPCADGAVCWLREKGPRRWGLPGAPGEAGLCGTNSPEGWPCPAPPGTPRLRVLPRATGL

SEQ ID NO: 806978 - protein, 228 aa, Homo sapiens
SRRVLVLRMLTAGPPAVSVGSCQGNWTAPQGVIYSPDFPDEYGPDRNCSWALGPPGAALELTFRLFELADPRDRLELRDAASGSLLRAFDGARPPPSGPLRLGTAALLLTFRSDARGHAQGFALTYRGEPQLRRALPAVPTPLSPPRLTPLSAGLQDAAEDPEAPEGSAQTPAAPLDGANVSCSPRPGAPPAAIGGEAGARDGSESGSRPLAPILTAAVCPQPGSSRR

SEQ ID NO: 806979 - protein, 79 aa, Homo sapiens
SPSANYLSLQALAWLPLQAPGCPPLQAPTVYLSKPRPGYLSKPLATSPCPAWLPLLLPIGPEGQFQPKGIHGSCCSKKT

SEQ ID NO: 806980 - protein, 200 aa, Homo sapiens
TGREKEREREKNQIDTRNNDEWSTSTYNAFTLLLRAAFQSLLDAQADEAVLDHPDLKHIDPVVLKHCHAAAATYILEAGKHRADKSTLSTYLEDCKFDRERIELFCTEYQNNKNSLEILLGSIGRSLPHITDVSWRLEYQIKTNQLHRMYRPAYLVTLSVQNTDSPSYPEISFSCSMEQLQDLVGKLKDASKSLERATQL

SEQ ID NO: 806981 - protein, 119 aa, Homo sapiens
MVNFDVQRLHASPPGGIPESAGRPGGRGRVRVSRSARLGAGSAGVEGRSEKRSRRSEKGKAPGRGSLRALPFAPDGVLGTWLCQDSEQTLSIVLAPLGTCIEPTPRSWPGFPPSLFVLL

SEQ ID NO: 806982 - protein, 119 aa, Homo sapiens; identical to SEQ ID NO: 806981

SEQ ID NO: 806983 - protein, 119 aa, Homo sapiens; identical to SEQ ID NO: 806981

SEQ ID NO: 806984 - protein, 119 aa, Homo sapiens; identical to SEQ ID NO: 806981

SEQ ID NO: 806985 - protein, 119 aa, Homo sapiens; identical to SEQ ID NO: 806981

SEQ ID NO: 806986 - protein, 184 aa, Homo sapiens
RLVEAGVESAENAFTLLLRAAFQSLLDAQADEAVLDHPDLKHIDPVVLKHCHAAAATYILEAGKHRADKSTLSTYLEDCKFDRERIELFCTEYQNNKNSLEILLGSIGRSLPHITDVSWRLEYQIKTNQLHRMYRPAYLVTLSVQNTDSPSYPEISFSCSMEQLQDLVGKLKDASKSLERATQL

SEQ ID NO: 806987 - protein, 119 aa, Homo sapiens; identical to SEQ ID NO: 806981

SEQ ID NO: 806988 - protein, 119 aa, Homo sapiens; identical to SEQ ID NO: 806981

SEQ ID NO: 806989 - protein, 119 aa, Homo sapiens; identical to SEQ ID NO: 806981

SEQ ID NO: 806990 - protein, 184 aa, Homo sapiens; identical to SEQ ID NO: 806986

SEQ ID NO: 806991 - protein, 119 aa, Homo sapiens; identical to SEQ ID NO: 806981

SEQ ID NO: 806992 - protein, 174 aa, Homo sapiens
GGRGSPSDARSSDARSADARGRGRLDHPDLKHIDPVVLKHCHAAAATYILEAGKHRADKSTLSTYLEDCKFDRERIELFCTEYQNNKNSLEILLGSIGRSLPHITDVSWRLEYQIKTNQLHRMYRPAYLVTLSVQNTDSPSYPEISFSCSMEQLQDLVGKLKDASKSLERATQL

SEQ ID NO: 806993 - protein, 119 aa, Homo sapiens; identical to SEQ ID NO: 806981

SEQ ID NO: 806994 - protein, 118 aa, Homo sapiens
TGREKEREREKNQIDTRNNDEWSTSTYNAFTLLLRAAFQSLLDAQADEAVLDHPDLKHIDPVVLKHCHAAAATYILEAGKHRADKSTLSTYLEDCKFDRERIELFCTEYQVTYFKIFN

SEQ ID NO: 806995 - protein, 119 aa, Homo sapiens; identical to SEQ ID NO: 806981

SEQ ID NO: 806996 - protein, 75 aa, Homo sapiens
MLPWLRINNDFFSLMFLHRKDQNVLSPVNCWNLLLNQVKRESRDHTTLSDIYLNNIIPRFVQVSEDSGRLFKKVQ

SEQ ID NO: 806997 - protein, 116 aa, Homo sapiens
MTSPAKFKKDKEIIAEYDTQVKEIRAQLTEQMKCLDQQCELRVQLLQDLQDFFRKKAEIEMDYSRNLEKLAERFLAKTRSTKDQQFKYGALWLLLSETLEYGVQGGGGQGMPLRSS

SEQ ID NO: 806998 - protein, 143 aa, Homo sapiens
MTSPAKFKKDKEIIAEYDTQVKEIRAQLTEQMKCLDQQCELRVQLLQDLQDFFRKKAEIEMDYSRNLEKLAERFLAKTRSTKDQQFKKDQNVLSPVNCWNLLLNQVKRESRDHTTLSDIYLNNIIPRFVQVSEDSGRLFKKVQ

SEQ ID NO: 806999 - protein, 116 aa, Homo sapiens; identical to SEQ ID NO: 806997

SEQ ID NO: 807000 - protein, 215 aa, Homo sapiens
LWRLHPTQAAPFRTREAGGYLSWGDASDCFIVGASGAEDRVPPEVTRKPRLSATRVGRTLEVPRRPRNCAFDLHSRLKPAAQDKWTSQQDPDHPNRLILRQDPDASESDHSPALVTPEADQSTHGRSFVKEVNVVRNLKPSNFPCHLNCFTINLSLCSTPSSGQTSLVHPRYKHATLPFVLAALARSMSEGGICGEFNLTNCCLKIDDNEEDVMN

SEQ ID NO: 807001 - protein, 69 aa, Homo sapiens
GSRLYSQSLGRSRREDRLSPGARDQTRQHGETHISAFKNERLAVTFLGETRPTASLWGPQERRIGSRPR

SEQ ID NO: 807002 - protein, 207 aa, Homo sapiens
MIRIEAIPPKRSWRRALGGAFRGPRASDCFIVGASGAEDRVPPEVTRKPRLSATRVGRTLEVPRRPRRLKPAAQDKWTSQQDPDHPNRLILRQDPDASESDHSPALVTPEADQSTHGRSFVKEVNVVRNLKPSNFPCHLNCFTINLSLCSTPSSGQTSLVHPRYKHATLPFVLAALARSMSEGGICGEFNLTNCCLKIDDNEEDVMN

SEQ ID NO: 807003 - protein, 207 aa, Homo sapiens
LWRLHPTQAAPFRTREAGGYLSWGDASDCFIVGASGAEDRVPPEVTRKPRLSATRVGRTLEVPRRPRRLKPAAQDKWTSQQDPDHPNRLILRQDPDASESDHSPALVTPEADQSTHGRSFVKEVNVVRNLKPSNFPCHLNCFTINLSLCSTPSSGQTSLVHPRYKHATLPFVLAALARSMSEGGICGEFNLTNCCLKIDDNEEDVMN

SEQ ID NO: 807004 - protein, 211 aa, Homo sapiens
VLANRDQLRLWASNPSQQGEAGGYLSWGDASDCFIVGASGAEDRVPPEVTRKPRLSATRVGRTLEVPRRPRRLKPAAQDKWTSQQDPDHPNRLILRQDPDASESDHSPALVTPEADQSTHGRSFVKEVNVVRNLKPSNFPCHLNCFTINLSLCSTPSSGQTSLVHPRYKHATLPFVLAALARSMSEGGICGEFNLTNCCLKIDDNEEDVMN

SEQ ID NO: 807005 - protein, 352 aa, Homo sapiens
LSPWTSQLLEEHTERAPRISQEFGERMAHCCLGGLAEFLQSFQQRVERFHENPAVREMLPDTYISKTIALVNCGPPLRALAERLARVGPPESEPAREASASALDHVTRLCHRVVANLLFQELQPHFNKLMRRKWLSSPEALDGIVGTLGAQALALRRMQDEPYQALVAELHRRALVEYVRPLLRGRLRCSSARTRSRVAGRLREDAAQLQRLFRRLESQASWLDAVVPHLAEVMQLEDTPSIQVEVGVLVRDYPDIRQKHVAALLDIRGLRNTAARQEILAVARDLELSEEGALSPPRDRAFFADIPVPRPSFCLSLPLFLGRLPLSRLARPSLACLPRPRPPSLARPRAQR

SEQ ID NO: 807006 - protein, 295 aa, Homo sapiens
MRKKPGRGRGKQRRQEWFFLRALAERLARVGPPESEPAREASASALDHVTRLCHRVVANLLFQELQPHFNKLMRRKWLSSPEALDGIVGTLGAQALALRRMQDEPYQALVAELHRRALVEYVRPLLRGRLRCSSARTRSRVAGRLREDAAQLQRLFRRLESQASWLDAVVPHLAEVMQLEDTPSIQVEVGVLVRDYPDIRQKHVAALLDIRGLRNTAARQEILAVARDLELSEEGALSPPRDRAFFADIPVPRPSFCLSLPLFLGRLPLSRLARPSLACLPRPRPPSLARPRAQR

SEQ ID NO: 807007 - protein, 138 aa, Homo sapiens
PAASTLGEAPVVPSTPGASPDPLGPPPAGALAPLPGSPGTVDSGPRPPWNERCTDWAVISHRVLTAPRQNAMRIGRRPHCGVLGANPPGHVGSSPTGLSGCSPRVRRREIVINKDTRQRDKGKTAGPRGPLPSRRGDR

SEQ ID NO: 807008 - protein, 230 aa, Homo sapiens [sequence omitted]

SEQ ID NO: 807009 - protein, 121 aa, Homo sapiens
MYSLNQEIKAFSRNNLRKQCTRVTTLTGKKIIETWKDARIHVVEEVEPSSGGGCGYVQDLSSDLQVGVIKPWLLLGSQDAAHDLDTLKKNKNVLNLLKKQKEKMEWFLFIVMQAFPGLLQL

SEQ ID NO: 807010 - protein, 217 aa, Homo sapiens
MYSLNQEIKAFSRNNLRKQCTRVTTLTGKKIIETWKDARIHVVEEVEPSSGGGCGYVQDLSSDLQVGVIKPWLLLGSQDAAHDLDTLKKNKVTHILNVAYGVENAFLSDFTYKSISILDLPETNILSYFPECFEFIEEAKRKDGVVLVHCNAGVSRAAAIVIGFLMNSEQTSFTSAFSLVKNARPSICPNSGFMEQLRTYQEGKESNKCDRIQENSS

SEQ ID NO: 807011 - protein, 159 aa, Homo sapiens
QSIPVPRGYRLARLCCAGAELQLQGFPQRPLFCTLGETTFPKSFVPGLERLWAPESPAAGTAGPTADMAVLAGSLLGPTSRSAALLGGRWLQPRAWLGFPDAWGLPTPQQARGKARGNEYQPSNIKRKNKHGWVRRLSTPAGVQVILRRMLKGRKSLSH

SEQ ID NO: 807012 - protein, 80 aa, Homo sapiens
QAMPRRPSGYFLSSGGAGSGSGRALGEGSGSQSRNSWSSVLTVSGHSSITMWLPSSMSFRNARSRICRRRRAQGENEATW

SEQ ID NO: 807013 - protein, 185 aa, Homo sapiens
QAMPRRPSGYFLSSGGAGSGSGRALGEGSGSQSRNSWSSVLTVSGHSSITMWLPSSMSFRKPGAGSAEDAGLKERMRPLGSGQALGTKPSMEGFLGWSGSGLRNRPQPVLRDPLRIWLSWLDPCWAPRVGRQRCWVAGGSSPGPGWGSQTPGASPPRSRPGARLAGMSISRATSNARTSTAGSGA

SEQ ID NO: 807014 - protein, 185 aa, Homo sapiens; identical to SEQ ID NO: 807013

SEQ ID NO: 807015 - protein, 185 aa, Homo sapiens; identical to SEQ ID NO: 807013

SEQ ID NO: 807016 - protein, 85 aa, Homo sapiens
PAPRLTFLAVLYPRRWLQPRAWLGFPDAWGLPTPQQARGKARGNEYQPSNIKRKNKHGWVRRLSTPAGVQVILRRMLKGRKSLSH

SEQ ID NO: 807017 - protein, 185 aa, Homo sapiens; identical to SEQ ID NO: 807013

SEQ ID NO: 807018 - protein, 138 aa, Homo sapiens
LSRCLGPGDGTSCLPAPYPRLGAAKGLERLWAPESPAAGTAGPTADMAVLAGSLLGPTSRSAALLGGRWLQPRAWLGFPDAWGLPTPQQARGKARGNEYQPSNIKRKNKHGWVRRLSTPAGVQVILRRMLKGRKSLSH

SEQ ID NO: 807019 - protein, 118 aa, Homo sapiens
GRDPVGRLRPMGSRKPGGARAWPMRSCAAPSSPIDAGAADLPSRPPRLPREQCCGECGARGSRWWSTPACRFSVGVSPGHIELSRGTLFPWLHGPEDARLSPLESVFRRPRGERKVLG

SEQ ID NO: 807020 - protein, 118 aa, Homo sapiens; identical to SEQ ID NO: 807019

SEQ ID NO: 807021 - protein, 118 aa, Homo sapiens; identical to SEQ ID NO: 807019

SEQ ID NO: 807022 - protein, 102 aa, Homo sapiens
KMEILQGPFRICLGILLSPPNTLLLYWTLAPIYSLLWNPRGIPKDVTTVLARCTGHRGLNLITPQTYHSGFAKNDTVNVTKLPCLLVNTNSAPLLYSEIRMR

SEQ ID NO: 807023 - protein, 190 aa, Homo sapiens
RSASACGVCLVSTAGSLDPAARAAPRTAAVGLPTVRFSAVAEHSGSALASLHLTSGIGKCTHHGFSGCSNPRTPMGAPRRPQTQRGAPSTWDPLKATRRAVSGRLADPEQRGHGVRGLSRKDPAMVLHNSPPRTTHPSLRARRAAARGTERVLGWFAALFPPPTHIPAGCVRAHLSVRRVLGACAFDAWR

SEQ ID NO: 807024 - protein, 33 aa, Homo sapiens
MVPSLRLPQTKAYTAHLMSLAPLDSRGSSRKGP

SEQ ID NO: 807025 - protein, 948 aa, Homo sapiens
EFPGYSLFMTFTSFIKFQRLLIPPPGLCQPGPNPRSLNHPISRSHRLLYLAKAKMSQLNSVFPFTSVCFSFLLPPSVPQEGTPLGSPEALAPSSEKLSTSLCWAAEAAAAAAAAAASGRLSGQRGEPGLGSRSRSREPVMEAEGSSAPARAGSGEGSDSAGGATLKAPKHLWRHEQHHQYPLRQPQFRLLHPHHHLPPPPPPSPQPQPQCPLQPPPPPPLPPPPPPPGAARGRYASSGATGRVRHRGYSDTERYLYCRAMDRTSYAVETGHRPGLKKSRMSWPSSFQGLRRFDVDNGTSAGRSPLDPMTSPGSGLILQANFVHSQRRESFLYRSDSDYDLSPKSMSRNSSIASDIHGDDLIVTPFAQVLASLRTVRNNFAALTNLQDRAPSKRSPMCNQPSINKATITEEAYQKLASETLEELDWCLDQLETLQTRHSVSEMASNKFKRMLNRELTHLSEMSRSGNQVSEFISNTFLDKQHEVEIPSPTQKEKEKKKRPMSQISGVKKLMHSSSLTNSSIPRFGVKTEQEDVLAKELEDVNKWGLHVFRIAELSGNRPLTVIMHTIFQERDLLKTFKIPVDTLITYLMTLEDHYHADVAYHNNIHAADVVQSTHVLLSTPALEAVFTDLEILAAIFASAIHDVDHPGVSNQFLINTNSELALMYNDSSVLENHHLAVGFKLLQEENCDIFQNLTKKQRQSLRKMVIDIVLATDMSKHMNLLADLKTMVETKKVTSSGVLLLDNYSDRIQVLQNMVHCADLSNPTKPLQLYRQWTDRIMEEFFRQGDRERERGMEISPMCDKHNASVEKSQVGFIDYIVHPLWETWADLVHPDAQDILDTLEDNREWYQSTIPQSPSPAPDDPEEGRQGQTEKFQFELTLEEDGESDTEKDSGSQVEEDTSCSDSKTLCTQDSESTEIPLDEQVEEEAVGEEEESQPEACVIDDRSPDT

SEQ ID NO: 807026 - protein, 673 aa, Homo sapiens
MMHVNNFPFRRHSWICFDVDNGTSAGRSPLDPMTSPGSGLILQANFVHSQRRESFLYRSDSDYDLSPKSMSRNSSIASDIHGDDLIVTPFAQVLASLRTVRNNFAALTNLQDRAPSKRSPMCNQPSINKATITEEAYQKLASETLEELDWCLDQLETLQTRHSVSEMASNKFKRMLNRELTHLSEMSRSGNQVSEFISNTFLDKQHEVEIPSPTQKEKEKKKRPMSQISGVKKLMHSSSLTNSSIPRFGVKTEQEDVLAKELEDVNKWGLHVFRIAELSGNRPLTVIMHTIFQERDLLKTFKIPVDTLITYLMTLEDHYHADVAYHNNIHAADVVQSTHVLLSTPALEAVFTDLEILAAIFASAIHDVDHPGVSNQFLINTNSELALMYNDSSVLENHHLAVGFKLLQEENCDIFQNLTKKQRQSLRKMVIDIVLATDMSKHMNLLADLKTMVETKKVTSSGVLLLDNYSDRIQVLQNMVHCADLSNPTKPLQLYRQWTDRIMEEFFRQGDRERERGMEISPMCDKHNASVEKSQVGFIDYIVHPLWETWADLVHPDAQDILDTLEDNREWYQSTIPQSPSPAPDDPEEGRQGQTEKFQFELTLEEDGESDTEKDSGSQVEEDTSCSDSKTLCTQDSESTEIPLDEQVEEEAVGEEEESQPEACVIDDRSPDT

SEQ ID NO: 807027 - protein, 787 aa, Homo sapiens
RQATECTNSSRLRPASLDISGTVSEGTTLPWILASCTKLTRKMAQQTSPDTLTVPEVDNPHCPNPWLNEDLVKSLRENLLQHEKSKTARKSVSPKLSPVISPRNSPRLLRRMLLSSNIPKQRRFTVAHTCFDVDNGTSAGRSPLDPMTSPGSGLILQANFVHSQRRESFLYRSDSDYDLSPKSMSRNSSIASDIHGDDLIVTPFAQVLASLRTVRNNFAALTNLQDRAPSKRSPMCNQPSINKATITEEAYQKLASETLEELDWCLDQLETLQTRHSVSEMASNKFKRMLNRELTHLSEMSRSGNQVSEFISNTFLDKQHEVEIPSPTQKEKEKKKRPMSQISGVKKLMHSSSLTNSSIPRFGVKTEQEDVLAKELEDVNKWGLHVFRIAELSGNRPLTVIMHTIFQERDLLKTFKIPVDTLITYLMTLEDHYHADVAYHNNIHAADVVQSTHVLLSTPALEAVFTDLEILAAIFASAIHDVDHPGVSNQFLINTNSELALMYNDSSVLENHHLAVGFKLLQEENCDIFQNLTKKQRQSLRKMVIDIVLATDMSKHMNLLADLKTMVETKKVTSSGVLLLDNYSDRIQVLQNMVHCADLSNPTKPLQLYRQWTDRIMEEFFRQGDRERERGMEISPMCDKHNASVEKSQVGFIDYIVHPLWETWADLVHPDAQDILDTLEDNREWYQSTIPQSPSPAPDDPEEGRQGQTEKFQFELTLEEDGESDTEKDSGSQVEEDTSCSDSKTLCTQDSESTEIPLDEQVEEEAVGEEEESQPEACVIDDRSPDT

SEQ ID NO: 807028 - protein, 507 aa, Homo sapiens
MASNKFKRMLNRELTHLSEMSRSGNQVSEFISNTFLDKQHEVEIPSPTQKEKEKKKRPMSQISGVKKLMHSSSLTNSSIPRFGVKTEQEDVLAKELEDVNKWGLHVFRIAELSGNRPLTVIMHTIFQERDLLKTFKIPVDTLITYLMTLEDHYHADVAYHNNIHAADVVQSTHVLLSTPALEAVFTDLEILAAIFASAIHDVDHPGVSNQFLINTNSELALMYNDSSVLENHHLAVGFKLLQEENCDIFQNLTKKQRQSLRKMVIDIVLATDMSKHMNLLADLKTMVETKKVTSSGVLLLDNYSDRIQVLQNMVHCADLSNPTKPLQLYRQWTDRIMEEFFRQGDRERERGMEISPMCDKHNASVEKSQVGFIDYIVHPLWETWADLVHPDAQDILDTLEDNREWYQSTIPQSPSPAPDDPEEGRQGQTEKFQFELTLEEDGESDTEKDSGSQVEEDTSCSDSKTLCTQDSESTEIPLDEQVEEEAVGEEEESQPEACVIDDRSPDT

SEQ ID NO: 807029 - protein, 585 aa, Homo sapiens
MKEQPSCAGTGHPSMAGYGRMAPFELASGPVKRLRTESPFPCLFAEEAYQKLASETLEELDWCLDQLETLQTRHSVSEMASNKFKRMLNRELTHLSEMSRSGNQVSEFISNTFLDKQHEVEIPSPTQKEKEKKKRPMSQISGVKKLMHSSSLTNSSIPRFGVKTEQEDVLAKELEDVNKWGLHVFRIAELSGNRPLTVIMHTIFQERDLLKTFKIPVDTLITYLMTLEDHYHADVAYHNNIHAADVVQSTHVLLSTPALEAVFTDLEILAAIFASAIHDVDHPGVSNQFLINTNSELALMYNDSSVLENHHLAVGFKLLQEENCDIFQNLTKKQRQSLRKMVIDIVLATDMSKHMNLLADLKTMVETKKVTSSGVLLLDNYSDRIQVLQNMVHCADLSNPTKPLQLYRQWTDRIMEEFFRQGDRERERGMEISPMCDKHNASVEKSQVGFIDYIVHPLWETWADLVHPDAQDILDTLEDNREWYQSTIPQSPSPAPDDPEEGRQGQTEKFQFELTLEEDGESDTEKDSGSQVEEDTSCSDSKTLCTQDSESTEIPLDEQVEEEAVGEEEESQPEACVIDDRSPDT

SEQ ID NO: 807030 - protein, 802 aa, Homo sapiens
RQATECTNSSRLRPASLDISGTVSEGTTLPWILASCTKLTRKMAQQTSPDTLTVPEVDNPHCPNPWLNEDLVKSLRENLLQHEKSKTARKSVSPKLSPVISPRNSPRLLRRMLLSSNIPKQRRFTVAHTCFDVDNGTSAGRSPLDPMTSPGSGLILQANFVHSQRRESFLYRSDSDYDLSPKSMSRNSSIASDIHGDDLIVTPFAQVLASLRTVRNNFAALTNLQDRAPSKRSPMCNQPSINKATITGLYNGIICISLITNEKEAYQKLASETLEELDWCLDQLETLQTRHSVSEMASNKFKRMLNRELTHLSEMSRSGNQVSEFISNTFLDKQHEVEIPSPTQKEKEKKKRPMSQISGVKKLMHSSSLTNSSIPRFGVKTEQEDVLAKELEDVNKWGLHVFRIAELSGNRPLTVIMHTIFQERDLLKTFKIPVDTLITYLMTLEDHYHADVAYHNNIHAADVVQSTHVLLSTPALEAVFTDLEILAAIFASAIHDVDHPGVSNQFLINTNSELALMYNDSSVLENHHLAVGFKLLQEENCDIFQNLTKKQRQSLRKMVIDIVLATDMSKHMNLLADLKTMVETKKVTSSGVLLLDNYSDRIQVLQNMVHCADLSNPTKPLQLYRQWTDRIMEEFFRQGDRERERGMEISPMCDKHNASVEKSQVGFIDYIVHPLWETWADLVHPDAQDILDTLEDNREWYQSTIPQSPSPAPDDPEEGRQGQTEKFQFELTLEEDGESDTEKDSGSQVEEDTSCSDSKTLCTQDSESTEIPLDEQVEEEAVGEEEESQPEACVIDDRSPDT

SEQ ID NO: 807031 - protein, 507 aa, Homo sapiens; identical to SEQ ID NO: 807028

SEQ ID NO: 807032 - protein, 261 aa, Homo sapiens
RQATECTNSSRLRPASLDISGTVSEGTTLPWILASCTKLTRKMAQQTSPDTLTVPEVDNPHCPNPWLNEDLVKSLRENLLQHEKSKTARKSVSPKLSPVISPRNSPRLLRRMLLSSNIPKQRRFTVAHTCFDVDNGTSAGRSPLDPMTSPGSGLILQANFVHSQRRESFLYRSDSDYDLSPKSMSRNSSIASDIHGDDLIVTPFAQVLASLRTVRNNFAALTNLQDRAPSKRSPMCNQPSINKATITGSWMELNPYTLLDM

SEQ ID NO: 807033 - protein, 730 aa, Homo sapiens
TAQRKCPHSATSASCSVRGLRAPEPRTSSDFSWFLGILASSLKMAFVWDPLGATVPGPSTRAKSRLRFSKSYSFDVDNGTSAGRSPLDPMTSPGSGLILQANFVHSQRRESFLYRSDSDYDLSPKSMSRNSSIASDIHGDDLIVTPFAQVLASLRTVRNNFAALTNLQDRAPSKRSPMCNQPSINKATITEEAYQKLASETLEELDWCLDQLETLQTRHSVSEMASNKFKRMLNRELTHLSEMSRSGNQVSEFISNTFLDKQHEVEIPSPTQKEKEKKKRPMSQISGVKKLMHSSSLTNSSIPRFGVKTEQEDVLAKELEDVNKWGLHVFRIAELSGNRPLTVIMHTIFQERDLLKTFKIPVDTLITYLMTLEDHYHADVAYHNNIHAADVVQSTHVLLSTPALEAVFTDLEILAAIFASAIHDVDHPGVSNQFLINTNSELALMYNDSSVLENHHLAVGFKLLQEENCDIFQNLTKKQRQSLRKMVIDIVLATDMSKHMNLLADLKTMVETKKVTSSGVLLLDNYSDRIQVLQNMVHCADLSNPTKPLQLYRQWTDRIMEEFFRQGDRERERGMEISPMCDKHNASVEKSQVGFIDYIVHPLWETWADLVHPDAQDILDTLEDNREWYQSTIPQSPSPAPDDPEEGRQGQTEKFQFELTLEEDGESDTEKDSGSQVEEDTSCSDSKTLCTQDSESTEIPLDEQVEEEAVGEEEESQPEACVIDDRSPDT

SEQ ID NO: 807034 - protein, 499 aa, Homo sapiens
MLNRELTHLSEMSRSGNQVSEFISNTFLDKQHEVEIPSPTQKEKEKKKRPMSQISGVKKLMHSSSLTNSSIPRFGVKTEQEDVLAKELEDVNKWGLHVFRIAELSGNRPLTVIMHTIFQERDLLKTFKIPVDTLITYLMTLEDHYHADVAYHNNIHAADVVQSTHVLLSTPALEAVFTDLEILAAIFASAIHDVDHPGVSNQFLINTNSELALMYNDSSVLENHHLAVGFKLLQEENCDIFQNLTKKQRQSLRKMVIDIVLATDMSKHMNLLADLKTMVETKKVTSSGVLLLDNYSDRIQVLQNMVHCADLSNPTKPLQLYRQWTDRIMEEFFRQGDRERERGMEISPMCDKHNASVEKSQVGFIDYIVHPLWETWADLVHPDAQDILDTLEDNREWYQSTIPQSPSPAPDDPEEGRQGQTEKFQFELTLEEDGESDTEKDSGSQVEEDTSCSDSKTLCTQDSESTEIPLDEQVEEEAVGEEEESQPEACVIDDRSPDT

SEQ ID NO: 807035 - protein, 66 aa, Homo sapiens
AGTVPNYGIQLGGASPCYLLNMASLLDVTSPSPFPLRTLLTDLLSRAGPAHYRAHVSCCASFPQAA

SEQ ID NO: 807036 - protein, 101 aa, Homo sapiens
KLVRSRIMESSWAGLRRVTFSTWRACWTSRRLRLFRCGLCSPTSSVEPALLTTAPTCPVVLHSHRPHKKWVPRLPSHCHSTGPEEASVVFRWAGTLPREVK

SEQ ID NO: 807037 - protein, 66 aa, Homo sapiens; identical to SEQ ID NO: 807035

SEQ ID NO: 807038 - protein, 101 aa, Homo sapiens; identical to SEQ ID NO: 807036

SEQ ID NO: 807039 - protein, 70 aa, Homo sapiens
LGRLRYYRIIFAMALVQNASFLPVPECAPQNMSLWHKDYFELETLEKQQIEEVHVILPFSPQKQEIKTFL

SEQ ID NO: 807040 - protein, 131 aa, Homo sapiens
KLVRSRIMESSWAGLRRVTFSTWRACWTSRRLRLFRCGLCSPTSSVEPALLTTAPTCPVVLHSHRPHKQFYIWTLSYKCSCVCMKEGKIENNPSVRPRGLWLNEVWNPCSEHQPSIMDRGSPSLRIRNNPR

SEQ ID NO: 807041 - protein, 1099 aa, Homo sapiens [sequence omitted]

SEQ ID NO: 807042 - protein, 1387 aa, Homo sapiens
SDFCSKGLRTLYPFGFRFPVFVSYFTNSGTRQLRLEVLERLLPRTPPPPPPLMESEMLQSPLLGLGEEDEADLTDWNLPLAFMKKRHCEKIEGSKSLAQSWRMKDRMKTVSVALVLCLNVGVDPPDVVKTTPCARLECWIDPLSMGPQKALETIGANLQKQYENWQPRARYKQSLDPTVDEVKKLCTSLRRNAKEERVLFHYNGHGVPRPTVNGEVWVFNKNYTQYIPLSIYDLQTWMGSPSIFVYDCSNAGLIVKSFKQFALQREQELEVAAINPNHPLAQMPLPPSMKNCIQLAACEATELLPMIPDLPADLFTSCLTTPIKIALRWFCMQKCVSLVPGVTLDLIEKIPGRLNDRRTPLGELNWIFTAITDTIAWNVLPRDLFQKLFRQDLLVASLFRNFLLAERIMRSYNCTPVSSPRLPPTYMHAMWQAWDLAVDICLSQLPTIIEEGTAFRHSPFFAEQLTAFQVWLTMGVENRNPPEQLPIVLQVLLSQVHRLRALDLLGRFLDLGPWAVSLALSVGIFPYVLKLLQSSARELRPLLVFIWAKILAVDSSCQADLVKDNGHKYFLSVLADPYMPAEHRTMTAFILAVIVNSYHTGQEACLQGNLIAICLEQLNDPHPLLRQWVAICLGRIWQNFDSARWCGVRDSAHEKLYSLLSDPIPEVRCAAVFALGTFVGNSAERTDHSTTIDHNVAMMLAQLVSDGSPMVRKELVVALSHLVVQYESNFCTVALQFIEEEKNYALPSPATTEGGSLTPVRDSPCTPRLRSVSSYGNIRAVATARSLNKSLQNLSLTEESGGAVAFSPGNLSTSSSASSTLGSPENEEHILSFETIDKMRRASSYSSLNSLIGVSFNSVYTQIWRVLLHLAADPYPEVSDVAMKVLNSIAYKATVNARPQRVLDTSSLTQSAPASPTNKGVHIHQAGGSPPASSTSSSSLTNDVAKQPVSRDLPSGRPGTTGPAGAQYTPHSHQFPRTRKMFDKGPEQTADDADDAAGHKSFISATVQTGFCDWSARYFAQPVMKIPEEHDLESQIRKEREWRFLRNSRVRRQAQQVIQKGITRLDDQIFLNRNPGVPSVVKFHPFTPCIAVADKDSICFWDWEKGEKLDYFHNGNPRYTRVTAMEYLNGQDCSLLLTATDDGAIRVWKNFADLEKNPEMVTAWQGLSDMLPTTRGAGMVVDWEQETGLLMSSGDVRIVRIWDTDREMKVQDIPTGADSCVTSLSCDSHRSLIVAGLGDGSIRVYDRRMALSECRVMTYREHTAWVVKASLQKRPDGHIVSVSVNGDVRIFDPRMPESVNVLQIVKGLTALDIHPQADLIACGSVNQFTAIYNSSGELINNIKYYDGFMGQRVGAISCLAFHPHWPHLAVGSNDYYISVYSVEKRVR

SEQ ID NO: 807043 - protein, 263 aa, Homo sapiens [sequence omitted]

SEQ ID NO: 807044 - protein, 1387 aa, Homo sapiens; identical to SEQ ID NO: 807042

SEQ ID NO: 807045 - protein, 167 aa, Homo sapiens
WHEVARVAGVKEAAQGSGLSLAAGSITEQEAHSPPSPHLQVSGLQFWPLSHRAVSRGRCGGAQGRQVLGEVAPALIHGAPFPPKGCSSPQARGQQPDLWSPCLCPHTGVAHACADGTTAGTWGHTHAGGVVSLLCPHTFLTYRQEALPGPGRLRVTPAPSPALSRPC

SEQ ID NO: 807046 - protein, 196 aa, Homo sapiens
TRGLCASCSVMLPAAKDSPDPWAASFTPASWRGVSFFPLTQSCQQGPLWRCTGEAGPWRGSPCLNPRGSFPSEGLLFPTGAGTAARPVVSMPVPSHRCSTRMCRWHHGRHLGAHTCRRRGLPALSPHVPHIQARGTAGSRTAPGDTSPVSSLEPPMLMRPRLTAGPVVQTGAVWTVPPRRGRRACMSSFANRTQPQ

SEQ ID NO: 807047 - protein, 329 aa, Homo sapiens
SDFCSKGLRTLYPFGFRFPVFVSYFTNSGTRYLRLEVLERLLPRTPPPPPPLMESEMLQSPLLGLGEEDEADLTDWNLPLAFMKKRHCEKIEGSKSLAQSWRMKDRMKTVSVALVLCLNVGVDPPDVVKTTPCARLECWIDPLSMGPQKALETIGANLQKQYENWQPRARYKQSLDPTVDEVKKLCTSLRRNAKEERVLFHYNGHGVPRPTVNGEVWVFNKNYTQYIPLSIYDLQTWMGSPSIFVYDCSNAGLIVKSFKQFALQREQELEVAAINPNHPLAQMPLPPSMKNCIQLAACEATELLPMIPDLPADLFTSCLTTPIKIALRW

SEQ ID NO: 807048 - protein, 431 aa, Homo sapiens
SDFCSKGLRTLYPFGFRFPVFVSYFTNSGTRQLRLEVLERLLPRTPPPPPPLMESEMLQSPLLGLGEEDEADLTDWNLPLAFMKKRHCEKIEGSKSLAQSWRMKDRMKTVSVALVLCLNVGVDPPDVVKTTPCARLECWIDPLSMGPQKALETIGANLQKQYENWQPRARYKQSLDPTVDEVKKLCTSLRRNAKEERVLFHYNGHGVPRPTVNGEVWVFNKNYTQYIPLSIYDLQTWMGSPSIFVYDCSNAGLIVKSFKQFALQREQELEVAAINPNHPLAQMPLPPSMKNCIQLAACEATELLPMIPDLPADLFTSCLTTPIKIALRWFCMQKCVSLVPGVTLDLIEKIPGRLNDRRTPLGELNWIFTAITDTIAWNVLPRDLFQKLFRQDLLVASLFRNFLLAERIMRSYNCTPVSSPRLPPTYMHAMW

SEQ ID NO: 807049 - protein, 292 aa, Homo sapiens
SDFCSKGLRTLYPFGFRFPVFVSYFTNSGTRQLRLEVLERLLPRTPPPPPPLMESEMLQSPLLGLGEEDEADLTDWNLPLAFMKKRHCEKIEGSKSLAQSWRMKDRMKTVSVALVLCLNVGVDPPDVVKTTPCARLECWIDPLSMGPQKALETIGANLQKQYENWQPRARYKQSLDPTVDEVKKLCTSLRRNAKEERVLFHYNGHGVPRPTVNGEVWVFNKNYTQYIPLSIYDLQTWMGSPSIFVYDCSNAGLIVKSFKQFALQREQELESCNQPKITLLLKTQTSVTVGRA

SEQ ID NO: 807050 - protein, 403 aa, Homo sapiens
MASQPPPPPKPWETRRIPGAGPGPGPGPTFQSADLGPTLMTRPGQPALTRVPPPILPRPSQQTGSSSVNTFRPAYSSFSSGYGAYGNSFYGGYSPYSYGYNGLGYNRLRVDDLPPSRFVQQAEESSRGAFQSIESIVHAFASVSMMMDATFSAVYNSFRAVLDVANHFSRLKIHFTKVFSAFALVRTIRYLYRRLQRMLGLRRGSENEDLWAESEGTVACLGAEDRAATSAKSWPIFLFFAVILGGPYLIWKLLSTHSDEVTDSINWASGEDDHVVARAEYDFAAVSEEEISFRAGDMLNLALKEQQPKVRGWLLASLDGQTTGLIPANYVKILGKRKGRKTVESSKVSKQQQSFTNPTLTKGATVADSLDEQEAAFESVFVETNKVPVAPDSIGKDGEKQDL

SEQ ID NO: 807051 - protein, 73 aa, Homo sapiens
RARRRLGIPGCDMLNALKNNNPKCVVGFWLALMAKQQDLYLRIMSKFLAKEKVGKRWNQVKFPSSNNLLPTQH

SEQ ID NO: 807052 - protein, 118 aa, Homo sapiens
LIWLIDSINWASGEDDHVVARAEYDFAAVSEEEISFRAGDMLNLALKEQQPKVRGWLLASLDGQTTGLIPANYVKILGKRKGRKTVESSKVSKQQQSYKSLFTKPLYYVSYKVAHRFA

SEQ ID NO: 807053 - protein, 403 aa, Homo sapiens; identical to SEQ ID NO: 807050

SEQ ID NO: 807054 - protein, 734 aa, Homo sapiens
MRPAVLGSPDRAPPEDEGPVMVKLEDSEEEGEAALWDPGPEAARLRFRCFHYEEATGPQEALAQLRELCRQWLRPEVRSKEQMLELLVLEQFLGALPPEIQARVQGQRPGSPEEAAALVDGLRREPGGPRRWVTVQVQGQEVLSEKMEPSSFQPLPETEPPTPEPGPKTPPRTMQESPLGLQVKEESEVTEDSDFLESGPLAATQESVPTLLPEEAQRCGTVLDQIFPHSKTGPEGPSWREHPRALWHEEAGGIFSPGFALQLGSISAGPGSVSPHLHVPWDLGMAGLSGQIQSPSREGGFAHALLLPSDLRSEQDPTDEDPCRGVGPALITTRWRSPRGRSRGRPSTGGGVVRGGRCDVCGKVFSQRSNLLRHQKIHTGERPFVCSECGRSFSRSSHLLRHQLTHTEERPFVCGDCGQGFVRSARLEEHRRVHTGEQPFRCAECGQSFRQRSNLLQHQRIHGDPPGPGAKPPAPPGAPEPPGPFPCSECRESFARRAVLLEHQAVHTGDKSFGCVECGERFGRRSVLLQHRRVHSGERPFACAECGQSFRQRSNLTQHRRIHTGERPFACAECGKAFRQRPTLTQHLRVHTGEKPFACPECGQRFSQRLKLTRHQRTHTGEKPYHCGECGLGFTQVSRLTEHQRIHTGERPFACPECGQSFRQHANLTQHRRIHTGERPYACPECGKAFRQRPTLTQHLRTHRREKPFACQDCGRRFHQSTKLIQHQRVHSAE

SEQ ID NO: 807055 - protein, 734 aa, Homo sapiens; identical to SEQ ID NO: 807054

SEQ ID NO: 807056 - protein, 121 aa, Homo sapiens
ASSYFFTRGRHWPQIPDLVPSMRPAVLGSPDRAPPEDEGPVMVKLEDSEEEGEAALWDPGPEAARLRFRCFHYEEATGPQEALAQLRELCRQWLRPEVRSKEQMLELLCTPVWAMGVRPSL

SEQ ID NO: 807057 - protein, 485 aa, Homo sapiens
MNGPLVYAGFALQLGSISAGPGSVSPHLHVPWDLGMAGLSGQIQSPSREGGFAHALLLPSDLRSEQDPTDEDPCRGVGPALITTRWRSPRGRSRGRPSTGGGVVRGGRCDVCGKVFSQRSNLLRHQKIHTGERPFVCSECGRSFSRSSHLLRHQLTHTEERPFVCGDCGQGFVRSARLEEHRRVHTGEQPFRCAECGQSFRQRSNLLQHQRIHGDPPGPGAKPPAPPGAPEPPGPFPCSECRESFARRAVLLEHQAVHTGDKSFGCVECGERFGRRSVLLQHRRVHSGERPFACAECGQSFRQRSNLTQHRRIHTGERPFACAECGKAFRQRPTLTQHLRVHTGEKPFACPECGQRFSQRLKLTRHQRTHTGEKPYHCGECGLGFTQVSRLTEHQRIHTGERPFACPECGQSFRQHANLTQHRRIHTGERPYACPECGKAFRQRPTLTQHLRTHRREKPFACQDCGRRFHQSTKLIQHQRVHSAE

SEQ ID NO: 807058 - protein, 471 aa, Homo sapiens
MNGPLVYAGFALQLGSISAGPGSVSPHLHVPWDLGMAGLSGQIQSPSREGGFAHALLLPSDLRSEQDPTDEDPCRGVGPALITTRWRSPRGRSRGRPSTGGGVVRGGRCDVCGKVFSQRSNLLRHQKIHTGERPFVCSECGRSFSRSSHLLRHQLTHTEERPFVCGDCGQGFVRSARLEEHRRVHTGEQPFRCAECGQSFRQRSNLLQHQRIHGDPPGPGAKPPAPPGAPEPPGPFPCSECRESFARRAVLLEHQAVHTGDKSFGCVECGERFGRRSVLLQHRRVHSGERPFACAECGQSFRQRSNLTQHRRIHTGERPFACAECGKAFRQRPTLTQHLRVHTGEKPFACPECGQRFSQRLKLTRHQRTHTGEKPYHCGECGLGFTQVSRLTEHQRIHTGERPFACPECGQSFRQHANLTQHRRIHTGERPYACPECGKAFRQRPTLTQHLRTHRHQSTKLIQHQRVHSAE

SEQ ID NO: 807059 - protein, 328 aa, Homo sapiens
MNGPLVYAGFALQLGSISAGPGSVSPHLHVPWDLGMAGLSGQIQSPSREGGFAHALLLPSDLRSEQDPTDEDPCRGVGPALITTRWRSPRGRSRGRPSTGGGVVRGGRCDVCGKVFSQRSNLLRHQKIHTGERPFVCSECGRSFSRSSHLLRHQLTHTEERPFVCGDCGQGFVRSARLEEHRRVHTGEKPFACPECGQRFSQRLKLTRHQRTHTGEKPYHCGECGLGFTQVSRLTEHQRIHTGERPFACPECGQSFRQHANLTQHRRIHTGERPYACPECGKAFRQRPTLTQHLRTHRREKPFACQDCGRRFHQSTKLIQHQRVHSAE

SEQ ID NO: 807060 - protein, 485 aa, Homo sapiens; identical to SEQ ID NO: 807057

SEQ ID NO: 807061 - protein, 485 aa, Homo sapiens; identical to SEQ ID NO: 807057

SEQ ID NO: 807062 - protein, 718 aa, Homo sapiens
MRPAVLGSPDRAPPEDEGPVMVKLEDSEEEGEAALWDPGPEAARLRFRCFHYEEATGPQEALAQLRELCRQWLRPEVRSKEQMLELLVLEQFLGALPPEIQARVQGQRPGSPEEAAALVDGLRREPGGPRRWVTVQVQGQEVLSEKMEPSSFQPLPETEPPTPEPGPKTPPRTMQESPLGLQVKEESEVTEDSDFLESGPLAATQESVPTLLPEEAQRCGTVLDQIFPHSKTGPEGPSWREHPRALWHEEAGGIFSPGFALQLGSISAGPGSVSPHLHVPWDLGMAGLSGQIQSPSREGGFAHALLLPSDLRSEQDPTDEDPCRGVGPALITTRWRSPRGRCDVCGKVFSQRSNLLRHQKIHTGERPFVCSECGRSFSRSSHLLRHQLTHTEERPFVCGDCGQGFVRSARLEEHRRVHTGEQPFRCAECGQSFRQRSNLLQHQRIHGDPPGPGAKPPAPPGAPEPPGPFPCSECRESFARRAVLLEHQAVHTGDKSFGCVECGERFGRRSVLLQHRRVHSGERPFACAECGQSFRQRSNLTQHRRIHTGERPFACAECGKAFRQRPTLTQHLRVHTGEKPFACPECGQRFSQRLKLTRHQRTHTGEKPYHCGECGLGFTQVSRLTEHQRIHTGERPFACPECGQSFRQHANLTQHRRIHTGERPYACPECGKAFRQRPTLTQHLRTHRREKPFACQDCGRRFHQSTKLIQHQRVHSAE

SEQ ID NO: 807063 - protein, 775 aa, Homo sapiens
MILRCHPLHKRRFLPKAAAAEGTARGGRGRHWPQIPDLVPSMRPAVLGSPDRAPPEDEGPVMVKLEDSEEEGEAALWDPGPEAARLRFRCFHYEEATGPQEALAQLRELCRQWLRPEVRSKEQMLELLVLEQFLGALPPEIQARVQGQRPGSPEEAAALVDGLRREPGGPRRWVTVQVQGQEVLSEKMEPSSFQPLPETEPPTPEPGPKTPPRTMQESPLGLQVKEESEVTEDSDFLESGPLAATQESVPTLLPEEAQRCGTVLDQIFPHSKTGPEGPSWREHPRALWHEEAGGIFSPGFALQLGSISAGPGSVSPHLHVPWDLGMAGLSGQIQSPSREGGFAHALLLPSDLRSEQDPTDEDPCRGVGPALITTRWRSPRGRSRGRPSTGGGVVRGGRCDVCGKVFSQRSNLLRHQKIHTGERPFVCSECGRSFSRSSHLLRHQLTHTEERPFVCGDCGQGFVRSARLEEHRRVHTGEQPFRCAECGQSFRQRSNLLQHQRIHGDPPGPGAKPPAPPGAPEPPGPFPCSECRESFARRAVLLEHQAVHTGDKSFGCVECGERFGRRSVLLQHRRVHSGERPFACAECGQSFRQRSNLTQHRRIHTGERPFACAECGKAFRQRPTLTQHLRVHTGEKPFACPECGQRFSQRLKLTRHQRTHTGEKPYHCGECGLGFTQVSRLTEHQRIHTGERPFACPECGQSFRQHANLTQHRRIHTGERPYACPECGKAFRQRPTLTQHLRTHRREKPFACQDCGRRFHQSTKLIQHQRVHSAE

SEQ ID NO: 807064 - protein, 259 aa, Homo sapiens
MRPAVLGSPDRAPPEDEGPVMVKLEDSEEEGEAALWDPGPEAARLRFRCFHYEEATGPQEALAQLRELCRQWLRPEVRSKEQMLELLVLEQFLGALPPEIQARVQGQRPGSPEEAAALVDGLRREPGGPRRWVTVQVQGQEVLSEKMEPSSFQPLPETEPPTPEPGPKTPPRTMQESPLGLQVKEESEVTEDSDFLESGPLAATQESVPTLLPEEAQRCGTVLDQIFPHSKTGPEGPSWREHPRALWHEEAGGIFSPGK

SEQ ID NO: 807065 - protein, 211 aa, Homo sapiens
PQIPDLVPSMRPAVLGSPDRAPPEDEGPVMVKLEDSEEEGEAALWDPGPEAARLRFRCFHYEEATGPQEALAQLRELCRQWLRPEVRSKEQMLELLVLEQFLGALPPEIQARVQGQRPGSPEEAAALVDGLRREPGGPRRWVSECPRVGFRTGASSSSASPWAAPRFARHTFSLVVQKWPPATETLCKAAQGRGIPGPDSPAHSCITCSHV

SEQ ID NO: 807066 - protein, 111 aa, Homo sapiens
TCGTQRGSCSWAGLGLGSMSLRVGARAKRNPWVSGDPGGPDQCSLVVGADAWAHQRAGRAEVQVRAVDPGGGWDDRRVVLAVKRVLEAQERVGEAGGPGPGVCRPSSCPAA

SEQ ID NO: 807067 - protein, 189 aa, Homo sapiens
MRDCLSLKPRPLFPTQFFFILLLIFIAEVAAAVVALVYTTMAEHFLTLLVVPAIKKDYGSQEDFTQVWNTTMKGLKCCGFTNYTDFEDSPYFKENSAFPPFCCNDNVTNTANETCTKQKAHDQKVEVAQSELYDIRIMHPGWGAVEWGPAGPDGPFLSDSKVLCLNGQEWKAARVGGESGKTSRKDQRR

SEQ ID NO: 807068 - protein, 241 aa, Homo sapiens
MQCFSFIKTMMILFNLLIFLCGAALLAVGIWVSIDGASFLKIFGPLSSSAMQFVNVGYFLIAAGVVVFALGFLGCYGAKTESKCALVTFFFILLLIFIAEVAAAVVALVYTTMAEHFLTLLVVPAIKKDYGSQEDFTQVWNTTMKGLKCCGFTNYTDFEDSPYFKENSAFPPFCCNDNVTNTANETCTKQKAHDQKVEGCFNQLLYDIRTNAVTVGGVAAGIGGLELAAMIVSMYLYCNLQ

SEQ ID NO: 807069 - protein, 241 aa, Homo sapiens; identical to SEQ ID NO: 807068

SEQ ID NO: 807070 - protein, 241 aa, Homo sapiens; identical to SEQ ID NO: 807068

SEQ ID NO: 807071 - protein, 241 aa, Homo sapiens; identical to SEQ ID NO: 807068

SEQ ID NO: 807072 - protein, 241 aa, Homo sapiens; identical to SEQ ID NO: 807068

SEQ ID NO: 807073 - protein, 241 aa, Homo sapiens; identical to SEQ ID NO: 807068

SEQ ID NO: 807074 - protein, 191 aa, Homo sapiens [sequence omitted]

SEQ ID NO: 807075 - protein, 226 aa, Homo sapiens
MVIFLCGAALLAVGIWVSIDGASFLKIFGPLSSSAMQFVNVGYFLIAAGVVVFALGFLGCYGAKTESKCALVTFFFILLLIFIAEVAAAVVALVYTTMAEHFLTLLVVPAIKKDYGSQEDFTQVWNTTMKGLKCCGFTNYTDFEDSPYFKENSAFPPFCCNDNVTNTANETCTKQKAHDQKVEGCFNQLLYDIRTNAVTVGGVAAGIGGLELAAMIVSMYLYCNLQ

SEQ ID NO: 807076 - protein, 226 aa, Homo sapiens [sequence omitted]

SEQ ID NO: 807077 - protein, 291 aa, Homo sapiens
MGPQLCGAALLAVGIWVSIDGASFLKIFGPLSSSAMQFVNVGYFLIAAGVVVFALGFLGCYGAKTESKCALVTVCETQLHRLMTKSPLALDTRPWDSQTLLWTPLGSGFCLTFPGGGLGQGGHEGLSLPKTRPLFPTQFFFILLLIFIAEVAAAVVALVYTTMAEHFLTLLVVPAIKKDYGSQEDFTQVWNTTMKGLKCCGFTNYTDFEDSPYFKENSAFPPFCCNDNVTNTANETCTKQKAHDQKVEGCFNQLLYDIRTNAVTVGGVAAGIGGLELAAMIVSMYLYCNLQ

SEQ ID NO: 807078 - protein, 169 aa, Homo sapiens [sequence omitted]

SEQ ID NO: 807079 - protein, 164 aa, Homo sapiens
MQCFSFIKTMMILFNLLIFLCGAALLAVGIWVSIDGASFLKIFGPLSSSAMQFVNVGYFLIAAGVVVFALGFLGCYGAKTESKCALVTVCETQLHRLMTKSPLALDTRPWDSQTLLWTPLGSGFCLTFPGGGLGQGGHEGLSLPKTQTPVPHSVLLHPPPHLHC

SEQ ID NO: 807080 - protein, 183 aa, Homo sapiens
MQCFSFIKTMMILFNLLIFLCGAALLAVGIWVSIDGASFLKIFGPLSSSAMQFVNVGYFLIAAGVVVFALGFLGCYGAKTESKCALVTFFFILLLIFIAEVAAAVVALVYTTMAEHFLTLLVVPAIKKDYGSQEDFTQVWNTTMKGVRLAGGGFRVERKKQGPTSTLILSPAQVLWLHQLYGF

SEQ ID NO: 807081 - protein, 148 aa, Homo sapiens
MQCFSFIKTMMILFNLLIFLCGAALLAVGIWVSIDGASFLKIFGPLSSSAMQFVNVGYFLIAAGVVVFALGFLGCYGAKTESKCALVTFFFILLLIFIAEVAAAVVALVYTTMAEHFLTLLVVPAIKKDYGSQEDFTQVWNTTMKGGF

SEQ ID NO: 807082 - protein, 156 aa, Homo sapiens
MQCFSFIKTMMILFNLLIFLCGAALLAVGIWVSIDGASFLKIFGPLSSSAMQFVNVGYFLIAAGVVVFALGFLGCYGAKTESKCALVTFFFILLLIFIAEVAAAVVALVYTTMVRHWDGGREEDWAKPWEWAVACEWAPSVPAPKHWPASPRLSTS

SEQ ID NO: 807083 - protein, 243 aa, Homo sapiens
MQCFSFIKTMMILFNLLIFLCGAALLAVGIWVSIDGASFLKIFGPLSSSAMQFVNVGYFLIAAGVVVFALGFLGCYGAKTESKCALVTFFFILLLIFIAEVAAAVVALVYTTMAEHFLTLLVVPAIKKDYGSQEDFTQVWNTTMKGLKCCGFTNYTDFEDSPYFKENSAFPPFCCNDNVTNTANETCTKQKAHDQKVEGCFNQLLYDIRTNAVTVGGVAAGIGGLELAAMIVSMYLLPIPPVY

SEQ ID NO: 807084 - protein, 241 aa, Homo sapiens; identical to SEQ ID NO: 807068

SEQ ID NO: 807085 - protein, 149 aa, Homo sapiens
MGPQLCGAALLAVGIWVSIDGASFLKIFGPLSSSAMQFVNVGYFLIAAGVVVFALGFLGCYGAKTESKCALVTVCETQLHRLMTKSPLALDTRPWDSQTLLWTPLGSGFCLTFPGGGLGQGGHEGLSLPKTQTPVPHSVLLHPPPHLHC

SEQ ID NO: 807086 - protein, 110 aa, Homo sapiens
GRLLLLNSRSSRLRGLKCCGFTNYTDFEDSPYFKENSAFPPFCCNDNVTNTANETCTKQKAHDQKVEGCFNQLLYDIRTNAVTVGGVAAGIGGLELAAMIVSMYLYCNLQ

SEQ ID NO: 807087 - protein, 258 aa, Homo sapiens
MQCFSFIKTMMILFNLLIFLCGAALLAVGIWVSIDGASFLKIFGPLSSSAMQFVNVGYFLIAAGVVVFALGFLGCYGAKTESKCALVTFFFILLLIFIAEVAAAVVALVYTTMAEHFLTLLVVPAIKKDYGSQEDFTQVWNTTMKGLKCCGFTNYTDFEDSPYFKENSAFPPFCCNDNVTNTANETCTKQKAHDQKVEGCFNQLLYDIRTNAVTVGGVAAGIGGLEFFSNSARRPPLPESLYSTPIRRDHVFLQPSPP

SEQ ID NO: 807088 - protein, 210 aa, Homo sapiens
MQCFSFIKTMMILFNLLIFLCGAALLAVGIWVSIDGASFLKIFGPLSSSAMQFVNVGYFLIAAGVVVFALGFLGCYGAKTESKCALVTFFFILLLIFIAEVAAAVVALVYTTMAEHFLTLLVVPAIKKDYGSQEDFTQVWNTTMKGLKCCGFTNYTDFEDSPYFKENSAFPPFCCNDNVTNTAMYSQEVLTSHDLVSTRVCFKSADVCQA

SEQ ID NO: 807089 - protein, 311 aa, Homo sapiens
MGPQLCGAALLAVGIWVSIDGASFLKIFGPLSSSAMQFVNVGYFLIAAGVVVFALGFLGCYGAKTESKCALVTVCETQLHRLMTKSPLALDTRPWDSQTLLWTPLGSGFCLTFPGGGLGQGGHEGLSLPKTRPLFPTQFFFILLLIFIAEVAAAVVALVYTTMAEHFLTLLVVPAIKKDYGSQEDFTQVWNTTMKGLKCCGFTNYTDFEDSPYFKENSAFPPFCCNDNVTNTANETCTKQKAHDQKVEVAQSELYDIRIMHPGWGAVEWGPAGPDGPFLSDSKVLCLNGQEWKAARVGGESGKTSRKDQRR

SEQ ID NO: 807090 - protein, 140 aa, Homo sapiens
ASPLRAALGLRSLVCALVRPPVLSTRAWPPDDAGAARAGRGSLRSLLPSAGPLRRSPQFPARTRSGPPNLRPKSGGGSGGKKMKNEIAAVVFFFTRLVRKHDKLKKEAVERFAEKLTLILQEKYKNHWYPEKPSKGQAYR

SEQ ID NO: 807091 - protein, 378 aa, Homo sapiens
ASPLRAALGLRSLVCALVRPPVLSTRAWPPDDAGAARAGRGSLRSLLPSAGPLRRSPQFPARTRSGPPNLRPKSGGGSGGKKMKNEIAAVVFFFTRLVRKHDKLKKEAVERFAEKLTLILQEKYKNHWYPEKPSKGQAYRCIRVNKFQRVDPDVLKACENSCILYSDLGLPKELTLWVDPCEVCCRRDGVSPCWPDCSQTPDLVIRPPWPPKALDYRREPLRPASSFLIMYGEKNNAFIVASFENKDENKDEISRKVTRALDKVTSDYHSGSSSSDEETSKEMEVKPSSVTAAASPVYQISELIFPPLPMWHPLPRKKPGMYRGNGHQNHYPPPVPFGYPNQGRKNKPYRPIPVTWVPPPGMHCDRNHWINPHMLAPH

SEQ ID NO: 807092 - protein, 334 aa, Homo sapiens
ASPLRAALGLRSLVCALVRPPVLSTRAWPPDDAGAARAGRGSLRSLLPSAGPLRRSPQFPARTRSGPPNLRPKSGGGSGGKKMKNEIAAVVFFFTRLVRKHDKLKKEAVERFAEKLTLILQEKYKNHWYPEKPSKGQAYRCIRVNKFQRVDPDVLKACENSCILYSDLGLPKELTLWVDPCEVCCRYGEKNNAFIVASFENKDENKDEISRKVTRALDKVTSDYHSGSSSSDEETSKEMEVKPSSVTAAASPVYQISELIFPPLPMWHPLPRKKPGMYRGNGHQNHYPPPVPFGYPNQGRKNKPYRPIPVTWVPPPGMHCDRNHWINPHMLAPH

SEQ ID NO: 807093 - protein, 334 aa, Homo sapiens; identical to SEQ ID NO: 807092

SEQ ID NO: 807094 - protein, 762 aa, Homo sapiens
MIGIKVIVHIYMNVIYFPLHLFVVYSRAYTSLVLVGCTNLCAVLFARCLDDHLVSLRMSGSRKEFDVKQILKIRWRWFGHQASSPNSTVDSQQGEFWNRGQTGANGGRKFLDPCSLQLPLASIGYRRSSQLDFQNSPSWPMASTSEVPAFEFTAEDCGGAHWLDRPEVDDGTSEEENESDSSSCRTSNSSQTLSSCHTMEPCTSDEFFQALNHAEQTFKKMENYLRHKQLCDVILVAGDRRIPAHRLVLSSVSDYFAAMFTNDVREARQEEIKMEGVEPNSLWSLIQYAYTGRLELKEDNIECLLSTACLLQLSQVVEACCKFLMKQLHPSNCLGIRSFADAQGCTDLHKVAHNYTMEHFMEVIRNQEFVLLPASEIAKLLASDDMNIPNEETILNALLTWVRHDLEQRRKDLSKLLAYIRLPLLAPQFLADMENNVLFRDDIECQKLIMEAMKYHLLPERRPMLQSPRTKPRKSTVGTLFAVGGMDSTKGATSIEKYDLRTNMWTPVANMNGRRLQFGVAVLDDKLYVVGGRDGLKTLNTVECYNPKTKTWSVMPPMSTHRHGLGVAVLEGPMYAVGGHDGWSYLNTVERWDPQARQWNFVATMSTPRSTVGVAVLSGKLYAVGGRDGSSCLKSVECFDPHTNKWTLCAQMSKRRGGVGVTTWNGLLYAIGGHDAPASNLTSRLSDCVERYDPKTDMWTAVASMSISRDAVGVCLLGDKLYAVGGYDGQAYLNTVEAYDPQTNEWTQVWHSCFIITLTLFF

SEQ ID NO: 807095 - protein, 190 aa, Homo sapiens
MNVIYFPLHLFVVYSRAYTSLVLVGCTNLCAVLFARCLDDHLVSLRMSGSRKEFDVKQILKIRWRWFGHQASSPNSTVDSQQGEFWNRGQTGANGGRKFLDPCSLQLPLASIGYRRSSQLDFQNSPSWPMASTSEVPAFEFTAEDCGGAHWLDRPEVDDGTSEEENESDSSSCRLIIFLLLEKGCGGMAL

SEQ ID NO: 807096 - protein, 755 aa, Homo sapiens [sequence omitted]

SEQ ID NO: 807097 - protein, 589 aa, Homo sapiens
GRLRSPTRTSNSSQTLSSCHTMEPCTSDEFFQALNHAEQTFKKMENYLRHKQLCDVILVAGDRRIPAHRLVLSSVSDYFAAMFTNDVREARQEEIKMEGVEPNSLWSLIQYAYTGRLELKEDNIECLLSTACLLQLSQVVEACCKFLMKQLHPSNCLGIRSFADAQGCTDLHKVAHNYTMEHFMEVIRNQEFVLLPASEIAKLLASDDMNIPNEETILNALLTWVRHDLEQRRKDLSKLLAYIRLPLLAPQFLADMENNVLFRDDIECQKLIMEAMKYHLLPERRPMLQSPRTKPRKSTVGTLFAVGGMDSTKGATSIEKYDLRTNMWTPVANMNGRRLQFGVAVLDDKLYVVGGRDGLKTLNTVECYNPKTKTWSVMPPMSTHRHGLGVAVLEGPMYAVGGHDGWSYLNTVERWDPQARQWNFVATMSTPRSTVGVAVLSGKLYAVGGRDGSSCLKSVECFDPHTNKWTLCAQMSKRRGGVGVTTWNGLLYAIGGHDAPASNLTSRLSDCVERYDPKTDMWTAVASMSISRDAVGVCLLGDKLYAVGGYDGQAYLNTVEAYDPQTNEWTQVAPLCLGRAGACVVTVKL

SEQ ID NO: 807098 - protein, 755 aa, Homo sapiens [sequence omitted]

SEQ ID NO: 807099 - protein, 757 aa, Homo sapiens [sequence omitted]

SEQ ID NO: 807100 - protein, 757 aa, Homo sapiens [sequence omitted]

SEQ ID NO: 807101 - protein, 770 aa, Homo sapiens
MNVIYFPLHLFVVYSRAYTSLVLVGCTNLCAVLFARCLDDHLVSLRMSGSRKEFDVKQILKIRWRWFGHQASSPNSTVDSQQGEFWNRGQTGANGGRKFLDPCSLQLPLASIGYRRSSQLDFQNSPSWPMASTSEVPAFEFTAEDCGGAHWLDRPEVDDGTSEEENESDSSSCRTSNSSQTLSSCHTMEPCTSDEFFQALNHAEQTFKKMENYLRHKQLCDVILVAGDRRIPAHRLVLSSVSDYFAAMFTNDVREARQEEIKMEGVEPNSLWSLIQYAYTGRLELKEDNIECLLSTACLLQLSQVVEACCKFLMKQLHPSNCLGIRSFADAQGCTDLHKVAHNYTMEHFMEVIRNQEFVLLPASEIAKLLASDDMNIPNEETILNALLTWVRHDLEQRRKDLSKLLAYIRLPLLAPQFLADMENNVLFRDDIECQKLIMEAMKYHLLPERRPMLQSPRTKPRKSTVGTLFAVGGMDSTKGATSIEKYDLRTNMWTPVANMNGRRLQFGVAVLDDKLYVVGGRDGLKTLNTVECYNPKTKTWSVMPPMSTHRHGLGVAVLEGPMYAVGGHDGWSYLNTVERWDPQARQWNFVATMSTPRSTVGVAVLSGKLYAVGGRDGSSCLKSVECFDPHTNKWTLCAQMSKRRGGVGVTTWNGLLYAIGGHDAPASNLTSRLSDCVERYDPKTDMWTAVASMSISRDAVGVCLLGDKLYAVGGYDGQAYLNTVEAYDPQTNEWTQVFSHTFEDSKDHLVAIKQTIWRQNSLSEEFRSH

SEQ ID NO: 807102 - protein, 755 aa, Homo sapiens [sequence omitted]

SEQ ID NO: 807103 - protein, 755 aa, Homo sapiens [sequence omitted]

SEQ ID NO: 807104 - protein, 755 aa, Homo sapiens [sequence omitted]

SEQ ID NO: 807105 - protein, 755 aa, Homo sapiens [sequence omitted]

SEQ ID NO: 807106 - protein, 694 aa, Homo sapiens
MNVIYFPLHLFVVYSRAYTSLVLVGCTNLCAVLFARCLDDHLVSLRMSGSRKEFDVKQILKIRWRWFGHQASSPNSTVDSQQGEFWNRGQTGANGGRKFLDPCSLQLPLASIGYRRSSQLDFQNSPSWPMASTSEVPAFEFTAEDCGGAHWLDRPEVDDGTSEEENESDSSSCRTSNSSQTLSSCHTMEPCTSDEFFQALNHAEQTFKKMENYLRHKQLCDVILVAGDRRIPAHRLVLSSVSDYFAAMFTNDVREARQEEIKMEGVEPNSLWSLIQYAYTGRLELKEDNIECLLSTACLLQLSQVVEACCKFLMKQLHPSNCLGIRSFADAQGCTDLHKVAHNYTMEHFMEVIRNQEFVLLPASEIAKLLASDDMNIPNEETILNALLTWVRHDLEQRRKDLSKLLAYIRLPLLAPQFLADMENNVLFRDDIECQKLIMEAMKYHLLPERRPMLQSPRTKPRKSTVGTLFAVGGMDSTKGATSIEKYDLRTNMWTPVANMNGRRLQFGVAVLDDKLYVVGGRDGLKTLNTVECYNPKTKTWSVMPPMSTHRHGLGVAVLEGPMYAVGGHDGWSYLNTVERWDPQARQWNFVATMSTPRSTVGVAVLSGKLYAVGGRDGSSCLKSVECFDPHTNKWTLCAQMSKRRGGVGVTTWNGLLYAIGGHDAPASNLTSRLSDCVESAKRIMIPKQTCGLQ

SEQ ID NO: 807107 - protein, 491 aa, Homo sapiens
MNVIYFPLHLFVVYSRAYTSLVLVGCTNLCAVLFARCLDDHLVSLRMSGSRKEFDVKQILKIRWRWFGHQASSPNSTVDSQQGEFWNRGQTGANGGRKFLDPCSLQLPLASIGYRRSSQLDFQNSPSWPMASTSEVPAFEFTAEDCGGAHWLDRPEVDDGTSEEENESDSSSCRTSNSSQTLSSCHTMEPCTSDEFFQALNHAEQTFKKMENYLRHKQLCDVILVAGDRRIPAHRLVLSSVSDYFAAMFTNDVREARQEEIKMEGVEPNSLWSLIQYAYTGRLELKEDNIECLLSTACLLQLSQVVEACCKFLMKQLHPSNCLGIRSFADAQGCTDLHKVAHNYTMEHFMEVIRNQEFVLLPASEIAKLLASDDMNIPNEETILNALLTWVRHDLEQRRKDLSKLLAYIRLPLLAPQFLADMENNVLFRDDIECQKLIMEAMKYHLLPERRPMLQSPRTKPRKSTVGTLFAVGGMDSTKEQALEAQFRGAL

SEQ ID NO: 807108 - protein, 1054 aa, Homo sapiens
MGEIEGTYRVLQTAGMRLGAQTPVGVSTLEPGQTLLPRMQEKHLHLRVKLLDNTMEIFDIEPKCDGQVLLTQVWKRLNLVECDYFGMEFQNTQSYWIWLEPMKPIIRQIRRPKNVVLRLAVKFFPPDPGQLQEEYTRYLFALQLKRDLLEERLTCADTTAALLTSHLLQSEIGDYDETLDREHLKVNEYLPGQQHCLEKILEFHQKHVGQTPAESDFQVLEIARKLEMYGIRFHMASDREGTKIQLAVSHMGVLVFQGTTKINTFNWSKVRKLSFKRKRFLIKLHPEVHGPYQDTLEFLLGSRDECKNFWKICVEYHTFFRLLDQPKPKAKAVFFSRGSSFRYSGRTQKQLVDYFKDSGMKRIPYERRHSKTHTSVRALTADLPKQSISFPEGLRTPASPSSANAFYSLSPSTLVPSGLPEFKDSSSSLTDPQVSYVKSPAAERRSGAVAGGPDTPSAQPLGPPALQPGPGLSTKSPQPSPSSRKSPLSLSPAFQVPLGPAEQGSSPLLSPVLSDAGGAGMDCEEPRHKRVPADEAYFIVKEILATERTYLKDLEVITVWFRSAVVKEDAMPATLMTLLFSNIDPIYEFHRGFLREVEQRLALWEGPSKAHTKGSHQRIGDILLRNMRQLKEFTSYFQRHDEVLTELEKATKRCKKLEAVYKEFELQKVCYLPLNTFLLKPIQRLLHYRLLLRRLCGHYSPGHHDYADCHDALKAITEVTTTLQHILIRLENLQKLTELQRDLVGIENLIAPGREFIREGCLHKLTKKGLQQRMFFLFSDMLLYTSKGVAGTSHFRIRGLLPLQGMLVEESDNEWSVPHCFTIYAAQKTIVVAASTRLEKEKWMLDLNSAIQAAKSGGDTAPALPGRTVCTRPPRSPNEVSLEQESEDDARGVRSSLEGHGQHRANTTMHVCWYRNTSVSRADHSAAVENQLSGYLLRKFKNSHGWQKLWVVFTNFCLFFYKTHQDDYPLASLPLLGYSVSIPREADGIHKDYVFKLQFKSHVYFFRAESKYTFERWMEVIQGASSSAGRAPSIVQDGPQPSSGLEGMVRGKEE

SEQ ID NO: 807109 - protein, 122 aa, Homo sapiens
MGEIEGTYRVLQTAGMRLGAQTPVGVSTLEPGQTLLPRMQEKHLHLRVKLLDNTMEIFDIEPKCDGQVLLTQVWKRLNLVECDYFGMEFQNTQSYWIWLEPMKPIIRQIRNRVSLFVAQAGV

SEQ ID NO: 807110 - protein, 849 aa, Homo sapiens
VHLSSQLLRRLRQENPLEPGRQSCSEPRSRHCTPAWAQSKILSQKKTLLIFNFGIPYRVICFLNVLSLVQYFILELINLCVLFLGPYQDTLEFLLGSRDECKNFWKICVEYHTFFRLLDQPKPKAKAVFFSRGSSFRYSGRTQKQLVDYFKDSGMKRIPYERRHSKTHTSVRALTADLPKQSISFPEGLRTPASPSSANAFYSLSPSTLVPSGLPEFKDSSSSLTDPQVSYVKSPAAERRSGAVAGGPDTPSAQPLGPPALQPGPGLSTKSPQPSPSSRKSPLSLSPAFQVPLGPAEQGSSPLLSPVLSDAGGAGMDCEEPRHKRVPADEAYFIVKEILATERTYLKDLEVITVWFRSAVVKEDAMPATLMTLLFSNIDPIYEFHRGFLREVEQRLALWEGPSKAHTKGSHQRIGDILLRNMRQLKEFTSYFQRHDEVLTELEKATKRCKKLEAVYKEFELQKVCYLPLNTFLLKPIQRLLHYRLLLRRLCGHYSPGHHDYADCHDALKAITEVTTTLQHILIRLENLQKLTELQRDLVGIENLIAPGREFIREGCLHKLTKKGLQQRMFFLFSDMLLYTSKGVAGTSHFRIRGLLPLQGMLVEESDNEWSVPHCFTIYAAQKTIVVAASTRLEKEKWMLDLNSAIQAAKSGGDTAPALPGRTVCTRPPRSPNEVSLEQESEDDARGVRSSLEGHGQHRANTTMHVCWYRNTSVSRADHSAAVENQLSGYLLRKFKNSHGWQKLWVVFTNFCLFFYKTHQDDYPLASLPLLGYSVSIPREADGIHKDYVFKLQFKSHVYFFRAESKYTFERWMEVIQGASSSAGRAPSIVQDGPQPSSGLEGMVRGKEE

SEQ ID NO: 807111 - protein, 686 aa, Homo sapiens
MHTTDPDRRSVLQWLAKQSISFPEGLRTPASPSSANAFYSLSPSTLVPSGLPEFKDSSSSLTDPQVSYVKSPAAERRSGAVAGGPDTPSAQPLGPPALQPGPGLSTKSPQPSPSSRKSPLSLSPAFQVPLGPAEQGSSPLLSPVLSDAGGAGMDCEEPRHKRVPADEAYFIVKEILATERTYLKDLEVITVWFRSAVVKEDAMPATLMTLLFSNIDPIYEFHRGFLREVEQRLALWEGPSKAHTKGSHQRIGDILLRNMRQLKEFTSYFQRHDEVLTELEKATKRCKKLEAVYKEFELQKVCYLPLNTFLLKPIQRLLHYRLLLRRLCGHYSPGHHDYADCHDALKAITEVTTTLQHILIRLENLQKLTELQRDLVGIENLIAPGREFIREGCLHKLTKKGLQQRMFFLFSDMLLYTSKGVAGTSHFRIRGLLPLQGMLVEESDNEWSVPHCFTIYAAQKTIVVAASTRLEKEKWMLDLNSAIQAAKSGGDTAPALPGRTVCTRPPRSPNEVSLEQESEDDARGVRSSLEGHGQHRANTTMHVCWYRNTSVSRADHSAAVENQLSGYLLRKFKNSHGWQKLWVVFTNFCLFFYKTHQDDYPLASLPLLGYSVSIPREADGIHKDYVFKLQFKSHVYFFRAESKYTFERWMEVIQGASSSAGRAPSIVQDGPQPSSGLEGMVRGKEE

SEQ ID NO: 807112 - protein, 538 aa, Homo sapiens
CVLLRYCVSSSPQRVPADEAYFIVKEILATERTYLKDLEVITVWFRSAVVKEDAMPATLMTLLFSNIDPIYEFHRGFLREVEQRLALWEGPSKAHTKGSHQRIGDILLRNMRQLKEFTSYFQRHDEVLTELEKATKRCKKLEAVYKEFELQKVCYLPLNTFLLKPIQRLLHYRLLLRRLCGHYSPGHHDYADCHDALKAITEVTTTLQHILIRLENLQKLTELQRDLVGIENLIAPGREFIREGCLHKLTKKGLQQRMFFLFSDMLLYTSKGVAGTSHFRIRGLLPLQGMLVEESDNEWSVPHCFTIYAAQKTIVVAASTRLEKEKWMLDLNSAIQAAKSGGDTAPALPGRTVCTRPPRSPNEVSLEQESEDDARGVRSSLEGHGQHRANTTMHVCWYRNTSVSRADHSAAVENQLSGYLLRKFKNSHGWQKLWVVFTNFCLFFYKTHQDDYPLASLPLLGYSVSIPREADGIHKDYVFKLQFKSHVYFFRAESKYTFERWMEVIQGASSSAGRAPSIVQDGPQPSSGLEGMVRGKEE

SEQ ID NO: 807113 - protein, 1130 aa, Homo sapiens
MGEIEGTYRVLQTAGMRLGAQTPVGVSTLEPGQTLLPRMQEKHLHLRVKLLDNTMEIFDIEPKCDGQVLLTQVWKRLNLVECDYFGMEFQNTQSYWIWLEPMKPIIRQIRRPKNVVLRLAVKFFPPDPGQLQEEYTRYLFALQLKRDLLEERLTCADTTAALLTSHLLQSEIGDYDETLDREHLKVNEYLPGQQHCLEKILEFHQKHVGQTPAESDFQVLEIARKLEMYGIRFHMASDREGTKIQLAVSHMGVLVFQGTTKINTFNWSKVRKLSFKRKRFLIKLHPEVHGPYQDTLEFLLGSRDECKNFWKICVEYHTFFRLLDQPKPKAKAVFFSRGSSFRYSGRTQKQLVDYFKDSGMKRIPYERRHSKTHTSVRALTADLPKQSISFPEGLRTPASPSSANAFYSLSPSTLVPSGLPEFKDSSSSLTDPQVSYVKSPAAERRSGAVAGGPDTPSAQPLGPPALQPGPGLSTKSPQPSPSSRKSPLSLSPAFQVPLGPAEQGSSPLLSPVLSDAGGAGMDCEEPRHKRVPADEAYFIVKEILATERTYLKDLEVITVWFRSAVVKEDAMPATLMTLLFSNIDPIYEFHRGFLREVEQRLALWEGPSKAHTKGSHQRIGDILLRNMRQLKEFTSYFQRHDEVLTELEKATKRCKKLEAVYKEFELQKVCYLPLNTFLLKPIQRLLHYRLLLRRLCGHYSPGHHDYADCHDALKAITEVTTTLQHILIRLENLQKLTELQRDLVGIENLIAPGREFIREGCLHKLTKKGLQQRMFFLFSDMLLYTSKGVAGTSHFRIRGLLPLQGMLVEESDNEWSVPHCFTIYAAQKTIVVAASTRLEKEKWMLDLNSAIQAAKSGGDTAPALPGRTVCTRPPRSPNEVSLEQESEDDARGVRSSLEGHGQHRANTTMHVCWYRNTSVSRADHSAAVENQLSGYLLRKFKNSHGWQKLWVVFTNFCLFFYKTHQVDGGDPGGQQLSREGPKHRAGWPPTLLRAGGDGQGEGGMTLNLPRFGHNYKEQQDTEVTSVLRLLNRWEVAVVSLDPHWHQQCGWASCNIWEGLHPPTQDLVHASSYLGPWEKCASLERGAAQATAPRPLAQRRRQGLSSALGIGPKPGHTLPLSPEQGPCRGLA

SEQ ID NO: 807114 - protein, 127 aa, Homo sapiens [sequence omitted]

SEQ ID NO: 807115 - protein, 118 aa, Homo sapiens
AGTEPRIHGWQKLWVVFTNFCLFFYKTHQDDYPLASLPLLGYSVSIPREADGIHKDYVFKLQFKSHVYFFRAESKYTFERWMEVIQGASSSAGRAPSIVQDGPQPSSGLEGMVRGKEE

SEQ ID NO: 807116 - protein, 1044 aa, Homo sapiens
MGEIEGTYRVLQTAGMRLGAQTPVGVSTLEPGQTLLPRMQEKHLHLRVKLLDNTMEIFDIEPKCDGQVLLTQVWKRLNLVECDYFGMEFQNTQSYWIWLEPMKPIIRQIRRPKNVVLRLAVKFFPPDPGQLQEEYTRYLFALQLKRDLLEERLTCADTTAALLTSHLLQSEIGDYDETLDREHLKVNEYLPGQQHCLEKILEFHQKHVGQTPAESDFQVLEIARKLEMYGIRFHMASDREGTKIQLAVSHMGVLVFQGTTKINTFNWSKVRKLSFKRKRFLIKLHPEVHGPYQDTLEFLLGSRDECKNFWKICVEYHTFFRLLDQPKPKAKAVFFSRGSSFRYSGRTQKQLVDYFKDSGMKRIPYERRHSKTHTSVRALTADLPKQSISFPEGLRTPASPSSANAFYSLSPSTLVPSGLPEFKDSSSSLTDPQVSYVKSPAAERRSGAVAGGPDTPSAQPLGPPALQPGPGLSTKSPQPSPSSRKSPLSLSPAFQVPLGPAEQGSSPLLSPVLSDAGGAGMDCEEPRHKRVPADEAYFIVKEILATERTYLKDLEVITVWFRSAVVKEDAMPATLMTLLFSNIDPIYEFHRGFLREVEQRLALWEGPSKAHTKGSHQRIGDILLRNMRQLKEFTSYFQRHDEVLTELEKATKRCKKLEAVYKEFELQKVCYLPLNTFLLKPIQRLLHYRLLLRRLCGHYSPGHHDYADCHDALKAITEVTTTLQHILIRLENLQKLTELQRDLVGIENLIAPGREFIREGCLHKLTKKGLQQRMFFLFSDMLLYTSKGVAGTSHFRIRGLLPLQGMLVEESDNEWSVPHCFTIYAAQKTIVVAASTRLEKEKWMLDLNSAIQAAKSGGDTAPALPGRTVCTRPPRSPNEVSLEQESEDDARGVRSSLEGHGQHRANTTMHVCWYRNTSVSRADHSAAVENQLSGYLLRKFKNSHGWQKLWVVFTNFCLFFYKTHQDDYPLASLPLLGYSVSIPREADGIHKDYVFKLQFKSHVYFFRAESKYTFERWMEVIQGASSSAGRAPSIVQDGPQPSSG

SEQ ID NO: 807117 - protein, 638 aa, Homo sapiens
MGEIEGTYRVLQTAGMRLGAQTPVGVSTLEPGQTLLPRMQEKHLHLRVKLLDNTMEIFDIEPKCDGQVLLTQVWKRLNLVECDYFGMEFQNTQSYWIWLEPMKPIIRQIRRPKNVVLRLAVKFFPPDPGQLQEEYTRYLFALQLKRDLLEERLTCADTTAALLTSHLLQSEIGDYDETLDREHLKVNEYLPGQQHCLEKILEFHQKHVGQTPAESDFQVLEIARKLEMYGIRFHMASDREGTKIQLAVSHMGVLVFQGTTKINTFNWSKVRKLSFKRKRFLIKLHPEVHGPYQDTLEFLLGSRDECKNFWKICVEYHTFFRLLDQPKPKAKAVFFSRGSSFRYSGRTQKQLVDYFKDSGMKRIPYERRHSKTHTSVRALTADLPKQSISFPEGLRTPASPSSANAFYSLSPSTLVPSGLPEFKDSSSSLTDPQVSYVKSPAAERRSGAVAGGPDTPSAQPLGPPALQPGPGLSTKSPQPSPSSRKSPLSLSPAFQVPLGPAEQGSSPLLSPVLSDAGGAGMDCEEPRHKRVPADEAYFIVKEILATERTYLKDLEVITVWFRSAVVKEDAMPATLMTLLFSNIDPIYEFHRGFLREVEQRLALWEGPSKAHTKGSHQRIGDILLRNMRQLKAAHEFTT

SEQ ID NO: 807118 - protein, 604 aa, Homo sapiens
MGEIEGTYRVLQTAGMRLGAQTPVGVSTLEPGQTLLPRMQEKHLHLRVKLLDNTMEIFDIEPKCDGQVLLTQVWKRLNLVECDYFGMEFQNTQSYWIWLEPMKPIIRQIRRPKNVVLRLAVKFFPPDPGQLQEEYTRYLFALQLKRDLLEERLTCADTTAALLTSHLLQSEIGDYDETLDREHLKVNEYLPGQQHCLEKILEFHQKHVGQTPAESDFQVLEIARKLEMYGIRFHMASDREGTKIQLAVSHMGVLVFQGTTKINTFNWSKVRKLSFKRKRFLIKLHPEVHGPYQDTLEFLLGSRDECKNFWKICVEYHTFFRLLDQPKPKAKAVFFSRGSSFRYSGRTQKQLVDYFKDSGMKRIPYERRHSKTHTSVRALTADLPKQSISFPEGLRTPASPSSANAFYSLSPSTLVPSGLPEFKDSSSSLTDPQVSYVKSPAAERRSGAVAGGPDTPSAQPLGPPALQPGPGLSTKSPQPSPSSRKSPLSLSPAFQVPLGPAEQGSSPLLSPVLSDAGGAGMDCEEPRHKRVPADEAYFIVKEILATERTYLKDLEVITVWFRSAVVKEDAMPATLMTLLFSNIDPIYEFHRGFLREVEQRLALW

SEQ ID NO: 807119 - protein, 520 aa, Homo sapiens
MGEIEGTYRVLQTAGMRLGAQTPVGVSTLEPGQTLLPRMQEKHLHLRVKLLDNTMEIFDIEPKCDGQVLLTQVWKRLNLVECDYFGMEFQNTQSYWIWLEPMKPIIRQIRRPKNVVLRLAVKFFPPDPGQLQEEYTRYLFALQLKRDLLEERLTCADTTAALLTSHLLQSEIGDYDETLDREHLKVNEYLPGQQHCLEKILEFHQKHVGQTPAESDFQVLEIARKLEMYGIRFHMASDREGTKIQLAVSHMGVLVFQGTTKINTFNWSKVRKLSFKRKRFLIKLHPEVHGPYQDTLEFLLGSRDECKNFWKICVEYHTFFRLLDQPKPKAKAVFFSRGSSFRYSGRTQKQLVDYFKDSGMKRIPYERRHSKTHTSVRALTADLPKQSISFPEGLRTPASPSSANAFYSLSPSTLVPSGLPEFKDSSSSLTDPQVSYVKSPAAERRSGAVAGGPDTPSAQPLGPPALQPGPGVGFCHVVSSCGSVCAGGQSFSALDLDTGRAGRELSAACKNDNGGDDFTT

SEQ ID NO: 807120 - protein, 265 aa, Homo sapiens
MGEIEGTYRVLQTAGMRLGAQTPVGVSTLEPGQTLLPRMQEKHLHLRVKLLDNTMEIFDIEPKCDGQVLLTQVWKRLNLVECDYFGMEFQNTQSYWIWLEPMKPIIRQIRRPKNVVLRLAVKFFPPDPGQLQEEYTRYLFALQLKRDLLEERLTCADTTAALLTSHLLQSEIGDYDETLDREHLKVNEYLPGQQHCLEKILEFHQKHVGQTPAESDFQVLEIARKLEMYGIRFHMASDREGTKIQLAVSHMGVLVFQVGQWGREG

SEQ ID NO: 807121 - protein, 79 aa, Homo sapiens
FFHLILVSYKKNIQGKELTELKLLSAGILYSPVISHSTWLIERMNKPDIHRKVTMSVEWLTEACWQLTLAQTHVNKTSV

SEQ ID NO: 807122 - protein, 79 aa, Homo sapiens
RPGKMVEDGAEELEDLVHFSVSELPSRGYGVMEEIRRQGKLCDVTLKELCCSLIISPKGGITQTLQPHCLRLSSGSATC

SEQ ID NO: 807123 - protein, 79 aa, Homo sapiens; identical to SEQ ID NO: 807122

SEQ ID NO: 807124 - protein, 117 aa, Homo sapiens
MVGEVWRFSLLYADFHLIPLNGTTSLSSVVPWLPRSRGSCSSCLKSKPPVFCSCLSGEGDQYFLISALLLAHNFRGNWYLQWFHFGGDSSVACHPQYSVSSKSVTTHVSSFLLLKFC

SEQ ID NO: 807125 - protein, 428 aa, Homo sapiens
MATSWGTVFFMLVVSCVCSAVSHRNQQTWFEGIFLSSMCPINVSASTLYGIMFDAGSTGTRIHVYTFVQKMPGQLPILEGEVFDSVKPGLSAFVDQPKQGAETVQGLLEVAKDSIPRSHWKKTPVVLKATAGLRLLPEHKAKALLFEVKEIFRKSPFLVPKGSVSIMDGSDEGILAWVTVNFLTGQLHGHRQETVGTLDLGGASTQITFLPQFEKTLEQTPRGYLTSFEMFNSTYKLYTHSYLGFGLKAARLATLGALETEGTDGHTFRSACLPRWLEAEWIFGGVKYQYGGNQEGEVGFEPCYAEVLRVVRGKLHQPEEVQRGSFYAFSYYYDRAVDTDMIDYEKGGILKVEDFERKAREVCDNLENFTSGSPFLCMDLSYITALLKDGFGFADSTVLQLTKKVNNIETGWALGATFHLLQSLGISH

SEQ ID NO: 807126 - protein, 428 aa, Homo sapiens; identical to SEQ ID NO: 807125

SEQ ID NO: 807127 - protein, 428 aa, Homo sapiens; identical to SEQ ID NO: 807125

SEQ ID NO: 807128 - protein, 428 aa, Homo sapiens; identical to SEQ ID NO: 807125

SEQ ID NO: 807129 - protein, 236 aa, Homo sapiens
MATSWGTVFFMLVVSCVCSAVSHRNQQTWFEGIFLSSMCPINVSASTLYGIMFDAGSTGTRIHVYTFVQKMPGQLPILEGEVFDSVKPGLSAFVDQPKQGAETVQGLLEVAKDSIPRSHWKKTPVVLKATAGLRLLPEHKAKALLFEVKEIFRKSPFLVPKGSVSIMDGSDEGILAWVTVNFLTGQLHGHRQETVGTLDLGGASTQITFLPQFELLGIWIESCKTSNPGSPGDRRD

SEQ ID NO: 807130 - protein, 166 aa, Homo sapiens
FLLFPHCLQQPASESVPFPQRRSHLTPVHLCLAGEVGFEPCYAEVLRVVRGKLHQPEEVQRGSFYAFSYYYDRAVDTDMIDYEKGGILKVEDFERKAREVCDNLENFTSGSPFLCMDLSYITALLKDGFGFADSTVLQLTKKVNNIETGWALGATFHLLQSLGISH

SEQ ID NO: 807131 - protein, 519 aa, Homo sapiens
MATSWGTVFFMLVVSCVCSAVSHRNQQTWFEGIFLSSMCPINVSASTLYGIMFDAGSTGTRIHVYTFVQKMPGQLPILEGEVFDSVKPGLSAFVDQPKQGAETVQGLLEVAKDSIPRSHWKKTPVVLKATAGLRLLPEHKAKALLFEVKEIFRKSPFLVPKGSVSIMDGSDEGILAWVTVNFLTGQLHGHRQETVGTLDLGGASTQITFLPQFEKTLEQTPRGYLTSFEMFNSTYKLYTHSYLGFGLKAARLATLGALETEGTDGHTFRSACLPRWLEAEWIFGGVKYQYGGNQEGEVGFEPCYAEVLRVVRGKLHQPEEVQRGSFYAFSYYYDRAVDTDMIDYEKGGILKVEDFERKAREVCDNLENFTSGSPFLCMDLSYITALLKDGFGFADSTVLQAAVLRRWAKLEISPKPMLTPCPASGWTLWAASLRIKQSSGVTSGSKVRREWPCSVIVLPNERHPRPDVLSSMSQPKRKQNSAFGIHPGYAWGQLASRDLSGLQKADSILQHGTSCVDEV

SEQ ID NO: 807132 - protein, 962 aa, Homo sapiens
MLEGGSLSSAEYEARVRARRDFQRLQRRDSDGDRQVWFLQRRFHKDILLNPVLALSFCPDLSSKPGHLGTATRELLFLLDSSSVAHKDAIVLAVKSLPPQTLINLAVFGTLVQPLFPESRPCSDDAVQLICESIETLQVPSGPPDVLAALDWAVGQPQHRAYPRQLFLLTAASPMAATTHRTLELMRWHRGTARCFSFGLGPTCHQLLQGLSALSRGQAYFLRPGQRLQPMLVQALRKALEPALSDISVDWFVPDTVEALLTPREIPALYPGDQLLGYCSLFRVDGFRSRPPGGQEPGWQSSGGSVFPSPEEAPSAASPGTEPTGTSEPLGTGTVSAELSSPWAARDSEQSTDALTDPVTDPGPNPSDTAIWRRIFQSSYIREQYVLTHCSASPEPGPGSTGSSESPGSQGPGSPEGSAPLEPPSQQGCRSLAWGEPAGSRSCPLPAPTPAPFKVGALSTEVLGRQHRAALAGRSLSSPPGRANQVPGRPRKPSLGAILDGPSPEPGQQLGQGLDDSGNLLSPAPMDWDMLMEPPFLFTAVPPSGELAPPAVPPQAPRCHVVIRGLCGEQPMCWEVGVGLETLWGPGDGSQPPSPPVREAAWDQALHRLTAASVVRDNEQLALRGGAETTADRGHARRCWLRALQTSKVSSAPSCFTCPVAVDATTREVLPGALQVCSSEPAEPPGTPPASHSHLDAAPLPTVVYSKGLQRGSPAGAWDSDQNGNSKRALGDPATPTEGPRRPPPRPPCRLSMGRRHKLCSPDPGQANNSEGSDHDYLPLVRLQEAPGSFRLDAPFCAAVRISQERLCRASPFAVHRASLSPTSASLPWALLGPGVGQGDSATASCSPSPSSGSEGPGQVDSGRGSDTEASEGAEGLGGTDLRGRTWATAVALAWLEHRCAAAFDEWELTAAKADCWLRAQHLPDGLDLAALKAAARGLFLLLRHWDQNLQLHLLCYSPANV

SEQ ID NO: 807133 - protein, 229 aa, Homo sapiens
MWPCPLCSPRWPRQARRGPPGLRGSVTTGWAYGDSLRPSLGFSGSSAGEGALAGYPGMGRVRKGWGQSAGGFRGLHSGPVTLLMLPSSPTSCFGVGSLQEEGLAWEELAAPRDVFSGPARCPAPYTFSFEMLVTGPCLLAGLESPSHALRADAPPHASSAATICVTLAEGHHCDRALEILLHPSEPHQPHLMLEGGSLSSAEYEARVRARRDFQRLQRRDSDGDRQVPP

SEQ ID NO: 807134 - protein, 275 aa, Homo sapiens
MLEGGSLSSAEYEARVRARRDFQRLQRRDSDGDRQVWFLQRRFHKDILLNPVLALSFCPDLSSKPGHLGTATRELLFLLDSSSVAHKDAIVLAVKSLPPQTLINLAVFGTLVQPLFPESRPCSDDAVQLICESIETLQVPSGPPDVLAALDWAVGQPQHRAYPRQLFLLTAASPMAATTHRTLELMRWHRGTARCFSFGLGPTCHQLLQGLSALSRGQAYFLRPGQRLQPMLVHGRGTPGPGSMNFWAAWADCAGLSPGVHPPGARGGSGGTAPQ

SEQ ID NO: 807135 - protein, 210 aa, Homo sapiens [sequence omitted]

SEQ ID NO: 807136 - protein, 380 aa, Homo sapiens
SGVRAGGRRGRQQQRRNVSLSSQFAHTMAAPAQQTTQPGGGKRKGKAQYVLAKRARRCDAGGPRQLEPGLQGILITCNMNERKCVEEAYSLLNEYGDDMYGPEKFTDKDQQPSGSEGEDDDAEAALKKEVGDIKASTEMRLRRFQSVESGANNVVFIRTLGIEPEKLVHHILQDMYKTKKKKTRVILRMLPISGTCKAFLEDMKKYAETFLEPWFKAPNKGTFQIVYKSRNNSHVNREEVIRELAGIVCTLNSENKVDLTNPQYTVVVEIIKAVCCLSVVKDYMLFRKYNLQEVVKSPKDPSQLNSKQGNGKEAKLESADKSDQNNTAEGKNNQQVPENTEELGQTKPTSNPQVVNEGGAKPELASQATEGSKSNENDFS

SEQ ID NO: 807137 - protein, 380 aa, Homo sapiens; identical to SEQ ID NO: 807136

SEQ ID NO: 807138 - protein, 206 aa, Homo sapiens
MYKTKKKKTRVILRMLPISGTCKAFLEDMKKYAETFLEPWFKAPNKGTFQIVYKSRNNSHVNREEVIRELAGIVCTLNSENKVDLTNPQYTVVVEIIKAVCCLSVVKDYMLFRKYNLQEVVKSPKDPSQLNSKQGNGKEAKLESADKSDQNNTAEGKNNQQVPENTEELGQTKPTSNPQVVNEGGAKPELASQATEGSKSNENDFS

SEQ ID NO: 807139 - protein, 380 aa, Homo sapiens; identical to SEQ ID NO: 807136

SEQ ID NO: 807140 - protein, 67 aa, Homo sapiens
RPPTTTKFAAASTINWKTQVTQLAICLQSIQLCGTKLFLLCESCYFYGKILIIQFVFKLSFIFICIW

SEQ ID NO: 807141 - protein, 302 aa, Homo sapiens
MRHLGAFLFLLGVLGALTEMCEIPEMDSHLVEKLGQHLLPWMDRLSLEHLNPSIYVGLRLSSLQAGTKEDLYLHSLKLGYQQCLLGSAFSEDDGDCQGKPSMGQLALYLLALRANCEFVRGHKGDRLVSQLKWFLEDEKRAIGHDHKGHPHTSYYQYGLGILALCLHQKRVHDSVVDKLLYAVEPFHQGHHSVDTAAMAGLGIHLSEALKLQPWSETTDHHGHQNSARGDLEGPDPRGPLWECLQHPIGITVPHDFPHAWGRTGNSMSQGEGCFAGQSAGWSLPECSHDFPAAARSEPQDLH

SEQ ID NO: 807142 - protein, 275 aa, Homo sapiens
MRHLGAFLFLLGVLGALTEMCEIPEMDSHLVEKLGQHLLPWMDRLSLEHLNPSIYVGLRLSSLQAGTKEDLYLHSLKLGYQQCLLGSAFSEDDGDCQGKPSMGQLALYLLALRANWHDHKGHPHTSYYQYGLGILALCLHQKRVHDSVVDKLLYAVEPFHQGHHSVDTAAMAGLGIHLSEALKLQPWSETTDHHGHQNSARGDLEGPDPRGPLWECLQHPIGITVPHDFPHAWGRTGNSMSQGEGCFAGQSAGWSLPECSHDFPAAARSEPQDLH

SEQ ID NO: 807143 - protein, 302 aa, Homo sapiens; identical to SEQ ID NO: 807141

SEQ ID NO: 807144 - protein, 302 aa, Homo sapiens; identical to SEQ ID NO: 807141

SEQ ID NO: 807145 - protein, 302 aa, Homo sapiens; identical to SEQ ID NO: 807141

SEQ ID NO: 807146 - protein, 48 aa, Homo sapiens
MTRTERGPRALTFSNFISSSSWTISSRLLSCRADILCSSSSFLCLSKT

SEQ ID NO: 807147 - protein, 292 aa, Homo sapiens
MAQPQLYLPEPFKIAYRKVGQCRRFQQLKKKNGSFKRKGIERWHRAVSTNLLKQNVLVPKEESSSDSDMGFHESQQNQKSNLKTKVKTAFGRMLSYKYRSKPACASQEGSTDHKEALLSNTQSLLPRIVKEFSSPKLFTAKMRKLSENATIQLDVVEAETEEITQGNTLLRARRTTKRLSVTSLPSGLQKGPYSPKKRPHFPALKKKKRGMENILRKSDLTVGKLQMQVDDLIETVTDKSMKLLAQRHAELQQCEFLGDEILQSSKQFQRISKRTMRKYKLKNMTTKGPGDS

SEQ ID NO: 807148 - protein, 298 aa, Homo sapiens
MAQPQLYLPEPFKIAYRKVGQCRRFQQLKKKNGSFKRKGIERWHRAVSTNLLKQNVLVPKEESSSDSDMGFHESQQNQKSNLKTKVKTAFGRMLSYKYRSKPACASQEGSTDHKEALLSNTQSLLPRIVKEFSSPKLFTAKMRKLSENATIQLDVVEAETEEITQGNTLLRARRTTKRLSVTSLPSGLQKGPYSPKKRPHFPALKKKKRGMENILRKSDLTVGKLQMQVDDLIETVTDKSMKLLAQRHAELQQCWPWWLTPVISALWEAERVDHLMSGVQNQPGQHGETLSLLKIQKL

SEQ ID NO: 807149 - protein, 534 aa, Homo sapiens
MIWYILIIGILLPQSLAHPGFFTSIGQMTDLIHTEKDLVTSLKDYIKAEEDKLEQIKKWAEKLDRLTSTATKDPEGFVGHPVNAFKLMKRLNTEWSELENLVLKDMSDGFISNLTIQRQYFPNDEDQVGAAKALLRLQDTYNLDTDTISKGNLPGVKHKSFLTAEDCFELGKVAYTEADYYHTELWMEQALRQLDEGEISTIDKVSVLDYLSYAVYQQGDLDKALLLTKKLLELDPEHQRANGNLKYFEYIMAKEKDVNKSASDDQSDQKTTPKKKGVAVDYLPERQKYEMLCRGEGIKMTPRRQKKLFCRYHDGNRNPKFILAPAKQEDEWDKPRIIRFHDIISDAEIEIVKDLAKPRLRRATISNPITGDLETVHYRISKSAWLSGYENPVVSRINMRIQDLTGLDVSTAEELQVANYGVGGQYEPHFDFARKDEPDAFKELGTGNRIATWLFYMSDVSAGGATVFPEVGASVWPKKGTAVFWYNLFASGEGDYSTRHAACPVLVGNKWVSNKWLHERGQEFRRPCTLSELE

SEQ ID NO: 807150 - protein, 365 aa, Homo sapiens
MIWYILIIGILLPQSLAHPGFFTSIGQMTDLIHTEKDLVTSLKDYIKAEEDKLEQIKKWAEKLDRLTSTATKDPEGFVGHPVNAFKLMKRLNTEWSELENLVLKDMSDGFISNLTIQRQYFPNDEDQVGAAKALLRLQDTYNLDTDTISKGNLPGVKHKSFLTAEDCFELGKVAYTEADYYHTELWMEQALRQLDEGEISTIDKVSVLDYLSYAVYQQGDLDKALLLTKKLLELDPEHQRANGNLKYFEYIMAKEKDVNKSASDDQSDQKTTPKKKGVAVDYLPERQKYEMLCRGEGIKMTPRRQKKLFCRYHDGNRNPKFILAPAKQEDEWDKPRIIRFHDIISDAEIEIVKDLAKPRCLALWL

SEQ ID NO: 807151 - protein, 516 aa, Homo sapiens
MIWYILIIGILLPQSLAHPGFFTSIGQMTDLIHTEKDLVTSLKDYIKAEEDKLEQIKKWAEKLDRLTSTATSLNTEWSELENLVLKDMSDGFISNLTIQRQYFPNDEDQVGAAKALLRLQDTYNLDTDTISKGNLPGVKHKSFLTAEDCFELGKVAYTEADYYHTELWMEQALRQLDEGEISTIDKVSVLDYLSYAVYQQGDLDKALLLTKKLLELDPEHQRANGNLKYFEYIMAKEKDVNKSASDDQSDQKTTPKKKGVAVDYLPERQKYEMLCRGEGIKMTPRRQKKLFCRYHDGNRNPKFILAPAKQEDEWDKPRIIRFHDIISDAEIEIVKDLAKPRLRRATISNPITGDLETVHYRISKSAWLSGYENPVVSRINMRIQDLTGLDVSTAEELQVANYGVGGQYEPHFDFARKDEPDAFKELGTGNRIATWLFYMSDVSAGGATVFPEVGASVWPKKGTAVFWYNLFASGEGDYSTRHAACPVLVGNKWVSNKWLHERGQEFRRPCTLSELE

SEQ ID NO: 807152 - protein, 341 aa, Homo sapiens
MIWYILIIGILLPQSLAHPGFFTSIGQMTDLIHTEKDLVTSLKDYIKAEEDKLEQIKKWAEKLDRLTSTATKDPEGFVGHPVNAFKLMKRLNTEWSELENLVLKDMSDGFISNLTIQRQYFPNDEDQVGAAKALLRLQDTYNLDTDTISKGNLPGVKHKSFLTAEDCFELGKVAYTEADYYHTELWMEQALRQLDEGEISTIDKVSVLDYLSYAVYQQGDLDKALLLTKKLLELDPEHQRANGNLKYFEYIMAKEKDVNKSASDDQSDQKTTPKKKGVAVDYLPERQPLGDRKNSFAATMMETVILNLFWLQLNRRMNGTSLVLFASMILFLMQKLKSSKT

SEQ ID NO: 807153 - protein, 341 aa, Homo sapiens; identical to SEQ ID NO: 807152

SEQ ID NO: 807154 - protein, 217 aa, Homo sapiens
SSSVPCYSTKQEDEWDKPRIIRFHDIISDAEIEIVKDLAKPRLRRATISNPITGDLETVHYRISKSAWLSGYENPVVSRINMRIQDLTGLDVSTAEELQVANYGVGGQYEPHFDFARKDEPDAFKELGTGNRIATWLFYMSDVSAGGATVFPEVGASVWPKKGTAVFWYNLFASGEGDYSTRHAACPVLVGNKWVSNKWLHERGQEFRRPCTLSELE

SEQ ID NO: 807155 - protein, 534 aa, Homo sapiens; identical to SEQ ID NO: 807149

SEQ ID NO: 807156 - protein, 534 aa, Homo sapiens; identical to SEQ ID NO: 807149

SEQ ID NO: 807157 - protein, 534 aa, Homo sapiens; identical to SEQ ID NO: 807149

SEQ ID NO: 807158 - protein, 522 aa, Homo sapiens
MIWYILIIGILLPQSLAHPGFFTSIGQMTDLIHTEKDLVTSLKDYIKAEEDKLEQIKKWAEKLDRLTSTATKDPEGFVGHPVNAFKLMKRLNTEWSELENLVLKDMSDGFISNLTIQRQYFPNDEDQVGAAKALLRLQDTYNLDTDTISKGNLPGVKHKSFLTAEDCFELGKVAYTEADYYHTELWMEQALRQLDEGEISTIDKVSVLDYLSYAVYQQGDLDKALLLTKKLLELDPEHQRANGNLKYFEYIMAKEKDVNKSASDDQSDQKTTPKKKGVAVDYLPERQKYEMLCRGEGIKMTPRRQKKLFCRYHDGNRNPKFILAPAKQEDEWDKPRIIRFHDIISDAEIEIVKDLAKPRLRRATISNPITGDLETVHYRISKSAWLSGYENPVVSRINMRIQDLTGLDVSTAEELQVANYGVGGQYEPHFDFARKDEPDAFKELGTGNRIATWLFYMSDVSAGGATVFPEVGASVWPKKGTAVFWYNLFASGEGDYSTRHAACPVLVGNKWGKYFIYSAKIM

SEQ ID NO: 807159 - protein, 383 aa, Homo sapiens
MIWYILIIGILLPQSLAHPGFFTSIGQMTDLIHTEKDLVTSLKDYIKAEEDKLEQIKKWAEKLDRLTSTATKDPEGFVGHPVNAFKLMKRLNTEWSELENLVLKDMSDGFISNLTIQRQYFPNDEDQVGAAKALLRLQDTYNLDTDTISKGNLPGVKHKSFLTAEDCFELGKVAYTEADYYHTELWMEQALRQLDEGEISTIDKVSVLDYLSYAVYQQGDLDKALLLTKKLLELDPEHQRANGNLKYFEYIMAKEKDVNKSASDDQSDQKTTPKKKGVAVDYLPERQKYEMLCRGEGIKMTPRRQKKLFCRYHDGNRNPKFILAPAKQEDEWDKPRIIRFHDIISDAEIEIVKDLAKPRLRRATISNPITGDLETVHYRISKS

SEQ ID NO: 807160 - protein, 74 aa, Homo sapiens
VSDSPGQFYFCAELAASCWENVSGGVTPRNKVHLLLKSQAIRTTNNMMKGHSEPHPRRKPEVLVRPKRWDEEFH

SEQ ID NO: 807161 - protein, 710 aa, Homo sapiens
METRESEDLEKTRRKSASDQWNTDNEPAKVKPELLPEKEETSQADQDIQDKEPHCHIPIKRNSIFNRSIRRKSKAKARDNPERNASCLADSQDNGKSVNEPLTLNIPWSRTPPCRTAMQTDPGAQEMSESSSTPGNGATPEEWPALADSPTTLTEALRMIHPIPADSWRNLIEQIGLLYQEYRDKSTLQEIETRRQQDAEIEDNTNGSPASEDTPEEEEEEEEEEEPASPPERKTLPQICLLSNPHSRFNLWQDLPEIRSSGVLEILQPEEIKLQEAMFELVTSEASYYKSLNLLVSHFMENERIRKILHPSEAHILFSNVLDVLAVSERFLLELEHRMEENIVISDVCDIVYRYAADHFSVYITYVSNQTYQERTYKQLLQEKAAFRELIAQLELDPKCRGLPFSSFLILPFQRITRLKLLVQNILKRVEERSERECTALDAHKELEMVVKACNEGVRKMSRTEQMISIQKKMEFKIKSVPIISHSRWLLKQGELQQMSGPKTSRTLRTKKLFHEIYLFLFNDLLVICRQIPGDKYQVFDSAPRGLLRVEELEDQGQTLANVFILRLLENADDREATYMLKASSQSEMKRWMTSLAPNRRTKFVSFTSRLLDCPQVQCVHPYVAQQPDELTLELADILNILDKTDDGWIFGERLHDQERGWFPSSMTEEILNPKIRSQNLKECFRVHKMDDPQRSQNKDRRKLGSRNRQ

SEQ ID NO: 807162 - protein, 598 aa, Homo sapiens
SESDARDSAAGHLPGSESSSTPGNGATPEEWPALADSPTTLTEALRMIHPIPADSWRNLIEQIGLLYQEYRDKSTLQEIETRRQQDAEIEDNTNGSPASEDTPEEEEEEEEEEEPASPPERKTLPQICLLSNPHSRFNLWQDLPEIRSSGVLEILQPEEIKLQEAMFELVTSEASYYKSLNLLVSHFMENERIRKILHPSEAHILFSNVLDVLAVSERFLLELEHRMEENIVISDVCDIVYRYAADHFSVYITYVSNQTYQERTYKQLLQEKAAFRELIAQLELDPKCRGLPFSSFLILPFQRITRLKLLVQNILKRVEERSERECTALDAHKELEMVVKACNEGVRKMSRTEQMISIQKKMEFKIKSVPIISHSRWLLKQGELQQMSGPKTSRTLRTKKLFHEIYLFLFNDLLVICRQIPGDKYQVFDSAPRGLLRVEELEDQGQTLANVFILRLLENADDREATYMLKASSQSEMKRWMTSLAPNRRTKFVSFTSRLLDCPQVQCVHPYVAQQPDELTLELADILNILDKTDDGWIFGERLHDQERGWFPSSMTEEILNPKIRSQNLKECFRVHKMDDPQRSQNKDRRKLGSRNRQ

SEQ ID NO: 807163 - protein, 594 aa, Homo sapiens
VAFRGGTPARTDESSSTPGNGATPEEWPALADSPTTLTEALRMIHPIPADSWRNLIEQIGLLYQEYRDKSTLQEIETRRQQDAEIEDNTNGSPASEDTPEEEEEEEEEEEPASPPERKTLPQICLLSNPHSRFNLWQDLPEIRSSGVLEILQPEEIKLQEAMFELVTSEASYYKSLNLLVSHFMENERIRKILHPSEAHILFSNVLDVLAVSERFLLELEHRMEENIVISDVCDIVYRYAADHFSVYITYVSNQTYQERTYKQLLQEKAAFRELIAQLELDPKCRGLPFSSFLILPFQRITRLKLLVQNILKRVEERSERECTALDAHKELEMVVKACNEGVRKMSRTEQMISIQKKMEFKIKSVPIISHSRWLLKQGELQQMSGPKTSRTLRTKKLFHEIYLFLFNDLLVICRQIPGDKYQVFDSAPRGLLRVEELEDQGQTLANVFILRLLENADDREATYMLKASSQSEMKRWMTSLAPNRRTKFVSFTSRLLDCPQVQCVHPYVAQQPDELTLELADILNILDKTDDGWIFGERLHDQERGWFPSSMTEEILNPKIRSQNLKECFRVHKMDDPQRSQNKDRRKLGSRNRQ

SEQ ID NO: 807164 - protein, 296 aa, Homo sapiens
PLVQRPQDCKNILKRVEERSERECTALDAHKELEMVVKACNEGVRKMSRTEQMISIQKKMEFKIKSVPIISHSRWLLKQGELQQMSGPKTSRTLRTKKLFHEIYLFLFNDLLVICRQIPGDKYQVFDSAPRGLLRVEELEDQGQTLANVFILRLLENADDREATYMLKASSQSEMKRWMTSLAPNRRTKFVSFTSRLLDCPQVQCVHPYVAQQPDELTLELADILNILDKTDDGWIFGERLHDQERGWFPSSMTEEILNPKIRSQNLKECFRVHKMDDPQRSQNKDRRKLGSRNRQ

SEQ ID NO: 807165 - protein, 335 aa, Homo sapiens
METRESEDLEKTRRKSASDQWNTDNEPAKVKPELLPEKEETSQADQDIQDKEPHCHIPIKRNSIFNRSIRRKSKAKARDNPERNASCLADSQDNGKSVNEPLTLNIPWSRTPPCRTAMQTDPGAQEMSESSSTPGNGATPEEWPALADSPTTLTEALRMIHPIPADSWRNLIEQIGLLYQEYRDKSTLQEIETRRQQDAEIEDNTNGSPASEDTPEEEEEEEEEEEPASPPERKTLPQICLLSNPHSRFNLWQDLPEIRSSGVLEILQPEEIKLQEVTGAEGRGLPHSTPGWPSLLGVRLPLGGEVPWLVHQRNRWQGCPSRTCRKINMVSQAAR

SEQ ID NO: 807166 - protein, 127 aa, Homo sapiens
VRLASSRLCARPSLASRGESLLKNNQPLSSSLSGSESSSTPGNGATPEEWPALADSPTTLTEALRMIHPIPADSWRNLIEQIGGCLRSNRVLFGKRGSLEDSEGPPAHGMPLCFIRRTASDMGKESF

SEQ ID NO: 807167 - protein, 106 aa, Homo sapiens
MCPCLLSLNCPQVQCVHPYVAQQPDELTLELADILNILDKTDDGWIFGERLHDQERGWFPSSMTEEILNPKIRSQNLKECFRVHKMDDPQRSQNKDRRKLGSRNRQ

SEQ ID NO: 807168 - protein, 128 aa, Homo sapiens
METRESEDLEKTRRKSASDQWNTDNEPAKVKPELLPEKEETSQADQDIQDKEPHCHIPIKRNSIFNRSIRRKSKAKARDNPERNASCLADSQDNGKSVNEPLTLNIPWSRTPPCRTAMQTDPGAQEMR

SEQ ID NO: 807169 - protein, 87 aa, Homo sapiens
GFDSLEGTKRHFREDGGAQVRSGTCFRGADPAMTVRGSLPPNGGSRSPGLLANVRGAEYFYPSGTGVGGLEFSPQEQGSLGKGQPAL

SEQ ID NO: 807170 - protein, 446 aa, Homo sapiens [sequence omitted]

SEQ ID NO: 807171 - protein, 446 aa, Homo sapiens [sequence omitted]

SEQ ID NO: 807172 - protein, 487 aa, Homo sapiens
MNVTPEVKSRGMKFAEEQLLKHGWTQGKGLGRKENGITQALRVTLKQDTHGVGHDPAKEFTNHWWNELFNKTAANLVVETGQDGVQIRSLSKETTRYNHPKPNLLYQKFVKWDPVTSLAVAYLDCPDPQQELRSSGSVDPAICEGSSNRAWEMATLTSGGEKPNKDLESCSDDDNQGSKSPKILTDEMLLQACEGRTAHKAARLGITMKAKLARLEAQEQAFLARLKGQDPGAPQLQSESKPPKKKKKKRRQKEEEEATASERNDADEKHPEHAEQNIRKSKKKKRRHQEGKVSDEREGTTKGNEKEDAAGTSGLGELNSREQTNQSLRKGKKKKRWHHEEEKMGVLEEGGKGKEAAGSVRTEEVESRAYADPCSRRKKRQQQEEEDLNLEDRGEETVLGGGTREAESRACSDGRSRKSKKKRQQHQEEEDILDVRDEKDSGAREAESRAHTGSSSRGKRKRQQHPKKERAGVSTVQKAKKKQKKRD

SEQ ID NO: 807173 - protein, 401 aa, Homo sapiens
MNVTPEVKSRGMKFAEEQLLKHGWTQGKGLGRKENGITQALRVTLKQDTHGVGHDPAKEFTNHWWNELFNKTAANLVVETGQDGVQIRSLSKETTRYNHPKPNLLYQKFVKMATLTSGGEKPNKDLESCSDDDNQGSKSPKILTDEMLLQACEGRTAHKAARLGITMKAKLARLEAQEQAFLARLKGQDPGAPQLQSESKPPKKKKKKRRQKEEEEATASERNDADEKHPEHAEQNIRKSKKKKRRHQEGKVSDEREGTTKGNEKEDAAGTSGLGELNSREQTNQSLRKGKKKKRWHHEEEKMGVLEEGGKGKEAAGSVRTEEVESRAYADPCSRRKKRQQQEEEDLNLEDRGEETVLGGGTREAESRACSDGRSRKSKKKRQQHQEEEDILDVRDEKDSG

SEQ ID NO: 807174 - protein, 523 aa, Homo sapiens
MNVTPEVKSRGMKFAEEQLLKHGWTQGKGLGRKENGITQALRVTLKQDTHGVGHDPAKEFTNHWWNELFNKTAANLVVETGQDGVQIRSLSKETTRYNHPKPNLLYQKFVKMATLTSGGEKPNKDLESCSDDDNQGSKSPKILTDEMLLQACEGRTAHKYVVVSSLSSLFSPPLTMACATSWFFLPQGNDSYYLPIYCLKIGSSPLLPSTNFPCRLKDEAHFPRYPRFDLDPVCFRAARLGITMKAKLARLEAQEQAFLARLKGQDPGAPQLQSESKPPKKKKKKRRQKEEEEATASERNDADEKHPEHAEQNIRKSKKKKRRHQEGKVSDEREGTTKGNEKEDAAGTSGLGELNSREQTNQSLRKGKKKKRWHHEEEKMGVLEEGGKGKEAAGSVRTEEVESRAYADPCSRRKKRQQQEEEDLNLEDRGEETVLGGGTREAESRACSDGRSRKSKKKRQQHQEEEDILDVRDEKDSGAREAESRAHTGSSSRGKRKRQQHPKKERAGVSTVQKAKKKQKKRD

SEQ ID NO: 807175 - protein, 373 aa, Homo sapiens
MNVTPEVKSRGMKFAEEQLLKHGWTQGKGLGRKENGITQALRVTLKQDTHGVGHDPAKEFTNHWWNELFNKTAANLVVETGQDGVQIRSLSKETTRYNHPKPNLLYQKFVKMATLTSGGEKPNKDLESCSDDDNQGSKSPKILTDEMLLQACEGRTAHKAARLGITMKAKLARLEAQEQAFLARLKGQDPGAPQLQSESKPPKKKKKKRRQKEEEEATASERNDADEKHPEHAEQNIRKSKKKKRRHQEGKVSDEREGTTKGNEKEDAAGTSGLGELNSREQTNQSLRKGKKKKRWHHEEEKMGVLEEGGKGKEAAGSVRTEEVESRAYADPCSRRKKRQQQEEEDLNLEDRGEETVLGGGTREAKDLARQRA

SEQ ID NO: 807176 - protein, 360 aa, Homo sapiens
MNVTPEVKSRGMKFAEEQLLKHGWTQGKGLGRKENGITQALRVTLKQDTHGVGHDPAKEFTNHWWNELFNKTAANLVVETGQDGVQIRSLSKETTRYNHPKPNLLYQKFVKMATLTSGGEKPNKDLESCSDDDNQGSKSPKILTDEMLLQACEGRTAHKAARLGITMKAKLARLEAQEQAFLARLKGQDPGAPQLQSESKPPKKKKKKRRQKEEEEATASERNDADEKHPEHAEQNIRKSKKKKRRHQEGKVSDEREGTTKGNEKEDAAGTSGLGELNSREQTNQSLRKGKKKKRWHHEEEKMGVLEEGGKGKEAAGSVRTEEVESRAYADPCSRRKKRRRWMQSAAWDAVSGVGCSRVP

SEQ ID NO: 807177 - protein, 280 aa, Homo sapiens [sequence omitted]

SEQ ID NO: 807178 - protein, 197 aa, Homo sapiens
RPSSYLPEGTTKGNEKEDAAGTSGLGELNSREQTNQSLRKGKKKKRWHHEEEKMGVLEEGGKGKEAAGSVRTEEVESRAYADPCSRRKKRQQQEEEDLNLEDRGEETVLGGGTREAESRACSDGRSRKSKKKRQQHQEEEDILDVRDEKDSGAREAESRAHTGSSSRGKRKRQQHPKKERAGVSTVQKAKKKQKKRD

SEQ ID NO: 807179 - protein, 446 aa, Homo sapiens [sequence omitted]

SEQ ID NO: 807180 - protein, 446 aa, Homo sapiens [sequence omitted]

SEQ ID NO: 807181 - protein, 475 aa, Homo sapiens
WFRQPRRNKTAFPGRWRRTSQVRHMFPRSGPSNDEVKSRGMKFAEEQLLKHGWTQGKGLGRKENGITQALRVTLKQDTHGVGHDPAKEFTNHWWNELFNKTAANLVVETGQDGVQIRSLSKETTRYNHPKPNLLYQKFVKMATLTSGGEKPNKDLESCSDDDNQGSKSPKILTDEMLLQACEGRTAHKAARLGITMKAKLARLEAQEQAFLARLKGQDPGAPQLQSESKPPKKKKKKRRQKEEEEATASERNDADEKHPEHAEQNIRKSKKKKRRHQEGKVSDEREGTTKGNEKEDAAGTSGLGELNSREQTNQSLRKGKKKKRWHHEEEKMGVLEEGGKGKEAAGSVRTEEVESRAYADPCSRRKKRQQQEEEDLNLEDRGEETVLGGGTREAESRACSDGRSRKSKKKRQQHQEEEDILDVRDEKDSGAREAESRAHTGSSSRGKRKRQQHPKKERAGVSTVQKAKKKQKKRD

SEQ ID NO: 807182 - protein, 335 aa, Homo sapiens
MATLTSGGEKPNKDLESCSDDDNQGSKSPKILTDEMLLQACEGRTAHKAARLGITMKAKLARLEAQEQAFLARLKGQDPGAPQLQSESKPPKKKKKKRRQKEEEEATASERNDADEKHPEHAEQNIRKSKKKKRRHQEGKVSDEREGTTKGNEKEDAAGTSGLGELNSREQTNQSLRKGKKKKRWHHEEEKMGVLEEGGKGKEAAGSVRTEEVESRAYADPCSRRKKRQQQEEEDLNLEDRGEETVLGGGTREAESRACSDGRSRKSKKKRQQHQEEEDILDVRDEKDSGAREAESRAHTGSSSRGKRKRQQHPKKERAGVSTVQKAKKKQKKRD

SEQ ID NO: 807183 - protein, 485 aa, Homo sapiens
MNVTPEVKSRGMKFAEEQLLKHGWTQGKGLGRKENGITQALRVTLKQDTHGVGHDPAKEFTNHWWNELFNKTAANLVVETGQDGVQIRSLSKETTRYNHPKPNLLYQKFVKMATLTSGGEKPNKDLESCSDDDNQGSKSPKIDLKKCQVLNKNSVLKECFRRRRGQAFPPGLFVTADLPYSLTDEMLLQACEGRTAHKAARLGITMKAKLARLEAQEQAFLARLKGQDPGAPQLQSESKPPKKKKKKRRQKEEEEATASERNDADEKHPEHAEQNIRKSKKKKRRHQEGKVSDEREGTTKGNEKEDAAGTSGLGELNSREQTNQSLRKGKKKKRWHHEEEKMGVLEEGGKGKEAAGSVRTEEVESRAYADPCSRRKKRQQQEEEDLNLEDRGEETVLGGGTREAESRACSDGRSRKSKKKRQQHQEEEDILDVRDEKDSGAREAESRAHTGSSSRGKRKRQQHPKKERAGVSTVQKAKKKQKKRD

SEQ ID NO: 807184 - protein, 320 aa, Homo sapiens
ILFARRRQKGSKSPKILTDEMLLQACEGRTAHKAARLGITMKAKLARLEAQEQAFLARLKGQDPGAPQLQSESKPPKKKKKKRRQKEEEEATASERNDADEKHPEHAEQNIRKSKKKKRRHQEGKVSDEREGTTKGNEKEDAAGTSGLGELNSREQTNQSLRKGKKKKRWHHEEEKMGVLEEGGKGKEAAGSVRTEEVESRAYADPCSRRKKRQQQEEEDLNLEDRGEETVLGGGTREAESRACSDGRSRKSKKKRQQHQEEEDILDVRDEKDSGAREAESRAHTGSSSRGKRKRQQHPKKERAGVSTVQKAKKKQKKRD

SEQ ID NO: 807185 - protein, 244 aa, Homo sapiens
MKKLMVVLSLIAAAWAEEQNKLVHGGPCDKTSHPYQAALYTSGHLLCGGVLIHPLWVLTAAHCKKPNLQVFLGKHNLRQRESSQEQSSVVRAVIHPDYDAASHDQDIMLLRLARPAKLSELIQPLPLERDCSANTTSCHILGWGKTADGDFPDTIQCAYIHLVSREECEHAYPGQITQNMLCAGDEKYGKDSCQGDSGGPLVCGDHLRGLVSWGNIPCGSKEKPGVYTNVCRYTNWIQKTIQAK

SEQ ID NO: 807186 - protein, 137 aa, Homo sapiens
MLLRLARPAKLSELIQPLPLERDCSANTTSCHILGWGKTADGDFPDTIQCAYIHLVSREECEHAYPGQITQNMLCAGDEKYGKDSCQGDSGGPLVCGDHLRGLVSWGNIPCGSKEKPGVYTNVCRYTNWIQKTIQAK

SEQ ID NO: 807187 - protein, 270 aa, Homo sapiens
MELLDQLFLPRVKNPRRPGGLQQERHKKLMVSAESEKCCTWAEEQNKLVHGGPCDKTSHPYQAALYTSGHLLCGGVLIHPLWVLTAAHCKKPNLQVFLGKHNLRQRESSQEQSSVVRAVIHPDYDAASHDQDIMLLRLARPAKLSELIQPLPLERDCSANTTSCHILGWGKTADGDFPDTIQCAYIHLVSREECEHAYPGQITQNMLCAGDEKYGKDSCQGDSGGPLVCGDHLRGLVSWGNIPCGSKEKPGVYTNVCRYTNWIQKTIQAK

SEQ ID NO: 807188 - protein, 225 aa, Homo sapiens
MKKLMVVLSLIAAAWAEEQNKLVHGGPCDKTSHPYQAALYTSGHLLCGGVLIHPLWVLTAAHCKKPNLQVFLGKHNLRQRESSQEQSSVVRAVIHPDYDAASHDQDIMLLRLARPAKLSELIQPLPLERDCSANTTSCHILGWGKTADGDFPDTIQCAYIHLVSREECEHAYPGQITQNMLCAGDEKYGKDSCQSPGQPPHTLTHSREAQVGGEPAATSISPLVY

SEQ ID NO: 807189 - protein, 325 aa, Homo sapiens
ADKARLFLGPFPIAPGPAPQPGAGAGASVVTHAVAVSPAGWLALSWGHRGRQAAHRGTYGQLFLPPTQESPEARRPAAGAAMKKLMVVLSLIAAAWAEEQNKLVHGGPCDKTSHPYQAALYTSGHLLCGGVLIHPLWVLTAAHCKKPNLQVFLGKHNLRQRESSQEQSSVVRAVIHPDYDAASHDQDIMLLRLARPAKLSELIQPLPLERDCSANTTSCHILGWGKTADGDFPDTIQCAYIHLVSREECEHAYPGQITQNMLCAGDEKYGKDSCQGDSGGPLVCGDHLRGLVSWGNIPCGSKEKPGVYTNVCRYTNWIQKTIQAK

SEQ ID NO: 807190 - protein, 302 aa, Homo sapiens
CRTVRHATHAVAVSPAGWLALSWGHRGRQAAHRGTYGQLFLPPTQESPEARRPAAGAAMKKLMVVLSLIAAAWAEEQNKLVHGGPCDKTSHPYQAALYTSGHLLCGGVLIHPLWVLTAAHCKKPNLQVFLGKHNLRQRESSQEQSSVVRAVIHPDYDAASHDQDIMLLRLARPAKLSELIQPLPLERDCSANTTSCHILGWGKTADGDFPDTIQCAYIHLVSREECEHAYPGQITQNMLCAGDEKYGKDSCQGDSGGPLVCGDHLRGLVSWGNIPCGSKEKPGVYTNVCRYTNWIQKTIQAK

SEQ ID NO: 807191 - protein, 325 aa, Homo sapiens; identical to SEQ ID NO: 807189

SEQ ID NO: 807192 - protein, 115 aa, Homo sapiens
HPAPSPGEGLLSQHHQLPHPGLGQDSRWSVVGGWWGAGYWLLGEVCQRMGSGKIGEGPWEDGLMVRTNGTGFQWEKGQGGGRVNLGAGPVSEQPMENVDQWVNSMGEMEHKMKVQ

SEQ ID NO: 807193 - protein, 198 aa, Homo sapiens
MTLRCLEPSGNGGEGTRSQWGTAGSAEEPSPQAARLAKALRELGQTGWYWGSMTVNEAKEKLKEAPEGTFLIRDSSHSDYLLTISVKTSAGPTNLRIEYQDGKFRLDSIICVKSKLKQFDSVVHLIDYYVQMCKDKRTGPEAPRNGTVHLYLTKPLYTSAPSLQHLCRLTINKCTGAIWGLPLPTRLKDYLEEYKFQV

SEQ ID NO: 807194 - protein, 198 aa, Homo sapiens; identical to SEQ ID NO: 807193

SEQ ID NO: 807195 - protein, 198 aa, Homo sapiens; identical to SEQ ID NO: 807193

SEQ ID NO: 807196 - protein, 198 aa, Homo sapiens; identical to SEQ ID NO: 807193

SEQ ID NO: 807197 - protein, 198 aa, Homo sapiens; identical to SEQ ID NO: 807193

SEQ ID NO: 807198 - protein, 198 aa, Homo sapiens; identical to SEQ ID NO: 807193

SEQ ID NO: 807199 - protein, 153 aa, Homo sapiens
EAAWCGGGGGGRGRGRGKSAALVVCIFRSARDRPLGPGLASEPREGCALGPIPRQRPRRREPPQPSWSGSDRRGTPNPARAGTRKRGEGSEEPPGRRCGSSRTSAPRVGASGPRSALGRRTKFVWVLLPGGPRAAPGVRPECQFGESLLFFPF

SEQ ID NO: 807200 - protein, 198 aa, Homo sapiens; identical to SEQ ID NO: 807193

SEQ ID NO: 807201 - protein, 204 aa, Homo sapiens
MTLRCLEPSGNGGEGTRSQWGTAGSAEEPSPQAARLAKALRELGQTGWYWGSMTVNEAKEKLKEAPEGTFLIRDSSHSDYLLTISVKTSAGPTNLRIEYQDGKFRLDSIICVKSKLKQFDSVVHLIDYYVQMCKDKRTGPEAPRNGTVHLYLTKPLYTSAPSLQHLCRLTINKCTGAIWGLPLPTRLKDYLEEYKFQPAVFYPG

SEQ ID NO: 807202 - protein, 198 aa, Homo sapiens; identical to SEQ ID NO: 807193

SEQ ID NO: 807203 - protein, 725 aa, Homo sapiens
MSQAEVHHGAWVMAESPPDIQFEAALGRPWVLLRPRRDRQPFYNRPTLGLPEDWKKLEHLLMPGVAFDTYKYNLTESSPQTSEVDSAFISTSETRRLTLHRLNDLIVSKDKITTISLKDLELPLFAIPELGNTSFHKIEKVFQLAKQKRLVLQPERSRRKQKTEPRVDWSFQSKVPCKVGTGRQNNRKVTDWLTSGYSRLLFCKDYSRGNLIIMLIETSLLGKLGCYLSPDFSEGQITTYFQFGKNLSLSDSILIKLDFWGLVQDLQSKTMTFYNFYLTGGKLEDLNSSHSDFKSHGFLTLLFIFSISLQMLLTSDACSQHVPQYCLLVTCEVIFHHVVNTEEGYDLLIMMHLNNDAIIGTLISEVMQDLPKSKLSSLEESLTSEFTPFLPFFFFGDGVSLLLPRLECNGMISAHCNLCLPGSSDSLASASRVAGITGACHHAQLIFVFFVETAFHHVGQASLKLLTSGDSPVSASQSAGITGVAITPGHSSLLLISFRCLSSATITHKLFPITPFLSLEVNFINDVSIIIAILRCRTNNPKLSVAENNKDFYIYYTSVIITREALLATQNQADEAAAAPPQTAGLGAELMGKENQRISEWCLNALSLLLLTDWPELCKIVPPNHKGARKHSSPLCQEGEKTEMFGERHGVTTTYDHAIYILLPSFFLPSLANLTSRKLYRTCIASLIPFLFRLCLPKVFQVLQNSVSPSCKPKGKISSLEVKYT

SEQ ID NO: 807204 - protein, 198 aa, Homo sapiens; identical to SEQ ID NO: 807193

SEQ ID NO: 807205 - protein, 198 aa, Homo sapiens; identical to SEQ ID NO: 807193

SEQ ID NO: 807206 - protein, 198 aa, Homo sapiens; identical to SEQ ID NO: 807193

SEQ ID NO: 807207 - protein, 198 aa, Homo sapiens; identical to SEQ ID NO: 807193

SEQ ID NO: 807208 - protein, 198 aa, Homo sapiens; identical to SEQ ID NO: 807193

SEQ ID NO: 807209 - protein, 103 aa, Homo sapiens
MTLRCLEPSGNGGEGTRSQWGTAGSAEEPSPQAARLAKALRELGQTGWYWGSMTVNEAKEKLKEAPEGTFLIRDSSHSDYLLTISVKTSAGPTNLRIEYQDGK

SEQ ID NO: 807210 - protein, 203 aa, Homo sapiens
MAHVSSETQDVSPKDELTASEASTRSPLCEHTFPGDSDLRSMIEEHAFQVLSQGSLLESPSYTVCVSEPDKDDDFLSLNFPRKLWKIVESDQFKSISWDENGTCIVINEELFKKEILETKAPYRIFQTDAIKSFVRQLNLYGFSKIQQNFQRSAFLATFLSEEKESSVLSKIRFTKMKLSRSSTYENRYLCCNLHLKDESNYS

SEQ ID NO: 807211 - protein, 212 aa, Homo sapiens
MAHVSSETQDVSPKDELTASEASTRSPLCEHTFPGDSDLRSMIEEHAFQVLSQGSLLESPSYTVCVSEPDKDDDFLSLNFPRKLWKIVESDQFKSISWDENGTCIVINEELFKKEILETKAPYRIFQTDAIKSFVRQLNLYGFSKIQQNFQRSAFLATFLSEEKESSVLSKLKFYYNPNFKRGYPQLLVRVKRRIGVKNASPISTLFNEDFN

SEQ ID NO: 807212 - protein, 136 aa, Homo sapiens
SVGIKCDARVLSEDEEDVDFDIIHNANDTFTVKYVPPAAGRYTIKVLFASQVRGGAWEEMGGVGLDSLWPLVCMSHLLFGVLLVLLFLRWSLTLSPKLECSGVILAHCNLCLPGSSDPPTSASQVAGDYRLIPPPS

SEQ ID NO: 807213 - protein, 345 aa, Homo sapiens
MSSYQKELEKYRDIDEDEILRTLSPEELEQLDCELQEMDPENMLLPAGLRQRDQTKKSPTGPLDREALLQYLEQQALEVKERDDLVPFTGEKKGKPYIQPKREIPAEEQITLEPELEEALAHATDAEMCDIAAILDMYTLMSNKQYYDALCSGEICNTEGISSVVQPDKYKPVPDEPPNPTNIEEILKRVRSNDKELEEVNLNNIQDIPIPMLSELCEAMKANTYVRSFSLVATRSGDPIANAVADMLRENRSLQSLNIESNFISSTGLMAVLKAVRENATLTELRVDNQRQWPGDAVEMEMATVLEQCPSIVRFGYHFTQQGPRARAAQAMTRNNELRRQQKKR

SEQ ID NO: 807214 - protein, 309 aa, Homo sapiens
MSSYQKELEKYRDIDEDEILRTLSPEELEQLDCELQEMDPENMLLPAGLRQRDQTKKSPTGPLDREALLQYLEQQALEVKERDDLVPFTGEKKGKPYIQPKREIPAEEQITLEPELEEALAHATDAEMCDIAAILDMYTLMSNKQYYDALCSGEICNTEGISSVVQPDKYKPVPDEPPNPTNIEEILKRVRSNDKELEEVNLNNIQAVADMLRENRSLQSLNIESNFISSTGLMAVLKAVRENATLTELRVDNQRQWPGDAVEMEMATVLEQCPSIVRFGYHFTQQGPRARAAQAMTRNNELRRQQKKR

SEQ ID NO: 807215 - protein, 303 aa, Homo sapiens
MLLPAGLRQRDQTKKSPTGPLDREALLQYLEQQALEVKERDDLVPFTGEKKGKPYIQPKREIPAEEQITLEPELEEALAHATDAEMCDIAAILDMYTLMSNKQYYDALCSGEICNTEGISSVVQPDKYKPVPDEPPNPTNIEEILKRVRSNDKELEEVNLNNIQDIPIPMLSELCEAMKANTYVRSFSLVATRSGDPIANAVADMLRENRSLQSLNIESNFISSTGLMAVLKAVRENATLTELRVDNQRQWPGDAVEMEMATVLEQCPSIVRFGYHFTQQGPRARAAQAMTRNNELRRQQKKR

SEQ ID NO: 807216 - protein, 269 aa, Homo sapiens
MSSYQKELEKYRDIDEDEILRTLSPEELEQLDCELQEMDPENMLLPAGLRQRDQTKKSPTGPLDREALLQYLEQQALEVKERDDLVPFTGEKKGKPYIQPKREIPAEEQITLEPELEEALAHATDAEMCDIAAILDMYTLMSNKQYYDALCSGEICNTEGISSVVQPDKYKPVPDEPPNPTNIEEILKRVRSNDKELEEVNLNNIQAVADMLRENRSLQSLNIESNFISSTGLMAVLKAVRENATLTELRVDNQVASKRRDNTAFPFTN

SEQ ID NO: 807217 - protein, 111 aa, Homo sapiens
MGPSVSASVRRGGRCVPSLAGLRLGLNGVRSARQLPSALPSRASLLPATRPAGARGVTSQAVARLHAEYRQGAGARAVVLPDAAAEDVLDLPQDFQVPDEEIILLTGYRMH

SEQ ID NO: 807218 - protein, 301 aa, Homo sapiens
MAKSLLKTASLSGRTKLLHQTGLSLYSTSHGFYEEEVKKTLQQFPGGSIDLQKEDNGIGILTLNNPSRMNAFSGVMMLQLLEKVIELENWTEGKGLIVRGAKNTFSSGSDLNAVKSLGTPEDGMAVCMFMQNTLTRFMRLPLISVALVQGWALGGGAEFTTACDFRLMTPESKIRFVHKEMGIIPSWGGTTRLVEIIGSRQALKVLSGALKLDSKNALNIGMVEEVLQSSDETKSLEEAQEWLKQFIQGPPEVIRALKKSVCSGRELYLEEALQNERDLLGTVWGGPANLEAIAKKGKFNK

SEQ ID NO: 807219 - protein, 307 aa, Homo sapiens
MALKQEMAKSLLKTASLSGRTKLLHQTGLSLYSTSHGFYEEEVKKTLQQFPGGSIDLQKEDNGIGILTLNNPSRMNAFSGVMMLQLLEKVIELENWTEGKGLIVRGAKNTFSSGSDLNAVKSLGTPEDGMAVCMFMQNTLTRFMRLPLISVALVQGWALGGGAEFTTACDFRLMTPESKIRFVHKEMGIIPSWGGTTRLVEIIGSRQALKVLSGALKLDSKNALNIGMVEEVLQSSDETKSLEEAQEWLKQFIQGPPEVIRALKKSVCSGRELYLEEALQNERDLLGTVWGGPANLEAIAKKGKFNK

SEQ ID NO: 807220 - protein, 301 aa, Homo sapiens; identical to SEQ ID NO: 807218

SEQ ID NO: 807221 - protein, 145 aa, Homo sapiens
MAKSLLKTASLSGRTKLLHQTGLSLYSTSHGFYEEEVKKTLQQFPGGSIDLQKEDNGIGILTLNNPSRMNAFSGVMMLQLLEKVIELENWTEGKGLIVRGAKNTFSSGSDLNAVKSLGTPETSFNKCCAGSRLGIGWRSRIYYSM

SEQ ID NO: 807222 - protein, 319 aa, Homo sapiens
PWPATDPFQLLPESFAEEMAKSLLKTASLSGRTKLLHQTGLSLYSTSHGFYEEEVKKTLQQFPGGSIDLQKEDNGIGILTLNNPSRMNAFSGVMMLQLLEKVIELENWTEGKGLIVRGAKNTFSSGSDLNAVKSLGTPEDGMAVCMFMQNTLTRFMRLPLISVALVQGWALGGGAEFTTACDFRLMTPESKIRFVHKEMGIIPSWGGTTRLVEIIGSRQALKVLSGALKLDSKNALNIGMVEEVLQSSDETKSLEEAQEWLKQFIQGPPEVIRALKKSVCSGRELYLEEALQNERDLLGTVWGGPANLEAIAKKGKFNK

SEQ ID NO: 807223 - protein, 320 aa, Homo sapiens
MVLPEIRMEKEVTTVACEEMAKSLLKTASLSGRTKLLHQTGLSLYSTSHGFYEEEVKKTLQQFPGGSIDLQKEDNGIGILTLNNPSRMNAFSGVMMLQLLEKVIELENWTEGKGLIVRGAKNTFSSGSDLNAVKSLGTPEDGMAVCMFMQNTLTRFMRLPLISVALVQGWALGGGAEFTTACDFRLMTPESKIRFVHKEMGIIPSWGGTTRLVEIIGSRQALKVLSGALKLDSKNALNIGMVEEVLQSSDETKSLEEAQEWLKQFIQGPPEVIRALKKSVCSGRELYLEEALQNERDLLGTVWGGPANLEAIAKKGKFNK

SEQ ID NO: 807224 - protein, 160 aa, Homo sapiens
LRTLSSFLPESFAEEMAKSLLKTASLSGRTKLLHQTGLSLYSTSHGFYEEEVKKTLQQFPGGSIDLQKEDNGIGILTLNNPSRMNAFSGVMMLQLLEKVIELENWTEGKGLIVRGAKNTFSSGSDLNAVKSLGTPETSFNKCCAGSRLGIGWRSRIYYSM

SEQ ID NO: 807225 - protein, 225 aa, Homo sapiens [sequence omitted]

SEQ ID NO: 807226 - protein, 357 aa, Homo sapiens
MTKALHENRENVVTVVCACCDRYGTAPTIGAAWATNTWLNKLLFDMTRPSRGLGKAHHIIVHIRYTVLSTLYSYIPREFYEETEVKRHTSEVSLVSSPLTVHQGIGQMGHWSIAYSDDNTTVAMQLPFSGVMMLQLLEKVIELENWTEGKGLIVRGAKNTFSSGSDLNAVKSLGTPEDGMAVCMFMQNTLTRFMRLPLISVALVQGWALGGGAEFTTACDFRLMTPESKIRFVHKEMGIIPSWGGTTRLVEIIGSRQALKVLSGALKLDSKNALNIGMVEEVLQSSDETKSLEEAQEWLKQFIQGPPEVIRALKKSVCSGRELYLEEALQNERDLLGTVWGGPANLEAIAKKGKFNK

SEQ ID NO: 807227 - protein, 134 aa, Homo sapiens
MTPESKIRFVHKEMGIIPSWGGTTRLVEIIGSRQALKVLSGALKLDSKNALNIGMVEEVLQSSDETKSLEEAQEWLKQFIQGPPEVIRALKKSVCSGRELYLEEALQNERDLLGTVWGGPANLEAIAKKGKFNK

SEQ ID NO: 807228 - protein, 134 aa, Homo sapiens; identical to SEQ ID NO: 807227

SEQ ID NO: 807229 - protein, 277 aa, Homo sapiens
MAKSLLKTASLSGRTKLLHQTGLSLYSTSHGFYEEEVKKTLQQFPGGSIDLQKEDNGIGILTLNNPSRMNAFSGVMMLQLLEKVIELENWTEGKGLIVRGAKNTFSSGSDLNAVKSLGTPEDGMAVCMFMQNTLTRFMRLPLISVALVQGWALGGGAEFTTACDFRLMTPESKIRFVHKEMGIIPSWGGTTRLVEIIGSRQALKVLSGALKLDSKNALNIGMVEEVLQSSDETKSLEEAQEWLKQFIQGPPEVIRALKKSVCSRNSLGWACKFRGYC

SEQ ID NO: 807230 - protein, 277 aa, Homo sapiens; identical to SEQ ID NO: 807229

SEQ ID NO: 807231 - protein, 139 aa, Homo sapiens
MAKSLLKTASLSGRTKLLHQTGLSLYSTSHGFYEEEVKKTLQQFPGGSIDLQKEDNGIGILTLNNPSRMNAFSGVMMLQLLEKVIELENWTEGKGLIVRGAKNTFSSGSDLNAVKSLGTPEDGMAVCMFMQNTLTRFMR

SEQ ID NO: 807232 - protein, 169 aa, Homo sapiens
MAKSLLKTASLSGRTKLLHQTGLSLYSTSHGFYEEEVKKTLQQFPGGSIDLQKEDNGIGILTLNNPSRMNAFSGVMMLQLLEKVIELENWTEGKGLIVRGAKNTFSSGSDLNAVKSLGTPEDGMAVCMFMQNTLTRFMRLPLISVALVQGWALGGGAEFTTACDFSFRH

SEQ ID NO: 807233 - protein, 139 aa, Homo sapiens; identical to SEQ ID NO: 807231

SEQ ID NO: 807234 - protein, 145 aa, Homo sapiens; identical to SEQ ID NO: 807221

SEQ ID NO: 807235 - protein, 121 aa, Homo sapiens
MMLQLLEKVIELENWTEGKGLIVRGAKNTFSSGSDLNAVKSLGTPEDGMAVCMFMQNTLTRFMRLPLISVAPAQPGPDPHQPKQEEVPLSTCAGCCVPGLRRRPAPAPSPQAFFLIQINVS

SEQ ID NO: 807236 - protein, 139 aa, Homo sapiens; identical to SEQ ID NO: 807231

SEQ ID NO: 807237 - protein, 301 aa, Homo sapiens; identical to SEQ ID NO: 807218

SEQ ID NO: 807238 - protein, 137 aa, Homo sapiens
MAKSLLKTASLSGRTKLLHQTGLSLYSTSHGFYEEEVKKTLQQFPGGSIDLQKEDNGIGILTLNNPSRMNAFSGVMMLQLLEKVIELENWTEGKGLIVRGAKNRWNGRMHVHAKHLNKIYEVKKQRGKILLGLSRYV

SEQ ID NO: 807239 - protein, 139 aa, Homo sapiens; identical to SEQ ID NO: 807231

SEQ ID NO: 807240 - protein, 341 aa, Homo sapiens
MAKSLLKTASLSGRTKLLHQTGLSLYSTSHGFYEEEVKKTLQQFPGGSIDLQKEDNGIGILTLNNPSRMNAFSGVMMLQLLEKVIELENWTEGKGLIVRGAKNTFSSGSDLNAVKSLGTPEESCRWNTEFLYTLHPVSPFINILYSYGWNGRMHVHAKHLNKIYEVKKQRGKILLGLSRLPLISVALVQGWALGGGAEFTTACDFRLMTPESKIRFVHKEMGIIPSWGGTTRLVEIIGSRQALKVLSGALKLDSKNALNIGMVEEVLQSSDETKSLEEAQEWLKQFIQGPPEVIRALKKSVCSGRELYLEEALQNERDLLGTVWGGPANLEAIAKKGKFNK

SEQ ID NO: 807241 - protein, 301 aa, Homo sapiens; identical to SEQ ID NO: 807218

SEQ ID NO: 807242 - protein, 607 aa, Homo sapiens
MDNLSDTLKKLKITAVDKTEDSLEGCLDCLLQALAQNNTETSEKIQASGILQLFASLLTPQSSCKAKVANIIAEVAKNEFMRIPCVDAGLISPLVQLLNSKDQEVLLQTGRALGNICYDSHEGRSAVDQAGGAQIVIDHLRSLCSITDPANEKLLTVFCGMLMNYSNENDSLQAQLINMGVIPTLVKLLGIHCQNAALTEMCLVAFGNLAELESSKEQFASTNIAEELVKLFKKQIEHDKREMIFEVLAPLAENDAIKLQLVEAGLVECLLEIVQQKVDSDKEDDITELKTGSDLMVLLLLGDESMQKLFEGGKGSVFQRVLSWIPSNNHQLQLAGALAIANFARNDANCIHMVDNGIVEKLMDLLDRHVEDGNVTVQHAALSALRNLAIPVINKAKMLSAGVTEAVLKFLKSEMPPVQFKLLGTLRMLIDAQAEAAEQLGKNVKLVERLVEWCEAKDHAGVMGESNRLLSALIRHSKSKDVIKTIVQSGGIKHLVTMATSEHVIMQNEALVALALIAALELGTAEKDLESAKLVQILHRLLADERSAPEIKYNSMVLICALMGSECLHKEVQDLAFLDVVSKLRSHENKSVAQQASLTEQRLTVES

SEQ ID NO: 807243 - protein, 607 aa, Homo sapiens; identical to SEQ ID NO: 807242

SEQ ID NO: 807244 - protein, 558 aa, Homo sapiens
MDNLSDTLKKLKITAVDKTEDSLEGCLDCLLQALAQNNTETSEKIQASGILQLFASLLTPQSSCKAKVANIIAEVAKNEFMRIPCVDAGLISPLVQLLNSKDQEVLLQTGRALGNICYDSHSLQAQLINMGVIPTLVKLLGIHCQNAALTEMCLVAFGNLAELESSKEQFASTNIAEELVKLFKKQIEHDKREMIFEVLAPLAENDAIKLQLVEAGLVECLLEIVQQKVDSDKEDDITELKTGSDLMVLLLLGDESMQKLFEGGKGSVFQRVLSWIPSNNHQLQLAGALAIANFARNDANCIHMVDNGIVEKLMDLLDRHVEDGNVTVQHAALSALRNLAIPVINKAKMLSAGVTEAVLKFLKSEMPPVQFKLLGTLRMLIDAQAEAAEQLGKNVKLVERLVEWCEAKDHAGVMGESNRLLSALIRHSKSKDVIKTIVQSGGIKHLVTMATSEHVIMQNEALVALALIAALELGTAEKDLESAKLVQILHRLLADERSAPEIKYNSMVLICALMGSECLHKEVQDLAFLDVVSKLRSHENKSVAQQASLTEQRLTVES

SEQ ID NO: 807245 - protein, 565 aa, Homo sapiens
MDNLSDTLKKLKITAVDKTEDSLEGCLDCLLQALAQNNTETSEKIQASGILQLFASLLTPQSSCKAKVANIIAEVAKNEFMRIPCVDAGLISPLVQLLNSKDQEVLLQTGRALGNICYDSHEGRSAVDQAGGAQIVIDHLRSLCSITDPANEKLLTVFCGMLMNYSNENDSLQAQLINMGVIPTLVKLLGIHCQNAALTEMCLVAFGNLAELDAIKLQLVEAGLVECLLEIVQQKVDSDKEDDITELKTGSDLMVLLLLGDESMQKLFEGGKGSVFQRVLSWIPSNNHQLQLAGALAIANFARNDANCIHMVDNGIVEKLMDLLDRHVEDGNVTVQHAALSALRNLAIPVINKAKMLSAGVTEAVLKFLKSEMPPVQFKLLGTLRMLIDAQAEAAEQLGKNVKLVERLVEWCEAKDHAGVMGESNRLLSALIRHSKSKDVIKTIVQSGGIKHLVTMATSEHVIMQNEALVALALIAALELGTAEKDLESAKLVQILHRLLADERSAPEIKYNSMVLICALMGSECLHKEVQDLAFLDVVSKLRSHENKSVAQQASLTEQRLTVES

SEQ ID NO: 807246 - protein, 607 aa, Homo sapiens; identical to SEQ ID NO: 807242

SEQ ID NO: 807247 - protein, 515 aa, Homo sapiens
MDNLSDTLKKLKITAVDKTEDSLEGCLDCLLQALAQNNTETSEKIQASGILQLFASLLTPQSSCKAKVANIIAEVAKNEFMRIPCVDAGLISPLVQLLNSKDQEVLLQTGRALGNICYDSQSSKEQFASTNIAEELVKLFKKQIEHDKREMIFEVLAPLAENDAIKLQLVEAGLVECLLEIVQQKVDSDKEDDITELKTGSDLMVLLLLGDESMQKLFEGGKGSVFQRVLSWIPSNNHQLQLAGALAIANFARNDANCIHMVDNGIVEKLMDLLDRHVEDGNVTVQHAALSALRNLAIPVINKAKMLSAGVTEAVLKFLKSEMPPVQFKLLGTLRMLIDAQAEAAEQLGKNVKLVERLVEWCEAKDHAGVMGESNRLLSALIRHSKSKDVIKTIVQSGGIKHLVTMATSEHVIMQNEALVALALIAALELGTAEKDLESAKLVQILHRLLADERSAPEIKYNSMVLICALMGSECLHKEVQDLAFLDVVSKLRSHENKSVAQQASLTEQRLTVES

SEQ ID NO: 807248 - protein, 258 aa, Homo sapiens
MDNLSDTLKKLKITAVDKTEDSLEGCLDCLLQALAQNNTETSEKIQASGILQLFASLLTPQSSCKAKVANIIAEVAKNEFMRIPCVDAGLISPLVQLLNSKDQEVLLQTGRALGNICYDSHEGRSAVDQAGGAQIVIDHLRSLCSITDPANEKLLTVFCGMLMNYSNENDSLQAQLINMGVIPTLVKLLGIHCQNAALTEMCLVAFGNLAELESSKEQFASTNIAEELVKLFKKQIEHDKREMIFEVLAPLAENGKQD

SEQ ID NO: 807249 - protein, 224 aa, Homo sapiens
MDNLSDTLKKLKITAVDKTEDSLEGCLDCLLQALAQNNTETSEKIQASGILQLFASLLTPQSSCKAKVANIIAEVAKNEFMRIPCVDAGLISPLVQLLNSKDQEVLLQTGRALGNICYDSHEGRSAVDQAGGAQIVIDHLRSLCSITDPANEKLLTVFCGMLMNYSNENDSLQAQLINMGVIPTLVKLLGIHCQNAALTEMCLVAFGNLAELGKLETKNAAGSV

SEQ ID NO: 807250 - protein, 215 aa, Homo sapiens [sequence omitted]

SEQ ID NO: 807251 - protein, 141 aa, Homo sapiens
MDNLSDTLKKLKITAVDKTEDSLEGCLDCLLQALAQNNTETSEKIQASGILQLFASLLTPQSSCKAKVANIIAEVAKNEFMRIPCVDAGLISPLVQLLNSKDQEVLLQTGRALGNICYDSQSCKALHLCISLSKYPNRLLI

SEQ ID NO: 807252 - protein, 173 aa, Homo sapiens
MDNLSDTLKKLKITAVDKTEDSLEGCLDCLLQALAQNNTETSEKIQASGILQLFASLLTPQSSCKAKVANIIAEVAKNEFMRIPCVDAGLISPLVQLLNSKDQEVLLQTGRALGNICYDSHEGRSAVDQAGGAQIVIDHLRSLCSITDPANEKLLTVFCGMLMNYSNENGKQN

SEQ ID NO: 807253 - protein, 179 aa, Homo sapiens
LSHSRSDALGHILPQLGKDWTHQGITSLYHKIQLNGYKFLYCSARAIGMADLTKGYLQGEVIEKKPEVFKVACLSDIQQLFLPHGQPFYAAFGNRPNDVFAYRQVGLPESRIFTVNPRGELIQELIKNHKSTYERLGEVVELLFPPVARGPSTDLANPEYSNFCYWREPLPAVDLDTLD

SEQ ID NO: 807254 - protein, 184 aa, Homo sapiens
MAEVVLGVHEVSSETNRCSSTASSVCTRGRADLPGEALSWLSSPANVARRSSRLCTRSSSMVPKPPTPHPPMSNLRQHPLAPPSVPLSVSRPSSSPSTPPSSMAAESLVSSSPAGAPGPLWVSVTACRALSRPSIRALIKASCPQQLPLPDTLRPCSWLPSCDSSWRRASSRPSRLWCSLRLAA

SEQ ID NO: 807255 - protein, 159 aa, Homo sapiens
ESLSSPCGRQCGGIPEPAIPSGFFPTLAPFPAVVLATPGEVIEKKPEVFKVACLSDIQQLFLPHGQPFYAAFGNRPNDVFAYRQVGLPESRIFTVNPRGELIQELIKNHKSTYERLGEVVELLFPPVARGPSTDLANPEYSNFCYWREPLPAVDLDTLD

SEQ ID NO: 807256 - protein, 159 aa, Homo sapiens; identical to SEQ ID NO: 807255

SEQ ID NO: 807257 - protein, 159 aa, Homo sapiens; identical to SEQ ID NO: 807255

SEQ ID NO: 807258 - protein, 139 aa, Homo sapiens
LPKGPILLSPSSLFSALHREVIEKKPEVFKVACLSDIQQLFLPHGQPFYAAFGNRPNDVFAYRQVGLPESRIFTVNPRGELIQELIKNHKSTYERLGEVVELLFPPVARGPSTDLANPEYSNFCYWREPLPAVDLDTLD

SEQ ID NO: 807259 - protein, 134 aa, Homo sapiens
MAPQALSGPQWLSGQAVQARGQQAQPPARTLHLCHPLVKVSHCVLKFLGCVLAAAQPTGHLGHTSLELLQLPTQVQDLPVASLKPGALAADLLLDGLDFGFHLAFPLIQGRVGSQEGIRVLADRVTEACERLAH

SEQ ID NO: 807260 - protein, 53 aa, Homo sapiens
MGPSCLPQDVFAYRQVGLPESRIFTVNPRGELIQELIKNHKSTVRLNPAMFPM

SEQ ID NO: 807261 - protein, 730 aa, Homo sapiens [sequence omitted]

SEQ ID NO: 807262 - protein, 2217 aa, Homo sapiens
QAGTRDVMDLEKKLSSERPSSDGEGVVENGITTCNGKEQVKRKKSSKSEAKGTVSKVTGKKITKIISLGKKKPSTDEQTSSAEEDVPTCGYLNVLSNSRWRERWCRVKDNKLIFHKDRTDLKTHIVSIPLRGCEVIPGLDSKHPLTFRLLRNGQEVAVLEASSSEDMGRWIGILLAETGSSTDPEALHYDYIDVEMSASVIQTAKQTFCFMNRRVISANPYLGGTSNGYAHPSGTALHYDDVPCINGSLKGKKPPVASNGVTGKGKTLSSQPKKADPAAVVKRTGSNAAQYKYGKNRVEADAKRLQTKEEELLKRKEALRNRLAQLRKERKDLRAAIEVNAGMKGVGDCPGCMFVLETGDFILLCPKDLLLTKAVILFSKSGLSHSVSWGLETLLVTPRQVPVWSNMRRAGRGQGQTHTLLTEAGEVLGDLFRLLALTTEIVWRMAPVSAGRSRFWSPGRRDQLDFSTEGSPQGSVIFRSPDKGRSSPSFVEKGQARARQHLSWDASGKRPGYMEYRHQRGTEVTETEFAARVAALGQARAIPAGGSWRSAPEPGVAPLTYAWPALPARCLDYGRLLLRLRLYWPGLGRGLQMPQSPGRSREEAVAFPWLAARGGADAHPAGGYQLQPCWTLCLNDLMKGNAFGFRGGKAGVGRAGQADPIGGPGCGLQSEADPTGGGCAREWDGAWSLMRQKKHFSRVPSLQDSEDAGGPGVLLALKKRTSPAGHHRPRPGHKSVHLLGLVFSSAQWVHLRSLQQTSNKISECALKKCVPCPVEMQAELLFIASGANKMTEGSAELRGGQGSHSKKVAALGTVEFEGPRFKMRTLRPRARSSWPSSESASPLSWSESSTAAAKGNGRRRTLIPERTAEFKFHNEDLKSGELDLRRFVEVLLGDQVPSLLFGEPVPAAGVTAFLGIPGRKPQAILEEKLKQLEEECRQKEAERVSLELELTEVKESLKKALAGGVTLGLAIEPKSGTSSPQSPVFRHRTLENSPISSCDTSDTEGPVPVNSAAVLKKSQAAPGSSPCRRACAAEGQGMGIEERDLGDSSTTPASETAHPLACILICVTAGSSAQSGLSCTTPEAPRLSSEASACPPGPLVFFSTVKWRLYKRCKTLVPNFVKKQKKVMERCLKGCYQAKRHLSNQIGHCFHRFQPSPGLRMDGSMSPQMKTWIRQGRAWIPGCPGHECGWPWALGSPCTPTRRARGIRSPDVDFVSVAYPLHVPVPLVIRGKGMRKSRCETFFTFYYYFLDRCFCHQDMKSCHSSYLFFKNVFLLCVTLRSRSFQRFLILLINYLCCFCQVAEGFNTSLTVHPPPPWASIPSPYIHVGAGRCFSHQEPLGAGAGSSPLYRTFTAAWGQGSPLKGKQVPEFVPSWNYNTLEQEAGIPGPPAPPLPPACQVKPPNVLVGLAVLPLLSRVGASRASFPAFLLAFCAIFLGEFGCQGIKEKNRVHSLSWYLPPGFKNQINFLVSRRLLSGILQYGKMQSLMTKEVTPERLRRQIHGDQSQVATAPSPSIEYRGAILGVSLPSVHCPECPFSHRGRDGGKTLTDSLGFPQTYFQSASCVVHGTLQLGFMFKVGRLSLQGPRWITEAESGLPCIRKSFTTRIGSCLSPPELELIAKPSAGNGFGFLSHQPAFLSPLMHVPPGLVREAHHTSIRDASFPLGHPGRSGGDATRLRAVRCIAIEEPSLQWSLPTIAGRLPTIAGSWAHFISHKMNFLYREKSLLLHRFLLPSGQIVSLVDALGPLCLAACFAKENCVRFWWLVREGGDGQPEVTVLAQHRWAAASWQVKCEQHAKCHVGLSQSPTSFLTRQGGPGALAGTCPTAQLIGARLPACIFCCKNPEFVIHIHNPKPFKAEANVNEPHRGPWSLSKWVPWRGLTVGSFHGGYSLEISHSIKVYKHLLQNKLFMCICSINIVFNLYLYILDTREPSCQNSDSDVILFPSQNMPQEQAPLASVAAASVSDFINEARLRARGPTGRPGSPEKPDFFAMSLVLSRWSCSQGLATCTTVPTAMRGMWWPRDGAGRRTGQVRGPTPAGLRAPSILTLSHSVTLQGSAPGSILLSVISLQPPFIYFYNVKPLTNFFIETTIRFEGSLCPPDLGTGMGHGSLFPESAGNWGKAHLSARLVALSLGFQSPRQLQGNQCGSAESPQAPDLPQEHGPLSMGPSLRPSLGAGGRRLTSWVSPISPLCAYALALPGLTFPCILLIPELLLAISK

SEQ ID NO: 807263 - protein, 121 aa, Homo sapiens
MHPGLGTGMGHGSLFPESAGNWGKAHLSARLVALSLGFQSPRQLQGNQCGSAESPQAPDLPQEHGPLSMGPSLRPSLGAGGRRLTSWVSPISPLCAYALALPGLTFPCILLIPELLLAISK

SEQ ID NO: 807264 - protein, 512 aa, Homo sapiens
QAGTRDVMDLEKKLSSERPSSDGEGVVENGITTCNGKEQVKRKKSSKSEAKGTVSKVTGKKITKIISLGKKKPSTDEQTSSAEEDVPTCGYLNVLSNSRWRERWCRVKDNKLIFHKDRTDLKTHIVSIPLRGCEVIPGLDSKHPLTFRLLRNGQEVAVLEASSSEDMGRWIGILLAETGSSTDPEALHYDYIDVEMSASVIQTAKQTFCFMNRRVISANPYLGGTSNGYAHPSGTALHYDDVPCINGSLKGKKPPVASNGVTGKGKTLSSQPKKADPAAVVKRTGSNAAQYKYGKNRVEADAKRLQTKEEELLKRKEALRNRLAQLRKERKDLRAAIEVNAGMKGVGDCPGCMFVLETGDFILLCPKDLLLTKAVILFSKSGLSHSVSWGLETLLVTPRQVPVWSNMRRAGRGQGQTHTLLTEAGEVLGDLFRLLALTTEIVWRMAPVSAGRSRFWSPGRRDQLDFSTEGSPQGSVIFRSPDKGRSSPSFVEKGQARARQHLSWDASGKRPG

SEQ ID NO: 807265 - protein, 512 aa, Homo sapiens; identical to SEQ ID NO: 807264

SEQ ID NO: 807266 - protein, 121 aa, Homo sapiens
QAGTRDVMDLEKKLSSERPSSDGEGVVENGITTCNGKEQVKRKKSSKSEAKGTVSKVTGKKITKIISLGKKKPSTDEQTSSAEEDVPTCGKTALPGDEQRAPKWVSFSPAVVSVPSSSKAR

SEQ ID NO: 807267 - protein, 2217 aa, Homo sapiens; identical to SEQ ID NO: 807262

SEQ ID NO: 807268 - protein, 165 aa, Homo sapiens
MSQATKRKHVVKEVLGEHIVPSDQQQIVRVLRTPGNNLHEVETAQGQRFLVSMPSKYRKNIWIKRGDFLIVDPIEEGEKVKAEISFVLCKDHVRSLQKEGFWPEAFSEVAEKHNNRNRQTQPELPAEPQLSGEESSSEDDSDLFVNTNRRQYHESEEESEEEEAA

SEQ ID NO: 807269 - protein, 165 aa, Homo sapiens; identical to SEQ ID NO: 807268

SEQ ID NO: 807270 - protein, 165 aa, Homo sapiens; identical to SEQ ID NO: 807268

SEQ ID NO: 807271 - protein, 165 aa, Homo sapiens; identical to SEQ ID NO: 807268

SEQ ID NO: 807272 - protein, 113 aa, Homo sapiens
MPSKYRKNIWIKRGDFLIVDPIEEGEKVKAEISFVLCKDHVRSLQKEGFWPEAFSEVAEKHNNRNRQTQPELPAEPQLSGEESSSEDDSDLFVNTNRRQYHESEEESEEEEAA

SEQ ID NO: 807273 - protein, 165 aa, Homo sapiens; identical to SEQ ID NO: 807268

SEQ ID NO: 807274 - protein, 165 aa, Homo sapiens; identical to SEQ ID NO: 807268

SEQ ID NO: 807275 - protein, 165 aa, Homo sapiens; identical to SEQ ID NO: 807268

SEQ ID NO: 807276 - protein, 176 aa, Homo sapiens
MSQATKRKHVVKEVLGEHIVPSDQQQIVRVLRTPGNNLHEVETAQGQRFLVSMPSKYRKNIWIKRGDFLIVDPIEEGEKVKAEISFVLCKDHVRSLQKEGFWPEAFSEVAEKHNNRNRQIHQNPSEPQVSGEDPDQKSSDLSYTTGDDLKGLGIQEGGGIRPFLSEAGLGGTRAFP

SEQ ID NO: 807277 - protein, 149 aa, Homo sapiens
METSSRELQAAEYLEKHQIKEVVSYLTSALLFFRPEKPKEYLISLLERLRIAKVTGVAFPFFMDNSNIVAMFEMMDSSGRGTISFVQYKEALKTLGLCTEDEDLQDDGHKITLDKFKEEVNKRMKEICEKTKGKDSESYQTAAGLLLLH

SEQ ID NO: 807278 - protein, 131 aa, Homo sapiens
METSSRELQAAEYLEKHQIKEVVSYLTSALLFFRPEKPKEYLISLLERLRIAKVTGVAFPFFMDNSNIVAMFEMMDSSGRGTISFVQYKEALKTLGLCTEDEDLQDDGHKITLDKFKEEVNKRMKEIWSAF

SEQ ID NO: 807279 - protein, 959 aa, Homo sapiens [sequence omitted]

SEQ ID NO: 807280 - protein, 440 aa, Homo sapiens
VSRRAHTGTLDPPESRLVCSGRRLTQRRAVGSAGHLAGVGGGPLSCPSFHSATTVATPWGGDVGHHGLGSKRLLQHRKPKLGSGEVATPERVPPEIYNRMDPRAQTPVPGKGPFGREELLRRKLIHDGCLLWKTATGRFKDVLVLLMTDVLVFLQEKDQKYIFPTLDKPSVVSLQNLIVRDIANQEKGMFLISAAPPEMYEVHTASRDDRSTWIRVIQQSVRTCPSREDFPLIETEDEAYLRRIKMELQQKDRALVELLREKVGLFAEMTHFQAEEDGGSGMALPTLPRGLFRSESLESPRGERLLQDAIREVEGLKDLLVGPGVELLLTPREPALPLEPDSGGNTSPGVTANGEARTFNGSIELCRADSDSSQRDRNGNQLRSPQEEALQRLVNLYGLLHGLQAAVAQQDTLMEARFPEGPERREKLCRANSPQAMPCT

SEQ ID NO: 807281 - protein, 1029 aa, Homo sapiens
GRGESDFLSPRPTRAGRTPPPAFPQQYRTPGSAPRPPWSPRPIMSRIESLTRARIDRSRELASKTREKEKMKEAKDARYTNGHLFTTISVSGMTMCYACNKSITAKEALICPTCNVTIHNRCKDTLANCTKVKQKQQKAALLKNNTALQSVSLRSKTTIRERPSSAIYPSDSFRQSLLGSRRGRSSLSLAKSVSTTNIAGHFNDESPLGLRRILSQSTDSLNMRNRTLSVESLIDEAEVIYSELMSDFEMDEKDFAADSWSLAVDSSFLQQHKKEVMKQQDVIYELIQTELHHVRTLKIMTRLFRTGMLEELHLEPGVVQGLFPCVDELSDIHTRFLSQLLERRRQALCPGSTRNFVIHRLGDLLISQFSGPSAEQMCKTYSEFCSRHSKALKLYKELYARDKRFQQFIRKVTRPAVLKRHGVQECILLVTQRITKYPLLISRILQHSHGIEEERQDLTTALGLVKELLSNVDEGIYQLEKGARLQEIYNRMDPRAQTPVPGKGPFGREELLRRKLIHDGCLLWKTATGRFKDVLVLLMTDVLVFLQEKDQKYIFPTLDKPSVVSLQNLIVRDIANQEKGMFLISAAPPEMYEVHTASRDDRSTWIRVIQQSVRTCPSREDFPLIETEDEAYLRRIKMELQQKDRALVELLREKVGLFAEMTHFQAEEDGGSGMALPTLPRGLFRSESLESPRGERLLQDAIREVEGLKDLLVGPGVELLLTPREPALPLEPDSGGNTSPGVTANGEARTFNGSIELCRADSDSSQRDRNGNQLRSPQEEALQRLVNLYGLLHGLQAAVAQQDTLMEARFPEGPERREKLCRANSRDGEAGRAGAAPVAPEKQATELALLQRQHALLQEELRRCRRLGEERATEAGSLEARLRESEQARALLEREAEEARRQLAALGQTEPLPAEAPWARRPVDPRRRSLPAGDALYLSFNPPQPSRGTDRLDLPVTTRSVHRNFEDRERQELGSPEERLQDSSDPDTGSEEEGSSRLSPPHSPRDFTRMQDIPEETESRDGEAVASES

SEQ ID NO: 807282 - protein, 1029 aa, Homo sapiens; identical to SEQ ID NO: 807281

SEQ ID NO: 807283 - protein, 1024 aa, Homo sapiens
MKEAKDARYTNGHLFTTISVSGMTMCYACNKSITAKEALICPTCNVTIHNRCKDTLANCTKVKQKQQKAALLKNNTALQSVSLRSKTTIRERPSSAIYPSDSFRQSLLGSRRGRSSLSLAKSVSTTNIAGHFNDESPLGLRRILSQSTDSLNMRNRTLSVESLIDEAEVIYSELMSDFEMDEKDFAADSWSLAVDSSFLQQHKKEVMKQQDVIYELIQTELHHVRTLKIMTRLFRTGMLEELHLEPGVVQGLFPCVDELSDIHTRFLSQLLERRRQALCPGSTRNFVIHRLGDLLISQFSGPSAEQMCKTYSEFCSRHSKALKLYKELYARDKRFQQFIRKVTRPAVLKRHGVQECILLVTQRITKYPLLISRILQHSHGEEAGPGEGHWETATWGEERLGMTTGRVGSGVKPWAASKGGIKTRWELGCERNWLSRSPCQPPVPGIEEERQDLTTALGLVKELLSNVDEGIYQLEKGARLQEIYNRMDPRAQTPVPGKGPFGREELLRRKLIHDGCLLWKTATGRFKDVLVLLMTDVLVFLQEKDQKYIFPTLDKPSVVSLQNLIVRDIANQEKGMFLISAAPPEMYEVHTASRDDRSTWIRVIQQSVRTCPSREDFPLIETEDEAYLRRIKMELQQKDRALVELLREKVGLFAEMTHFQAEEDGGSGMALPTLPRGLFRSESLESPRGERLLQDAIREVEGLKDLLVGPGVELLLTPREPALPLEPDSGGNTSPGVTANGEARTFNGSIELCRADSDSSQRDRNGNQLRSPQEEALQRLVNLYGLLHGLQAAVAQQDTLMEARFPEGPERREKLCRANSRDGEAGRAGAAPVAPEKQATELALLQRQHALLQEELRRCRRLGEERATEAGSLEARLRESEQARALLEREAEEARRQLAALGQTEPLPAEAPWARRPVDPRRRSLPAGDALYLSFNPPQPSRGTDRLDLPVTTRSVHRNFEDRERQELGSPEERLQDSSDPDTGSEEEGSSRLSPPHSPRDFTRMQDIPEETESRDGEAVASES

SEQ ID NO: 807284 - protein, 875 aa, Homo sapiens
NYSAELRNASAVMKNQVARFNDLRFVGRSGRGKSFTLTITVFTNPTQVATYHRAIKVTVDGPREPRREMRNRTLSVESLIDEAEVIYSELMSDFEMDEKDFAADSWSLAVDSSFLQQHKKEVMKQQDVIYELIQTELHHVRTLKIMTRLFRTGMLEELHLEPGVVQGLFPCVDELSDIHTRFLSQLLERRRQALCPGSTRNFVIHRLGDLLISQFSGPSAEQMCKTYSEFCSRHSKALKLYKELYARDKRFQQFIRKVTRPAVLKRHGVQECILLVTQRITKYPLLISRILQHSHGIEEERQDLTTALGLVKELLSNVDEGIYQLEKGARLQEIYNRMDPRAQTPVPGKGPFGREELLRRKLIHDGCLLWKTATGRFKDVLVLLMTDVLVFLQEKDQKYIFPTLDKPSVVSLQNLIVRDIANQEKGMFLISAAPPEMYEVHTASRDDRSTWIRVIQQSVRTCPSREDFPLIETEDEAYLRRIKMELQQKDRALVELLREKVGLFAEMTHFQAEEDGGSGMALPTLPRGLFRSESLESPRGERLLQDAIREVEGLKDLLVGPGVELLLTPREPALPLEPDSGGNTSPGVTANGEARTFNGSIELCRADSDSSQRDRNGNQLRSPQEEALQRLVNLYGLLHGLQAAVAQQDTLMEARFPEGPERREKLCRANSRDGEAGRAGAAPVAPEKQATELALLQRQHALLQEELRRCRRLGEERATEAGSLEARLRESEQARALLEREAEEARRQLAALGQTEPLPAEAPWARRPVDPRRRSLPAGDALYLSFNPPQPSRGTDRLDLPVTTRSVHRNFEDRERQELGSPEERLQDSSDPDTGSEEEGSSRLSPPHSPRDFTRMQDIPEETESRDGEAVASES

SEQ ID NO: 807285 - protein, 807 aa, Homo sapiens
MRNRTLSVESLIDEAEVIYSELMSDFEMDEKDFAADSWSLAVDSSFLQQHKKEVMKQQDVIYELIQTELHHVRTLKIMTRLFRTGMLEELHLEPGVVQGLFPCVDELSDIHTRFLSQLLERRRQALCPGSTRNFVIHRLGDLLISQFSGPSAEQMCKTYSEFCSRHSKALKLYKELYARDKRFQQFIRKVTRPAVLKRHGVQECILLVTQRITKYPLLISRILQHSHGIEEERQDLTTALGLVKELLSNVDEGIYQLEKGARLQEIYNRMDPRAQTPVPGKGPFGREELLRRKLIHDGCLLWKTATGRFKDVLVLLMTDVLVFLQEKDQKYIFPTLDKPSVVSLQNLIVRDIANQEKGMFLISAAPPEMYEVHTASRDDRSTWIRVIQQSVRTCPSREDFPLIETEDEAYLRRIKMELQQKDRALVELLREKVGLFAEMTHFQAEEDGGSGMALPTLPRGLFRSESLESPRGERLLQDAIREVEGLKDLLVGPGVELLLTPREPALPLEPDSGGNTSPGVTANGEARTFNGSIELCRADSDSSQRDRNGNQLRSPQEEALQRLVNLYGLLHGLQAAVAQQDTLMEARFPEGPERREKLCRANSRDGEAGRAGAAPVAPEKQATELALLQRQHALLQEELRRCRRLGEERATEAGSLEARLRESEQARALLEREAEEARRQLAALGQTEPLPAEAPWARRPVDPRRRSLPAGDALYLSFNPPQPSRGTDRLDLPVTTRSVHRNFEDRERQELGSPEERLQDSSDPDTGSEEEGSSRLSPPHSPRDFTRMQDIPEETESRDGEAVASES

SEQ ID NO: 807286 - protein, 807 aa, Homo sapiens
NDGPQLTVESLIDEAEVIYSELMSDFEMDEKDFAADSWSLAVDSSFLQQHKKEVMKQQDVIYELIQTELHHVRTLKIMTRLFRTGMLEELHLEPGVVQGLFPCVDELSDIHTRFLSQLLERRRQALCPGSTRNFVIHRLGDLLISQFSGPSAEQMCKTYSEFCSRHSKALKLYKELYARDKRFQQFIRKVTRPAVLKRHGVQECILLVTQRITKYPLLISRILQHSHGIEEERQDLTTALGLVKELLSNVDEGIYQLEKGARLQEIYNRMDPRAQTPVPGKGPFGREELLRRKLIHDGCLLWKTATGRFKDVLVLLMTDVLVFLQEKDQKYIFPTLDKPSVVSLQNLIVRDIANQEKGMFLISAAPPEMYEVHTASRDDRSTWIRVIQQSVRTCPSREDFPLIETEDEAYLRRIKMELQQKDRALVELLREKVGLFAEMTHFQAEEDGGSGMALPTLPRGLFRSESLESPRGERLLQDAIREVEGLKDLLVGPGVELLLTPREPALPLEPDSGGNTSPGVTANGEARTFNGSIELCRADSDSSQRDRNGNQLRSPQEEALQRLVNLYGLLHGLQAAVAQQDTLMEARFPEGPERREKLCRANSRDGEAGRAGAAPVAPEKQATELALLQRQHALLQEELRRCRRLGEERATEAGSLEARLRESEQARALLEREAEEARRQLAALGQTEPLPAEAPWARRPVDPRRRSLPAGDALYLSFNPPQPSRGTDRLDLPVTTRSVHRNFEDRERQELGSPEERLQDSSDPDTGSEEEGSSRLSPPHSPRDFTRMQDIPEETESRDGEAVASES

SEQ ID NO: 807287 - protein, 566 aa, Homo sapiens
MKEAKDARYTNGHLFTTISVSGMTMCYACNKSITAKEALICPTCNVTIHNRCKDTLANCTKVKQKQQKAALLKNNTALQSVSLRSKTTIRERPSSAIYPSDSFRQSLLGSRRGRSSLSLAKSVSTTNIAGHFNDESPLGLRRILSQSTDSLNMRNRTLSVESLIDEAEVIYSELMSDFEMDEKDFAADSWSLAVDSSFLQQHKKEVMKQQDVIYELIQTELHHVRTLKIMTRLFRTGMLEELHLEPGVVQGLFPCVDELSDIHTRFLSQLLERRRQALCPGSTRNFVIHRLGDLLISQFSGPSAEQMCKTYSEFCSRHSKALKLYKELYARDKRFQQFIRKVTRPAVLKRHGVQECILLVTQRITKYPLLISRILQHSHGIEEERQDLTTALGLVKELLSNVDEGIYQLEKGARLQEIYNRMDPRAQTPVPGKGPFGREELLRRKLIHDGCLLWKTATGRFKDVLVLLMTDVLVFLQEKDQKYIFPTLDKPSVVSLQNLIVRDIANQEKGMFLISAAPPEMYEVHTASRDDRSTWIRVIQQSVRTGVAAEGPGTGGAAAREGRAVC

SEQ ID NO: 807288 - protein, 1029 aa, Homo sapiens; identical to SEQ ID NO: 807281

SEQ ID NO: 807289 - protein, 1029 aa, Homo sapiens; identical to SEQ ID NO: 807281

SEQ ID NO: 807290 - protein, 969 aa, Homo sapiens
MKEAKDARYTNGHLFTTISVSGMTMCYACNKSITAKEALICPTCNVTIHNRCKDTLANCTKVKQKQQKAALLKNNTALQSVSLRSKTTIRERPSSAIYPSDSFRQSLLGSRRGRSSLSLAKSVSTTNIAGHFNDESPLGLRRILSQSTDSLNMRNRTLSVESLIDEAEVIYSELMSDFEMDEKDFAADSWSLAVDSSFLQQHKKEVMKQQDVIYELIQTELHHVRTLKIMTRLFRTGMLEELHLEPGVVQGLFPCVDELSDIHTRFLSQLLERRRQALCPGSTRNFVIHRLGDLLISQFSGPSAEQMCKTYSEFCSRHSKALKLYKELYARDKRFQQFIRKVTRPAVLKRHGVQECILLVTQRITKYPLLISRILQHSHGIEEERQDLTTALGLVKELLSNVDEGIYQLEKGARLQEIYNRMDPRAQTPVPGKGPFGREELLRRKLIHDGCLLWKTATGRFKDVLVLLMTDVLVFLQEKDQKYIFPTLDKPSVVSLQNLIVRDIANQEKGMFLISAAPPEMYEVHTASRDDRSTWIRVIQQSVRTCPSREDFPLIETEDEAYLRRIKMELQQKDRALVELLREKVGLFAEMTHFQAEEDGGSGMALPTLPRGLFRSESLESPRGERLLQDAIREVEGLKDLLVGPGVELLLTPREPALPLEPDSGGNTSPGVTANGEARTFNGSIELCRADSDSSQRDRNGNQLRSPQEEALQRLVNLYGLLHGLQAAVAQQDTLMEARFPEGPERREKLCRANSRDGEAGRAGAAPVAPEKQATELALLQRQHALLQEELRRCRRLGEERATEAGSLEARLRESEQARALLEREAEEARRQLAALGQTEPLPAEAPWARRPVDPRRRSLPAGDALYLSFNPPQPSRGTDRLDLPVTTRSVHRNFEDRERQELGSPEERLQDSSDPDTGSEEEGSSRLSPPHSPRGETLAETWTRDFTRMQDIPEETESRDGEAVASES

SEQ ID NO: 807291 - protein, 765 aa, Homo sapiens
MKEAKDARYTNGHLFTTISVSGMTMCYACNKSITAKEALICPTCNVTIHNRCKDTLANCTKVKQKQQKAALLKNNTALQSVSLRSKTTIRERPSSAIYPSDSFRQSLLGSRRGRSSLSLAKSVSTTNIAGHFNDESPLGLRRILSQSTDSLNMRNRTLSVESLIDEAEVIYSELMSDFEMDEKDFAADSWSLAVDSSFLQQHKKEVMKQQDVIYELIQTELHHVRTLKIMTRLFRTGMLEELHLEPGVVQGLFPCVDELSDIHTRFLSQLLERRRQALCPGSTRNFVIHRLGDLLISQFSGPSAEQMCKTYSEFCSRHSKALKLYKELYARDKRFQQFIRKVTRPAVLKRHGVQECILLVTQRITKYPLLISRILQHSHGIEEERQDLTTALGLVKELLSNVDEGIYQLEKGARLQEIYNRMDPRAQTPVPGKGPFGREELLRRKLIHDGCLLWKTATGRFKDVLVLLMTDVLVFLQEKDQKYIFPTLDKPSVVSLQNLIVRDIANQEKGMFLISAAPPEMYEVHTASRDDRSTWIRVIQQSVRTCPSREDFPLIETEDEAYLRRIKMELQQKDRALVELLREKVGLFAEMTHFQAEEDGGSGMALPTLPRGLFRSESLESPRGERLLQDAIREVEGLKDLLVGPGVELLLTPREPALPLEPDSGGNTSPGVTANGEARTFNGSIELCRADSDSSQRDRNGNQLRSPQEEALQRLVNLYGLLHGLQAAVAQQDKEIWTESPDRWQLPTRSIRTNHAGLINCLIRK

SEQ ID NO: 807292 - protein, 535 aa, Homo sapiens
MKEAKDARYTNGHLFTTISVSGMTMCYACNKSITAKEALICPTCNVTIHNRCKDTLANCTKVKQKQQKAALLKNNTALQSVSLRSKTTIRERPSSAIYPSDSFRQSLLGSRRGRSSLSLAKSVSTTNIAGHFNDESPLGLRRILSQSTDSLNMRNRTLSVESLIDEAEVIYSELMSDFEMDEKDFAADSWSLAVDSSFLQQHKKEVMKQQDVIYELIQTELHHVRTLKIMTRLFRTGMLEELHLEPGVVQGLFPCVDELSDIHTRFLSQLLERRRQALCPGSTRNFVIHRLGDLLISQFSGPSAEQMCKTYSEFCSRHSKALKLYKELYARDKRFQQFIRKVTRPAVLKRHGVQECILLVTQRITKYPLLISRILQHSHGIEEERQDLTTALGLVKELLSNVDEGIYQLEKGARLQEIYNRMDPRAQTPVPGKGPFGREELLRRKLIHDGCLLWKTATGRFKDVLVLLMTDVLVFLQEKDQKYIFPTLVRHSFFTFLSTDKCFSLFLLSCPSPRELWSPPESNSYNCYYYRNNKK

SEQ ID NO: 807293 - protein, 381 aa, Homo sapiens
MKEAKDARYTNGHLFTTISVSGMTMCYACNKSITAKEALICPTCNVTIHNRCKDTLANCTKVKQKQQKAALLKNNTALQSVSLRSKTTIRERPSSAIYPSDSFRQSLLGSRRGRSSLSLAKSVSTTNIAGHFNDESPLGLRRILSQSTDSLNMRNRTLSVESLIDEAEVIYSELMSDFEMDEKDFAADSWSLAVDSSFLQQHKKEVMKQQDVIYELIQTELHHVRTLKIMTRLFRTGMLEELHLEPGVVQGLFPCVDELSDIHTRFLSQLLERRRQALCPGSTRNFVIHRLGDLLISQFSGPSAEQMCKTYSEFCSRHSKALKLYKELYARDKRFQQFIRKVTRPAVLKRHGVQECILLVTQRITKYPLLISRILQHSHGE

SEQ ID NO: 807294 - protein, 994 aa, Homo sapiens
LGSAHAGMCCCCGCCPLLAHLEQGSLRERTREKEKMKEAKDARYTNGHLFTTISVSGMTMCYACNKSITAKEALICPTCNVTIHNRCKDTLANCTKVKQKQQKAALLKNNTALQSVSLRSKTTIRERPSSAIYPSDSFRQSLLGSRRGRSSLSLAKSVSTTNIAGHFNDESPLGLRRILSQSTDSLNMRNRTLSVESLIDEAEVIYSELMSDFEMDEKDFAADSWSLAVDSSFLQQHKKEVMKQQDVIYELIQTELHHVRTLKIMTRLFRTGMLEELHLEPGVVQGLFPCVDELSDIHTRFLSQLLERRRQALCPGSTRNFVIHRLGDLLISQFSGPSAEQMCKTYSEFCSRHSKALKLYKELYARDKRFQQFIRKVTRPAVLKRHGVQECILLVTQRITKYPLLISRILQHSHGIEEERQDLTTALGLVKELLSNVDEGIYQLEKGARLQEIYNRMDPRAQTPVPGKGPFGREELLRRKLIHDGCLLWKTATGRFKDVLVLLMTDVLVFLQEKDQKYIFPTLDKPSVVSLQNLIVRDIANQEKGMFLISAAPPEMYEVHTASRDDRSTWIRVIQQSVRTCPSREDFPLIETEDEAYLRRIKMELQQKDRALVELLREKVGLFAEMTHFQAEEDGGSGMALPTLPRGLFRSESLESPRGERLLQDAIREVEGLKDLLVGPGVELLLTPREPALPLEPDSGGNTSPGVTANGEARTFNGSIELCRADSDSSQRDRNGNQLRSPQEEALQRLVNLYGLLHGLQAAVAQQDTLMEARFPEGPERREKLCRANSRDGEAGRAGAAPVAPEKQATELALLQRQHALLQEELRRCRRLGEERATEAGSLEARLRESEQARALLEREAEEARRQLAALGQTEPLPAEAPWARRPVDPRRRSLPAGDALYLSFNPPQPSRGTDRLDLPVTTRSVHRNFEDRERQELGSPEERLQDSSDPDTGSEEEGSSRLSPPHSPRDFTRMQDIPEETESRDGEAVASES

SEQ ID NO: 807295 - protein, 118 aa, Homo sapiens
MGEPQGGELLPSAKQNLQSSHYSVPDLLFFLPTVHSPAEALTAWIYLSLLALSIETLRTERGRNWGAPKSGCKTAVTLTLAARRKVAAVCLRPTVHEVRPWRRHGPEVECSLGTCELV

SEQ ID NO: 807296 - protein, 959 aa, Homo sapiens [sequence omitted]

SEQ ID NO: 807297 - protein, 825 aa, Homo sapiens
ICITDRCRILSQSTDSLNMRNRTLSVESLIDEAEVIYSELMSDFEMDEKDFAADSWSLAVDSSFLQQHKKEVMKQQDVIYELIQTELHHVRTLKIMTRLFRTGMLEELHLEPGVVQGLFPCVDELSDIHTRFLSQLLERRRQALCPGSTRNFVIHRLGDLLISQFSGPSAEQMCKTYSEFCSRHSKALKLYKELYARDKRFQQFIRKVTRPAVLKRHGVQECILLVTQRITKYPLLISRILQHSHGIEEERQDLTTALGLVKELLSNVDEGIYQLEKGARLQEIYNRMDPRAQTPVPGKGPFGREELLRRKLIHDGCLLWKTATGRFKDVLVLLMTDVLVFLQEKDQKYIFPTLDKPSVVSLQNLIVRDIANQEKGMFLISAAPPEMYEVHTASRDDRSTWIRVIQQSVRTCPSREDFPLIETEDEAYLRRIKMELQQKDRALVELLREKVGLFAEMTHFQAEEDGGSGMALPTLPRGLFRSESLESPRGERLLQDAIREVEGLKDLLVGPGVELLLTPREPALPLEPDSGGNTSPGVTANGEARTFNGSIELCRADSDSSQRDRNGNQLRSPQEEALQRLVNLYGLLHGLQAAVAQQDTLMEARFPEGPERREKLCRANSRDGEAGRAGAAPVAPEKQATELALLQRQHALLQEELRRCRRLGEERATEAGSLEARLRESEQARALLEREAEEARRQLAALGQTEPLPAEAPWARRPVDPRRRSLPAGDALYLSFNPPQPSRGTDRLDLPVTTRSVHRNFEDRERQELGSPEERLQDSSDPDTGSEEEGSSRLSPPHSPRDFTRMQDIPEETESRDGEAVASES

SEQ ID NO: 807298 - protein, 842 aa, Homo sapiens
SYKLLLHWHILLEHFNDESPLGLRRILSQSTDSLNMRNRTLSVESLIDEAEVIYSELMSDFEMDEKDFAADSWSLAVDSSFLQQHKKEVMKQQDVIYELIQTELHHVRTLKIMTRLFRTGMLEELHLEPGVVQGLFPCVDELSDIHTRFLSQLLERRRQALCPGSTRNFVIHRLGDLLISQFSGPSAEQMCKTYSEFCSRHSKALKLYKELYARDKRFQQFIRKVTRPAVLKRHGVQECILLVTQRITKYPLLISRILQHSHGIEEERQDLTTALGLVKELLSNVDEGIYQLEKGARLQEIYNRMDPRAQTPVPGKGPFGREELLRRKLIHDGCLLWKTATGRFKDVLVLLMTDVLVFLQEKDQKYIFPTLDKPSVVSLQNLIVRDIANQEKGMFLISAAPPEMYEVHTASRDDRSTWIRVIQQSVRTCPSREDFPLIETEDEAYLRRIKMELQQKDRALVELLREKVGLFAEMTHFQAEEDGGSGMALPTLPRGLFRSESLESPRGERLLQDAIREVEGLKDLLVGPGVELLLTPREPALPLEPDSGGNTSPGVTANGEARTFNGSIELCRADSDSSQRDRNGNQLRSPQEEALQRLVNLYGLLHGLQAAVAQQDTLMEARFPEGPERREKLCRANSRDGEAGRAGAAPVAPEKQATELALLQRQHALLQEELRRCRRLGEERATEAGSLEARLRESEQARALLEREAEEARRQLAALGQTEPLPAEAPWARRPVDPRRRSLPAGDALYLSFNPPQPSRGTDRLDLPVTTRSVHRNFEDRERQELGSPEERLQDSSDPDTGSEEEGSSRLSPPHSPRDFTRMQDIPEETESRDGEAVASES

SEQ ID NO: 807299 - protein, 1105 aa, Homo sapiens
MKEAKDARYTNGHLFTTISVSGMTMCYACNKSITAKEALICPTCNVTIHNRCKDTLANCTKVKQKQQKAALLKNNTALQSVSLRSKTTIRERPSSAIYPSDSFRQSLLGSRRGRSSLSLAKSVSTTNIAGHFNDESPLGLRRILSQSTDSLNMRNRTLSVESLIDEAEVIYSELMSDFEMDEKDFAADSWSLAVDSSFLQQHKKEVMKQQDVIYELIQTELHHVRTLKIMTRLFRTGMLEELHLEPGVVQGLFPCVDELSDIHTRFLSQLLERRRQALCPGSTRNFVIHRLGDLLISQFSGPSAEQMCKTYSEFCSRHSKALKLYKELYARDKRFQQFIRKVTRPAVLKRHGVQECILLVTQRITKYPLLISRILQHSHGIEEERQDLTTALGLVKELLSNVDEGIYQLEKGARLQEIYNRMDPRAQTPVPGKGPFGREELLRRKLIHDGCLLWKTATGRFKDVLVLLMTDVLVFLQEKDQKYIFPTLVRHSFFTFLSTDKCFSLFLLSCPSPESSGVPQSQTAIIVTITVIIKNKSSSQVLLLCTGTFTPVGKDYFRPHFIDDESKASSQLNNLSRVAHISKSLLAGTSAWLFNWYCKMTLQSFQSLSRRIEGLNMPRDRIPRLNPSFSPDWQDKPSVVSLQNLIVRDIANQEKGMFLISAAPPEMYEVHTASRDDRSTWIRVIQQSVRTCPSREDFPLIETEDEAYLRRIKMELQQKDRALVELLREKVGLFAEMTHFQAEEDGGSGMALPTLPRGLFRSESLESPRGERLLQDAIREVEGLKDLLVGPGVELLLTPREPALPLEPDSGGNTSPGVTANGEARTFNGSIELCRADSDSSQRDRNGNQLRSPQEEALQRLVNLYGLLHGLQAAVAQQDTLMEARFPEGPERREKLCRANSRDGEAGRAGAAPVAPEKQATELALLQRQHALLQEELRRCRRLGEERATEAGSLEARLRESEQARALLEREAEEARRQLAALGQTEPLPAEAPWARRPVDPRRRSLPAGDALYLSFNPPQPSRGTDRLDLPVTTRSVHRNFEDRERQELGSPEERLQDSSDPDTGSEEEGSSRLSPPHSPRDFTRMQDIPEETESRDGEAVASES

SEQ ID NO: 807300 - protein, 1029 aa, Homo sapiens; identical to SEQ ID NO: 807281

SEQ ID NO: 807301 - protein, 1029 aa, Homo sapiens; identical to SEQ ID NO: 807281

SEQ ID NO: 807302 - protein, 959 aa, Homo sapiens [sequence omitted]

SEQ ID NO: 807303 - protein, 446 aa, Homo sapiens
MKEAKDARYTNGHLFTTISVSGMTMCYACNKSITAKEALICPTCNVTIHNRCKDTLANCTKVKQKQQKAALLKNNTALQSVSLRSKTTIRERPSSAIYPSDSFRQSLLGSRRGRSSLSLAKSVSTTNIAGHFNDESPLGLRRILSQSTDSLNMRNRTLSVESLIDEAEVIYSELMSDFEMDEKDFAADSWSLAVDSSFLQQHKKEVMKQQDVIYELIQTELHHVRTLKIMTRLFRTGMLEELHLEPGVVQGLFPCVDELSDIHTRFLSQLLERRRQALCPGSTRNFVIHRLGDLLISQFSGPSAEQMCKTYSEFCSRHSKALKLYKELYARDKRFQQFIRKVTRPAVLKRHGVQECILLVTQRITKYPLLISRILQHSHGIEEERQDLTTALGLVKELLSNVDEGIYQLEKGARLQEIYNRMDPRTEAQTHPDIDRCTGVLQERPK

SEQ ID NO: 807304 - protein, 129 aa, Homo sapiens
MRNRTLSVESLIDEAEVIYSELMSDFEMDEKDFAADSWSLAVDSSFLQQHKKEVMKQQDVIYELIQTELHHVRTLKIMTRLFRTGMLEELHLEPGVVQGLFPCVDELSDIHTRFLSSSSSSRDPLDHLS

SEQ ID NO: 807305 - protein, 481 aa, Homo sapiens
SKWTSGSRRSWLSRGGGEISPTGMITKTHKVDLGLPEKKKKKKVVKEPETRYSVLNNDDYFADVSPLRATSPSKSVAHGQAPEMPLVKKKKKKKKGVSTLCEEHVEPETTLPARRTEKSPSLRKQVFGHLEFLSGEKKNKKSPLAMSHASGVKTSPDPRQGEEETRVGKKLKKHKKEKKGAQDPTAFSVQDPWFCEAREARDVGDTCSVGKKDEEQAALGQKRKRKSPREHNGKVKKKKKIHQEGDALPGHSKPSRSMESSPRKGSKKKPVKVEAPEYIPISDDPKASAKKKMKSKKKVEQPVIEEPALKRKKKKKRKESGVAGDPWKEETDTDLEVVLEKKGNMDEAHIDQVRRKALQEEIDRESGKTEASETRKWTGTQFGQWDTAGFENEDQKLKFLRLMGGFKNLSPSFSRPASTIARPNMALGKKAADSLQQNLQRDYDRAMSWKYSRGAGLGFSTAPNKIFYIDRNASKSVKLED

SEQ ID NO: 807306 - protein, 458 aa, Homo sapiens
MITKTHKVDLGLPEKKKKKKVVKEPETRYSVLNNDDYFADVSPLRATSPSKSVAHGQAPEMPLVKKKKKKKKGVSTLCEEHVEPETTLPARRTEKSPSLRKQVFGHLEFLSGEKKNKKSPLAMSHASGVKTSPDPRQGEEETRVGKKLKKHKKEKKGAQDPTAFSVQDPWFCEAREARDVGDTCSVGKKDEEQAALGQKRKRKSPREHNGKVKKKKKIHQEGDALPGHSKPSRSMESSPRKGSKKKPVKVEAPEYIPISDDPKASAKKKMKSKKKVEQPVIEEPALKRKKKKKRKESGVAGDPWKEETDTDLEVVLEKKGNMDEAHIDQVRRKALQEEIDRESGKTEASETRKWTGTQFGQWDTAGFENEDQKLKFLRLMGGFKNLSPSFSRPASTIARPNMALGKKAADSLQQNLQRDYDRAMSWKYSRGAGLGFSTAPNKIFYIDRNASKSVKLED

SEQ ID NO: 807307 - protein, 481 aa, Homo sapiens; identical to SEQ ID NO: 807305

SEQ ID NO: 807308 - protein, 271 aa, Homo sapiens
MCPQTTQSCSQKRKRKSPREHNGKVKKKKKIHQEGDALPGHSKPSRSMESSPRKGSKKKPVKVEAPEYIPISDDPKASAKKKMKSKKKVEQPVIEEPALKRKKKKKRKESGVAGDPWKEETDTDLEVVLEKKGNMDEAHIDQVRRKALQEEIDRESGKTEASETRKWTGTQFGQWDTAGFENEDQKLKFLRLMGGFKNLSPSFSRPASTIARPNMALGKKAADSLQQNLQRDYDRAMSWKYSRGAGLGFSTAPNKIFYIDRNASKSVKLED

SEQ ID NO: 807309 - protein, 168 aa, Homo sapiens
MGITTVFLIGLSLGLTEYPLLSLLALCLVHSSHLICWALPDEGGGQGKERALNSRKIATFFLSSQGTQFGQWDTAGFENEDQKLKFLRLMGGFKNLSPSFSRPASTIARPNMALGKKAADSLQQNLQRDYDRAMSWKYSRGAGLGFSTAPNKIFYIDRNASKSVKLED

SEQ ID NO: 807310 - protein, 107 aa, Homo sapiens
MITKTHKVDLGLPEKKKKKKVVKEPETRYSVLNNDDYFADVSPLRATSPSKSVAHGQAPEMPLVKKKKKKKKGVSTLCEEHVEPVPFVQPPRQHDCKAQHGPRQEGG

SEQ ID NO: 807311 - protein, 402 aa, Homo sapiens
SKWTSGSRRSWLSRGGGEISPTGMITKTHKVDLGLPEKKKKKKVVKEPETRYSVLNNDDYFADVSPLRATSPSKSVAHGQAPEMPLVKKKKKKKKGVSTLCEEHVEPETTLPARRTEKSPSLRKQVFGHLEFLSGEKKNKKSPLAMSHASGVKTSPDPRQGEEETRVGKKLKKHKKEKKGAQDPTAFSVQDPWFCEAREARDVGDTCSVGKKDEEQAALGQKRKRKSPREHNGKVKKKKKIHQEGDALPGHSKPSRSMESSPRKGSKKKPVKVEAPEYIPISDDPKASAKKKMKSKKKVEQPVIEEPALKRKKKKKRKESGVAGDPWKEETDTDLEVVLEKKGNMDEAHIDQVRRKALQEEIDRESGKTEASETRKWTVSLGLGLCEEVARSASRRFPSPPA

SEQ ID NO: 807312 - protein, 101 aa, Homo sapiens
ETVSLLLPRLVPGLQQALQAVSLALNPDPQALARSIVGQVCATRTYLGHFPQDVNLSCLSFLDSTLRYIMGEAVESPRGSVLDLSECLLGTSSFDGETNPS

SEQ ID NO: 807313 - protein, 243 aa, Homo sapiens
MSSGTELLWPGAALLVLLGVAASLCVRCSRPGAKRSEKIYQQRSLREDQQSFTGSRTYSLVGQAWPGPLADMAPTRKDKLLQFYPSLEDPASSRYQNFSKGSRHGSEEAYIDPIAMEYYNWGRFSKPPEDDDANSYENVLICKQKTTETGAQQEGIGGLCRGDLSLSLALKTGPTSGLCPSASPEEDEESEDYQNSASIHQWRESRKVMGQLQREASPGPVGSPDEEDGEPDYVNGEVAATEA

SEQ ID NO: 807314 - protein, 243 aa, Homo sapiens; identical to SEQ ID NO: 807313

SEQ ID NO: 807315 - protein, 243 aa, Homo sapiens; identical to SEQ ID NO: 807313

SEQ ID NO: 807316 - protein, 243 aa, Homo sapiens; identical to SEQ ID NO: 807313

SEQ ID NO: 807317 - protein, 243 aa, Homo sapiens; identical to SEQ ID NO: 807313

SEQ ID NO: 807318 - protein, 243 aa, Homo sapiens; identical to SEQ ID NO: 807313

SEQ ID NO: 807319 - protein, 111 aa, Homo sapiens
MSSGTELLWPGAALLVLLGVAASLCVRCSRPGAKRSEKIYQQRSLREDQQSFTGSRTYSLVGQAWPGPLADMAPTRKDKLLQFYPSLEDPASSRYQNFSKGSRHGSEEAYI

SEQ ID NO: 807320 - protein, 243 aa, Homo sapiens; identical to SEQ ID NO: 807313

SEQ ID NO: 807321 - protein, 316 aa, Homo sapiens
FILRYAVYYSFVFCLLFALSVVCVLLRSAVVYVSVALHLSSLHCCSLSSVSLSSVFFVIVFLFRLLLFVVRVCSSVCFSLSVFALLRSSLVSFSFVVCLLSLFVVFSSLSAPLCSSVLFLLPHLSLRRSSYALFLSALSPLSVSSFALVLFGAVVSSSLFLLLFSPSFVFLSVGFIAVLCVVFRFSLRCVLVLFVSLLFVCVCVVGVMCSGVGSDWLRAVVVLCVVFWAWCAMLVRCLVCVFVLFVDASSVRCGVVLCLVFLVLCLFRLFVVFSARLGRECGAVCGAVGFGLVLDAACACCFVSRRVAVVRVSVSL

SEQ ID NO: 807322 - protein, 415 aa, Homo sapiens
MGTTARAALVLTYLAVASAASEGGFTATGQRQLRPEHFQEVGYAAPPSPPLSRSLPMDHPDSSQHGPPFEGQSQVQPPPSQEATPLQQEKLLPAQLPAEKEVGPPLPQEAVPLQKELPSLQHPNEQKEGTPAPFGDQSHPEPESWNAAQHCQQDRSQGGWGHRLDGFPPGRPSPDNLNQICLPNRQHVVYGPWNLPQSSYSHLTRQGETLNFLEIGYSRCCHCRSHTNRLECAKLVWEDTLDKYCDREYAVKTHHHLCCRHPPSPTRDECFARRAPYPNYDRDILTIDISRVTPNLMGHLCGNQRVLTKHKHIPGLIHNMTARCCDLPFPEQACCAEEEKLTFINDLCGPRRNIWRDPALCCYLSPGDEQVNCFNINYLRNVALVSGDTENAKGQGEQGSTGGTNISSTSEPKEE

SEQ ID NO: 807323 - protein, 132 aa, Homo sapiens
CLQPVPVSYVGGTLSSLAARVCIKCLACTRARERTTPSAGTLGGSLGGSLGGSSGGTWSGSLRGTSGGSSGGPSCGSVGGTITPVHGRLVVWEDTLDKYCDREYAVKTHHHLCPHEPRERHWSSHPKSPDGQ

SEQ ID NO: 807324 - protein, 540 aa, Homo sapiens
MGTTARAALVLTYLAVASAASEGGFTATGQRQLRPEHFQEVGYAAPPSPPLSRSLPMDHPDSSQHGPPFEGQSQVQPPPSQEATPLQQEKLLPAQLPAEKEVGPPLPQEAVPLQKELPSLQHPNEQKEGTPAPFGDQSHPEPESWNAAQHCQQDRSQGGWGHRLDGFPPGRPSPDNLNQICLPNRQHVVYGPWNLPQSSYSHLTRQGETLNFLEIGYSRCCHCRSHTNRLECAKLVWEEAMSRFCEAEFSVKTRPHWCCTRQGEARFSCFQEEAPQPHYQLRACPSHQPDISSGLELPFPPGVPTLDNIKNICHLRRFRSVPRNLPATDPLQRELLALIQLEREFQRCCRQGNNHTCTWKAWEDTLDKYCDREYAVKTHHHLCCRHPPSPTRDECFARRAPYPNYDRDILTIDISRVTPNLMGHLCGNQRVLTKHKHIPGLIHNMTARCCDLPFPEQACCAEEEKLTFINDLCGPRRNIWRDPALCCYLSPGDEQVNCFNINYLRNVALVSGDTENAKGQGEQGSTGGTNISSTSEPKEE

SEQ ID NO: 807325 - protein, 540 aa, Homo sapiens; identical to SEQ ID NO: 807324

SEQ ID NO: 807326 - protein, 540 aa, Homo sapiens; identical to SEQ ID NO: 807324

SEQ ID NO: 807327 - protein, 540 aa, Homo sapiens; identical to SEQ ID NO: 807324

SEQ ID NO: 807328 - protein, 563 aa, Homo sapiens
PRNVCPLGRKGPTSECPVVSCPRMGTTARAALVLTYLAVASAASEGGFTATGQRQLRPEHFQEVGYAAPPSPPLSRSLPMDHPDSSQHGPPFEGQSQVQPPPSQEATPLQQEKLLPAQLPAEKEVGPPLPQEAVPLQKELPSLQHPNEQKEGTPAPFGDQSHPEPESWNAAQHCQQDRSQGGWGHRLDGFPPGRPSPDNLNQICLPNRQHVVYGPWNLPQSSYSHLTRQGETLNFLEIGYSRCCHCRSHTNRLECAKLVWEEAMSRFCEAEFSVKTRPHWCCTRQGEARFSCFQEEAPQPHYQLRACPSHQPDISSGLELPFPPGVPTLDNIKNICHLRRFRSVPRNLPATDPLQRELLALIQLEREFQRCCRQGNNHTCTWKAWEDTLDKYCDREYAVKTHHHLCCRHPPSPTRDECFARRAPYPNYDRDILTIDISRVTPNLMGHLCGNQRVLTKHKHIPGLIHNMTARCCDLPFPEQACCAEEEKLTFINDLCGPRRNIWRDPALCCYLSPGDEQVNCFNINYLRNVALVSGDTENAKGQGEQGSTGGTNISSTSEPKEE

SEQ ID NO: 807329 - protein, 714 aa, Homo sapiens
MGTTARAALVLTYLAVASAASEGGFTATGQRQLRPEHFQEVGYAAPPSPPLSRSLPMDHPDSSQHGPPFEGQSQVQPPPSQEATPLQQEKLLPAQLPAEKEVGPPLPQEAVPLQKELPSLQHPNEQKEGTPAPFGDQSHPEPESWNAAQHCQQDRSQGGWGHRLDGFPPGRPSPDNLNQICLPNRQHVVYGPWNLPQSSYSHLTRQGETLNFLEIGYSRCCHCRSHTNRLECAKLVWEEAMSRFCEAEFSVKTRPHWCCTRQGEARFSCFQEEAPQPHYQLRACPSHQPDISSGLELPFPPGVPTLDNIKNICHLRRFRSVPRNLPATDPLQRELLALIQLEREFQRCCRQGNNHTCTWKAVSGRPSLPESLFACLPIFDLLILPVHPSMYPPCCECVHPFICLWLSVHPLCLSPEFVHLELRTTLLASSTHDPHTHLSTIHPSVQLWPHLTFSIHCSSSSPGTSLEPHPGFHPSTFPSPHINSCLLTLYFFAIPFGPLGLGAPHLVARDDKGSRWSGEKGPSVQLLTSLSLVHSWEDTLDKYCDREYAVKTHHHLCCRHPPSPTRDECFARRAPYPNYDRDILTIDISRVTPNLMGHLCGNQRVLTKHKHIPGLIHNMTARCCDLPFPEQACCAEEEKLTFINDLCGPRRNIWRDPALCCYLSPGDEQVNCFNINYLRNVALVSGDTENAKGQGEQGSTGGTNISSTSEPKEE

SEQ ID NO: 807330 - protein, 568 aa, Homo sapiens
MGTTARAALVLTYLAVASAASEGGFTATGQRQLRPEHFQEVGYAAPPSPPLSRSLPMDHPDSSQHGPPFEGQSQGGKEGRGPRPHSQPWLGERVGCSHIPPSMQPPPSQEATPLQQEKLLPAQLPAEKEVGPPLPQEAVPLQKELPSLQHPNEQKEGTPAPFGDQSHPEPESWNAAQHCQQDRSQGGWGHRLDGFPPGRPSPDNLNQICLPNRQHVVYGPWNLPQSSYSHLTRQGETLNFLEIGYSRCCHCRSHTNRLECAKLVWEEAMSRFCEAEFSVKTRPHWCCTRQGEARFSCFQEEAPQPHYQLRACPSHQPDISSGLELPFPPGVPTLDNIKNICHLRRFRSVPRNLPATDPLQRELLALIQLEREFQRCCRQGNNHTCTWKAWEDTLDKYCDREYAVKTHHHLCCRHPPSPTRDECFARRAPYPNYDRDILTIDISRVTPNLMGHLCGNQRVLTKHKHIPGLIHNMTARCCDLPFPEQACCAEEEKLTFINDLCGPRRNIWRDPALCCYLSPGDEQVNCFNINYLRNVALVSGDTENAKGQGEQGSTGGTNISSTSEPKEE

SEQ ID NO: 807331 - protein, 466 aa, Homo sapiens
MQPPPSQEATPLQQEKLLPAQLPAEKEVGPPLPQEAVPLQKELPSLQHPNEQKEGTPAPFGDQSHPEPESWNAAQHCQQDRSQGGWGHRLDGFPPGRPSPDNLNQICLPNRQHVVYGPWNLPQSSYSHLTRQGETLNFLEIGYSRCCHCRSHTNRLECAKLVWEEAMSRFCEAEFSVKTRPHWCCTRQGEARFSCFQEEAPQPHYQLRACPSHQPDISSGLELPFPPGVPTLDNIKNICHLRRFRSVPRNLPATDPLQRELLALIQLEREFQRCCRQGNNHTCTWKAWEDTLDKYCDREYAVKTHHHLCCRHPPSPTRDECFARRAPYPNYDRDILTIDISRVTPNLMGHLCGNQRVLTKHKHIPGLIHNMTARCCDLPFPEQACCAEEEKLTFINDLCGPRRNIWRDPALCCYLSPGDEQVNCFNINYLRNVALVSGDTENAKGQGEQGSTGGTNISSTSEPKEE

SEQ ID NO: 807332 - protein, 300 aa, Homo sapiens [sequence omitted]

SEQ ID NO: 807333 - protein, 365 aa, Homo sapiens
MGTTARAALVLTYLAVASAASEGGFTATGQRQLRPEHFQEVGYAAPPSPPLSRSLPMDHPDSSQHGPPFEGQSQVQPPPSQEATPLQQEKLLPAQLPAEKEVGPPLPQEAVPLQKELPSLQHPNEQKEGTPAPFGDQSHPEPESWNAAQHCQQDRSQGGWGHRLDGFPPGRPSPDNLNQICLPNRQHVVYGPWNLPQSSYSHLTRQGETLNFLEIGYSRCCHCRSHTNRLECAKLVWEEAMSRFCEAEFSVKTRPHWCCTRQGEARFSCFQEEAPQPHYQLRACPSHQPDISSGLELPFPPGVPTLDNIKNICHLRRFRSVPRNLPATDPLQRELLALIQLEREFQRCCRQGNNHTCTWKAWEIP

SEQ ID NO: 807334 - protein, 190 aa, Homo sapiens
QDSVDTQIMEGWEDTLDKYCDREYAVKTHHHLCCRHPPSPTRDECFARRAPYPNYDRDILTIDISRVTPNLMGHLCGNQRVLTKHKHIPGLIHNMTARCCDLPFPEQACCAEEEKLTFINDLCGPRRNIWRDPALCCYLSPGDEQVNCFNINYLRNVALVSGDTENAKGQGEQGSTGGTNISSTSEPKEE

SEQ ID NO: 807335 - protein, 209 aa, Homo sapiens
MGTTARAALVLTYLAVASAASEGGFTATGQRQLRPEHFQEVGYAAPPSPPLSRSLPMDHPDSSQHGPPFEGQSQVQPPPSQEATPLQQEKLLPAQLPAEKEVGPPLPQEAVPLQKELPSLQHPNEQKEGTPAPFGDQSHPEPESWNAAQHCQQDRSQGGWGHRLDGFPPGRPSPDNLGALAQEGTGVFRHTTDKHTLLSLLVFPSVPGP

SEQ ID NO: 807336 - protein, 266 aa, Homo sapiens
MPFNGEKQCVGEDQPSDSDSSRFSESMASLSDYECSRQSFASDSSSKSSSPASTSPPRVVTFDEVMATARNLSNLTLAHEIAVNENFQLKQEALPEKSLAGRVKHIVHQAFWDVLDSELNADPPEFEHAIKLFEEIREILLSFLTPGGNRLRNQICEVLDTDLIRQQAEHSAVDIQGLANYVISTMGKLCAPVRDNDIRELKATGNIVEVLRQIFHVLDLMQMDMANFTIMSLRPHLQRQLVEYERTKFQEILEETPRKAEVAGAS

SEQ ID NO: 807337 - protein, 314 aa, Homo sapiens
MPFNGEKQCVGEDQPSDSDSSRFSESMASLSDYECSRQSFASDSSSKSSSPASTSPPRVVTFDEVMATARNLSNLTLAHEIAVNENFQLKQEALPEKSLAGRVKHIVHQAFWDVLDSELNADPPEFEHAIKLFEEIREILLSFLTPGGNRLRNQICEVLDTDLIRQQAEHSAVDIQGLANYVISTMGKLCAPVRDNDIRELKATGNIVEVLRQIFHVLDLMQMDMANFTIMSLRPHLQRQLVEYERTKFQEILEETPSALDQTTEWIKESVNEELFSLSESALTPGAENTSKPSLSPTLVLNNSYLKLLQWDYQ

SEQ ID NO: 807338 - protein, 266 aa, Homo sapiens; identical to SEQ ID NO: 807336

SEQ ID NO: 807339 - protein, 147 aa, Homo sapiens
MPFNGEKQCVGEDQPSDSDSSRFSESMASLSDYECSRQSFASDSSSKSSSPASTSPPRVVTFDEVMATARNLSNLTLAHEIAVNENFQLKQEALPEKSLAGRVKHIVHQAFWDVLDSELNADPPEFEHAIKLFEEIREASCFVVCVS

SEQ ID NO: 807340 - protein, 274 aa, Homo sapiens
MPFNGEKQCVGEDQPSDSDSSRFSESMASLSDYECSRQSFASDSSSKSSSPASTSPPRVVTFDEVMATARNLSNLTLAHEIAVNENFQLKQEALPEKSLAGRVKHIVHQAFWDVLDSELNADPPEFEHAIKLFEEIREILLSFLTPGGNRLRNQICEVLDTDLIRQQAEHSAVDIQGLANYVISTMGKLCAPVRDNDIRELKATGNIVEVLRQIFHVLDLMQMDMANFTIMSLRPHLQRQLVEYERTKFQEILEETPRTVLSTIRFFIHSRYIY

SEQ ID NO: 807341 - protein, 266 aa, Homo sapiens; identical to SEQ ID NO: 807336

SEQ ID NO: 807342 - protein, 408 aa, Homo sapiens
QEERHKFRISPFIPQTHTASLPTSASSRNTGVPDHIEFTMNSLSEANTKFMFDLFQQFRKSKENNIFYSPISITSALGMVLLGAKDNTAQQISKVLHFDQVTENTTEKAATYHVDRSGNVHHQFQKLLTEFNKSTDAYELKIANKLFGEKTYQFLQEYLDAIKKFYQTSVESTDFANAPEESRKKINSWVESQTNEKIKNLFPDGTIGNDTTLVLVNAIYFKGQWENKFKKENTKEEKFWPNKDVQAKVLEIPYKGKDLSMIVLLPNEIDGLQKLEEKLTAEKLMEWTSLQNMRETCVDLHLPRFKMEESYDLKDTLRTMGMVNIFNGDADLSGMTWSHGLSVSKVLHKAFVEVTEEGVEAAAATAVVVVELSSPSTNEEFCCNHPFLFFIRQNKTNSILFYGRFSSP

SEQ ID NO: 807343 - protein, 386 aa, Homo sapiens
QEERHKFRISPFIPQTHTASLPTSASSRNTGVPDHIEFTMNSLSEANTKFMFDLFQQFRKSKENNIFYSPISITSALGMVLLGAKDNTAQQISKVLHFDQVTENTTEKAATYHEYLDAIKKFYQTSVESTDFANAPEESRKKINSWVESQTNEKIKNLFPDGTIGNDTTLVLVNAIYFKGQWENKFKKENTKEEKFWPNKNTYKSVQMMRQYNSFNFALLEDVQAKVLEIPYKGKDLSMIVLLPNEIDGLQKLEEKLTAEKLMEWTSLQNMRETCVDLHLPRFKMEESYDLKDTLRTMGMVNIFNGDADLSGMTWSHGLSVSKVLHKAFVEVTEEGVEAAAATAVVVVELSSPSTNEEFCCNHPFLFFIRQNKTNSILFYGRFSSP

SEQ ID NO: 807344 - protein, 69 aa, Homo sapiens
MDEFSSGDMSHVYAYLEICLLWVLLQLLCPSHINTQAFLMTNQMTLGNQVCSPASNFNMMRSYITFTPL

SEQ ID NO: 807345 - protein, 150 aa, Homo sapiens
MSAKDERAREILRGFKLNWMNLRDAETGKILWQGTEDLSVPGVEHEARVPKKILKCKAVSRELNFSSTEQMEKFRLEQKVYFKGQCLEEWFFEFGFVIPNSTNTWQSLIEAAPESQMMPASVLTGNVIIETKFFDDDLLVSTSRVRLFYV

SEQ ID NO: 807346 - protein, 150 aa, Homo sapiens; identical to SEQ ID NO: 807345

SEQ ID NO: 807347 - protein, 73 aa, Homo sapiens
RGKEKGSEAGAEGRERPVLVWPLRLLARGLQAGLRLHPRLLGTVCEAPPTRVRKPRAATAASCQPRTSGPGRS

SEQ ID NO: 807348 - protein, 111 aa, Homo sapiens
MSAKDERAREILRGFKLNWMNLRDAETGKILWQGTEDLSVPGVEHEARVPKKILKCKAVSRELNFSSTEQMEKFRLEQKVYFKGQCLEGILLPTCLKSGLRATRTKGNNTQ

SEQ ID NO: 807349 - protein, 150 aa, Homo sapiens; identical to SEQ ID NO: 807345

SEQ ID NO: 807350 - protein, 131 aa, Homo sapiens
MNLRDAETGKILWQGTEDLSVPGVEHEARVPKKILKCKAVSRELNFSSTEQMEKFRLEQKVYFKGQCLEEWFFEFGFVIPNSTNTWQSLIEAAPESQMMPASVLTGNVIIETKFFDDDLLVSTSRVRLFYV

SEQ ID NO: 807351 - protein, 73 aa, Homo sapiens; identical to SEQ ID NO: 807347

SEQ ID NO: 807352 - protein, 1196 aa, Homo sapiens [sequence omitted]

SEQ ID NO: 807353 - protein, 1080 aa, Homo sapiens
MCLKCKFLGPTPEQLIRKHRNSPSCVLTNTSGHSDAQEGKFFGFKFPGLRVLTYRKQSLPQEDPDVVVIDSSKHSDDSVAMKHFKSPTKESCSPSEADDTKALIQPSKCSPLVNISGPLDHSSPKRQWDRLYPDMLQSSSQLSHSRSRESLCSIRRASSVHDIEGFGVHPKNIFRDRHASEDNGRNVKGPFNHIKSSLLGSTSDSNLNKYSTINKIPQLTLNFSEVKTEKKNSSPPSSDKTIIAPKVKDRTHNVTEKVTQVLSLGADVLPEYKLQTPRINKFTILHYSPFKAVWDWLILLLVIYTAIFTPYSAAFLLNDREEQKRRECGYSCSPLNVVDLIVDIMFIIDILINFRTTYVNQNEEVVSDPAKIAIHYFKGWFLIDMVAAIPFDLLIFGSGSDETTTLIGLLKTARLLRLVRVARKLDRYSEYGAAVLMLSMCIFALNAHWLACIWYAIGNVERPYLTDKIGWLDSLGQQIGKRYNDSDSSSGPSIKDKYVTALYFTFSSLTSVGFGNVSPNTNSEKIFSICVMLIGSLMYASIFGNVSAIIQRLYSGTARYHMQMLRVKEFIRFHQIPNPLRQRLEEYFQHAWTYTNGIDMNMVLKGFPECLQADICLHLNQTLLQNCKAFRGASKGCLRALAMKFKTTHALQGDTLVHCGDVLTALYFLSRGSIEISKNDMVVAILGKNDIFGEMVHLYAKPGKSNADVRALTYCDLHKIQREDLLEVLDMYPEFSDHFLTNLELTFNLRHESAKADLLRSQSMNDSEGDNCKLRRRKLSFESEGEKENSTNDPEDSADTIRHYQSSKRHFEEKKSRSSSFISSIDDEQKPLFSGIVDSSPGIGKASGLDFEETVPTSGRMHIDKRSHSCKDITDMRSWERENAHPQPEDSSPSALQRAAWGISETESDLTYGEVEQRLDLLQEQLNRLESQMTTDIQTILQLLQKQTTVVPPAYSMVTAGSEYQRPIIQLMRTSQPEASIKTDRSFSPSSQCPEFLDLEKSKLKSKESLSSGVHLNTASEDNLTSLLKQDSDLSLELHLRQRKTYVHPIRHPSLPDSSLSTVGIVGLHRHVSDPGLPGK

SEQ ID NO: 807354 - protein, 270 aa, Homo sapiens
MCLKCKFLGPTPEQLIRKHRNSPSCVLTNTSGHSDAQEGKFFGFKFPGLRVLTYRKQSLPQEDPDVVVIDSSKHSDDSVAMKHFKSPTKESCSPSEADDTKALIQPSKCSPLVNISGPLDHSSPKRQWDRLYPDMLQSSSQLSHSRSRESLCSIRRASSVHDIEGFGVHPKNIFRDRHASEDNGRNVKGPFNHIKSSLLGSTSDSNLNKYSTINKIPQLTLNFSEVKTEKKNSSPPSSDKTIIAPKVKDRTHNVTEKVTQDLFIPTSRGP

SEQ ID NO: 807355 - protein, 68 aa, Homo sapiens
GTARYHMQMLRVKEFIRFHQIPNPLRQRLEEYFQHAWTYTNGIDMNMVCMSVFQNESAAGIIVIAKME

SEQ ID NO: 807356 - protein, 846 aa, Homo sapiens
MLFTVSCSKMSSIVDRDDSSIFDGLVEEDDKDKAKRVSRNKSEKKRRDQFNVLIKELGSMLPGNARKMDKSTVLQKSIDFLRKHKEITAQSDASEIRQDWKPTFLSNEEFTQLMLEALDGFFLAIMTDGSIIYVSESVTSLLEHLPSDLVDQSIFNFIPEGEHSEVYKILSTHLLESDSLTPEYLKSKNQLEFCCHMLRGTIDPKEPSTYEYVKFIGNFKSLNSVSSSAHNGFEGTIQRTHRPSYEDRVCFVATVRLATPQFIKEMCTVEEPNEEFTSRHSLEWKFLFLDHRAPPIIGYLPFEVLGTSGYDYYHVDDLENLAKCHEHLMQYGKGKSCYYRFLTKGQQWIWLQTHYYITYHQWNSRPEFIVCTHTVVSYAEVRAERRRELGIEESLPETAADKSQDSGSDNRINTVSLKEALERFDHSPTPSASSRSSRKSSHTAVSDPSSTPTKIPTDTSTPPRQHLPAHEKMVQRRSSFSSQSINSQSVGSSLTQPVMSQATNLPIPQGMSQFQFSAQLGAMQHLKDQLEQRTRMIEANIHRQQEELRKIQEQLQMVHGQGLQMFLQQSNPGLNFGSVQLSSGNSSNIQQLAPINMQGQVVPTNQIQSGMNTGHIGTTQHMIQQQTLQSTSTQSQQNVLSGHSQQTSLPSQTQSTLTAPLYNTMVISQPAAGSMVQIPSSMPQNSTQSAAVTTFTQDRQIRFSQGQQLVTKLVTAPVACGAVMVPSTMLMGQVVTAYPTFATQQQQSQTLSVTQQQQQQSSQEQQLTSVQQPSQAQLTQPPQQFLQTSRLLHGNPSTQLILSAAFPLQQSTFPQSHHQQHQSQQQQQLSRHRTDSLPDPSKVQPQ

SEQ ID NO: 807357 - protein, 846 aa, Homo sapiens; identical to SEQ ID NO: 807356

SEQ ID NO: 807358 - protein, 846 aa, Homo sapiens; identical to SEQ ID NO: 807356

SEQ ID NO: 807359 - protein, 818 aa, Homo sapiens
MHIFHFIRVSRNKSEKKRRDQFNVLIKELGSMLPGNARKMDKSTVLQKSIDFLRKHKEITAQSDASEIRQDWKPTFLSNEEFTQLMLEALDGFFLAIMTDGSIIYVSESVTSLLEHLPSDLVDQSIFNFIPEGEHSEVYKILSTHLLESDSLTPEYLKSKNQLEFCCHMLRGTIDPKEPSTYEYVKFIGNFKSLNSVSSSAHNGFEGTIQRTHRPSYEDRVCFVATVRLATPQFIKEMCTVEEPNEEFTSRHSLEWKFLFLDHRAPPIIGYLPFEVLGTSGYDYYHVDDLENLAKCHEHLMQYGKGKSCYYRFLTKGQQWIWLQTHYYITYHQWNSRPEFIVCTHTVVSYAEVRAERRRELGIEESLPETAADKSQDSGSDNRINTVSLKEALERFDHSPTPSASSRSSRKSSHTAVSDPSSTPTKIPTDTSTPPRQHLPAHEKMVQRRSSFSSQSINSQSVGSSLTQPVMSQATNLPIPQGMSQFQFSAQLGAMQHLKDQLEQRTRMIEANIHRQQEELRKIQEQLQMVHGQGLQMFLQQSNPGLNFGSVQLSSGNSSNIQQLAPINMQGQVVPTNQIQSGMNTGHIGTTQHMIQQQTLQSTSTQSQQNVLSGHSQQTSLPSQTQSTLTAPLYNTMVISQPAAGSMVQIPSSMPQNSTQSAAVTTFTQDRQIRFSQGQQLVTKLVTAPVACGAVMVPSTMLMGQVVTAYPTFATQQQQSQTLSVTQQQQQQSSQEQQLTSVQQPSQAQLTQPPQQFLQTSRLLHGNPSTQLILSAAFPLQQSTFPQSHHQQHQSQQQQQLSRHRTDSLPDPSKVQPQ

SEQ ID NO: 807360 - protein, 337 aa, Homo sapiens
MVLQFQFSAQLGAMQHLKDQLEQRTRMIEANIHRQQEELRKIQEQLQMVHGQGLQMFLQQSNPGLNFGSVQLSSGNSSNIQQLAPINMQGQVVPTNQIQSGMNTGHIGTTQHMIQQQTLQSTSTQSQQNVLSGHSQQTSLPSQTQSTLTAPLYNTMVISQPAAGSMVQIPSSMPQNSTQSAAVTTFTQDRQIRFSQGQQLVTKLVTAPVACGAVMVPSTMLMGQVVTAYPTFATQQQQSQTLSVTQQQQQQSSQEQQLTSVQQPSQAQLTQPPQQFLQTSRLLHGNPSTQLILSAAFPLQQSTFPQSHHQQHQSQQQQQLSRHRTDSLPDPSKVQPQ

SEQ ID NO: 807361 - protein, 374 aa, Homo sapiens [sequence omitted]

SEQ ID NO: 807362 - protein, 406 aa, Homo sapiens
MLFTVSCSKMSSIVDRDDSSIFDGLVEEDDKDKAKRVSRNKSEKKRRDQFNVLIKELGSMLPGNARKMDKSTVLQKSIDFLRKHKEITAQSDASEIRQDWKPTFLSNEEFTQLMLEALDGFFLAIMTDGSIIYVSESVTSLLEHLPSDLVDQSIFNFIPEGEHSEVYKILSTHLLESDSLTPEYLKSKNQLEFCCHMLRGTIDPKEPSTYEYVKFIGNFKSLNSVSSSAHNGFEGTIQRTHRPSYEDRVCFVATVRLATPQFIKEMCTVEEPNEEFTSRHSLEWKFLFLDHRAPPIIGYLPFEVLGTSGYDYYHVDDLENLAKCHEHLMQYGKGKSCYYRFLTKGQQWIWLQTHYYITYHQWNSRPEFIVCTHTVVSYAEVRAERRRELGIEESLPETAADKVCFL

SEQ ID NO: 807363 - protein, 530 aa, Homo sapiens
MLFTVSCSKMSSIVDRDDSSIFDGLVEEDDKDKAKRVSRNKSEKKRRDQFNVLIKELGSMLPGNARKMDKSTVLQKSIDFLRKHKEITAQSDASEIRQDWKPTFLSNEEFTQLMLEALDGFFLAIMTDGSIIYVSESVTSLLEHLPSDLVDQSIFNFIPEGEHSEVYKILSTHLLESDSLTPEYLKSKNQLEFCCHMLRGTIDPKEPSTYEYVKFIGNFKSLNSVSSSAHNGFEGTIQRTHRPSYEDRVCFVATVRLATPQFIKEMCTVEEPNEEFTSRHSLEWKFLFLDHRAPPIIGYLPFEVLGTSGYDYYHVDDLENLAKCHEHLMQYGKGKSCYYRFLTKGQQWIWLQTHYYITYHQWNSRPEFIVCTHTVVSYAEVRAERRRELGIEESLPETAADKSQDSGSDNRINTVSLKEALERFDHSPTPSASSRSSRKSSHTAVSDPSSTPTKIPTDTSTPPRQHLPAHEKMVQRRSSFSSQSINSQSVGSSLTQPVMSQATNLPIPQGMSQALQMPTVQIYELKNHYI

SEQ ID NO: 807364 - protein, 187 aa, Homo sapiens
MYLQVETRTSSRLHLKRAPGIRSWSLLVGILSIGLAAAYYSGDSLGWKLFYVTGCLFVAVQNLEDWEEAIFDKSTGKVVLKTFSLYKKLLTLFRAGHDQVVVLLHDVRDVSVEEEKVRYFGKGYMVVLRLATGFSHPLTQSAVMGHRSDVEAIAKLITSFLELHCLESPTELSQSSDSEAGDPASQS

SEQ ID NO: 807365 - protein, 231 aa, Homo sapiens
RLGSAPIPEVRAAPPPPVRVSLLRRGDRCALDPSSCREWCCPLGMYLQVETRTSSRLHLKRAPGIRSWSLLVGILSIGLAAAYYSGDSLGWKLFYVTGCLFVAVQNLEDWEEAIFDKSTGKVVLKTFSLYKKLLTLFRAGHDQVVVLLHDVRDVSVEEEKVRYFGKGYMVVLRLATGFSHPLTQSAVMGHRSDVEAIAKLITSFLELHCLESPTELSQSSDSEAGDPASQS

SEQ ID NO: 807366 - protein, 227 aa, Homo sapiens
LVVSPRDLWLSVARASALLRRGDRCALDPSSCREWCCPLGMYLQVETRTSSRLHLKRAPGIRSWSLLVGILSIGLAAAYYSGDSLGWKLFYVTGCLFVAVQNLEDWEEAIFDKSTGKVVLKTFSLYKKLLTLFRAGHDQVVVLLHDVRDVSVEEEKVRYFGKGYMVVLRLATGFSHPLTQSAVMGHRSDVEAIAKLITSFLELHCLESPTELSQSSDSEAGDPASQS

SEQ ID NO: 807367 - protein, 231 aa, Homo sapiens; identical to SEQ ID NO: 807365

SEQ ID NO: 807368 - protein, 215 aa, Homo sapiens
CRLYAPELWDDRCALDPSSCREWCCPLGMYLQVETRTSSRLHLKRAPGIRSWSLLVGILSIGLAAAYYSGDSLGWKLFYVTGCLFVAVQNLEDWEEAIFDKSTGKVVLKTFSLYKKLLTLFRAGHDQVVVLLHDVRDVSVEEEKVRYFGKGYMVVLRLATGFSHPLTQSAVMGHRSDVEAIAKLITSFLELHCLESPTELSQSSDSEAGDPASQS

SEQ ID NO: 807369 - protein, 187 aa, Homo sapiens; identical to SEQ ID NO: 807364

SEQ ID NO: 807370 - protein, 231 aa, Homo sapiens; identical to SEQ ID NO: 807365

SEQ ID NO: 807371 - protein, 174 aa, Homo sapiens
MYLQVETRTSSRLHLKRAPGIRSWSLLVGDSLGWKLFYVTGCLFVAVQNLEDWEEAIFDKSTGKVVLKTFSLYKKLLTLFRAGHDQVVVLLHDVRDVSVEEEKVRYFGKGYMVVLRLATGFSHPLTQSAVMGHRSDVEAIAKLITSFLELHCLESPTELSQSSDSEAGDPASQS

SEQ ID NO: 807372 - protein, 223 aa, Homo sapiens
MWKPSPSSSPASWSCTALRAPQSCLRAATVRPVTLQARADSPTVPEPVHRPQDPWHIPGVPEPVHRPQDPWHIPGVPEPVHRPQDPWHIPGVPEPVHRPQDPWHIPGVPEPVHRPQDPWPWLQLVPPAELAYCLLMLLLAHCMKQQARPGHPDFLHREAWACLSAAGGLASPGLLLWATARPRASGEAGPGRALVGADAACCPRHSVLSLVDIPSGQVLPQGQ

SEQ ID NO: 807373 - protein, 221 aa, Homo sapiens
MWKPSPSSSPASWSCTALRAPQSCLRAATVRPVTLQARADSPTVPEPVHRPQDPWHIPGVPEPVHRPQDPWHIPGVPEPVHRPQDPWHIPGVPEPVHRPQDRGTFRCAEPVTATDPWPWLQLVPPAELAYCLLMLLLAHCMKQQARPGHPDFLHREAWACLSAAGGLASPGLLLWATARPRASGEAGPGRALVGADAACCPRHSVLSLVDIPSGQVLPQGQ

SEQ ID NO: 807374 - protein, 231 aa, Homo sapiens; identical to SEQ ID NO: 807365

SEQ ID NO: 807375 - protein, 172 aa, Homo sapiens
MYLQVETRTSSRLHLKRAPGIRSWSLLVGILSIGLAAAYYSGDSLGWKLFYVTGCLFVAVQNLEDWEEAIFDKSTGKVVLKTFSLYKKLLTLFRAGHDQVVVLLHDVRDVSVEEEKVRYFGKGYMVVLRLATGFSHPLTQSAVMGHRRGLGFSWCLQPSWPIACSCCCLHTA

SEQ ID NO: 807376 - protein, 130 aa, Homo sapiens
MYLQVETRTSSRLHLKRAPGIRSWSLLVGILSIGLAAAYYSGDSLGWKLFYVTGCLFVAVQNLEDWEEAIFDKSTGKVVLKTFSLYKKLLTLFRAGHDQVVVLLHVVPDTASSPWWTSPAVRCFPKGSEG

SEQ ID NO: 807377 - protein, 119 aa, Homo sapiens
MYLQVETRTSSRLHLKRAPGIRSWSLLVGDSLGWKLFYVTGCLFVAVQNLEDWEETILTRQCSWSPECTQVLPGAVCTERAWPDALACELGTPGPCEPLGGRPRNGWVGQGTPLPHVWL

SEQ ID NO: 807378 - protein, 105 aa, Homo sapiens
MYLQVETRTSSRLHLKRAPGIRSWSLLVGILSIGLAAAYYSGDSLGWKLFYVTGCLFVAVQNLEDWEDKAGSGAGQSPGLFSSWVFCNGNERRRKGPGWPSASPS

SEQ ID NO: 807379 - protein, 101 aa, Homo sapiens
MSWSSQAGALCPSPDSLGWKLFYVTGCLFVAVQNLEDWEDKAGSGAGQSPGLFSSWVFCNGNERRRKGPGCLAPPRPEALVPAWRSPFIRTWPLHSSGTVL

SEQ ID NO: 807380 - protein, 228 aa, Homo sapiens
MLASKKAGLNWPRAGSRSLLRRGDRCALDPSSCREWCCPLGMYLQVETRTSSRLHLKRAPGIRSWSLLVGILSIGLAAAYYSGDSLGWKLFYVTGCLFVAVQNLEDWEEAIFDKSTGKVVLKTFSLYKKLLTLFRAGHDQVVVLLHDVRDVSVEEEKVRYFGKGYMVVLRLATGFSHPLTQSAVMGHRSDVEAIAKLITSFLELHCLESPTELSQSSDSEAGDPASQS

SEQ ID NO: 807381 - protein, 187 aa, Homo sapiens; identical to SEQ ID NO: 807364

SEQ ID NO: 807382 - protein, 187 aa, Homo sapiens; identical to SEQ ID NO: 807364

SEQ ID NO: 807383 - protein, 187 aa, Homo sapiens; identical to SEQ ID NO: 807364

SEQ ID NO: 807384 - protein, 223 aa, Homo sapiens; identical to SEQ ID NO: 807372

SEQ ID NO: 807385 - protein, 223 aa, Homo sapiens; identical to SEQ ID NO: 807372

SEQ ID NO: 807386 - protein, 221 aa, Homo sapiens; identical to SEQ ID NO: 807373

SEQ ID NO: 807387 - protein, 199 aa, Homo sapiens
MYLQVETRTSSRLHLKRAPGIRSWSLLVGILSIGLAAAYYSGDSLGWKLFYVTGCLFVAVQNLEDWEEAIFDKSTGKVVLKTFSLYKKLLTLFRAGHDQVVVLLHDVRDVSVEEEKVRYFGKGYMVVLRLATGFSHPLTQSAVMGHRLSPTQRPLPGGHPQRSGASPRAVRGEHPGPTWLCTLQPHCGSCPSPRTRLPC

SEQ ID NO: 807388 - protein, 223 aa, Homo sapiens; identical to SEQ ID NO: 807372

SEQ ID NO: 807389 - protein, 58 aa, Homo sapiens
MYLQVETRTSSRLHLKRAPGIRSWSLLVGGKALHVPPQNPRTGSLTFKKDENETKYFL

SEQ ID NO: 807390 - protein, 131 aa, Homo sapiens
GKHRPQLPGTPVIAAARSRPGNCPFSGVMMGSKMASASRVVQVVKPHTPLIRFPDRRDNPKPNVSEALRSAGLPSHSSVISQHSKGSKSPDLLMYQGPPDTAEIIKTLPQKYRRKLVSQEEMEFIQRGGPE

SEQ ID NO: 807391 - protein, 131 aa, Homo sapiens; identical to SEQ ID NO: 807390

SEQ ID NO: 807392 - protein, 131 aa, Homo sapiens; identical to SEQ ID NO: 807390

SEQ ID NO: 807393 - protein, 131 aa, Homo sapiens; identical to SEQ ID NO: 807390

SEQ ID NO: 807394 - protein, 115 aa, Homo sapiens
MVNDLVLWISSPNSKRRPGGESDAVREAISRMEFVRVIDYGSSQAGCPSELEYQDLRPVCEDGTLSLLDRAVRWVRRRGFEPCGNRAASWQVGPVPTAGIPRSSARTLLVLGVCG

SEQ ID NO: 807395 - protein, 131 aa, Homo sapiens; identical to SEQ ID NO: 807390

SEQ ID NO: 807396 - protein, 260 aa, Homo sapiens
GKHRPQLPGTPVIAAARSRPGNCPFSGVMMGSKMASASRVVQVVKPHTPLIRFPDRRDNPKPNVSEALRSAGLPSHSSVISQHSKGSKSPDLLMYQGPPDTAEIIKTLPQKYRRKLVSQEEMEFIQRCVCRGGPENHGGWPVGFGGVFHKFFSQKGGGKTPKNNETVFSFHDDGGGHNTTHQSQPSFFFSPRGGAGGRSHTSSSPPPRRIVLYKPINYLTPCRQRKQHNNAPPLTYTNDNAPNQHPPPFAFILHNDNQPP

SEQ ID NO: 807397 - protein, 131 aa, Homo sapiens; identical to SEQ ID NO: 807390

SEQ ID NO: 807398 - protein, 159 aa, Homo sapiens
RRCVLGTITRAVYVRIPENCKPLCSWASEVMPMASPQTLVLYLLVLAVTEAWGQEAVIPGCHLHPFNVTVRSDRQGTCQGSHVAQACVGHCESSAFPSRYSVLVASGYRHNITSVSQCCTISGLKKVKVQLQCVGSRREELEIFTARACQCDMCRLSRY

SEQ ID NO: 807399 - protein, 421 aa, Homo sapiens
MSALRRSGYGPSDGPSYGRYYGPGGGDVPVHPPPPLYPLRPEPPQPPISWRVRGGGPAETTWLGEGGGGDGYYPSGGAWPEPGRAGGSHQSLNSYTNGAYGPTYPPGPGANTASYSGAYYAPGYTQTSYSTEVPSTYRSSGNSPTPVSRWIYPQQDCQTEAPPLRGQVPGYPPSQNPGMTLPHYPYGDGNRSVPQSGPTVRPQEDAWASPGAYGMGGRYPWPSSAPSAPPGNLYMTESTSPWPSSGSPQSPPSPPVQQPKDSSYPYSQSDQSMNRHNFPCSVHQYESSGTVNNDDSDLLDSQVQYSAEPQLYGNATSDHPNNQDQSSSLPEECVPSDESTPPSIKKIIHVLEKVQYLEQEVEEFVGKKTDKAYWLLEEMLTKELLELDSVETGGQDSVRQARKEAVCKIQAILEKLEKKGL

SEQ ID NO: 807400 - protein, 457 aa, Homo sapiens
MSALRRSGYGPSDGPSYGRYYGPGGGDVPVHPPPPLYPLRPEPPQPPISWRVRGGGPAETTWLGEGGGGDGYYPSGGAWPEPGRAGGSHQEQPPYPSYNSNYWNSTARSRAPYPSTYPVRPELQGQSLNSYTNGAYGPTYPPGPGANTASYSGAYYAPGYTQTSYSTEVPSTYRSSGNSPTPVSRWIYPQQDCQTEAPPLRGQVPGYPPSQNPGMTLPHYPYGDGNRSVPQSGPTVRPQEDAWASPGAYGMGGRYPWPSSAPSAPPGNLYMTESTSPWPSSGSPQSPPSPPVQQPKDSSYPYSQSDQSMNRHNFPCSVHQYESSGTVNNDDSDLLDSQVQYSAEPQLYGNATSDHPNNQDQSSSLPEECVPSDESTPPSIKKIIHVLEKVQYLEQEVEEFVGKKTDKAYWLLEEMLTKELLELDSVETGGQDSVRQARKEAVCKIQAILEKLEKKGL

SEQ ID NO: 807401 - protein, 218 aa, Homo sapiens
MTLDLRPCTERLRGSPQFLKQLGLHPNWQFVDVYGMDPELLSMVPRPVCAVLLLFPITEKYEVFRTEEEEKIKSQGQDVTSSVYFMKQTISNACGTIGLIHAIANNKDKMHFESGSTLKKFLEESVSMSPEERARYLENYDAIRVTHETSAHEGQTEAPSIDEKVDLHFIALVHVDGHLYELDGRKPFPINHGETSDETLLEVTVTLVGPSSSIFCHL

SEQ ID NO: 807402 - protein, 71 aa, Homo sapiens
RLRGISDRLGGKRGSCRDSLIFPAHGRKPFPINHGETSDETLLEDAIEVCKKFMERDPDELRFNAIALSAA

SEQ ID NO: 807403 - protein, 294 aa, Homo sapiens
MTLDLRPCTERLRGSPGPSNSFWCLGAPPPGGVLGGPRSRRAWAEAAAVAKAAAVRAGGPGTAAMEGQRWLPLEANPEVTNQFLKQLGLHPNWQFVDVYGMDPELLSMVPRPVCAVLLLFPITEKYEVFRTEEEEKIKSQGQDVTSSVYFMKQTISNACGTIGLIHAIANNKDKMHFESGSTLKKFLEESVSMSPEERARYLENYDAIRVTHETSAHEGQTEAPSIDEKVDLHFIALVHVDGHLYELDGRKPFPINHGETSDETLLEDAIEVCKKFMERDPDELRFNAIALSAA

SEQ ID NO: 807404 - protein, 261 aa, Homo sapiens
MTLDLRPCTERLRGSPGPSNSFWCLGAPPPGGVLGGPRSRRAWAEAAAVAKAAAVRAGGPGTAAMEGQRWLPLEANPEVTNQFLKQLGLHPNWQFVDVYGMDPELLSMVPRPVCAVLLLFPITEKYEVFRTEEEEKIKSQGQDVTSSVYFMKQTISNACGTIGLIHAIANNKDKMHFESGSTLKKFLEESVSMSPEERARYLENYDAIRVTHETSAHEGQTEAPSIDEKVDLHFIALVHVDGHLYELGCHRSLQEVYGARP

SEQ ID NO: 807405 - protein, 260 aa, Homo sapiens
MTLDLRPCTERLRGSPGPSNSFWCLGAPPPGGVLGGPRSRRAWAEAAAVAKAAAVRAGGPGTAAMEGQRWLPLEANPEVTNQFLKQLGLHPNWQFVDVYGMDPELLSMVPRPVCAVLLLFPITEKYEVFRTEEEEKIKSQGQDVTSSVYFMKQTISNACGTIGLIHAIANNKDKMHFESGSTLKKFLEESVSMSPEERARYLENYDAIRVTHETSAHEGQTESSSPSSSQPHSSHCRTKASSLCHHASLPWVKRNHVGPA

SEQ ID NO: 807406 - protein, 294 aa, Homo sapiens; identical to SEQ ID NO: 807403

SEQ ID NO: 807407 - protein, 229 aa, Homo sapiens
MTLDLRPCTERLRGSPQFLKQLGLHPNWQFVDVYGMDPELLSMVPRPVCAVLLLFPITEKYEVFRTEEEEKIKSQGQDVTSSVYFMKQTISNACGTIGLIHAIANNKDKMHFESGSTLKKFLEESVSMSPEERARYLENYDAIRVTHETSAHEGQTEAPSIDEKVDLHFIALVHVDGHLYELDGRKPFPINHGETSDETLLEDAIEVCKKFMERDPDELRFNAIALSAA

SEQ ID NO: 807408 - protein, 294 aa, Homo sapiens; identical to SEQ ID NO: 807403

SEQ ID NO: 807409 - protein, 283 aa, Homo sapiens
MTLDLRPCTERLRGSPGPSNSFWCLGAPPPGGVLGGPRSRRAWAEAAAVAKAAAVRAGGPGTAAMEGQRWLPLEANPEVTNQFLKQLGLHPNWQFVDVYGMDPELLSMVPRPVCAVLLLFPITEKYEVFRTEEEEKIKSQGQDVTSSVYFMKQTISNACGTIGLIHAIANNKDKMHFESGSTLKKFLEESVSMSPEERARYLENYDAIRVTHETSAHEGQTEAPSIDEKVDLHFIALVHVDGHLYELDGRKPFPINHGETSDETLLEVTVTLVGPSSSIFCHL

SEQ ID NO: 807410 - protein, 325 aa, Homo sapiens
MEGLEENGGVVQVGELLPCKICGRTFFPVALKKHGPICQKTATKKRKTFDSSRQRAEGTDIPTVKPLKPRPEPPKKPSNWRRKHEEFIATIRAAKGLDQALKEGGKLPPPPPPSYDPDYIQCPYCQRRFNENAADRHINFCKEQAARISNKGKFSTDTKGKPTSRTQVYKPPALKKSNSPGTASSGSSRLPQPSGAGKTVVGVPSGKVSSSSSSLGNKLQTLSPSHKGIAAPHAGANVKPRNSTPPSLARNPAPGVLTNKRKTYTESYIARPDGDCASSLNGGNIKGIEGHSPGNLPKFCHECGTKYPVEWAKFCCECGIRRMIL

SEQ ID NO: 807411 - protein, 325 aa, Homo sapiens; identical to SEQ ID NO: 807410

SEQ ID NO: 807412 - protein, 151 aa, Homo sapiens
MRAGRLERARNSWGPWTPVAGRRGLVRCGGPRCARRAFRRAGGIGYRTVPDAVELTLPGCPASDGLQLGFPARSQILPLARRLHVSSYHFLILLDFLSALLVIPVSGQILFSLYWTLSIIVHGLNTNRPLCAAAPGCVSSLELLTFLGRFP

SEQ ID NO: 807413 - protein, 295 aa, Homo sapiens
MAFMRCHYLDLSDMESKRSSDIIDYSLRRTSEHVKPLKPRPEPPKKPSNWRRKHEEFIATIRAAKGLDQALKEGGKLPPPPPPSYDPDYIQCPYCQRRFNENAADRHINFCKEQAARISNKGKFSTDTKGKPTSRTQVYKPPALKKSNSPGTASSGSSRLPQPSGAGKTVVGVPSGKVSSSSSSLGNKLQTLSPSHKGIAAPHAGANVKPRNSTPPSLARNPAPGVLTNKRKTYTESYIARPDGDCASSLNGGNIKGIEGHSPGNLPKFCHECGTKYPVEWAKFCCECGIRRMIL

SEQ ID NO: 807414 - protein, 112 aa, Homo sapiens
IRGRVDQVYKPPALKKSNSPGTASSGSSRLPQPSGAGKTVVGVPSGKVSSSSSSLGNKLQTLSPSHKGIAAPHAGANVKPRNSTPPSLARNPAPGVLTNKRKSRRGREFSSS

SEQ ID NO: 807415 - protein, 94 aa, Homo sapiens [sequence omitted]

SEQ ID NO: 807416 - protein, 387 aa, Homo sapiens
RSTKKLNGMGDDGSPPAKKMITDIHANGKTINKVPTVKKEHLDDYGEAPVETDGEHVKRTCTSVPETLHLNPSLKHTLAQFHLSSQSSLGGPAAFSARHSQESMSPTVFLPLPSPQVLPGPLLIPSDSSTELTQTVLEGESISCFQVGGEKRLCLPQVLNSVLREFTLQQINTVCDELYIYCSRCTSDQLHILKVLGILPFNAPSCGLITLTDAQRLCNALLRPRTFPQNGSVLPAKSSLAQLKETGSAFEVEHECLGKCQGLFAPQFYVQPDAPCIQCLECCGMFAPQTFVMHSHRSPDKRTCHWGFESAKWHCYLHVNQKYLGTPEEKKLKIILEEMKEKFSMRSGKRNQSKTDAPSGMELQSWYPVIKQEGDHVSQTHSFLHPS

SEQ ID NO: 807417 - protein, 135 aa, Homo sapiens
MELAAAGTELRFGANQVGLGALEEGEESMEHKSKEQRLRLWVQGVVHEVTKEPWELKPLSLEPRLYVSKFWRVPPLRTTSLQALAALPGFLLPLLAVLTHDTRSESKQKSWGTEGGAQLKEEPLTKAHLKAQEKV

SEQ ID NO: 807418 - protein, 92 aa, Homo sapiens
GGGRRRGRKAAGRRKAGTGRDHRSPSPTQQPPGRERKKEPGRRAKRGERSREEIFTFPPHAHFEALLEAAVLALVAVVLVDGTVPVGTACVS

SEQ ID NO: 807419 - protein, 112 aa, Homo sapiens
ALRAGLAAGRSTLVRSPARRRGPGRGICALRRRRKDRGRALAPAEGHHSLRRPEGQSTGHAPGAFKKEARPDRGWRTLPEPQAHGPVPRGQLAPPRVGTADLLVMVPREYRD

SEQ ID NO: 807420 - protein, 93 aa, Homo sapiens
RPRPTPPPHRTYPRHEHETTARALKRSRRREGDRAREGERGERRREWETSDSERQGTAGTLDAQSAGPAALGPWTVRRGHQKRDSAKSCLTSR

SEQ ID NO: 807421 - protein, 153 aa, Homo sapiens
MHSASGGPLYAADGEEATGGSRGSLPSSLCPNKRANALPSSGQLKGETNTIKIDQKKRKKRKPFYVQILNRTPHTVRGRESRAEAAGGEREIGRGKENAERDEGSGRPATASARAPQAHWMPSPPAQPPSDPGPCVVGTRNETRPNPASPAGR

SEQ ID NO: 807422 - protein, 153 aa, Homo sapiens; identical to SEQ ID NO: 807421

SEQ ID NO: 807423 - protein, 153 aa, Homo sapiens; identical to SEQ ID NO: 807421

SEQ ID NO: 807424 - protein, 153 aa, Homo sapiens; identical to SEQ ID NO: 807421

SEQ ID NO: 807425 - protein, 247 aa, Homo sapiens
NGDTILEDLPIQSGDMLIIEEDQTRPRSSPAFTKRGASSYVRETLPVLTRTVVPADNSCLFTSVYYVVEGGVLNPACAPEMRRLIAQIVASDPDFYSEAILGKTNQEYCDWIKRDDTWGGAIEISILSKFYQCEICVVDTQTVRIDRFGEDAGYTKRVLLIYDGIHYDPLQRNFPDPDTPPLTIFSSNDDIVLVQALELADEARRRRQFTDVNRFTLRCMVCQKGLTGQAEAREHAKETGHTNFGEV

SEQ ID NO: 807426 - protein, 213 aa, Homo sapiens
NGDTILEDLPIQSGDMLIIEEDQTRPRSSPAFTKRGASSYVRETLPVLTRTVVPADNSCLFTSVYYVVEGGVLNPACAPEMRRLIAQIVASDPDFYSEAILGKTNQEYCDWIKRDDTWGGAIEISILSKFYQCEICVVDTQTVRIDRFGEDAGYTKRVLLIYDGIHYDPLQRNFPDPDTPPLTIFSSLRFKRREDERWTDGSSLGINFLYAAT

SEQ ID NO: 807427 - protein, 260 aa, Homo sapiens
AGMKSHRGDGEGQGPGPPPSRSQQLLGVLSAGLLKVVFVVFASLCAWYSGYLLAELIPDAPLSSAAYSIRSIGERPVLKAPVPKRQKCDHWTPCPSDTYAYRLLSGGGRSKYAKICFEDNLLMGEQLGNVARGINIAIVNYVTGNVTATRCFDMYEGDNSGPMTKFIQSAAPKSLLFMVTYDDGSTRLNNDAKNAIEALGSKEIRNMKFRSSWVFIAAKGLELPSEIQREKINHSDAKNNRYSGWPAEIQIEGCIPKERS

SEQ ID NO: 807428 - protein, 252 aa, Homo sapiens
RHDRCPPLAFLTQGLRWLRSPGSCRQGQEGSGTWKMRPLAGGLLKVVFVVFASLCAWYSGYLLAELIPDAPLSSAAYSIRSIGERPVLKAPVPKRQKCDHWTPCPSDTYAYRLLSGGGRSKYARGINIAIVNYVTGNVTATRCFDMYEGDNSGPMTKFIQSAAPKSLLFMVTYDDGSTRLNNDAKNAIEALGSKEIRNMKFRSSWVFIAAKGLELPSEIQREKINHSDAKNNRYSGWPAEIQIEGCIPKERS

SEQ ID NO: 807429 - protein, 260 aa, Homo sapiens; identical to SEQ ID NO: 807427

SEQ ID NO: 807430 - protein, 270 aa, Homo sapiens
RHDRCPPLAFLTQGLRWLRSPGSCRQGQEGSGTWKMRPLAGGLLKVVFVVFASLCAWYSGYLLAELIPDAPLSSAAYSIRSIGERPVLKAPVPKRQKCDHWTPCPSDTYAYRLLSGGGRSKYAKICFEDNLLMGEQLGNVARGINIAIVNYVTGNVTATRCFDMYEGDNSGPMTKFIQSAAPKSLLFMVTYDDGSTRLNNDAKNAIEALGSKEIRNMKFRSSWVFIAAKGLELPSEIQREKINHSDAKNNRYSGWPAEIQIEGCIPKERS

SEQ ID NO: 807431 - protein, 222 aa, Homo sapiens
RHDRCPPLAFLTQGLRWLRSPGSCRQGQEGSGTWKMRPLAGAPVPKRQKCDHWTPCPSDTYAYRLLSGGGRSKYAKICFEDNLLMGEQLGNVARGINIAIVNYVTGNVTATRCFDMYEGDNSGPMTKFIQSAAPKSLLFMVTYDDGSTRLNNDAKNAIEALGSKEIRNMKFRSSWVFIAAKGLELPSEIQREKINHSDAKNNRYSGWPAEIQIEGCIPKERS

SEQ ID NO: 807432 - protein, 107 aa, Homo sapiens
MSRSDNSGPMTKFIQSAAPKSLLFMVTYDDGSTRLNNDAKNAIEALGSKEIRNMKFRSSWVFIAAKGLELPSEIQREKINHSDAKNNRYSGWPAEIQIEGCIPKERS

SEQ ID NO: 807433 - protein, 431 aa, Homo sapiens
MRALLARLLLCVLVVSDSKGSNELHQVPSNCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKPLVQECMVHDCADGKKPSSPPEELKFQCGQKTLRPRFKIIGGEFTTIENQPWFAAIYRRHRGGSVTYVCGGSLISPCWVISATHCFIDYPKKEDYIVYLGRSRLNSNTQGEMKFEVENLILHKDYSADTLAHHNDIALLKIRSKEGRCAQPSRTIQTICLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 807434 - protein, 431 aa, Homo sapiens; identical to SEQ ID NO: 807433

SEQ ID NO: 807435 - protein, 68 aa, Homo sapiens
PLSFSKRTMPTDLMLFSWAWGNIITAGEVGATRTKSPPYSFPETLLPSPSPRGLAIAQEKCGLWLSLP

SEQ ID NO: 807436 - protein, 93 aa, Homo sapiens
DRPSGQIGLMQTPPCFLHLADYLYPEQLKMTVVKLISHRECQQPHYYGSEVTTKMLCAADPQWKTDSCQVSVPSISLHLFHISPELLGLFQPA

SEQ ID NO: 807437 - protein, 431 aa, Homo sapiens; identical to SEQ ID NO: 807433

SEQ ID NO: 807438 - protein, 470 aa, Homo sapiens
YRAGAAGRSTVRRPQPRSPGQGPPVPAAPARALLPQPPSRRLAPRPRHHESPAGAPASLRPGRERLQTNCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKPLVQECMVHDCADGKKPSSPPEELKFQCGQKTLRPRFKIIGGEFTTIENQPWFAAIYRRHRGGSVTYVCGGSLISPCWVISATHCFIDYPKKEDYIVYLGRSRLNSNTQGEMKFEVENLILHKDYSADTLAHHNDIALLKIRSKEGRCAQPSRTIQTICLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 807439 - protein, 307 aa, Homo sapiens
MLGTRQTLNYVQVGLKPLVQECMVHDCADGKKPSSPPEELKFQCGQKTLRPRFKIIGGEFTTIENQPWFAAIYRRHRGGSVTYVCGGSLISPCWVISATHCFIDYPKKEDYIVYLGRSRLNSNTQGEMKFEVENLILHKDYSADTLAHHNDIALLKIRSKEGRCAQPSRTIQTICLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 807440 - protein, 139 aa, Homo sapiens
MTWKGGGGWMAAVTQGPGITWGSLLPSAVRQGEQKCKNTDVSIFLNWGVEGCLLTASKELTVEGPQCIPPLPESLSPLGPPGSQSSEETDPSCFNSCCCFSLWAGPGRGRAEQAPGGLQSQLDLAVSPAGSPADTGEVG

SEQ ID NO: 807441 - protein, 139 aa, Homo sapiens; identical to SEQ ID NO: 807440

SEQ ID NO: 807442 - protein, 139 aa, Homo sapiens; identical to SEQ ID NO: 807440

SEQ ID NO: 807443 - protein, 139 aa, Homo sapiens; identical to SEQ ID NO: 807440

SEQ ID NO: 807444 - protein, 139 aa, Homo sapiens; identical to SEQ ID NO: 807440

SEQ ID NO: 807445 - protein, 112 aa, Homo sapiens [sequence omitted]

SEQ ID NO: 807446 - protein, 92 aa, Homo sapiens
QRPDDEFSDFVIYEDDKRGGGGGGSGGIGYPYPRAPVFPGRGSYSNRGNYNRGGMPNRGNYNQNFRGRGNNRGYKNQSQGYNQWQQGGTELV

SEQ ID NO: 807447 - protein, 807 aa, Homo sapiens
MSSSPVNVKKLKVSELKEELKKRRLSDKGLKAELMERLQAALDDEEAGGRPAMEPGNGSLDLGGDSAGRSGAGLEQEAAAGGDEEEEEEEEEEEGISALDGDQMELGEENGAAGAADSGPMEEEEAASEDENGDDQGFQEGEDELGDEEEGAGDENGHGEQQPQPPATQQQQPQQQRGAAKEAAGKSSGPTSLFAVTVAPPGARQGQQQAGGDGKTEQKGGDKKRGVKRPREDHGRGYFEYIEENKYSRAKSPQPPVEEEDEHFDDTVVCLDTYNCDLHFKISRDRLSASSLTMESFAFLWAGGRASYGVSKGKVCFEMKVTEKIPVRHLYTKDIDIHEVRIGWSLTTSGMLLGEEEFSYGYSLKGIKTCNCETEDYGEKFDENDVITCFANFESDEVELSYAKNGQDLGVAFKISKEVLAGRPLFPHVLCHNCAVEFNFGQKEKPYFPIPEEYTFIQNVPLEDRVRGPKGPEEKKDCEVVMMIGLPGAGKTTWVTKHAAENPGKYNILGTNTIMDKMMVAGFKKQMADTGKLNTLLQRAPQCLGKFIEIAARKKRNFILDQTNVSAAAQRRKMCLFAGFQRKAVVVCPKDEDYKQRTQKKAEVEGKDLPEHAVLKMKGNFTLPEVAECFDEITYVELQKEEAQKLLEQYKEGRSKKALPPEKKQNTGSKKSNKNKSGKNQFNRGGGHRGRGGFNMRGGNFRGGAPGNRGGYNRRGNMPQRGGGGGGSGGIGYPYPRAPVFPGRGSYSNRGNYNRGGMPNRGNYNQNFRGRGNNRGYKNQSQGYNQWQQGQFWGQKPWSQHYHQGYY

SEQ ID NO: 807448 - protein, 203 aa, Homo sapiens
LFVPVVIIFEFLKKLKVSELKEELKKRRLSDKGLKAELMERLQAALDDEEAGGRPAMEPGNGSLDLGGDSAGRSGAGLEQEAAAGGDEEEEEEEEEEEGISALDGDQMELGEENGAAGAADSGPMEEEEAASEDENGDDQGFQEGEDELGDEEEGAGDENGHGEQQPQPPATQQQQPQQQRGAAKEAAGKSSGPTSLFAVTVA

SEQ ID NO: 807449 - protein, 807 aa, Homo sapiens; identical to SEQ ID NO: 807447

SEQ ID NO: 807450 - protein, 826 aa, Homo sapiens
MSSSPVNVKKLKVSELKEELKKRRLSDKGLKAELMERLQAALDDEEAGGRPAMEPGNGSLDLGGDSAGRSGAGLEQEAAAGGDEEEEEEEEEEEGISALDGDQMELGEENGAAGAADSGPMEEEEAASEDENGDDQGFQEGEDELGDEEEGAGDENGHGEQQPQPPATQQQQPQQQRGAAKEAAGKSSGPTSLFAVTVAPPGARQGQQQAGGKKKAEGGGGGGRPGAPAAGDGKTEQKGGDKKRGVKRPREDHGRGYFEYIEENKYSRAKSPQPPVEEEDEHFDDTVVCLDTYNCDLHFKISRDRLSASSLTMESFAFLWAGGRASYGVSKGKVCFEMKVTEKIPVRHLYTKDIDIHEVRIGWSLTTSGMLLGEEEFSYGYSLKGIKTCNCETEDYGEKFDENDVITCFANFESDEVELSYAKNGQDLGVAFKISKEVLAGRPLFPHVLCHNCAVEFNFGQKEKPYFPIPEEYTFIQNVPLEDRVRGPKGPEEKKDCEVVMMIGLPGAGKTTWVTKHAAENPGKYNILGTNTIMDKMMVAGFKKQMADTGKLNTLLQRAPQCLGKFIEIAARKKRNFILDQTNVSAAAQRRKMCLFAGFQRKAVVVCPKDEDYKQRTQKKAEVEGKDLPEHAVLKMKGNFTLPEVAECFDEITYVELQKEEAQKLLEQYKEGRSKKALPPEKKQNTGSKKSNKNKSGKNQFNRGGGHRGRGGFNMRGGNFRGGAPGNRGGYNRRGNMPQRGGGGGGSGGIGYPYPRAPVFPGRGSYSNRGNYNRGGMPNRGNYNQNFRGRGNNRGYKNQSQGYNQWQQGQFWGQKPWSQHYHQGYY

SEQ ID NO: 807451 - protein, 807 aa, Homo sapiens; identical to SEQ ID NO: 807447

SEQ ID NO: 807452 - protein, 836 aa, Homo sapiens
MSSSPVNVKKLKVSELKEELKKRRLSDKGLKAELMERLQAALDDEEAGGRPAMEPGNGSLDLGGDSAGRSGAGLEQEAAAGGDEEEEEEEEEEEGISALDGDQMELGEENGAAGAADSGPMEEEEAASEDENGDDQGFQEGEDELGDEEEGAGDENGHGEQQPQPPATQQQQPQQQRGAAKEAAGKSSGPTSLFAVTVAPPGARQGQQQAGGKKKAEGGGGGGRPGAPAAGRWGGGKKTPGDGKTEQKGGDKKRGVKRPREDHGRGYFEYIEENKYSRAKSPQPPVEEEDEHFDDTVVCLDTYNCDLHFKISRDRLSASSLTMESFAFLWAGGRASYGVSKGKVCFEMKVTEKIPVRHLYTKDIDIHEVRIGWSLTTSGMLLGEEEFSYGYSLKGIKTCNCETEDYGEKFDENDVITCFANFESDEVELSYAKNGQDLGVAFKISKEVLAGRPLFPHVLCHNCAVEFNFGQKEKPYFPIPEEYTFIQNVPLEDRVRGPKGPEEKKDCEVVMMIGLPGAGKTTWVTKHAAENPGKYNILGTNTIMDKMMVAGFKKQMADTGKLNTLLQRAPQCLGKFIEIAARKKRNFILDQTNVSAAAQRRKMCLFAGFQRKAVVVCPKDEDYKQRTQKKAEVEGKDLPEHAVLKMKGNFTLPEVAECFDEITYVELQKEEAQKLLEQYKEGRSKKALPPEKKQNTGSKKSNKNKSGKNQFNRGGGHRGRGGFNMRGGNFRGGAPGNRGGYNRRGNMPQRGGGGGGSGGIGYPYPRAPVFPGRGSYSNRGNYNRGGMPNRGNYNQNFRGRGNNRGYKNQSQGYNQWQQGQFWGQKPWSQHYHQGYY

SEQ ID NO: 807453 - protein, 807 aa, Homo sapiens; identical to SEQ ID NO: 807447

SEQ ID NO: 807454 - protein, 648 aa, Homo sapiens
MSSGTKRKARATRTGTGSSSLNRRRRSSNSPTSLFAVTVAPPGARQGQQQAGGDGKTEQKGGDKKRGVKRPREDHGRGYFEYIEENKYSRAKSPQPPVEEEDEHFDDTVVCLDTYNCDLHFKISRDRLSASSLTMESFAFLWAGGRASYGVSKGKVCFEMKVTEKIPVRHLYTKDIDIHEVRIGWSLTTSGMLLGEEEFSYGYSLKGIKTCNCETEDYGEKFDENDVITCFANFESDEVELSYAKNGQDLGVAFKISKEVLAGRPLFPHVLCHNCAVEFNFGQKEKPYFPIPEEYTFIQNVPLEDRVRGPKGPEEKKDCEVVMMIGLPGAGKTTWVTKHAAENPGKYNILGTNTIMDKMMVAGFKKQMADTGKLNTLLQRAPQCLGKFIEIAARKKRNFILDQTNVSAAAQRRKMCLFAGFQRKAVVVCPKDEDYKQRTQKKAEVEGKDLPEHAVLKMKGNFTLPEVAECFDEITYVELQKEEAQKLLEQYKEGRSKKALPPEKKQNTGSKKSNKNKSGKNQFNRGGGHRGRGGFNMRGGNFRGGAPGNRGGYNRRGNMPQRGGGGGGSGGIGYPYPRAPVFPGRGSYSNRGNYNRGGMPNRGNYNQNFRGRGNNRGYKNQSQGYNQWQQGQFWGQKPWSQHYHQGYY

SEQ ID NO: 807455 - protein, 876 aa, Homo sapiens
MSSSPVNVKKLKVSELKEELKKRRLSDKGLKAELMERLQAALDDEEAGGRPAMEPGNGSLDLGGDSAGRSGAGLEQEAAAGGDEEEEEEEEEEEGISALDGDQMELGEENGAAGAADSGPMEEEEAASEDENGDDQGFQEGEDELGDEEEGAGDENGHGEQQPQPPATQQQQPQRRRAGLGPSPSLRSLRDTRGLRAWAAQFFFGFLESSRRLAKLVMSLDCVTSANRIRSGLFFEFTFESSVKTSVKKQDKVELLWFSERKSVFLLFRGLAFMGLVCVLGDGKTEQKGGDKKRGVKRPREDHGRGYFEYIEENKYSRAKSPQPPVEEEDEHFDDTVVCLDTYNCDLHFKISRDRLSASSLTMESFAFLWAGGRASYGVSKGKVCFEMKVTEKIPVRHLYTKDIDIHEVRIGWSLTTSGMLLGEEEFSYGYSLKGIKTCNCETEDYGEKFDENDVITCFANFESDEVELSYAKNGQDLGVAFKISKEVLAGRPLFPHVLCHNCAVEFNFGQKEKPYFPIPEEYTFIQNVPLEDRVRGPKGPEEKKDCEVVMMIGLPGAGKTTWVTKHAAENPGKYNILGTNTIMDKMMVAGFKKQMADTGKLNTLLQRAPQCLGKFIEIAARKKRNFILDQTNVSAAAQRRKMCLFAGFQRKAVVVCPKDEDYKQRTQKKAEVEGKDLPEHAVLKMKGNFTLPEVAECFDEITYVELQKEEAQKLLEQYKEGRSKKALPPEKKQNTGSKKSNKNKSGKNQFNRGGGHRGRGGFNMRGGNFRGGAPGNRGGYNRRGNMPQRGGGGGGSGGIGYPYPRAPVFPGRGSYSNRGNYNRGGMPNRGNYNQNFRGRGNNRGYKNQSQGYNQWQQGQFWGQKPWSQHYHQGYY

SEQ ID NO: 807456 - protein, 807 aa, Homo sapiens; identical to SEQ ID NO: 807447

SEQ ID NO: 807457 - protein, 550 aa, Homo sapiens
MFTLDVKSNTVFDIITDNCDLHFKISRDRLSASSLTMESFAFLWAGGRASYGVSKGKVCFEMKVTEKIPVRHLYTKDIDIHEVRIGWSLTTSGMLLGEEEFSYGYSLKGIKTCNCETEDYGEKFDENDVITCFANFESDEVELSYAKNGQDLGVAFKISKEVLAGRPLFPHVLCHNCAVEFNFGQKEKPYFPIPEEYTFIQNVPLEDRVRGPKGPEEKKDCEVVMMIGLPGAGKTTWVTKHAAENPGKYNILGTNTIMDKMMVAGFKKQMADTGKLNTLLQRAPQCLGKFIEIAARKKRNFILDQTNVSAAAQRRKMCLFAGFQRKAVVVCPKDEDYKQRTQKKAEVEGKDLPEHAVLKMKGNFTLPEVAECFDEITYVELQKEEAQKLLEQYKEGRSKKALPPEKKQNTGSKKSNKNKSGKNQFNRGGGHRGRGGFNMRGGNFRGGAPGNRGGYNRRGNMPQRGGGGGGSGGIGYPYPRAPVFPGRGSYSNRGNYNRGGMPNRGNYNQNFRGRGNNRGYKNQSQGYNQWQQGQFWGQKPWSQHYHQGYY

SEQ ID NO: 807458 - protein, 807 aa, Homo sapiens; identical to SEQ ID NO: 807447

SEQ ID NO: 807459 - protein, 541 aa, Homo sapiens
LKMKGNFTLPGVAECFDEITYVELQKEEAQKLLEQYEGRASYGVSKGKVCFEMKVTEKIPVRHLYTKDIDIHEVRIGWSLTTSGMLLGEEEFSYGYSLKGIKTCNCETEDYGEKFDENDVITCFANFESDEVELSYAKNGQDLGVAFKISKEVLAGRPLFPHVLCHNCAVEFNFGQKEKPYFPIPEEYTFIQNVPLEDRVRGPKGPEEKKDCEVVMMIGLPGAGKTTWVTKHAAENPGKYNILGTNTIMDKMMVAGFKKQMADTGKLNTLLQRAPQCLGKFIEIAARKKRNFILDQTNVSAAAQRRKMCLFAGFQRKAVVVCPKDEDYKQRTQKKAEVEGKDLPEHAVLKMKGNFTLPEVAECFDEITYVELQKEEAQKLLEQYKEGRSKKALPPEKKQNTGSKKSNKNKSGKNQFNRGGGHRGRGGFNMRGGNFRGGAPGNRGGYNRRGNMPQRGGGGGGSGGIGYPYPRAPVFPGRGSYSNRGNYNRGGMPNRGNYNQNFRGRGNNRGYKNQSQGYNQWQQGQFWGQKPWSQHYHQGYY

SEQ ID NO: 807460 - protein, 807 aa, Homo sapiens; identical to SEQ ID NO: 807447

SEQ ID NO: 807461 - protein, 326 aa, Homo sapiens
MMIGLPGAGKTTWVTKHAAENPGKYNILGTNTIMDKMMVAGFKKQMADTGKLNTLLQRAPQCLGKFIEIAARKKRNFILDQTNVSAAAQRRKMCLFAGFQRKAVVVCPKDEDYKQRTQKKAEVEGKDLPEHAVLKMKGNFTLPEVAECFDEITYVELQKEEAQKLLEQYKEGRSKKALPPEKKQNTGSKKSNKNKSGKNQFNRGGGHRGRGGFNMRGGNFRGGAPGNRGGYNRRGNMPQRGGGGGGSGGIGYPYPRAPVFPGRGSYSNRGNYNRGGMPNRGNYNQNFRGRGNNRGYKNQSQGYNQWQQGQFWGQKPWSQHYHQGYY

SEQ ID NO: 807462 - protein, 807 aa, Homo sapiens; identical to SEQ ID NO: 807447

SEQ ID NO: 807463 - protein, 807 aa, Homo sapiens; identical to SEQ ID NO: 807447

SEQ ID NO: 807464 - protein, 234 aa, Homo sapiens
MCLFAGFQRKAVVVCPKDEDYKQRTQKKAEVEGKDLPEHAVLKMKGNFTLPEVAECFDEITYVELQKEEAQKLLEQYKEGRSKKALPPEKKQNTGSKKSNKNKSGKNQFNRGGGHRGRGGFNMRGGNFRGGAPGNRGGYNRRGNMPQRGGGGGGSGGIGYPYPRAPVFPGRGSYSNRGNYNRGGMPNRGNYNQNFRGRGNNRGYKNQSQGYNQWQQGQFWGQKPWSQHYHQGYY

SEQ ID NO: 807465 - protein, 807 aa, Homo sapiens; identical to SEQ ID NO: 807447

SEQ ID NO: 807466 - protein, 164 aa, Homo sapiens
RARSGDTYVGRSKKALPPEKKQNTGSKKSNKNKSGKNQFNRGGGHRGRGGFNMRGGNFRGGAPGNRGGYNRRGNMPQRGGGGGGSGGIGYPYPRAPVFPGRGSYSNRGNYNRGGMPNRGNYNQNFRGRGNNRGYKNQSQGYNQWQQGQFWGQKPWSQHYHQGYY

SEQ ID NO: 807467 - protein, 807 aa, Homo sapiens; identical to SEQ ID NO: 807447

SEQ ID NO: 807468 - protein, 807 aa, Homo sapiens; identical to SEQ ID NO: 807447

SEQ ID NO: 807469 - protein, 804 aa, Homo sapiens
MSSSPVNVKKLKVSELKEELKKRRLSDKGLKAELMERLQAALDDEEAGGRPAMEPGNGSLDLGGDSAGRSGAGLEQEAAAGGDEEEEEEEEEEEGISALDGDQMELGEENGAAGAADSGPMEEEEAASEDENGDDQGFQEGEDELGDEEEGAGDENGHGEQQPQPPATQQQQPQQQRGAAKEAAGKSSGPTSLFAVTVAPPGARQGQQQAGGDGKTEQKGGDKKRGVKRPREDHGRGYFEYIEENKYSRAKSPQPPVEEEDEHFDDTVVCLDTYNCDLHFKISRDRLSASSLTMESFAFLWAGGRASYGVSKGKVCFEMKVTEKIPVRHLYTKDIDIHEVRIGWSLTTSGMLLGEEEFSYGYSLKGIKTCNCETEDYGEKFDENDVITCFANFESDEVELSYAKNGQDLGVAFKISKEVLAGRPLFPHVLCHNCAVEFNFGQKEKPYFPIPEEYTFIQNVPLEDRVRGPKGPEEKKDCEVVMMIGLPGAGKTTWVTKHAAENPGKYNILGTNTIMDKMMVAGFKKQMADTGKLNTLLQRAPQCLGKFIEIAARKKRNFILDQTNVSAAAQRRKMCLFAGFQRKAVVVCPKDEDYKQRTQKKAEVEGKDLPEHAVLKMKGNFTLPEVAECFDEITYVELQKEEAQKLLEQYKEGRSKKALPPEKKQNTGSKKSNKNKSGKNQFNRGGGHRGRGGFNMRGGNFRGGAPGNRGGYNRRGNMPQRGGGGGGSGGIGYPYPRAPVFPGRGSYSNRGNYNRGGMPNRGNYNQNFRGRGNNRGYKNQSQGYNQWQQGVSNFLCALCTLIVF

SEQ ID NO: 807470 - protein, 792 aa, Homo sapiens
MSSSPVNVKKLKVSELKEELKKRRLSDKGLKAELMERLQAALDDEEAGGRPAMEPGNGSLDLGGDSAGRSGAGLEQEAAAGGDEEEEEEEEEEEGISALDGDQMELGEENGAAGAADSGPMEEEEAASEDENGDDQGFQEGEDELGDEEEGAGDENGHGEQQPQPPATQQQQPQQQRGAAKEAAGKSSGPTSLFAVTVAPPGARQGQQQAGGDGKTEQKGGDKKRGVKRPREDHGRGYFEYIEENKYSRAKSPQPPVEEEDEHFDDTVVCLDTYNCDLHFKISRDRLSASSLTMESFAFLWAGGRASYGVSKGKVCFEMKVTEKIPVRHLYTKDIDIHEVRIGWSLTTSGMLLGEEEFSYGYSLKGIKTCNCETEDYGEKFDENDVITCFANFESDEVELSYAKNGQDLGVAFKISKEVLAGRPLFPHVLCHNCAVEFNFGQKEKPYFPIPEEYTFIQNVPLEDRVRGPKGPEEKKDCEVVMMIGLPGAGKTTWVTKHAAENPGKYNILGTNTIMDKMMVAGFKKQMADTGKLNTLLQRAPQCLGKFIEIAARKKRNFILDQTNVSAAAQRRKMCLFAGFQRKAVVVCPKDEDYKQRTQKKAEVEGKDLPEHAVLKMKGNFTLPEVAECFDEITYVELQKEEAQKLLEQYKEGRSKKALPPEKKQNTGSKKSNKNKSGKNQFNRGGGHRGRGGFNMRGGNFRGGAPGNRGGYNRRGNMPQRGGGGGGSGGIGYPYPRAPVFPGRGSYSNRGNYNRGGMPNRGNYNQNFRGRGNNRGYKNQSQGYNQWQQGQF

SEQ ID NO: 807471 - protein, 800 aa, Homo sapiens
MSSSPVNVKKLKVSELKEELKKRRLSDKGLKAELMERLQAALDDEEAGGRPAMEPGNGSLDLGGDSAGRSGAGLEQEAAAGGDEEEEEEEEEEEGISALDGDQMELGEENGAAGAADSGPMEEEEAASEDENGDDQGFQEGEDELGDEEEGAGDENGHGEQQPQPPATQQQQPQQQRGAAKEAAGKSSGPTSLFAVTVAPPGARQGQQQAGGDGKTEQKGGDKKRGVKRPREDHGRGYFEYIEENKYSRAKSPQPPVEEEDEHFDDTVVCLDTYNCDLHFKISRDRLSASSLTMESFAFLWAGGRASYGVSKGKVCFEMKVTEKIPVRHLYTKDIDIHEVRIGWSLTTSGMLLGEEEFSYGYSLKGIKTCNCETEDYGEKFDENDVITCFANFESDEVELSYAKNGQDLGVAFKISKEVLAGRPLFPHVLCHNCAVEFNFGQKEKPYFPIPEEYTFIQNVPLEDRVRGPKGPEEKKDCEVVMMIGLPGAGKTTWVTKHAAENPGKYNILGTNTIMDKMMVAGFKKQMADTGKLNTLLQRAPQCLGKFIEIAARKKRNFILDQTNVSAAAQRRKMCLFAGFQRKAVVVCPKDEDYKQRTQKKAEVEGKDLPEHAVLKMKGNFTLPEVAECFDEITYVELQKEEAQKLLEQYKEGRSKKALPPEKKQNTGSKKSNKNKSGKNQFNRGGGHRGRGGFNMRGGNFRGGAPGNRGGYNRRGNMPQRGGGGGGSGGIGYPYPRAPVFPGRGSYSNRGNYNRGGMPNRGNYNQNFRGRGNNRGYKNQSQGYNQWQQGQFPRGPVPSS

SEQ ID NO: 807472 - protein, 112 aa, Homo sapiens [sequence omitted]

SEQ ID NO: 807473 - protein, 759 aa, Homo sapiens
MSSSPVNVKKLKVSELKEELKKRRLSDKGLKAELMERLQAALDDEEAGGRPAMEPGNGSLDLGGDSAGRSGAGLEQEAAAGGDEEEEEEEEEEEGISALDGDQMELGEENGAAGAADSGPMEEEEAASEDENGDDQGFQEGEDELGDEEEGAGDENGHGEQQPQPPATQQQQPQQQRGAAKEAAGKSSGPTSLFAVTVAPPGARQGQQQAGGDGKTEQKGGDKKRGVKRPREDHGRGYFEYIEENKYSRAKSPQPPVEEEDEHFDDTVVCLDTYNCDLHFKISRDRLSASSLTMESFAFLWAGGRASYGVSKGKVCFEMKVTEKIPVRHLYTKDIDIHEVRIGWSLTTSGMLLGEEEFSYGYSLKGIKTCNCETEDYGEKFDENDVITCFANFESDEVELSYAKNGQDLGVAFKISKEVLAGRPLFPHVLCHNCAVEFNFGQKEKPYFPIPEEYTFIQNVPLEDRVRGPKGPEEKKDCEVVMMIGLPGAGKTTWVTKHAAENPGKYNILGTNTIMDKMMVAGFKKQMADTGKLNTLLQRAPQCLGKFIEIAARKKRNFILDQTNVSAAAQRRKMCLFAGFQRKAVVVCPKDEDYKQRTQKKAEVEGKDLPEHAVLKMKGNFTLPEVAECFDEITYVELQKEEAQKLLEQYKEGRSKKALPPEKKQNTGSKKSNKNKSGKNQFNRGGGHRGRGGFNMRGGNFRGGAPGNRGGYNRRGNMPQRGGGGGGSGGIGYPYPRAPVFPGRGSYSNRLGGELLVNS

SEQ ID NO: 807474 - protein, 707 aa, Homo sapiens
MSSSPVNVKKLKVSELKEELKKRRLSDKGLKAELMERLQAALDDEEAGGRPAMEPGNGSLDLGGDSAGRSGAGLEQEAAAGGDEEEEEEEEEEEGISALDGDQMELGEENGAAGAADSGPMEEEEAASEDENGDDQGFQEGEDELGDEEEGAGDENGHGEQQPQPPATQQQQPQQQRGAAKEAAGKSSGPTSLFAVTVAPPGARQGQQQAGGDGKTEQKGGDKKRGVKRPREDHGRGYFEYIEENKYSRAKSPQPPVEEEDEHFDDTVVCLDTYNCDLHFKISRDRLSASSLTMESFAFLWAGGRASYGVSKGKVCFEMKVTEKIPVRHLYTKDIDIHEVRIGWSLTTSGMLLGEEEFSYGYSLKGIKTCNCETEDYGEKFDENDVITCFANFESDEVELSYAKNGQDLGVAFKISKEVLAGRPLFPHVLCHNCAVEFNFGQKEKPYFPIPEEYTFIQNVPLEDRVRGPKGPEEKKDCEVVMMIGLPGAGKTTWVTKHAAENPGKYNILGTNTIMDKMMVAGFKKQMADTGKLNTLLQRAPQCLGKFIEIAARKKRNFILDQTNVSAAAQRRKMCLFAGFQRKAVVVCPKDEDYKQRTQKKAEVEGKDLPEHAVLKMKGNFTLPEVAECFDEITYVELQKEEAQKLLEQYKEGRSKKALPPEKKQNTGSKKSNTPHVLTHKGELNIENTLTQGVGTPHTRACRWVGV

SEQ ID NO: 807475 - protein, 622 aa, Homo sapiens
MSSSPVNVKKLKVSELKEELKKRRLSDKGLKAELMERLQAALDDEEAGGRPAMEPGNGSLDLGGDSAGRSGAGLEQEAAAGGDEEEEEEEEEEEGISALDGDQMELGEENGAAGAADSGPMEEEEAASEDENGDDQGFQEGEDELGDEEEGAGDENGHGEQQPQPPATQQQQPQQQRGAAKEAAGKSSGPTSLFAVTVAPPGARQGQQQAGGDGKTEQKGGDKKRGVKRPREDHGRGYFEYIEENKYSRAKSPQPPVEEEDEHFDDTVVCLDTYNCDLHFKISRDRLSASSLTMESFAFLWAGGRASYGVSKGKVCFEMKVTEKIPVRHLYTKDIDIHEVRIGWSLTTSGMLLGEEEFSYGYSLKGIKTCNCETEDYGEKFDENDVITCFANFESDEVELSYAKNGQDLGVAFKISKEVLAGRPLFPHVLCHNCAVEFNFGQKEKPYFPIPEEYTFIQNVPLEDRVRGPKGPEEKKDCEVVMMIGLPGAGKTTWVTKHAAENPGKYNILGTNTIMDKMMVAGFKKQMADTGKLNTLLQRAPQCLGKFIEIAARKKRNFILDQTNVSAAAQRRKMCLFAGFQRKAVVVCPKDEDYKQRTQKKAEVEGKDLPEHAVLKMKGMEF

SEQ ID NO: 807476 - protein, 625 aa, Homo sapiens
MSSSPVNVKKLKVSELKEELKKRRLSDKGLKAELMERLQAALDDEEAGGRPAMEPGNGSLDLGGDSAGRSGAGLEQEAAAGGDEEEEEEEEEEEGISALDGDQMELGEENGAAGAADSGPMEEEEAASEDENGDDQGFQEGEDELGDEEEGAGDENGHGEQQPQPPATQQQQPQQQRGAAKEAAGKSSGPTSLFAVTVAPPGARQGQQQAGGDGKTEQKGGDKKRGVKRPREDHGRGYFEYIEENKYSRAKSPQPPVEEEDEHFDDTVVCLDTYNCDLHFKISRDRLSASSLTMESFAFLWAGGRASYGVSKGKVCFEMKVTEKIPVRHLYTKDIDIHEVRIGWSLTTSGMLLGEEEFSYGYSLKGIKTCNCETEDYGEKFDENDVITCFANFESDEVELSYAKNGQDLGVAFKISKEVLAGRPLFPHVLCHNCAVEFNFGQKEKPYFPIPEEYTFIQNVPLEDRVRGPKGPEEKKDCEVVMMIGLPGAGKTTWVTKHAAENPGKYNILGTNTIMDKMMVAGFKKQMADTGKLNTLLQRAPQCLGKFIEIAARKKRNFILDQTNVSAAAQRRKMCLFAGFQRKAVVVCPKDEDYKQRTQKKAEVEGKDLPEHAVLKMKGTVPSQR

SEQ ID NO: 807477 - protein, 546 aa, Homo sapiens
MSSSPVNVKKLKVSELKEELKKRRLSDKGLKAELMERLQAALDDEEAGGRPAMEPGNGSLDLGGDSAGRSGAGLEQEAAAGGDEEEEEEEEEEEGISALDGDQMELGEENGAAGAADSGPMEEEEAASEDENGDDQGFQEGEDELGDEEEGAGDENGHGEQQPQPPATQQQQPQQQRGAAKEAAGKSSGPTSLFAVTVAPPGARQGQQQAGGDGKTEQKGGDKKRGVKRPREDHGRGYFEYIEENKYSRAKSPQPPVEEEDEHFDDTVVCLDTYNCDLHFKISRDRLSASSLTMESFAFLWAGGRASYGVSKGKVCFEMKVTEKIPVRHLYTKDIDIHEVRIGWSLTTSGMLLGEEEFSYGYSLKGIKTCNCETEDYGEKFDENDVITCFANFESDEVELSYAKNGQDLGVAFKISKEVLAGRPLFPHVLCHNCAVEFNFGQKEKPYFPIPEEYTFIQNVPLEDRVRGPKGPEEKKDCEVVMMIGLPGAGKTTWVTKHAAENPGKYNILGTNTIMDKMMVAGFKKQMADTGKLNTLLQNCKLLQLL

SEQ ID NO: 807478 - protein, 536 aa, Homo sapiens
MSSSPVNVKKLKVSELKEELKKRRLSDKGLKAELMERLQAALDDEEAGGRPAMEPGNGSLDLGGDSAGRSGAGLEQEAAAGGDEEEEEEEEEEEGISALDGDQMELGEENGAAGAADSGPMEEEEAASEDENGDDQGFQEGEDELGDEEEGAGDENGHGEQQPQPPATQQQQPQQQRGAAKEAAGKSSGPTSLFAVTVAPPGARQGQQQAGGDGKTEQKGGDKKRGVKRPREDHGRGYFEYIEENKYSRAKSPQPPVEEEDEHFDDTVVCLDTYNCDLHFKISRDRLSASSLTMESFAFLWAGGRASYGVSKGKVCFEMKVTEKIPVRHLYTKDIDIHEVRIGWSLTTSGMLLGEEEFSYGYSLKGIKTCNCETEDYGEKFDENDVITCFANFESDEVELSYAKNGQDLGVAFKISKEVLAGRPLFPHVLCHNCAVEFNFGQKEKPYFPIPEEYTFIQNVPLEDRVRGPKGPEEKKDCEVVMMIGLPGAGKTTWVTKHAAENPGKYNILGTNTIMDKMMVAGFKKKKKNWWEQRQQ

SEQ ID NO: 807479 - protein, 503 aa, Homo sapiens
MSSSPVNVKKLKVSELKEELKKRRLSDKGLKAELMERLQAALDDEEAGGRPAMEPGNGSLDLGGDSAGRSGAGLEQEAAAGGDEEEEEEEEEEEGISALDGDQMELGEENGAAGAADSGPMEEEEAASEDENGDDQGFQEGEDELGDEEEGAGDENGHGEQQPQPPATQQQQPQQQRGAAKEAAGKSSGPTSLFAVTVAPPGARQGQQQAGGDGKTEQKGGDKKRGVKRPREDHGRGYFEYIEENKYSRAKSPQPPVEEEDEHFDDTVVCLDTYNCDLHFKISRDRLSASSLTMESFAFLWAGGRASYGVSKGKVCFEMKVTEKIPVRHLYTKDIDIHEVRIGWSLTTSGMLLGEEEFSYGYSLKGIKTCNCETEDYGEKFDENDVITCFANFESDEVELSYAKNGQDLGVAFKISKEVLAGRPLFPHVLCHNCAVEFNFGQKEKPYFPIPEEYTFIQNVPLEDRVRGPKGPEEKKDCEVVMMIGLPGAGKTTWVTKHAAEGG

SEQ ID NO: 807480 - protein, 275 aa, Homo sapiens [sequence omitted]

SEQ ID NO: 807481 - protein, 171 aa, Homo sapiens
EIELGTGDTYVGRSKKALPPEKKQNTGSKKSNKNKSGKNQFNRGGGHRGRGGFNMRGGNFRGGAPGNRGGYNRRGNMPQRGGGGGGSGGIGYPYPRAPVFPGRGSYSNRGNYNRGGMPNRGNYNQNFRGRSKRGGEGQTWVAPITDHLEPALIISWPQKPRPPLLPLLPVL

SEQ ID NO: 807482 - protein, 102 aa, Homo sapiens [sequence omitted]

SEQ ID NO: 807483 - protein, 826 aa, Homo sapiens; identical to SEQ ID NO: 807450

SEQ ID NO: 807484 - protein, 807 aa, Homo sapiens; identical to SEQ ID NO: 807447

SEQ ID NO: 807485 - protein, 807 aa, Homo sapiens; identical to SEQ ID NO: 807447

SEQ ID NO: 807486 - protein, 286 aa, Homo sapiens
MSSSPVNVKKLKVSELKEELKKRRLSDKGLKAELMERLQAALDDEEAGGRPAMEPGNGSLDLGGDSAGRSGAGLEQEAAAGGDEEEEEEEEEEEGISALDGDQMELGEENGAAGAADSGPMEEEEAASEDENGDDQGFQEGEDELGDEEEGAGDENGHGEQQPQPPATQQQQPQQQRGAAKEAAGKSSGPTSLFAVTVAPPGARQGQQQAGGDGKTEQKGGDKKRGVKRPREDHGRGYFEYIEENKYSRAKSPQPPVEEEDEHFDDTVVCLDTCEVKLFLPNYEMR

SEQ ID NO: 807487 - protein, 807 aa, Homo sapiens; identical to SEQ ID NO: 807447

SEQ ID NO: 807488 - protein, 807 aa, Homo sapiens; identical to SEQ ID NO: 807447

SEQ ID NO: 807489 - protein, 603 aa, Homo sapiens
MGLVCVLGDGKTEQKGGDKKRGVKRPREDHGRGYFEYIEENKYSRAKSPQPPVEEEDEHFDDTVVCLDTYNCDLHFKISRDRLSASSLTMESFAFLWAGGRASYGVSKGKVCFEMKVTEKIPVRHLYTKDIDIHEVRIGWSLTTSGMLLGEEEFSYGYSLKGIKTCNCETEDYGEKFDENDVITCFANFESDEVELSYAKNGQDLGVAFKISKEVLAGRPLFPHVLCHNCAVEFNFGQKEKPYFPIPEEYTFIQNVPLEDRVRGPKGPEEKKDCEVVMMIGLPGAGKTTWVTKHAAENPGKYNILGTNTIMDKMMVAGFKKQMADTGKLNTLLQRAPQCLGKFIEIAARKKRNFILDQTNVSAAAQRRKMCLFAGFQRKAVVVCPKDEDYKQRTQKKAEVEGKDLPEHAVLKMKGNFTLPEVAECFDEITYVELQKEEAQKLLEQYKEGRSKKALPPEKKQNTGSKKSNKNKSGKNQFNRGGGHRGRGGFNMRGGNFRGGAPGNRGGYNRRGNMPQRGGGGGGSGGIGYPYPRAPVFPGRGSYSNRGNYNRGGMPNRGNYNQNFRGRGNNRGYKNQSQGYNQWQQGQFWGQKPWSQHYHQGYY

SEQ ID NO: 807490 - protein, 558 aa, Homo sapiens
FDGDSPCREEEDEHFDDTVVCLDTYNCDLHFKISRDRLSASSLTMESFAFLWAGGRASYGVSKGKVCFEMKVTEKIPVRHLYTKDIDIHEVRIGWSLTTSGMLLGEEEFSYGYSLKGIKTCNCETEDYGEKFDENDVITCFANFESDEVELSYAKNGQDLGVAFKISKEVLAGRPLFPHVLCHNCAVEFNFGQKEKPYFPIPEEYTFIQNVPLEDRVRGPKGPEEKKDCEVVMMIGLPGAGKTTWVTKHAAENPGKYNILGTNTIMDKMMVAGFKKQMADTGKLNTLLQRAPQCLGKFIEIAARKKRNFILDQTNVSAAAQRRKMCLFAGFQRKAVVVCPKDEDYKQRTQKKAEVEGKDLPEHAVLKMKGNFTLPEVAECFDEITYVELQKEEAQKLLEQYKEGRSKKALPPEKKQNTGSKKSNKNKSGKNQFNRGGGHRGRGGFNMRGGNFRGGAPGNRGGYNRRGNMPQRGGGGGGSGGIGYPYPRAPVFPGRGSYSNRGNYNRGGMPNRGNYNQNFRGRGNNRGYKNQSQGYNQWQQGQFWGQKPWSQHYHQGYY

SEQ ID NO: 807491 - protein, 807 aa, Homo sapiens; identical to SEQ ID NO: 807447

SEQ ID NO: 807492 - protein, 464 aa, Homo sapiens
MEKAVDEVGFGEEEFSYGYSLKGIKTCNCETEDYGEKFDENDVITCFANFESDEVELSYAKNGQDLGVAFKISKEVLAGRPLFPHVLCHNCAVEFNFGQKEKPYFPIPEEYTFIQNVPLEDRVRGPKGPEEKKDCEVVMMIGLPGAGKTTWVTKHAAENPGKYNILGTNTIMDKMMVAGFKKQMADTGKLNTLLQRAPQCLGKFIEIAARKKRNFILDQTNVSAAAQRRKMCLFAGFQRKAVVVCPKDEDYKQRTQKKAEVEGKDLPEHAVLKMKGNFTLPEVAECFDEITYVELQKEEAQKLLEQYKEGRSKKALPPEKKQNTGSKKSNKNKSGKNQFNRGGGHRGRGGFNMRGGNFRGGAPGNRGGYNRRGNMPQRGGGGGGSGGIGYPYPRAPVFPGRGSYSNRGNYNRGGMPNRGNYNQNFRGRGNNRGYKNQSQGYNQWQQGQFWGQKPWSQHYHQGYY

SEQ ID NO: 807493 - protein, 807 aa, Homo sapiens; identical to SEQ ID NO: 807447

SEQ ID NO: 807494 - protein, 654 aa, Homo sapiens
MSSSPVNVKKLKVSELKEELKKRRLSDKGLKAELMERLQAALDDEEAGGRPAMEPGNGSLDLGGDSAGRSGAGLEQEAAAGGDEEEEEEEEEEEGISALDGDQMELGEENGAAGAADSGPMEEEEAASEDENGDDQGFQEGEDELGDEEEGAGDENGHGEQQPQPPATQQQQPQQQRGAAKEAAGKSSGPTSLFAVTVAPPGARQGQQQAGGDGKTEQKGGDKKRGVKRPREDHGRGYFEYIEENKYSRAKSPQPPVEEEDEHFDDTVVCLDTYNCDLHFKISRDRLSASSLTMESFAFLWAGGRASYGVSKGKVCFEMKVTEKIPVRHLYTKDIDIHEVRIGWSLTTSGMLLGEEEFSYGYSLKGIKTCNCETEDYGEKFDENDVITCFANFESDEVELSYAKNGQDLGVAFKISKEVLAGRPLFPHVLCHNCAVEFNFGQKEKPYFPIPEEYTFIQNVPLEDRVRGPKGPEEKKDCEVVMMIGLPGAGKTTWVTKHAAENPGKYNILGTNTIMDKMMVAGFKKQMADTGKLNTLLQRAPQCLGKFIEIAARKKRNFILDQTNVSAAAQRRKMCLFAGFQRKAVVVCPKDEDYKQRTQKKAEVEGKDLPEHAVLKMKGNFTLPEVAECFDEITYVELQKEEAQKLLEQYKEEK

SEQ ID NO: 807495 - protein, 345 aa, Homo sapiens
RIDLAQLIQQKRDQTVIVVMMIGLPGAGKTTWVTKHAAENPGKYNILGTNTIMDKMMVAGFKKQMADTGKLNTLLQRAPQCLGKFIEIAARKKRNFILDQTNVSAAAQRRKMCLFAGFQRKAVVVCPKDEDYKQRTQKKAEVEGKDLPEHAVLKMKGNFTLPEVAECFDEITYVELQKEEAQKLLEQYKEGRSKKALPPEKKQNTGSKKSNKNKSGKNQFNRGGGHRGRGGFNMRGGNFRGGAPGNRGGYNRRGNMPQRGGGGGGSGGIGYPYPRAPVFPGRGSYSNRGNYNRGGMPNRGNYNQNFRGRGNNRGYKNQSQGYNQWQQGQFWGQKPWSQHYHQGYY

SEQ ID NO: 807496 - protein, 807 aa, Homo sapiens; identical to SEQ ID NO: 807447

SEQ ID NO: 807497 - protein, 166 aa, Homo sapiens
EIELGTGDTYVGRSKKALPPEKKQNTGSKKSNKNKSGKNQFNRGGGHRGRGGFNMRGGNFRGGAPGNRGGYNRRGNMPQRGGGGGGSGGIGYPYPRAPVFPGRGSYSNRGNYNRGGMPNRGNYNQNFRGRGNNRGYKNQSQGYNQWQQGQFWGQKPWSQHYHQGYY

SEQ ID NO: 807498 - protein, 800 aa, Homo sapiens
MSSSPVNVKKLKVSELKEELKKRRLSDKGLKAELMERLQAALDDEEAGGRPAMEPGNGSLDLGGDSAGRSGAGLEQEAAAGGDEEEEEEEEEEEGISALDGDQMELGEENGAAGAADSGPMEEEEAASEDENGDDQGFQEGEDELGDEEEGAGDENGHGEQQPQPPATQQQQPQQQRGAAKEAAGKSSGPTSLFAVTVAPPGARQGQQQAGGDGKTEQKGGDKKRGVKRPREDHGRGYFEYIEENKYSRAKSPQPPVEEEDEHFDDTVVCLDTYNCDLHFKISRDRLSASSLTMESFAFLWAGGRASYGVSKGKVCFEMKVTEKIPVRHLYTKDIDIHEVRIGWSLTTSGMLLGEEEFSYGYSLKGIKTCNCETEDYGEKFDENDVITCFANFESDEVELSYAKNGQDLGVAFKISKEVLAGRPLFPHVLCHNCAVEFNFGQKEKPYFPIPEEYTFIQNVPLEDRVRGPKGPEEKKDCEVVMMIGLPGAGKTTWVTKHAAENPGKYNILGTNTIMDKMMVAGFKKQMADTGKLNTLLQRAPQCLGKFIEIAARKKRNFILDQTNVSAAAQRRKMCLFAGFQRKAVVVCPKDEDYKQRTQKKAEVEGKDLPEHAVLKMKGNFTLPEVAECFDEITYVELQKEEAQKLLEQYKEGRSKKALPPEKKQNTGSKKSNKNKSGKNQFNRGGGHRGRGGFNMRGGNFRGGAPGNRGGYNRRGNMPQRGGGGGGSGGIGYPYPRAPVFPGRGSYSNRGNYNRGGMPNRGNYNQNFRGRGNNRGYKNQSQGYNQWQQGHSVDWSHIIR

SEQ ID NO: 807499 - protein, 800 aa, Homo sapiens
MSSSPVNVKKLKVSELKEELKKRRLSDKGLKAELMERLQAALDDEEAGGRPAMEPGNGSLDLGGDSAGRSGAGLEQEAAAGGDEEEEEEEEEEEGISALDGDQMELGEENGAAGAADSGPMEEEEAASEDENGDDQGFQEGEDELGDEEEGAGDENGHGEQQPQPPATQQQQPQQQRGAAKEAAGKSSGPTSLFAVTVAPPGARQGQQQAGGDGKTEQKGGDKKRGVKRPREDHGRGYFEYIEENKYSRAKSPQPPVEEEDEHFDDTVVCLDTYNCDLHFKISRDRLSASSLTMESFAFLWAGGRASYGVSKGKVCFEMKVTEKIPVRHLYTKDIDIHEVRIGWSLTTSGMLLGEEEFSYGYSLKGIKTCNCETEDYGEKFDENDVITCFANFESDEVELSYAKNGQDLGVAFKISKEVLAGRPLFPHVLCHNCAVEFNFGQKEKPYFPIPEEYTFIQNVPLEDRVRGPKGPEEKKDCEVVMMIGLPGAGKTTWVTKHAAENPGKYNILGTNTIMDKMMVAGFKKQMADTGKLNTLLQRAPQCLGKFIEIAARKKRNFILDQTNVSAAAQRRKMCLFAGFQRKAVVVCPKDEDYKQRTQKKAEVEGKDLPEHAVLKMKGNFTLPEVAECFDEITYVELQKEEAQKLLEQYKEGRSKKALPPEKKQNTGSKKSNKNKSGKNQFNRGGGHRGRGGFNMRGGNFRGGAPGNRGGYNRRGNMPQRGGGGGGSGGIGYPYPRAPVFPGRGSYSNRGNYNRGGMPNRGNYNQNFRGRGNNRGYKNQSQGYNQWQQGMEVVWLRCCR

SEQ ID NO: 807500 - protein, 83 aa, Homo sapiens
FEPRYPLSLSNPRAPVFPGRGSYSNRGNYNRGGMPNRGNYNQNFRGRGNNRGYKNQSQGYNQWQQGQFWGQKPWSQHYHQGYY

SEQ ID NO: 807501 - protein, 732 aa, Homo sapiens
MSSSPVNVKKLKVSELKEELKKRRLSDKGLKAELMERLQAALDDEEAGGRPAMEPGNGSLDLGGDSAGRSGAGLEQEAAAGGDEEEEEEEEEEEGISALDGDQMELGEENGAAGAADSGPMEEEEAASEDENGDDQGFQEGEDELGDEEEGAGDENGHGEQQPQPPATQQQQPQQQRGAAKEAAGKSSGPTSLFAVTVAPPGARQGQQQAGGDGKTEQKGGDKKRGVKRPREDHGRGYFEYIEENKYSRAKSPQPPVEEEDEHFDDTVVCLDTYNCDLHFKISRDRLSASSLTMESFAFLWAGGRASYGVSKGKVCFEMKVTEKIPVRHLYTKDIDIHEVRIGWSLTTSGMLLGEEEFSYGYSLKGIKTCNCETEDYGEKFDENDVITCFANFESDEVELSYAKNGQDLGVAFKISKEVLAGRPLFPHVLCHNCAVEFNFGQKEKPYFPIPEEYTFIQNVPLEDRVRGPKGPEEKKDCEVVMMIGLPGAGKTTWVTKHAAENPGKYNILGTNTIMDKMMVAGFKKQMADTGKLNTLLQRAPQCLGKFIEIAARKKRNFILDQTNVSAAAQRRKMCLFAGFQRKAVVVCPKDEDYKQRTQKKAEVEGKDLPEHAVLKMKGNFTLPEVAECFDEITYVELQKEEAQKLLEQYKEGRSKKALPPEKKQNTGSKKSNKNKSGKNQFNRGGGHRGRGGFNMRGGNFRGGAPGNRGGYNRRGNMPQRGGGGGKLNHSF

SEQ ID NO: 807502 - protein, 634 aa, Homo sapiens
MSSSPVNVKKLKVSELKEELKKRRLSDKGLKAELMERLQAALDDEEAGGRPAMEPGNGSLDLGGDSAGRSGAGLEQEAAAGGDEEEEEEEEEEEGISALDGDQMELGEENGAAGAADSGPMEEEEAASEDENGDDQGFQEGEDELGDEEEGAGDENGHGEQQPQPPATQQQQPQQQRGAAKEAAGKSSGPTSLFAVTVAPPGARQGQQQAGGDGKTEQKGGDKKRGVKRPREDHGRGYFEYIEENKYSRAKSPQPPVEEEDEHFDDTVVCLDTYNCDLHFKISRDRLSASSLTMESFAFLWAGGRASYGVSKGKVCFEMKVTEKIPVRHLYTKDIDIHEVRIGWSLTTSGMLLGEEEFSYGYSLKGIKTCNCETEDYGEKFDENDVITCFANFESDEVELSYAKNGQDLGVAFKISKEVLAGRPLFPHVLCHNCAVEFNFGQKEKPYFPIPEEYTFIQNVPLEDRVRGPKGPEEKKDCEVVMMIGLPGAGKTTWVTKHAAENPGKYNILGTNTIMDKMMVAGFKKQMADTGKLNTLLQRAPQCLGKFIEIAARKKRNFILDQTNVSAAAQRRKMCLFAGFQRKAVVVCPKDEDYKQRTQKKAEVEGKDLPEHAVLKMKGNFTLPEVPQVSFRQS

SEQ ID NO: 807503 - protein, 632 aa, Homo sapiens
MSSSPVNVKKLKVSELKEELKKRRLSDKGLKAELMERLQAALDDEEAGGRPAMEPGNGSLDLGGDSAGRSGAGLEQEAAAGGDEEEEEEEEEEEGISALDGDQMELGEENGAAGAADSGPMEEEEAASEDENGDDQGFQEGEDELGDEEEGAGDENGHGEQQPQPPATQQQQPQQQRGAAKEAAGKSSGPTSLFAVTVAPPGARQGQQQAGGDGKTEQKGGDKKRGVKRPREDHGRGYFEYIEENKYSRAKSPQPPVEEEDEHFDDTVVCLDTYNCDLHFKISRDRLSASSLTMESFAFLWAGGRASYGVSKGKVCFEMKVTEKIPVRHLYTKDIDIHEVRIGWSLTTSGMLLGEEEFSYGYSLKGIKTCNCETEDYGEKFDENDVITCFANFESDEVELSYAKNGQDLGVAFKISKEVLAGRPLFPHVLCHNCAVEFNFGQKEKPYFPIPEEYTFIQNVPLEDRVRGPKGPEEKKDCEVVMMIGLPGAGKTTWVTKHAAENPGKYNILGTNTIMDKMMVAGFKKQMADTGKLNTLLQRAPQCLGKFIEIAARKKRNFILDQTNVSAAAQRRKMCLFAGFQRKAVVVCPKDEDYKQRTQKKAEVEGKDLPEHAVLKMKGNFTLYSSFLLLVC

SEQ ID NO: 807504 - protein, 526 aa, Homo sapiens
MSSSPVNVKKLKVSELKEELKKRRLSDKGLKAELMERLQAALDDEEAGGRPAMEPGNGSLDLGGDSAGRSGAGLEQEAAAGGDEEEEEEEEEEEGISALDGDQMELGEENGAAGAADSGPMEEEEAASEDENGDDQGFQEGEDELGDEEEGAGDENGHGEQQPQPPATQQQQPQQQRGAAKEAAGKSSGPTSLFAVTVAPPGARQGQQQAGGDGKTEQKGGDKKRGVKRPREDHGRGYFEYIEENKYSRAKSPQPPVEEEDEHFDDTVVCLDTYNCDLHFKISRDRLSASSLTMESFAFLWAGGRASYGVSKGKVCFEMKVTEKIPVRHLYTKDIDIHEVRIGWSLTTSGMLLGEEEFSYGYSLKGIKTCNCETEDYGEKFDENDVITCFANFESDEVELSYAKNGQDLGVAFKISKEVLAGRPLFPHVLCHNCAVEFNFGQKEKPYFPIPEEYTFIQNVPLEDRVRGPKGPEEKKDCEVVMMIGLPGAGKTTWVTKHAAENPGKYNILGTNTIMDKMMVSKMFRA

SEQ ID NO: 807505 - protein, 530 aa, Homo sapiens
MSSSPVNVKKLKVSELKEELKKRRLSDKGLKAELMERLQAALDDEEAGGRPAMEPGNGSLDLGGDSAGRSGAGLEQEAAAGGDEEEEEEEEEEEGISALDGDQMELGEENGAAGAADSGPMEEEEAASEDENGDDQGFQEGEDELGDEEEGAGDENGHGEQQPQPPATQQQQPQQQRGAAKEAAGKSSGPTSLFAVTVAPPGARQGQQQAGGDGKTEQKGGDKKRGVKRPREDHGRGYFEYIEENKYSRAKSPQPPVEEEDEHFDDTVVCLDTYNCDLHFKISRDRLSASSLTMESFAFLWAGGRASYGVSKGKVCFEMKVTEKIPVRHLYTKDIDIHEVRIGWSLTTSGMLLGEEEFSYGYSLKGIKTCNCETEDYGEKFDENDVITCFANFESDEVELSYAKNGQDLGVAFKISKEVLAGRPLFPHVLCHNCAVEFNFGQKEKPYFPIPEEYTFIQNVPLEDRVRGPKGPEEKKDCEVVMMIGLPGAGKTTWVTKHAAVSAICFLKPATIILSIIVFVPRMLYFPGCR

SEQ ID NO: 807506 - protein, 69 aa, Homo sapiens
NRGGYNRRGNMPQRGGGGGGSGGIGYPYPRAPVFPGRGSYSNRGNYNRGGMPNRGNYNQVMIQDPWKHD

SEQ ID NO: 807507 - protein, 133 aa, Homo sapiens
MNYMPGTASLIEDIDKKHLVLLRDGRTLIGFLRSIDQFANLVLHQTVERIHVGKKYGDIPRGIFVVRGENVVLLGEIDLEKESDTPLQQVSIEEILEEQRVEQQTKLEAEKLKVQALKDRGLSIPRADTLDEY

SEQ ID NO: 807508 - protein, 109 aa, Homo sapiens
MEFPLTYLTGTGKGCPPTVRLPRLFLGAHTCYRKWVRVIWRSFRQPPAAESRGRSAGLGRDSGLGPTEAATAVGGKRFWTRWPPAAVHCSIISVQNELYAWHRQPHRGH

SEQ ID NO: 807509 - protein, 133 aa, Homo sapiens; identical to SEQ ID NO: 807507

SEQ ID NO: 807510 - protein, 134 aa, Homo sapiens
MNYMPGTASLIEDIDKKHLVLLRDGRTLIGFLRSIDQFANLVLHQTVERIHVGKKYGDIPRGIFVVRGENVVLLGEIDLEKESDTPLQQVSIEEILEEQRVEQQTKLEAEKLKVQALKDRGLSIPRGGAGPPIP

SEQ ID NO: 807511 - protein, 109 aa, Homo sapiens; identical to SEQ ID NO: 807508

SEQ ID NO: 807512 - protein, 133 aa, Homo sapiens; identical to SEQ ID NO: 807507

SEQ ID NO: 807513 - protein, 133 aa, Homo sapiens; identical to SEQ ID NO: 807507

SEQ ID NO: 807514 - protein, 133 aa, Homo sapiens; identical to SEQ ID NO: 807507

SEQ ID NO: 807515 - protein, 120 aa, Homo sapiens
MRPGSSPRAPECGAPALPRPQLDRLPARPAPSRGRGAPSLRWPAKEVGPRPQIPATCEPGKVCGASAGRRDAARPSRPRSSRVTFSTRRQPGPQRGRWGLRGGPESVRGLPHLGLRVSRL

SEQ ID NO: 807516 - protein, 118 aa, Homo sapiens
MRPGSSPRAPECGAPALPRPQLDRLPARPAPSRGRGAPSLRWPAKEVGPRPQIPATCEPGKVCGASAGRRDAARPSRPRSSRVTFSTRRQPGPQRGRWGLRGGPESVRGLPHLGLREH

SEQ ID NO: 807517 - protein, 130 aa, Homo sapiens
MRPGSSPRAPECGAPALPRPQLDRLPARPAPSRGRGAPSLRWPAKEVGPRPQIPATCEPGKVCGASAGRRDAARPSRPRSSRVTFSTRRQPGPQRGRWGLRGGPESVRGLPHLGLRISGTPLGIFSSWSL

SEQ ID NO: 807518 - protein, 130 aa, Homo sapiens; identical to SEQ ID NO: 807517

SEQ ID NO: 807519 - protein, 130 aa, Homo sapiens; identical to SEQ ID NO: 807517

SEQ ID NO: 807520 - protein, 130 aa, Homo sapiens; identical to SEQ ID NO: 807517

SEQ ID NO: 807521 - protein, 172 aa, Homo sapiens
MRPGSSPRAPECGAPALPRPQLDRLPARPAPSRGRGAPSLRWPAKEVGPRPQIPATCEPGKVCGASAGRRDAARPSRPRSSRVTFSTRRQPGPQRGRWGLRGGPESVRGLPHLGLRHQTCWHHLLVGPCGQGTLHETTSAVLESCCRRRKREEDNTTQEGISTSGHNGSSSC

SEQ ID NO: 807522 - protein, 172 aa, Homo sapiens; identical to SEQ ID NO: 807521

SEQ ID NO: 807523 - protein, 286 aa, Homo sapiens
MEPITKISHIPASRWALSCSLCKECTGTCIQCSMPSCVTAFHVTCAFDHGLEMRTILADNDEVKFKSFCQEHSDGGPRNEPTSEPTEPSQAGEDLEKVTLRKQRLQQLEEDFYELVEPAEVAERLDLAEALVDFIYQYWKLKRKANANQPLLTPKTDEVDNLAQQEQDVLYRRLKLFTHLRQDLERVRNLCYMVTRRERTKHAICKLQEQIFHLQMKLIEQDLCRGRRLPHLPPPPPCALSCGAGSQGGCVFGSWWGYVRGAKGHWPPLLPFTIQLVGPDGGLQGS

SEQ ID NO: 807524 - protein, 235 aa, Homo sapiens
MEPITKISHIPASRWALSCSLCKECTGTCIQCSMPSCVTAFHVTCAFDHGLEMRTILADNDEVKFKSFCQEHSDGGPRNEPTSEPTEPSQAGEDLEKVTLRKQRLQQLEEDFYELVEPAEVAERLDLAEALVDFIYQYWKLKRKANANQPLLTPKTDEVDNLAQQEQDVLYRRLKLFTHLRQDLERVRNLCYMVTRRERTKHAICKLQEQIFHLQMKLIEQDLCRRAMLVGILLE

SEQ ID NO: 807525 - protein, 361 aa, Homo sapiens
MAWQGWPAAWQWVAGCWLLLVLVLVLLVSPRGCRARRGLRGLLMAHSQRLLFRIGYSLYTRTWLGYLFYRQQLRRARNRYPKGHSKTQPRLFNGVKVLPIPVLSDNYSYLIIDTQAQLAVAVDPSDPRAVQASIEKEGVTLVAILCTHKHWDHSGGNRDLSRRHRDCRVYGSPQDGIPYLTHPLCHQDVVSVGRLQIRALATPGHTQGHLVYLLDGEPYKGPSCLFSGDLLFLSGCGRTFEGNAETMLSSLDTVLGLGDDTLLWPGHEYAEENLGFAGVVEPENLARERKMQWVQRQRLERKGTCPSTLGEERSYNPFLRTHCLALQEALGPGPGPTGDDDYSRAQLLEELRRLKDMHKSK

SEQ ID NO: 807526 - protein, 389 aa, Homo sapiens
WDLNMAAVVAATALKGRGARNARVLRGILAGATANKASHNRTRALQSHSSPEGKEEPEPLSPELEYIPRKRGKNPMKAVGLAWYSLYTRTWLGYLFYRQQLRRARNRYPKGHSKTQPRLFNGVKVLPIPVLSDNYSYLIIDTQAQLAVAVDPSDPRAVQASIEKEGVTLVAILCTHKHWDHSGGNRDLSRRHRDCRVYGSPQDGIPYLTHPLCHQDVVSVGRLQIRALATPGHTQGHLVYLLDGEPYKGPSCLFSGDLLFLSGCGRTFEGNAETMLSSLDTVLGLGDDTLLWPGHEYAEENLGFAGVVEPENLARERKMQWVQRQRLERKGTCPSTLGEERSYNPFLRTHCLALQEALGPGPGPTGDDDYSRAQLLEELRRLKDMHKSK

SEQ ID NO: 807527 - protein, 361 aa, Homo sapiens; identical to SEQ ID NO: 807525

SEQ ID NO: 807528 - protein, 361 aa, Homo sapiens; identical to SEQ ID NO: 807525

SEQ ID NO: 807529 - protein, 217 aa, Homo sapiens
MSLLSCRDHSGGNRDLSRRHRDCRVYGSPQDGIPYLTHPLCHQDVVSVGRLQIRALATPGHTQGHLVYLLDGEPYKGPSCLFSGDLLFLSGCGRTFEGNAETMLSSLDTVLGLGDDTLLWPGHEYAEENLGFAGVVEPENLARERKMQWVQRQRLERKGTCPSTLGEERSYNPFLRTHCLALQEALGPGPGPTGDDDYSRAQLLEELRRLKDMHKSK

SEQ ID NO: 807530 - protein, 361 aa, Homo sapiens; identical to SEQ ID NO: 807525

SEQ ID NO: 807531 - protein, 510 aa, Homo sapiens
MAADSDDGAVSAPAASDGGVSKSTTSGEELVVQVPVVDVQSNNFKEMWPSLLLAIKTANFVAVDTELSGLGDRKSLLNQCIEERYKAVCHAARTRSILSLGLACFKRQPDKGEHSYLAQVFNLTLLCMEEYVIEPKSVQFLIQHGFNFNQQYAQGIPYHKGNDKGDESQSQSVRTLFLELIRARRPLVLHNGLIDLVFLYQNFYAHLPESLGTFTADLCEMFPAGIYDTKYAAEFHARFVASYLEYAFRKCERENGKQRAAGSPHLTLEFCNYPSSMRDHIDYRCCLPPATHRPHPTSICDNFSAYGWCPLGPQCPQSHDIDLIIDTDEAAAEDKRRRRRRREKRKRALLNLPGTQTSGEAKDGPPKKQVCGDSIKPEETEQEVAADETRNLPHSKQGNKNDLEMGIKAARPEIADRATSEVPGSQASPNPVPGDGLHRAGFDAFMTGYVMAYVEVSQGPQPCSSGPWLPECHNKVYLSGKAVPLTVAKSQFSRSSKAHNQKMKLTWGSS

SEQ ID NO: 807532 - protein, 546 aa, Homo sapiens
MAADSDDGAVSAPAASDGGVSKSTTSGEELVVQVPVVDVQSNNFKEMWPSLLLAIKTANFVAVDTELSGLGDRKSLLNQCIEERYKAVCHAARTRSILSLGLACFKRQPDKGEHSYLAQVFNLTLLCMEEYVIEPKSVQFLIQHGFNFNQQYAQGIPYHKGNDKGDESQSQSVRTLFLELIRARRPLVLHNGLIDLVFLYQNFYAHLPESLGTFTADLCEMFPAGIYDTKYAAEFHARFVASYLEYAFRKWQCFGAEDSAVNKTDHKTLLLWSLYAEWTITLLRCCSERENGKQRAAGSPHLTLEFCNYPSSMRDHIDYRCCLPPATHRPHPTSICDNFSAYGWCPLGPQCPQSHDIDLIIDTDEAAAEDKRRRRRRREKRKRALLNLPGTQTSGEAKDGPPKKQVCGDSIKPEETEQEVAADETRNLPHSKQGNKNDLEMGIKAARPEIADRATSEVPGSQASPNPVPGDGLHRAGFDAFMTGYVMAYVEVSQGPQPCSSGPWLPECHNKVYLSGKAVPLTVAKSQFSRSSKAHNQKMKLTWGSS

SEQ ID NO: 807533 - protein, 90 aa, Homo sapiens
MAADSDDGAVSAPAASDGGVSKSTTSGEELVVQVPVVDVQSNNFKEMWPFNASGPFKPGGVEWPGEWPFYKHWVGKGKLQSKGGWPFNAS

SEQ ID NO: 807534 - protein, 510 aa, Homo sapiens; identical to SEQ ID NO: 807531

SEQ ID NO: 807535 - protein, 500 aa, Homo sapiens
MWPSLLLAIKTANFVAVDTELSGLGDRKSLLNQCIEERYKAVCHAARTRSILSLGLACFKRQPDKGEHSYLAQVFNLTLLCMEEYVIEPKSVQFLIQHGFNFNQQYAQGIPYHKGNDKGDESQSQSVRTLFLELIRARRPLVLHNGLIDLVFLYQNFYAHLPESLGTFTADLCEMFPAGIYDTKYAAEFHARFVASYLEYAFRKWQCFGAEDSAVNKTDHKTLLLWSLYAEWTITLLRCCSERENGKQRAAGSPHLTLEFCNYPSSMRDHIDYRCCLPPATHRPHPTSICDNFSAYGWCPLGPQCPQSHDIDLIIDTDEAAAEDKRRRRRRREKRKRALLNLPGTQTSGEAKDGPPKKQVCGDSIKPEETEQEVAADETRNLPHSKQGNKNDLEMGIKAARPEIADRATSEVPGSQASPNPVPGDGLHRAGFDAFMTGYVMAYVEVSQGPQPCSSGPWLPECHNKVYLSGKAVPLTVAKSQFSRSSKAHNQKMKLTWGSS

SEQ ID NO: 807536 - protein, 552 aa, Homo sapiens
MAADSDDGAVSAPAASDGERLPRGGVSKSTTSGEELVVQVPVVDVQSNNFKEMWPSLLLAIKTANFVAVDTELSGLGDRKSLLNQCIEERYKAVCHAARTRSILSLGLACFKRQPDKGEHSYLAQVFNLTLLCMEEYVIEPKSVQFLIQHGFNFNQQYAQGIPYHKGNDKGDESQSQSVRTLFLELIRARRPLVLHNGLIDLVFLYQNFYAHLPESLGTFTADLCEMFPAGIYDTKYAAEFHARFVASYLEYAFRKWQCFGAEDSAVNKTDHKTLLLWSLYAEWTITLLRCCSERENGKQRAAGSPHLTLEFCNYPSSMRDHIDYRCCLPPATHRPHPTSICDNFSAYGWCPLGPQCPQSHDIDLIIDTDEAAAEDKRRRRRRREKRKRALLNLPGTQTSGEAKDGPPKKQVCGDSIKPEETEQEVAADETRNLPHSKQGNKNDLEMGIKAARPEIADRATSEVPGSQASPNPVPGDGLHRAGFDAFMTGYVMAYVEVSQGPQPCSSGPWLPECHNKVYLSGKAVPLTVAKSQFSRSSKAHNQKMKLTWGSS

SEQ ID NO: 807537 - protein, 396 aa, Homo sapiens
MLGFLSARQTGLEDPLRLRRAESTRRVLGLELNKDRDVERIHGGGINTLDIEPVEGRYMLSGGSDGVIVLYDLENSSRQSYYTCKAVCSIGRDHPDVHRYSVETVQWYPHDTGMFTSSSFDKTLKVWDTNTLQTADVFNFEETVYSHHMSPVSTKHCLVAVGTRGPKVQLCDLKSGSCSHILQGHRQEILAVSWSPRYDYILATASADSRVKLWDVRRASGCLITLDQHNGKKSQAVESANTAHNGKVNGLCFTSDGLHLLTVGTDNRMRLWNSSNGENTLVNYGKVCNNSKKGLKFTVSCGCSSEFVFVPYGSTIAVYTVYSGEQITMLKGHYKTVDCCVFQSNFQELYSGSRDCNILAWVPSLYEPVPDDDETTTKSQLNPAFEDAWSSSDEEG

SEQ ID NO: 807538 - protein, 205 aa, Homo sapiens
MLGFLSARQTGLEDPLRLRRAESTRRVLGLELNKDRDVERIHGGGINTLDIEPVEGRYMLSGGSDGVIVLYDLENSSRQSYYTCKAVCSIGRDHPDVHRYSVETVQWYPHDTGMFTSSSFDKTLKVWDTNTLQTADVFNFEETVYSHHMSPVSTKHCLVAVGTRGPKVQLCDLKSGSCSHILQGIFILFQTATTLSKRFNKKKRY

SEQ ID NO: 807539 - protein, 330 aa, Homo sapiens
MLGFLSARQTGLEDPLRLRRAESTRRVLGLELNKDRDVERIHGGGINTLDIEPVEGRYMLSGGSDGVIVLYDLENSSRQSYYTCKAVCSIGRDHPDVHRYSVETVQWYPHDTGMFTSSSFDKTLKVWDTNTLQTADVFNFEETVYSHHMSPVSTKHCLVAVGTRGPKVQLCDLKSGSCSHILQGHRQEILAVSWSPRYDYILATASADSRVKLWDVRRASGCLITLDQHNGKKSQAVESANTAHNGKVNGLCFTSDGLHLLTVGTDNRMRLWNSSNGENTLELYSGSRDCNILAWVPSLYEPVPDDDETTTKSQLNPAFEDAWSSSDEEG

SEQ ID NO: 807540 - protein, 433 aa, Homo sapiens
TVGLLALSSVMATSSAPAGVRTRYAGVFVRTPNGFGGPSSPSESRVNTEFTDNSVLKSLCGQRVLGLELNKDRDVERIHGGGINTLDIEPVEGRYMLSGGSDGVIVLYDLENSSRQSYYTCKAVCSIGRDHPDVHRYSVETVQWYPHDTGMFTSSSFDKTLKVWDTNTLQTADVFNFEETVYSHHMSPVSTKHCLVAVGTRGPKVQLCDLKSGSCSHILQGHRQEILAVSWSPRYDYILATASADSRVKLWDVRRASGCLITLDQHNGKKSQAVESANTAHNGKVNGLCFTSDGLHLLTVGTDNRMRLWNSSNGENTLVNYGKVCNNSKKGLKFTVSCGCSSEFVFVPYGSTIAVYTVYSGEQITMLKGHYKTVDCCVFQSNFQELYSGSRDCNILAWVPSLYEPVPDDDETTTKSQLNPAFEDAWSSSDEEG

SEQ ID NO: 807541 - protein, 338 aa, Homo sapiens
MLSGGSDGVIVLYDLENSSRQSYYTCKAVCSIGRDHPDVHRYSVETVQWYPHDTGMFTSSSFDKTLKVWDTNTLQTADVFNFEETVYSHHMSPVSTKHCLVAVGTRGPKVQLCDLKSGSCSHILQGHRQEILAVSWSPRYDYILATASADSRVKLWDVRRASGCLITLDQHNGKKSQAVESANTAHNGKVNGLCFTSDGLHLLTVGTDNRMRLWNSSNGENTLVNYGKVCNNSKKGLKFTVSCGCSSEFVFVPYGSTIAVYTVYSGEQITMLKGHYKTVDCCVFQSNFQELYSGSRDCNILAWVPSLYEPVPDDDETTTKSQLNPAFEDAWSSSDEEG

SEQ ID NO: 807542 - protein, 500 aa, Homo sapiens
MLGFLSARQTGLEDPLRLRRAESTRRVLGLELNKDRDVERIHGGGINTLDIEPVEGRYMLSGGSDGVIVLYDLENSSRQSYYTCKAVCSIGRDHPDVHRYSVETVQWYPHDTGMFTSSSFDKTLKVWDTNTLQTESRSVTHAGVQWPVAQISAHCNLPVLSSSNSPASASRVSGTTGVCHHAWLIFVFLVETGFRHVGQAGLELLTSVDPPTSASQSVGITGVSHHARPIYCVVTIKTADVFNFEETVYSHHMSPVSTKHCLVAVGTRGPKVQLCDLKSGSCSHILQGHRQEILAVSWSPRYDYILATASADSRVKLWDVRRASGCLITLDQHNGKKSQAVESANTAHNGKVNGLCFTSDGLHLLTVGTDNRMRLWNSSNGENTLVNYGKVCNNSKKGLKFTVSCGCSSEFVFVPYGSTIAVYTVYSGEQITMLKGHYKTVDCCVFQSNFQELYSGSRDCNILAWVPSLYEPVPDDDETTTKSQLNPAFEDAWSSSDEEG

SEQ ID NO: 807543 - protein, 159 aa, Homo sapiens
MLGFLSARQTGLEDPLRLRRAESTRRVLGLELNKDRDVERIHGGGINTLDIEPVEGRYMLSGGSDGVIVLYDLENSSRQSYYTCKAVCSIGRDHPDVHRYSVETVQWYPHDTGMFTSSSFDKTLKVWDTNTLQTESRSVTHAGVQWPVAQSQLTATSPS

SEQ ID NO: 807544 - protein, 174 aa, Homo sapiens
MLGFLSARQTGLEDPLRLRRAESTRRVLGLELNKDRDVERIHGGGINTLDIEPVEGRYMLSGGSDGVIVLYDLENSSRQSYYTCKAVCSIGRDHPDVHRYSVETVQWYPHDTGMFTSSSFDKTLKVWDTNTLQTESRSVTHAGVAVSQDRATAHQPGQQSDSISKKKKKRIMFL

SEQ ID NO: 807545 - protein, 166 aa, Homo sapiens
MLSGGSDGVIVLYDLENSSRQSYYTCKAVCSIGRDHPDVHRYSVETVQWYPHDTGMFTSSSFDKTLKVWDTNTLQTADVFNFEETVYSHHMSPVSTKHCLVAVGTRGPKVQLCDLKSGSCSHILQGHRQEILAVSWSPRYDYILATASAGQQSNIMGMFPRASGSV

SEQ ID NO: 807546 - protein, 358 aa, Homo sapiens [sequence omitted]

SEQ ID NO: 807547 - protein, 338 aa, Homo sapiens; identical to SEQ ID NO: 807541

SEQ ID NO: 807548 - protein, 365 aa, Homo sapiens
MLGFLSARQTGLEDPLRLRRAESTRRVLGLELNKDRDVERIHGGGINTLDIEPVEGRYMLSGGSDGVIVLYDLENSSRQSYYTCKAVCSIGRDHPDVHRYSVETVQWYPHDTGMFTSSSFDKTLKVWDTNTLQTADVFNFEETVYSHHMSPVSTKHCLVAVSWSPRYDYILATASADSRVKLWDVRRASGCLITLDQHNGKKSQAVESANTAHNGKVNGLCFTSDGLHLLTVGTDNRMRLWNSSNGENTLVNYGKVCNNSKKGLKFTVSCGCSSEFVFVPYGSTIAVYTVYSGEQITMLKGHYKTVDCCVFQSNFQELYSGSRDCNILAWVPSLYEPVPDDDETTTKSQLNPAFEDAWSSSDEEG

SEQ ID NO: 807549 - protein, 173 aa, Homo sapiens
MLGFLSARQTGLEDPLRLRRAESTRSMLSGGSDGVIVLYDLENSSRQSYYTCKAVCSIGRDHPDVHRYSVETVQWYPHDTGMFTSSSFDKTLKVWDTNTLQTADVFNFEETVYSHHMSPVSTKHCLVAVGTRGPKVQLCDLKSGSCSHILQGIFILFQTATTLSKRFNKKKRY

SEQ ID NO: 807550 - protein, 145 aa, Homo sapiens
LLSAPSHSQLINESVDEADMENAGHPSADTPTATNYFLQYISSSLENSTNSADASSNKFVFGQNMSERVLSPPKLNEVSSDANRENAAAESGSESSSQEATPEKESLAESAAAYTKATARKCLLEKVEVITGEEFCHLGILKSQL

SEQ ID NO: 807551 - protein, 499 aa, Homo sapiens
MADLANEEKPAIAPPVFVFQKDKGQKRSAGGSSPEGGEDSDREDGNYCPPVKRERTSSLTQFPPSQSEERSSGFRLKPPTLIHGQAPSAGLPSQKPKEQQRSVLRPAVLQAPQPKALSQTVPSSGTNGVSLPADCTGAVPAASPDTAAWRSPSEAADEVCALEEKEPQKNESSNASEEEACEKKDPATQQAFVFGQNLRDRVKLINESVDEADMENAGHPSADTPTATNYFLQYISSSLENSTNSADASSNKFVFGQNMSERVLSPPKLNEVSSDANRENAAAESGSESSSQEATPEKESLAESAAAYTKATARKCLLEKVEVITGEEAESNVLQMQCKLFVFDKTSQSWVERGRGLLRLNDMASTDDGTLQSRLVMRTQGSLRLILNTKLWAQMQIDKASEKSIRITAMDTEDQGVKVFLISASSKDTGQLYAALHHRILALRSRVEQEQEAKMPAPEPGAAPSNEEDDSDDDDVLAPSGATAAGAGDEGDGQTTGST

SEQ ID NO: 807552 - protein, 470 aa, Homo sapiens
MADLANEEKPAIAPPVFVFQKDKGQKRSAGGSSPEGGEDSDREDGNYCPPVKRERTSSLTQFPPSQSEERSSGFRLKPPTLIHGQAPSAGLPSQKPKEQQRSVLRPAVLQAPQPKALSQTVPSSGTNGVSLPADCTGAVPAASPDTAAWRSPSEAADEVCALEEKEPQKNESSNASEEEACEKKDPATQQAFVFGQNLRDRVKLINESVDEADMENAGHPSADTPTATNYFLQYISSSLENSTNSADASSNKFVFGQNMSERVLSPPKLNEVSSDANRENAAAESGSESSSQEATPEKESLAESAAAYTKATARKCLLEKVEERGRGLLRLNDMASTDDGTLQSRLVMRTQGSLRLILNTKLWAQMQIDKASEKSIRITAMDTEDQGVKVFLISASSKDTGQLYAALHHRILALRSRVEQEQEAKMPAPEPGAAPSNEEDDSDDDDVLAPSGATAAGAGDEGDGQTTGST

SEQ ID NO: 807553 - protein, 375 aa, Homo sapiens
MADLANEEKPAIAPPVFVFQKDKGQKRSAGGSSPEGGEDSDREDGNYCPPVKRERTSSLTQFPPSQSEERSSGFRLKPPTLIHGQAPSAGLPSQKPKEQQRSVLRPAVLQAPQPKALSQTVPSSGTNGVSLPADCTGAVPAASPDTAAWRSPSEAADEVCALEEKEPQKNESSNASEEEACEKKDPATQQAFVFGQNLRDRVKLINESVDEADMENAGHPSADTPTATNYFLQYISSSLENSTNSADASSNKFVFGQNMSERVLSPPKLNEVSSDANRENAAAESGSESSSQEATPEKESLAESAAAYTKATARKCLLEKVEVITGEEAESNVLQMQCKLFVFDKTSQSWVERGRGLLRLNDMASTDDGQTTGST

SEQ ID NO: 807554 - protein, 591 aa, Homo sapiens
PRTPGPSMSVHYEPPGNLAVSAGIRDRLANEEKPAIAPPVFVFQKDKGQKSPAEQKNLSDSGEEPRGEAEAPHHGTGHPESAGEHALEPPAPAGASASTPPPPAPEAQLPPFPRELAGRSAGGSILQGGEDSDREDGNYCPPVKRERTSSLTQFPPSQSEERSSGFRLKPPTLIHGQAPSAGLPSQKPKEQQRSVLRPAVLQAPQPKALSQTVPSSGTNGVSLPADCTGAVPAASPDTAAWRSPSEAADEVCALEEKEPQKNESSNASEEEACEKKDPATQQAFVFGQNLRDRVKLINESVDEADMENAGHPSADTPTATNYFLQYISSSLENSTNSADASSNKFVFGQNMSERVLSPPKLNEVSSDANRENAAAESGSESSSQEATPEKESLAESAAAYTKATARKCLLEKVEVITGEEAESNVLQMQCKLFVFDKTSQSWVERGRGLLRLNDMASTDDGTLQSRLVMRTQGSLRLILNTKLWAQMQIDKASEKSIRITAMDTEDQGVKVFLISASSKDTGQLYAALHHRILALRSRVEQEQEAKMPAPEPGAAPSNEEDDSDDDDVLAPSGATAAGAGDEGDGQTTGST

SEQ ID NO: 807555 - protein, 286 aa, Homo sapiens
MENAGHPSADTPTATNYFLQYISSSLENSTNSADASSNKFVFGQNMSERVLSPPKLNEVSSDANRENAAAESGSESSSQEATPEKESLAESAAAYTKATARKCLLEKVEVITGEEAESNVLQMQCKLFVFDKTSQSWVERGRGLLRLNDMASTDDGTLQSRLVMRTQGSLRLILNTKLWAQMQIDKASEKSIRITAMDTEDQGVKVFLISASSKDTGQLYAALHHRILALRSRVEQEQEAKMPAPEPGAAPSNEEDDSDDDDVLAPSGATAAGAGDEGDGQTTGST

SEQ ID NO: 807556 - protein, 198 aa, Homo sapiens [sequence omitted]

SEQ ID NO: 807557 - protein, 198 aa, Homo sapiens [sequence omitted]

SEQ ID NO: 807558 - protein, 284 aa, Homo sapiens
MADLANEEKPAIAPPVFVFQKDKGQKSPAEQKNLSDSGEEPRGEAEAPHHGTGHPESAGEHALEPPAPAGASASTPPPPAPEAQLPPFPRELAGRSAGGSSPEGGEDSDREDGNYCPPVKRERTSSLTQFPPSQSEERSSGFRLKPPTLIHGQAPSAGLPSQKPKEQQRSVLRPAVLQAPQPKALSQTVPSSGTNGVSLPADCTGAVPAASPDTAAWRSPSEAADEVCALERKSPKNESSNASYTYLSLGFYFDRDDVALEGVSHFFRELAEEKREGYERLLKM

SEQ ID NO: 807559 - protein, 216 aa, Homo sapiens
MADLANEEKPAIAPPVFVFQKDKGQKRSAGGSSPEGGEDSDREDGNYCPPVKRERTSSLTQFPPSQSEERSSGFRLKPPTLIHGQAPSAGLPSQKPKEQQRSVLRPAVLQAPQPKALSQTVPSSGTNGVSLPADCTGAVPAASPDTAAWRSPSEAADEVCALERKSPKNESSNASYTYLSLGFYFDRDDVALEGVSHFFRELAEEKREGYERLLKM

SEQ ID NO: 807560 - protein, 567 aa, Homo sapiens
MADLANEEKPAIAPPVFVFQKDKGQKSPAEQKNLSDSGEEPRGEAEAPHHGTGHPESAGEHALEPPAPAGASASTPPPPAPEAQLPPFPRELAGRSAGGSSPEGGEDSDREDGNYCPPVKRERTSSLTQFPPSQSEERSSGFRLKPPTLIHGQAPSAGLPSQKPKEQQRSVLRPAVLQAPQPKALSQTVPSSGTNGVSLPADCTGAVPAASPDTAAWRSPSEAADEVCALEEKEPQKNESSNASEEEACEKKDPATQQAFVFGQNLRDRVKLINESVDEADMENAGHPSADTPTATNYFLQYISSSLENSTNSADASSNKFVFGQNMSERVLSPPKLNEVSSDANRENAAAESGSESSSQEATPEKESLAESAAAYTKATARKCLLEKVEVITGEEAESNVLQMQCKLFVFDKTSQSWVERGRGLLRLNDMASTDDGTLQSRLVMRTQGSLRLILNTKLWAQMQIDKASEKSIRITAMDTEDQGVKVFLISASSKDTGQLYAALHHRILALRSRVEQEQEAKMPAPEPGAAPSNEEDDSDDDDVLAPSGATAAGAGDEGDGQTTGST

SEQ ID NO: 807561 - protein, 429 aa, Homo sapiens
MENAGHPSADTPTATNYFLQYISSRCVSRCQRPAWHGDAGGREGFCQRGVCGPRARLRPRIQVALRPLSLIPHSGHNLGWARVVGLVLGFTGRLRQDQSSVGLSRGPWRLQPSPWSVPSVLWTSCPEQNRRGQRRLRRPLILGLGTWGKDLIMSLTDMAGGKATHGPAAPPGVSEESVSRLGDGRVEQVEGGFPHAVGPLHQGELRVNVFNGKGGVWLPASDTPPRAQWRRPLHCALCVSVCSMGTHTFAWPRSHVTPTLIAHLLFSLENSTNSADASSNKFVFGQNMSERVLSPPKLNEVSSDANRENAAAESGSESSSQEATPEKESLAESAAAYTKATARKCLLEKVEVITGEEAESNVLQMQCKLFVFDKTSQSWVERGRGLLRLNDMASTDDGTLQSRLGELPTAGAVAGSPWGGLGTMQFQRE

SEQ ID NO: 807562 - protein, 184 aa, Homo sapiens
FSSFSVDSDREDGNYCPPVKRERTSSLTQFPPSQSEERSSGFRLKPPTLIHGQAPSAGLPSQKPKEQQRSVLRPAVLQAPQPKALSQTVPSSGTNGVSLPADCTGAVPAASPDTAAWRSPSEAADEVCALEEKEPQKNESSNASEEEACEKKDPATQQAFVFGQNLRDRVKLINESVDEADDFK

SEQ ID NO: 807563 - protein, 499 aa, Homo sapiens; identical to SEQ ID NO: 807551

SEQ ID NO: 807564 - protein, 398 aa, Homo sapiens
MADLANEEKPAIAPPVFVFQKDKGQKRSAGGSSPEGGEDSDREDGNYCPPVKRERTSSLTQFPPSQSEERSSGFRLKPPTLIHGQAPSAGLPSQKPKEQQRSVLRPAVLQAPQPKALSQTVPSSGTNGVSLPADCTGAVPAASPDTAAWRSPSEAADEVCALEEKEPQKNESSNASEEEACEKKDPATQQAFVFGQNLRDRVKLINESVDEADMENAGHPSADTPTATNYFLQYISSSLENSTNSADASSNKFVFGQNMSERVLSPPKLNEVSSDANRENAAAESGSESSSQEATPEKESLAESAAAYTKATARKCLLEKVEVITGEEAESNVLQMQCKLFVFDKTSQSWVLLRHPHPSHPAVGPCLCGEQPALCPCPGLPNYRPGTPAQLGGLLVRV

SEQ ID NO: 807565 - protein, 286 aa, Homo sapiens; identical to SEQ ID NO: 807555

SEQ ID NO: 807566 - protein, 210 aa, Homo sapiens
MTDKLTDCILSLAPGPTRQLVLVTKGTGRRPGAHSGREPGCTPGCCFVRLSTRPPAPTPPAASRCGAGNHTPHWAGHSLDPHVLFKSRLGNCLNVVWDTRPHHIDERTNKNISSLPSFELKWHIKTCHGFSLGLETSFLHPACRQPLGPARAPGFSATHTLPTLLWGPAFVGSSQPSAPAQGSPTIGLGPPPSLGGCSYECRHWAHWTCC

SEQ ID NO: 807567 - protein, 195 aa, Homo sapiens
MADLANEEKPAIAPPVFVFQKDKGQKRSAGGSSPEGGEDSDREDGNYCPPVKRERTSSLTQFPPSQSEERSSGFRLKPPTLIHGQAPSAGLPSQKPKEQQRSVLRPAVLQAPQPKALSQTVPSSGTNGVSLPADCTGAVPAASPDTAAWRSPSEAADEVCALEEKEPQKNESSNASEEEACEKKDPATVYVAYLL

SEQ ID NO: 807568 - protein, 464 aa, Homo sapiens
MDFQHRPGGKTGSGGVASSSESNRDRRERLRQLALETIDINKDPYFMKNHLGSYECKLCLTLHNNEGSYLAHTQGKKHQTNLARRAAKEAKEAPAQPAPEKVKVEVKKFVKIGRPGYKVTKQRDSEMGQQSLLFQIDYPEIAEGIMPRHRFMSAYEQRIEPPDRRWQYLLMAAEPYETIAFKVPSREIDKAEGKFWTHWNRETKQFFLQFHFKMEKPPAPPSLPAGPPGVKRPPPPLMNGLPPRPPLPESLPPPPPGGLPLPPMPPTGPAPSGPPGPPQLPPPAPGVHPPAPVVHPPASGVHPPAPGVHPPAPGVHPPAPGVHPPTSGVHPPAPGVHPPAPGVHPPAPGVHPPAPGVHPPAPGVHPPPSAGVHPQAPGVHPAAPAVHPQAPGVHPPAPGMHPQAPGVHPQPPGVHPSAPGVHPQPPGVHPSNPGVHPPTPMPPMLRPPLPSEGPGNIPPPPPTN

SEQ ID NO: 807569 - protein, 560 aa, Homo sapiens
MRDLPLTSLALVLSALGALLGTEALRAEEPAVGTSGLIFREDLDWPPGSPQEPLCLVALGGDSNGSSSPLRVVGALSAYEQAFLGAVQRARWGPRDLATFGVCNTGDRQAALPSLRRLGAWLRDPGGQRLVVLHLEEVTWEPTPSLRFQEPPPGGAGPPELALLVLYPGPGPEVTVTRAGLPGAQSLCPSRDTRYLVLAVDRPAGAWRGSGLALTLQPRGEDSRLSTARLQALLFGDDHRCFTRMTPALLLLPRSEPAPLPAHGQLDTVPFPPPRPSAELEESPPSADPFLETLTRLVRALRVPPARASAPRLALDPDALAGFPQGLVNLSDPAALERLLDGEEPLLLLLRPTAATTGDPAPLHDPTSAPWATALARRVAAELQAAAAELRSLPGLPPATAPLLARLLALCPGGPGGLGDPLRALLLLKALQGLRVEWRGRDPRGPGRAQRSAGATAADGPCALRELSVDLRAERSVLIPETYQANNCQGVCGWPQSDRNPRYGNHVVLLLKMQARGAALARPPCCVPTAYAGKLLISLSEERISAHHVPNMVATECGCR

SEQ ID NO: 807570 - protein, 464 aa, Homo sapiens; identical to SEQ ID NO: 807568

SEQ ID NO: 807571 - protein, 464 aa, Homo sapiens; identical to SEQ ID NO: 807568

SEQ ID NO: 807572 - protein, 464 aa, Homo sapiens; identical to SEQ ID NO: 807568

SEQ ID NO: 807573 - protein, 464 aa, Homo sapiens; identical to SEQ ID NO: 807568

SEQ ID NO: 807574 - protein, 464 aa, Homo sapiens; identical to SEQ ID NO: 807568

SEQ ID NO: 807575 - protein, 354 aa, Homo sapiens
MDFQHRPGGKTGSGGVASSSESNRDRRERLRQLALETIDINKDPYFMKNHLGSYECKLCLTLHNNEGSYLAHTQGKKHQTNLARRAAKEAKEAPAQPAPEKVKVEVKKFVKIGRPGYKVTKQRDSEMGQQSLLFQIDYPEIAEGIMPRHRFMSAYEQRIEPPDRRWQYLLMAAEPYETIAFKVPSREIDKAEGKFWTHWNRETKQFFLQFHFKMEKPPAPPSLPAGPPGVKRPPPPLMNGLPPRPPLPESLPPPPPGGLPLPPMPPTGPAPSGPPGPPQLPPPAPGVHPPAPVVHPPASGVHPPAPGVHPPAPGVHPPAPGVHPPTSGVHPLSPQPRVNTTRSHHSLRSHNPGH

SEQ ID NO: 807576 - protein, 238 aa, Homo sapiens
MDFQHRPGGKTGSGGVASSSESNRDRRERLRQLALETIDINKDPYFMKNHLGSYECKLCLTLHNNEGSYLAHTQGKKHQTNLARRAAKEAKEAPAQPAPEKVKVEVKKFVKIGRPGYKVTKQRDSEMGQQSLLFQIDYPEIAEGIMPRHRFMSAYEQRIEPPDRRWQYLLMAAEPYETIAFKVPSREIDKAEGKFWTHWNRETKQFFLQFHFKMEKPPAPPSLPAGPPGVKRPPPPAH

SEQ ID NO: 807577 - protein, 464 aa, Homo sapiens; identical to SEQ ID NO: 807568

SEQ ID NO: 807578 - protein, 464 aa, Homo sapiens; identical to SEQ ID NO: 807568

SEQ ID NO: 807579 - protein, 418 aa, Homo sapiens
MKNHLGSYECKLCLTLHNNEGSYLAHTQGKKHQTNLARRAAKEAKEAPAQPAPEKVKVEVKKFVKIGRPGYKVTKQRDSEMGQQSLLFQIDYPEIAEGIMPRHRFMSAYEQRIEPPDRRWQYLLMAAEPYETIAFKVPSREIDKAEGKFWTHWNRETKQFFLQFHFKMEKPPAPPSLPAGPPGVKRPPPPLMNGLPPRPPLPESLPPPPPGGLPLPPMPPTGPAPSGPPGPPQLPPPAPGVHPPAPVVHPPASGVHPPAPGVHPPAPGVHPPAPGVHPPTSGVHPPAPGVHPPAPGVHPPAPGVHPPAPGVHPPAPGVHPPPSAGVHPQAPGVHPAAPAVHPQAPGVHPPAPGMHPQAPGVHPQPPGVHPSAPGVHPQPPGVHPSNPGVHPPTPMPPMLRPPLPSEGPGNIPPPPPTN

SEQ ID NO: 807580 - protein, 436 aa, Homo sapiens
MDFQHRPGGKTGSGGVASSSESNRDRRERLRQLALETIDINKTRYFMKKHQTNLARRAAKEAKEAPAQPAPEKVKVEVKKFVKIGRPGYKVTKQRDSEMGQQSLLFQIDYPEIAEGIMPRHRFMSAYEQRIEPPDRRWQYLLMAAEPYETIAFKVPSREIDKAEGKFWTHWNRETKQFFLQFHFKMEKPPAPPSLPAGPPGVKRPPPPLMNGLPPRPPLPESLPPPPPGGLPLPPMPPTGPAPSGPPGPPQLPPPAPGVHPPAPVVHPPASGVHPPAPGVHPPAPGVHPPAPGVHPPTSGVHPPAPGVHPPAPGVHPPAPGVHPPAPGVHPPAPGVHPPPSAGVHPQAPGVHPAAPAVHPQAPGVHPPAPGMHPQAPGVHPQPPGVHPSAPGVHPQPPGVHPSNPGVHPPTPMPPMLRPPLPSEGPGNIPPPPPTN

SEQ ID NO: 807581 - protein, 338 aa, Homo sapiens
MGQQSLLFQIDYPEIAEGIMPRHRFMSAYEQRIEPPDRRWQYLLMAAEPYETIAFKVPSREIDKAEGKFWTHWNRETKQFFLQFHFKMEKPPAPPSLPAGPPGVKRPPPPLMNGLPPRPPLPESLPPPPPGGLPLPPMPPTGPAPSGPPGPPQLPPPAPGVHPPAPVVHPPASGVHPPAPGVHPPAPGVHPPAPGVHPPTSGVHPPAPGVHPPAPGVHPPAPGVHPPAPGVHPPAPGVHPPPSAGVHPQAPGVHPAAPAVHPQAPGVHPPAPGMHPQAPGVHPQPPGVHPSAPGVHPQPPGVHPSNPGVHPPTPMPPMLRPPLPSEGPGNIPPPPPTN

SEQ ID NO: 807582 - protein, 169 aa, Homo sapiens
MDFHYPRQLQGSTPRPQWCIPLHLGSIPQLLASTPQLLASIPQPLGSTHQPLGSTPQLLESTLQPPGFTHQPPESTHQPLGFTHQPQGSILPHQRGFTPRPRGCTQQPPPFTLRPQGCTHQPQGCTLRPRGSTPNLPGSIRRLLGSTLSLREFTPQILGCTPQLPCPQC

SEQ ID NO: 807583 - protein, 512 aa, Homo sapiens
MRDLPLTSLALVLSALGALLGTEALRAEEPAVGTSGLIFREDLDWPPGSPQEPLCLVALGGDSNGSSSPLRVVGALSAYEQAFLGAVQRARWGPRDLATFGVCNTGDRQAALPSLRRLGAWLRDPGGQRLVVLHLEEEPLPLPRHPLPGVSGGPPCGGLARLRAGLDPAAPRRGLPAEYRPAAGTAVRRRPPLLHTDDPGPAPAAAVRARAAACARQLDTVPFPPPRPSAELEESPPSADPFLETLTRLVRALRVPPARASAPRLALDPDALAGFPQGLVNLSDPAALERLLDGEEPLLLLLRPTAATTGDPAPLHDPTSAPWATALARRVAAELQAAAAELRSLPGLPPATAPLLARLLALCPGGPGGLGDPLRALLLLKALQGLRVEWRGRDPRGPGRAQRSAGATAADGPCALRELSVDLRAERSVLIPETYQANNCQGVCGWPQSDRNPRYGNHVVLLLKMQARGAALARPPCCVPTAYAGKLLISLSEERISAHHVPNMVATECGCR

SEQ ID NO: 807584 - protein, 185 aa, Homo sapiens
MDFQHRPGGKTGSGGVASSSESNRDRRERLRQLALETIDINKDPYFMKNHLGSYECKLCLTLHNNEGSYLAHTQGKKHQTNLARRAAKEAKEAPAQPAPEKVKVEVKKFVKIGRPGYKAPNSHAPNAEAPTSLRRPREHTSPSPNQLRSCSLPQQAQRQVLLPFPTERRLLFCTAPRSLNSLPQP

SEQ ID NO: 807585 - protein, 65 aa, Homo sapiens
MAQASPAVPAAVTWEPTPSLRFQEPPPGGAGPPELALLVLYPGPGPEVTVTRAGLPGAQVPGSCM

SEQ ID NO: 807586 - protein, 69 aa, Homo sapiens
WRIRHEGEAPGVHPQPPGVHPSAPGVHPQPPGVHPSNPGVHPPTPMPPMLRPPLPSEGPGNIPPPPPTN

SEQ ID NO: 807587 - protein, 279 aa, Homo sapiens
MDFQHRPGGKTGSGGVASSSESNRDRRERLRQLALETIDINKDPYFMKNHLGSYECKLCLTLHNNEGSYLAHTQGKKHQTNLARRAAKEAKEAPAQPAPEKVKVEVKKFVKIGRPGYKVTKQRDSEMGQQSLLFQIDYPEIAEGIMPRHRFMSAYEQRIEPPDRRWQYLLMAAEPYETIAFKVPSREIDKAEGKFWTHWNRETKQFFLQFHFKMEKPPAPPSLPAGPPGVKRPPPPLMNGLPPRPPLPESLPPPQVRCHSKGRASARDHIDDSNHGEYI

SEQ ID NO: 807588 - protein, 222 aa, Homo sapiens
MDFQHRPGGKTGSGGVASSSESNRDRRERLRQLALETIDINKDPYFMKNHLGSYECKLCLTLHNNEGSYLAHTQGKKHQTNLARRAAKEAKEAPAQPAPEKVKVEVKKFVKIGRPGYKVTKQRDSEMGQQSLLFQIDYPEIAEGIMPRHRFMSAYEQRIEPPDRRWQYLLMAAEPYETIAFKVRAERSTRAERASCHTGPGTSVFLRPKESPPTGPGGRKSC

SEQ ID NO: 807589 - protein, 464 aa, Homo sapiens; identical to SEQ ID NO: 807568

SEQ ID NO: 807590 - protein, 464 aa, Homo sapiens; identical to SEQ ID NO: 807568

SEQ ID NO: 807591 - protein, 358 aa, Homo sapiens
MDFQHRPGGKTGSGGVASSSESNRDRRERLRQLALETIDINKDPYFMKNHLGSYECKLCLTLHNNEGSYLAHTQGKKHQTNLARRAAKEAKEAPAQPAPEKVKVEVKKFVKIGRPGYKVTKQRDSEMGQQSLLFQIDYPEIAEGIMPRHRFMSAYEQRIEPPDRRWQYLLMAAEPYETIAFKVPSREIDKAEGKFWTHWNRETKQFFLQFHFKMEKPPAPPSLPAGPPGVKRPPPPLMNGLPPRPPLPESLPPPPPGGLPLPPMPPTGPAPSGPPGPPQLPPPAPGVHPPAPGMHPQAPGVHPQPPGVHPSAPGVHPQPPGVHPSNPGVHPPTPMPPMLRPPLPSEGPGNIPPPPPTN

SEQ ID NO: 807592 - protein, 301 aa, Homo sapiens
MDFQHRPGGKTGSGGVASSSESNRDRRERLRQLALETIDINKDPYFMKNHLGSYECKLCLTLHNNEGSYLAHTQGKKHQTNLARRAAKEAKEAPAQPAPEKVKVEVKKFVKIGRPGYKVTKQRDSEMGQQSLLFQIDYPEIAEGIMPRHRFMSAYEQRIEPPDRRWQYLLMAAEPYETIAFKVPSREIDKAEGKFWTHWNRETKQFFLQFHFKMEKPPAPPSLPAGPPGVKRPPPPLMNGLPPRPLFLNFFPPSSHHPLPLRPDPPTQGHPYPGSSSSSASSPVSTTLVTQSESLTPGYTG

SEQ ID NO: 807593 - protein, 464 aa, Homo sapiens; identical to SEQ ID NO: 807568

SEQ ID NO: 807594 - protein, 464 aa, Homo sapiens; identical to SEQ ID NO: 807568

SEQ ID NO: 807595 - protein, 490 aa, Homo sapiens
MDFQHRPGGKTGSGGVASSSESNRDRRERLRQLALETIDINKDPYFMKNHLGSYECKLCLTLHNNEGSYLAHTQGKKHQTNLARRAAKEAKEAPAQPAPEKVKVEVKKFVKIGRPGYKVTKQRDSEMGQQSLLFQVRSGTWAWGAAKGTQEAALPPAVSLQIDYPEIAEGIMPRHRFMSAYEQRIEPPDRRWQYLLMAAEPYETIAFKVPSREIDKAEGKFWTHWNRETKQFFLQFHFKMEKPPAPPSLPAGPPGVKRPPPPLMNGLPPRPPLPESLPPPPPGGLPLPPMPPTGPAPSGPPGPPQLPPPAPGVHPPAPVVHPPASGVHPPAPGVHPPAPGVHPPAPGVHPPTSGVHPPAPGVHPPAPGVHPPAPGVHPPAPGVHPPAPGVHPPPSAGVHPQAPGVHPAAPAVHPQAPGVHPPAPGMHPQAPGVHPQPPGVHPSAPGVHPQPPGVHPSNPGVHPPTPMPPMLRPPLPSEGPGNIPPPPPTN

SEQ ID NO: 807596 - protein, 386 aa, Homo sapiens
CVCVCVYIYFFFFRWSLALLPRLECSGAISAHCKPRLPGSLTKQRDSEMGQQSLLFQIDYPEIAEGIMPRHRFMSAYEQRIEPPDRRWQYLLMAAEPYETIAFKVPSREIDKAEGKFWTHWNRETKQFFLQFHFKMEKPPAPPSLPAGPPGVKRPPPPLMNGLPPRPPLPESLPPPPPGGLPLPPMPPTGPAPSGPPGPPQLPPPAPGVHPPAPVVHPPASGVHPPAPGVHPPAPGVHPPAPGVHPPTSGVHPPAPGVHPPAPGVHPPAPGVHPPAPGVHPPAPGVHPPPSAGVHPQAPGVHPAAPAVHPQAPGVHPPAPGMHPQAPGVHPQPPGVHPSAPGVHPQPPGVHPSNPGVHPPTPMPPMLRPPLPSEGPGNIPPPPPTN

SEQ ID NO: 807597 - protein, 191 aa, Homo sapiens
MDFQHRPGGKTGSGGVASSSESNRDRRERLRQLALETIDINKDPYFMKNHLGSYECKLCLTLHNNEGSYLAHTQGKKHQTNLARRAAKEAKEAPAQPAPEKVKVEVKKFVKIGRPGYKVTKQRDSEMGQQSLLFQIDYPEIAEGIMPRHRFMSAYEQRIEPPGPGRLGNEPLASNWPARRPPLPGGTPILA

SEQ ID NO: 807598 - protein, 316 aa, Homo sapiens [sequence omitted]

SEQ ID NO: 807599 - protein, 41 aa, Homo sapiens
MDFQHRPGGKTGSGGVASSSESNRDRRERLRQLALETIDIN

SEQ ID NO: 807600 - protein, 155 aa, Homo sapiens
SARYRGRVVGTAPGPLPGQGSPGPAASAWISDPETRGDPGGPWGMWRGSDLRPRPVSLTGLTLVVVAAQGPQVHSVKLCFGLGGPCLLFPIFRPLLLHPRRPRLHPGTRGVAVEPHALRVVHVAHGEEAGIRAAGPGHGGVEIPQGVEAWEQGGG

SEQ ID NO: 807601 - protein, 111 aa, Homo sapiens [sequence omitted]

SEQ ID NO: 807602 - protein, 264 aa, Homo sapiens
MAEREEDDELRKPGCSYGPQNPCLPSAAAVAAHPVCLTSITEIWQGGRQPKPARTGACCVGQSHRGIVDDLEIQRAYTPISPANAEGYFEVLIKCYQMGLMSRYVESWRVGDTAFWRGPFGDFFYKPNQYGELLLLAAGTGLAPMVPILQSITDNENDETFVTLVGCFKTFESIYLKTFLQEQARFWNVRTFFVLSQESSSEQLPWSYQEKTHFGHLGQDLIKELVSCCRRKPFALVCGSAEFTKDIARCLLCAGLTEDSYFLF

SEQ ID NO: 807603 - protein, 162 aa, Homo sapiens
MAEREEDDDTEEAWMQLRPTEPLPSQCCGSGCSPCVFDLYHRDLARWEAAQASKDRSLLRGPESQSCPSKLNPETFVAFCIIAMDRLTKDTYRVRFALPGNSQLGLRPGQHLILRGIVDDLEIQRAYTPISPANAEGYFEVLIKMKKLKLKKMTSFVSRPLG

SEQ ID NO: 807604 - protein, 264 aa, Homo sapiens; identical to SEQ ID NO: 807602

SEQ ID NO: 807605 - protein, 120 aa, Homo sapiens
MAEREEDDDTEEAWMQLRPTEPLPSQCCGSGCSPCVFDLYHRDLARWEAAQASKDRSLLRGPESQSCPSKLNPETFVAFCIIAMDRLTKDTYRVRFALPGNSQLGLRPGQHLILRLVSNS

SEQ ID NO: 807606 - protein, 459 aa, Homo sapiens
AGTEARSAAHGGAQCRGRAGGSAVGGRPWTGMADRRRAWNTEDDLPVYLARPGSAAQTPRQKYGGMFAAVEGAYENKTIDFDAYSVGRRGSAHTPRSAGRPDAVGLPGPGGSEDTASDVSEPSGSAVSSPGERDERPPTLRIRRPAPRDLPLGRDNGQSDRLLIKGGRIINDDQSLYADVYLEDGLIKQIGENLIVPGGVKTIEANGRMVIPGGIDVNTYLQKPSQGMTAADDFFQGTRAALVGGTTMIIDHVVPEPGSSLLTSFEKWHEAADTKSCCDYSLHVDITSWYDGVREELEVLVQDKGVNSFQVYMAYKDVYQMSDSQLYEAFTFLKGLGAVILVHAENGDLIAQEQKRILEMGITGPEGHALSRPEELEAEAVFRAITIAGRINCPVYITKVMSKSAADIIALARKKGPSFGKPLRQLGRWPIMAKLAGWGRDSFLDRLPPIALLAGFGLA

SEQ ID NO: 807607 - protein, 717 aa, Homo sapiens
AGTEARSAAHGGAQCRGRAGGSAVGGRPWTGMADRRRAWNTEDDLPVYLARPGSAAQTPRQKYGGMFAAVEGAYENKTIDFDAYSVGLRGSAHTPRSAGRPDAVGLPGPGGSEDTASDVSEPSGSAVSSPGERDERPPTLRIRRPAPRDLPLGRDNGQSDRLLIKGGRIINDDQSLYADVYLEDGLIKQIGENLIVPGGVKTIEANGRMVIPGGIDVNTYLQKPSQGMTAADDFFQGTRAALVGGTTMIIDHVVPEPGSSLLTSFEKWHEAADTKSCCDYSLHVDITSWYDGVREELEVLVQDKGVNSFQVYMAYKDVYQMSDSQLYEAFTFLKGLGAVILVHAENGDLIAQEQKRILEMGITGPEGHALSRPEELEAEAVFRAITIAGRINCPVYITKVMSKSAADIIALARKKGPLVFGEPIAASLGTDGTHYWSKNWAKAAAFVTSPPLSPDPTTPDYLTSLLACGDLQVTGSGHCPYSTAQKAVGKDNFTLIPEGVNGIEERMTVVWDKAVATGKMDENQFVAVTSTNAAKIFNLYPRKGRIAVGSDADVVIWDPDKLKTITAKSHKSAVEYNIFEGMECHGSPLVVISQGKIVFEDGNINVNKGMGRFIPRKAFPEHLYQRVKIRNKVFGLQGVSRGMYDGPVYEVPATPKYATPAPSAKSSPSKHQPPPIRNLHQSNFSLSGAQIDDNNPRRTGHRIVAPPGGRSNITSLG

SEQ ID NO: 807608 - protein, 570 aa, Homo sapiens
MQKMNNEVVDKSDRLLIKGGRIINDDQSLYADVYLEDGLIKQIGENLIVPGGVKTIEANGRMVIPGGIDVNTYLQKPSQGMTAADDFFQGTRAALVGGTTMIIDHVVPEPGSSLLTSFEKWHEAADTKSCCDYSLHVDITSWYDGVREELEVLVQDKGVNSFQVYMAYKDVYQMSDSQLYEAFTFLKGLGAVILVHAENGDLIAQEQKRILEMGITGPEGHALSRPEELEAEAVFRAITIAGRINCPVYITKVMSKSAADIIALARKKGPLVFGEPIAASLGTDGTHYWSKNWAKAAAFVTSPPLSPDPTTPDYLTSLLACGDLQVTGSGHCPYSTAQKAVGKDNFTLIPEGVNGIEERMTVVWDKAVATGKMDENQFVAVTSTNAAKIFNLYPRKGRIAVGSDADVVIWDPDKLKTITAKSHKSAVEYNIFEGMECHGSPLVVISQGKIVFEDGNINVNKGMGRFIPRKAFPEHLYQRVKIRNKVFGLQGVSRGMYDGPVYEVPATPKYATPAPSAKSSPSKHQPPPIRNLHQSNFSLSGAQIDDNNPRRTGHRIVAPPGGRSNITSLG

SEQ ID NO: 807609 - protein, 569 aa, Homo sapiens
LGEPGVNGRGSDRLLIKGGRIINDDQSLYADVYLEDGLIKQIGENLIVPGGVKTIEANGRMVIPGGIDVNTYLQKPSQGMTAADDFFQGTRAALVGGTTMIIDHVVPEPGSSLLTSFEKWHEAADTKSCCDYSLHVDITSWYDGVREELEVLVQDKGVNSFQVYMAYKDVYQMSDSQLYEAFTFLKGLGAVILVHAENGDLIAQEQKRILEMGITGPEGHALSRPEELEAEAVFRAITIAGRINCPVYITKVMSKSAADIIALARKKGPLVFGEPIAASLGTDGTHYWSKNWAKAAAFVTSPPLSPDPTTPDYLTSLLACGDLQVTGSGHCPYSTAQKAVGKDNFTLIPEGVNGIEERMTVVWDKAVATGKMDENQFVAVTSTNAAKIFNLYPRKGRIAVGSDADVVIWDPDKLKTITAKSHKSAVEYNIFEGMECHGSPLVVISQGKIVFEDGNINVNKGMGRFIPRKAFPEHLYQRVKIRNKVFGLQGVSRGMYDGPVYEVPATPKYATPAPSAKSSPSKHQPPPIRNLHQSNFSLSGAQIDDNNPRRTGHRIVAPPGGRSNITSLG

SEQ ID NO: 807610 - protein, 688 aa, Homo sapiens
MGREALPGSSREGRIRLRSAPPGGAVCSPLLPPSPLPPPSPALLADPGGAGSRSGGGRAEQPGQPRVGIHGRRASVRVSIPPGPLSARPLGAGPRAPVPVRQPRRSAAGPRAPEGAMSYQGKKSIPHITSDRLLIKGGRIINDDQSLYADVYLEDGLIKQIGENLIVPGGVKTIEANGRMVIPGGIDVNTYLQKPSQGMTAADDFFQGTRAALVGGTTMIIDHVVPEPGSSLLTSFEKWHEAADTKSCCDYSLHVDITSWYDGVREELEVLVQDKGVNSFQVYMAYKDVYQMSDSQLYEAFTFLKGLGAVILVHAENGDLIAQEQKRILEMGITGPEGHALSRPEELEAEAVFRAITIAGRINCPVYITKVMSKSAADIIALARKKGPLVFGEPIAASLGTDGTHYWSKNWAKAAAFVTSPPLSPDPTTPDYLTSLLACGDLQVTGSGHCPYSTAQKAVGKDNFTLIPEGVNGIEERMTVVWDKAVATGKMDENQFVAVTSTNAAKIFNLYPRKGRIAVGSDADVVIWDPDKLKTITAKSHKSAVEYNIFEGMECHGSPLVVISQGKIVFEDGNINVNKGMGRFIPRKAFPEHLYQRVKIRNKVFGLQGVSRGMYDGPVYEVPATPKYATPAPSAKSSPSKHQPPPIRNLHQSNFSLSGAQIDDNNPRRTGHRIVAPPGGRSNITSLG

SEQ ID NO: 807611 - protein, 688 aa, Homo sapiens; identical to SEQ ID NO: 807610

SEQ ID NO: 807612 - protein, 688 aa, Homo sapiens; identical to SEQ ID NO: 807610

SEQ ID NO: 807613 - protein, 688 aa, Homo sapiens; identical to SEQ ID NO: 807610

SEQ ID NO: 807614 - protein, 430 aa, Homo sapiens
IGREALPGSSREGRIRLRSAPPGGAVCSPLLPPSPLPPPSPALLADPGGAGSRSGGGRAEQPGQPRVGIHGRRASVRVSIPPGPLSARPLGAGPRAPVPVRQPRRSAAGPRAPEGAMSYQGKKSIPHITSDRLLIKGGRIINDDQSLYADVYLEDGLIKQIGENLIVPGGVKTIEANGRMVIPGGIDVNTYLQKPSQGMTAADDFFQGTRAALVGGTTMIIDHVVPEPGSSLLTSFEKWHEAADTKSCCDYSLHVDITSWYDGVREELEVLVQDKGVNSFQVYMAYKDVYQMSDSQLYEAFTFLKGLGAVILVHAENGDLIAQEQKRILEMGITGPEGHALSRPEELEAEAVFRAITIAGRINCPVYITKVMSKSAADIIALARKKGPSFGKPLRQLGRWPIMAKLAGWGRDSFLDRLPPIALLAGFGLA

SEQ ID NO: 807615 - protein, 688 aa, Homo sapiens; identical to SEQ ID NO: 807610

SEQ ID NO: 807616 - protein, 251 aa, Homo sapiens
AGTEARSAAHGGAQCRGRAGGSAVGGRPWTGMADRRRAWNTEDDLPVYLARPGSAAQTPRQKYGGMFAAVEGAYENKTIDFDAYSVGRRGSAHTPRSAGRPDAVGLPGPGGSEDTASDVSEPSGSAVSSPGERDERPPTLRIRRPAPRDLPLGRDNGQSDRLLIKGGRIINDDQSLYADVYLEDGLIKQIGENLIVPGGVKTIEANGRMVIPGGIDVNTYLQKPSQGMTAADDFFQGTRAALVGGTTMISE

SEQ ID NO: 807617 - protein, 627 aa, Homo sapiens
RSEGKRFLVRAERGESGFAPRRREELSAAPSSRPRLSLLLLPPSSPIRAVLAAGAAAGGPSSRGSRAWASTGAEPPSVSLSLPGLCQRARWERGRERRFQSDSPAGQRPGRGRQRGPCRTRARRASRTSRVTDSSSKVDGSSTMTNPFMLTSTWRMDLSIDHVVPEPGSSLLTSFEKWHEAADTKSCCDYSLHVDITSWYDGVREELEVLVQDKGVNSFQVYMAYKDVYQMSDSQLYEAFTFLKGLGAVILVHAENGDLIAQEQKRILEMGITGPEGHALSRPEELEAEAVFRAITIAGRINCPVYITKVMSKSAADIIALARKKGPLVFGEPIAASLGTDGTHYWSKNWAKAAAFVTSPPLSPDPTTPDYLTSLLACGDLQVTGSGHCPYSTAQKAVGKDNFTLIPEGVNGIEERMTVVWDKAVATGKMDENQFVAVTSTNAAKIFNLYPRKGRIAVGSDADVVIWDPDKLKTITAKSHKSAVEYNIFEGMECHGSPLVVISQGKIVFEDGNINVNKGMGRFIPRKAFPEHLYQRVKIRNKVFGLQGVSRGMYDGPVYEVPATPKYATPAPSAKSSPSKHQPPPIRNLHQSNFSLSGAQIDDNNPRRTGHRIVAPPGGRSNITSLG

SEQ ID NO: 807618 - protein, 694 aa, Homo sapiens
IGREALPGSSREGRIRLRSAPPGGAVCSPLLPPSPLPPPSPALLADPGGAGSRSGGGRAEQPGQPRVGIHGRRASVRVSIPPGPLSARPLGAGPRAPVPVRQPRRSAAGPRAPEGAMSYQGKKSIPHITSDRLLIKGGRIINDDQSLYADVYLEDGLIKQIGENLIVPGGVKTIEANGRMVIPGGIDVNTYLQKPSQGMTAADDFFQGTRAALVGGTTMIIDHVVPEPGSSLLTSFEKWHEAADTKSCCDYSLHVDITSWYDGVREELEVLVQDKGVNSFQVYMAYKDVYQMSDSQLYEAFTFLKGLGAVILVHAENGDLIAQEQKRILEMGITGPEGHALSRPEELEAEAVFRAITIAGRINCPVYITKVMSKSAADIIALARKKGPLVFGEPIAASLGTDGTHYWSKNWAKAAAFVTSPPLSPDPTTPDYLTSLLACGDLQVTGSGHCPYSTAQKAVGKDNFTLIPEGVNGIEERMTVVWDKAVATGKMDENQFVAVTSTNAAKIFNLYPRKGRIAVGSDADVVIWDPDKLKTITAKSHKSAVEYNIFEGMECHGSPLVVISQGKIVFEDGNINVNKGMGRFIPRKAFPEHLYQRVKIRNKVFGLQGVSRGMYDGPVYEVPATPKYATPAPSAKSSPSKHQPPPIRNLHQSNFSLSALPEPAAPENRTIALRLQSFFPSESSSAVGLWSWNT

SEQ ID NO: 807619 - protein, 241 aa, Homo sapiens
AGTEARSAAHGGAQCRGRAGGSAVGGRPWTGMADRRRAWNTEDDLPVYLARPGSAAQTPRQKYGGMFAAVEGAYENKTIDFDAYSVGRRGSAHTPRSAGRPDAVGLPGPGGSEDTASDVSEPSGSAVSSPGERDERPPTLRIRRPAPRDLPLGRDNGQSDRLLIKGGRIINDDQSLYADVYLEDGLIKQIGENLIVPGGVKTIEANGRMVIPGGIDVNTYLQKPSQGMTAVTETRCRDLKP

SEQ ID NO: 807620 - protein, 220 aa, Homo sapiens
GPEPLDLGSQLLHLAAGLLAGARLQLLQPPSLLLRLRQPLLQLQVVSHQLLLAAALQALGVEAFPSSAPGRVASAFCASMAADGVSSGPAQPPLSSPLGSGSGDSYCSSPGHRQPQQDLHPLSGSPSAVSGAGNHQSHDAQGVFGGSPGHQRSKEREEEEGWIRQPVLGGGTFPSLPSLKPTFLHSANLVTLSPSTFWNHLFTKRPVYCLSPNLPQVNSW

SEQ ID NO: 807621 - protein, 265 aa, Homo sapiens
LGEAGVNGRGITEAHTVVADALAKAVAENFFVETLQPQLLHVSEQSILTSTALLTAMLRQLRSPALLREAVAFLLGTDRQPEAPGDNPHTLYAHLIGHCDHLSDEISITTLRLFEELLQKPHEGIIHSLVLRNLEGRPYVAWGSPEPESYEDTLDLEEDPYFTDSFLDSGFQTPAKPRLAPATSYDGKTAVTEIVNSFLCLVPEEAKTSAFLEETGYDTYVHDAYGLCHGWGPGSLWGGFAPTLVPCDGAFSGAPRVVRCRSGTS

SEQ ID NO: 807622 - protein, 685 aa, Homo sapiens
MLDILVYEEQQQAAAGEAGPCLEYLLQHKILETLCTLGKAEYPPGMRQQVFQFFSKVLAQVQHPLLHYLSVHRPVQKLLRLGGTASGSVTEKEEVQFTTVLCSKIQQDPELLAYILEGKKIVGRKKACGEPTALPKDTTSHGDKDCSHDGAPARPQLDGESCGAQALNSHMPAETEELDGGTTESNLITSLLGLCQSKKSRVALKAQENLLLLVSMASPAAATYLVQSSACCPAIVRHLCQLYRSMPVFLDPADIATLEGISWRLPSAPSDEASFPGKEALAAFLGWFDYCDHLITEAHTVVADALAKAVAENFFVETLQPQLLHVSEQSILTSTALLTAMLRQLRSPALLREAVAFLLGTDRQPEAPGDNPHTLYAHLIGHCDHLSDEISITTLRLFEELLQKPHEGIIHSLVLRNLEGRPYVAWGSPEPESYEDTLDLEEDPYFTDSFLDSGFQTPAKPRLAPATSYDGKTAVTEIVNSFLCLVPEEAKTSAFLEETGYDTYVHDAYGLFQECSSRVASWGWPLTPTPLDPHEPERPFFEGHFLRVLFDRMSRILDQPYSLNLQVTSVLSRLALFPHPHIHEYLLDPYISLAPGCRSLFSVLVRVIGDLMQRIQRVPQFPGKLLLVRKQLTGQAPGEQLDHQTLLQGVVVLEEFCKELAAIAFVKFPPHDPRQNVSPAPEGQV

SEQ ID NO: 807623 - protein, 685 aa, Homo sapiens; identical to SEQ ID NO: 807622

SEQ ID NO: 807624 - protein, 619 aa, Homo sapiens
AEAEIRYPGGTQAASPPAPGRRPAGSPPCGPSGGPWEVVPTRSGLISPSFQGKKIVGRKKACGEPTALPKDTTSHGDKDCSHDGAPARPQLDGESCGAQALNSHMPAETEELDGGTTESNLITSLLGLCQSKKSRVALKAQENLLLLVSMASPAAATYLVQSSACCPAIVRHLCQLYRSMPVFLDPADIATLEGISWRLPSAPSDEASFPGKEALAAFLGWFDYCDHLITEAHTVVADALAKAVAENFFVETLQPQLLHVSEQSILTSTALLTAMLRQLRSPALLREAVAFLLGTDRQPEAPGDNPHTLYAHLIGHCDHLSDEISITTLRLFEELLQKPHEGIIHSLVLRNLEGRPYVAWGSPEPESYEDTLDLEEDPYFTDSFLDSGFQTPAKPRLAPATSYDGKTAVTEIVNSFLCLVPEEAKTSAFLEETGYDTYVHDAYGLFQECSSRVASWGWPLTPTPLDPHEPERPFFEGHFLRVLFDRMSRILDQPYSLNLQVTSVLSRLALFPHPHIHEYLLDPYISLAPGCRSLFSVLVRVIGDLMQRIQRVPQFPGKLLLVRKQLTGQAPGEQLDHQTLLQGVVVLEEFCKELAAIAFVKFPPHDPRQNVSPAPEGQV

SEQ ID NO: 807625 - protein, 915 aa, Homo sapiens
ALPPPLSPGSRGPGAIMLSRLGALLQEAVGAREPSIDLLQAFVEHWKGITHYYIESTDESTPAKKTDIPWRLKQMLDILVYEEQQQAAAGEAGPCLEYLLQHKILETLCTLGKAEYPPGMRQQVFQFFSKVLAQVQHPLLHYLSVHRPVQKLLRLGGTASGSVTEKEEVQFTTVLCSKIQQDPELLAYILEGKKIVGRKKACGEPTALPKDTTSHGDKDCSHDGAPARPQLDGESCGAQALNSHMPAETEELDGGTTESNLITSLLGLCQSKKSRVALKAQENLLLLVSMASPAAATYLVQSSACCPAIVRHLCQLYRSMPVFLDPADIATLEGISWRLPSAPSDEASFPGKEALAAFLGWFDYCDHLITEAHTVVADALAKAVAENFFVETLQPQLLHVSEQSILTSTALLTAMLRQLRSPALLREAVAFLLGTDRQPEAPGDNPHTLYAHLIGHCDHLSDEISITTLRLFEELLQKPHEGIIHSLVLRNLEGRPYVAWGSPEPESYEDTLDLEEDPYFTDSFLDSGFQTPAKPRLAPATSYDGKTAVTEIVNSVGSKLGSLNHLSFILFYFIFGDRVSLRHPGWSAVVQSRLTATSTSRVPDPSDSCASASRVPGITDMHHHTQLIFIVLVETGFPHVGQAGLELLTSGDPPTSASQSAGITDMSHRACPEFYSLATALGSSQGGRWGPTSRGEQGEPGAPPHRLLSLSFLCLVPEEAKTSAFLEETGYDTYVHDAYGLFQECSSRVASWGWPLTPTPLDPHEPERPFFEGHFLRVLFDRMSRILDQPYSLNLQVTSVLSRLALFPHPHIHEYLLDPYISLAPGCRSLFSVLVRVIGDLMQRIQRVPQFPGKLLLVRKQLTGQAPGEQLDHQTLLQGVVVLEEFCKELAAIAFVKFPPHDPRQNVSPAPEGQV

SEQ ID NO: 807626 - protein, 112 aa, Homo sapiens
WRIRHEGGLPPPPRALPPPLSPGCRSLFSVLVRVIGDLMQRIQRVPQFPGKLLLVRKQLTGQAPGEQLDHQTLLQGVVVLEEFCKELAAIAFVKFPPHDPRQNVSPAPEGQV

SEQ ID NO: 807627 - protein, 759 aa, Homo sapiens
ALPPPLSPGSRGPGAIMLSRLGALLQEAVGAREPSIDLLQAFVEHWKGITHYYIESTDESTPAKKTDIPWRLKQMLDILVYEEQQQAAAGEAGPCLEYLLQHKILETLCTLGKAEYPPGMRQQVFQFFSKVLAQVQHPLLHYLSVHRPVQKLLRLGGTASGSVTEKEEVQFTTVLCSKIQQDPELLAYILEGKKIVGRKKACGEPTALPKDTTSHGDKDCSHDGAPARPQLDGESCGAQALNSHMPAETEELDGGTTESNLITSLLGLCQSKKSRVALKAQENLLLLVSMASPAAATYLVQSSACCPAIVRHLCQLYRSMPVFLDPADIATLEGISWRLPSAPSDEASFPGKEALAAFLGWFDYCDHLITEAHTVVADALAKAVAENFFVETLQPQLLHVSEQSILTSTALLTAMLRQLRSPALLREAVAFLLGTDRQPEAPGDNPHTLYAHLIGHCDHLSDEISITTLRLFEELLQKPHEGIIHSLVLRNLEGRPYVAWGSPEPESYEDTLDLEEDPYFTDSFLDSGFQTPAKPRLAPATSYDGKTAVTEIVNSFLCLVPEEAKTSAFLEETGYDTYVHDAYGLFQECSSRVASWGWPLTPTPLDPHEPERPFFEGHFLRVLFDRMSRILDQPYSLNLQVTSVLSRLALFPHPHIHEYLLDPYISLAPGCRSLFSVLVRVIGDLMQRIQRVPQFPGKLLLVRKQLTGQAPGEQLDHQTLLQGVVVLEEFCKELAAIAFVKFPPHDPRQNVSPAPEGQV

SEQ ID NO: 807628 - protein, 759 aa, Homo sapiens; identical to SEQ ID NO: 807627

SEQ ID NO: 807629 - protein, 759 aa, Homo sapiens; identical to SEQ ID NO: 807627

SEQ ID NO: 807630 - protein, 754 aa, Homo sapiens
ALPPPLSPGSRGPGAIMLSRLGALLQEAVGAREPSIDLLQAFVEHWKGITHYYIESTDESTPAKKTDIPWRLKQMLDILVYEEQQQAAAGEAGPCLEYLLQHKILETLCTLGKAEYPPGMRQQVFQFFSKVLAQVQHPLLHYLSVHRPVQKLLRLGGTASGSVTEKEEVQFTTVLCSKIQQDPELLAYILEGKKIVGRKKACGEPTALPKDTTSHGDKDCSHDGAPARPQLDGESCGAQALNSHMPAETEELDGGTTESNLITSLLGLCQSKKSRVALKAQENLLLLVSMASPAAATYLVQSSACCPAIVRHLCQLYRSMPVFLDPADIATLEGISWRLPSAPSDEASFPGKEALAAFLGWFDYCDHLITEAHTVVADALAKAVAENFFVETLQPQLLHVSEQSILTSTALLTAMLRQLRSPALLREAVAFLLGTDRQPEAPGDNPHTLYAHLIGHCDHLSDEISITTLRLFEELLQKPHEGIIHSLVLRNLEGRPYVAWGSPEPESYEDTLDLEEDPYFTDSFLDSGFQTPAKPRLAPATSYDGKTAVTEIVNSFLCLVPEEAKTSAFLEETGYDTYVHDAYGLFQECSSRVASWGWPLTPTPLDPHEPERPFFEGHFLRVLFDRMSRILDQPYSLNLQVTSVLSRLALFPHPHIHEYLLDPYISLAPGCRSLFSVLVRVIGDLMQRIQRVPQFPGKLLLVRKQLTGQAPGEQLDHQTLLQGVVVLEEFCKELAAIAFVKFPPHDPPGSGFRT

SEQ ID NO: 807631 - protein, 412 aa, Homo sapiens
ALPPPLSPGSRGPGAIMLSRLGALLQEAVGAREPSIDLLQAFVEHWKGITHYYIESTDESTPAKKTDIPWRLKQMLDILVYEEQQQAAAGEAGPCLEYLLQHKILETLCTLGKAEYPPGMRQQVFQFFSKVLAQVQHPLLHYLSVHRPVQKLLRLGGTASGSVTEKEEVQFTTVLCSKIQQDPELLAYILEGKKIVGRKKACGEPTALPKDTTSHGDKDCSHDGAPARPQLDGESCGAQALNSHMPAETEELDGGTTESNLITSLLGLCQSKKSRVALKAQENLLLLVSMASPAAATYLVQSSACCPAIVRHLCQLYRSMPVFLDPADIATLEGISWRLPSAPSDEASFPGKEALAAFLGWFDYCDHLITEAHTVVADALAKAVAENFFVEAAVNCYRETARLLGGRARHCL

SEQ ID NO: 807632 - protein, 268 aa, Homo sapiens
KAPCGVFNSARPEPESYEDTLDLEEDPYFTDSFLDSGFQTPAKPRLAPATSYDGKTAVTEIVNSFLCLVPEEAKTSAFLEETGYDTYVHDAYGLFQECSSRVASWGWPLTPTPLDPHEPERPFFEGHFLRVLFDRMSRILDQPYSLNLQVTSVLSRLALFPHPHIHEYLLDPYISLAPGCRSLFSVLVRVIGDLMQRIQRVPQFPGKLLLVRKQLTGQAPGEQLDHQTLLQGVVVLEEFCKELAAIAFVKFPPHDPRQNVSPAPEGQV

SEQ ID NO: 807633 - protein, 759 aa, Homo sapiens; identical to SEQ ID NO: 807627

SEQ ID NO: 807634 - protein, 685 aa, Homo sapiens; identical to SEQ ID NO: 807622

SEQ ID NO: 807635 - protein, 820 aa, Homo sapiens
AAAAAFAREPGAGRHHAEPARGAAAGSRGGDNSRTLLGCRTPFPSPRDVGSAGPAGPSPHEGASPALTCCRPSWSTGRASRTTTSRAQVRPGPPQPRDPGGSGEEGVCRVSPFRCPGKDESTPAKKTDIPWRLKQMLDILVYEEQQQAAAGEAGPCLEYLLQHKILETLCTLGKAEYPPGMRQQVFQFFSKVLAQVQHPLLHYLSVHRPVQKLLRLGGTASGSVTEKEEVQFTTVLCSKIQQDPELLAYILEGKKIVGRKKACGEPTALPKDTTSHGDKDCSHDGAPARPQLDGESCGAQALNSHMPAETEELDGGTTESNLITSLLGLCQSKKSRVALKAQENLLLLVSMASPAAATYLVQSSACCPAIVRHLCQLYRSMPVFLDPADIATLEGISWRLPSAPSDEASFPGKEALAAFLGWFDYCDHLITEAHTVVADALAKAVAENFFVETLQPQLLHVSEQSILTSTALLTAMLRQLRSPALLREAVAFLLGTDRQPEAPGDNPHTLYAHLIGHCDHLSDEISITTLRLFEELLQKPHEGIIHSLVLRNLEGRPYVAWGSPEPESYEDTLDLEEDPYFTDSFLDSGFQTPAKPRLAPATSYDGKTAVTEIVNSFLCLVPEEAKTSAFLEETGYDTYVHDAYGLFQECSSRVASWGWPLTPTPLDPHEPERPFFEGHFLRVLFDRMSRILDQPYSLNLQVTSVLSRLALFPHPHIHEYLLDPYISLAPGCRSLFSVLVRVIGDLMQRIQRVPQFPGKLLLVRKQLTGQAPGEQLDHQTLLQGVVVLEEFCKELAAIAFVKFPPHDPRQNVSPAPEGQV

SEQ ID NO: 807636 - protein, 774 aa, Homo sapiens
MLSRLGALLQEAVGATTQDLVGVQDALPVTPGRGKCRPCRSKSPRRREPSIDLLQAFVEHWKGITHYYIESTDESTPAKKTDIPWRLKQMLDILVYEEQQQAAAGEAGPCLEYLLQHKILETLCTLGKAEYPPGMRQQVFQFFSKVLAQVQHPLLHYLSVHRPVQKLLRLGGTASGSVTEKEEVQFTTVLCSKIQQDPELLAYILEGKKIVGRKKACGEPTALPKDTTSHGDKDCSHDGAPARPQLDGESCGAQALNSHMPAETEELDGGTTESNLITSLLGLCQSKKSRVALKAQENLLLLVSMASPAAATYLVQSSACCPAIVRHLCQLYRSMPVFLDPADIATLEGISWRLPSAPSDEASFPGKEALAAFLGWFDYCDHLITEAHTVVADALAKAVAENFFVETLQPQLLHVSEQSILTSTALLTAMLRQLRSPALLREAVAFLLGTDRQPEAPGDNPHTLYAHLIGHCDHLSDEISITTLRLFEELLQKPHEGIIHSLVLRNLEGRPYVAWGSPEPESYEDTLDLEEDPYFTDSFLDSGFQTPAKPRLAPATSYDGKTAVTEIVNSFLCLVPEEAKTSAFLEETGYDTYVHDAYGLFQECSSRVASWGWPLTPTPLDPHEPERPFFEGHFLRVLFDRMSRILDQPYSLNLQVTSVLSRLALFPHPHIHEYLLDPYISLAPGCRSLFSVLVRVIGDLMQRIQRVPQFPGKLLLVRKQLTGQAPGEQLDHQTLLQGVVVLEEFCKELAAIAFVKFPPHDPRQNVSPAPEGQV

SEQ ID NO: 807637 - protein, 728 aa, Homo sapiens
ALPPPLSPGSRGPGAIMLSRLGALLQEAVGAREPSIDLLQAFVEHWKGITHYYIESTDESTPAKKTDIPWRLKQMLDILVYEEQQQAAAGEAGPCLEYLLQHKILETLCTLGKAEYPPGMRQQVFQFFSKVLAQVQHPLLHYLSVHRPVQKLLRLGGTASGSVTEKEEVQFTTVLCSKIQQDPELLAYILEGKKIVGRKKACGEPTALPKDTTSHGDKDCSHDGAPARPQLDGESCGAQALNSHMPAETEELDGGTTESNLITSLLGLCQSKKSRVALKAQENLLLLVSMASPAAATYLVQSSACCPAIVRHLCQLYRSMPVFLDPADIATLEGISWRLPSAPSDEASFPGKEALAAFLGWFDYCDHLITEAHTVVADALAKAVAENFFVETLQPQLLHVSEQSILTSTALLTAMLRQLRSPALLREAVAFLLGTDRQPEAPGDNPHTLYAHLIGHCDHLSDEISITTLRLFEELLQKPHEGIIHSLVLRNLEGRPYVAWGSPEPESYEDTLDLEEDPYFTDSFLDSGFQTPAKPRLAPATSYDGKTAVTEIVNSQECSSRVASWGWPLTPTPLDPHEPERPFFEGHFLRVLFDRMSRILDQPYSLNLQVTSVLSRLALFPHPHIHEYLLDPYISLAPGCRSLFSVLVRVIGDLMQRIQRVPQFPGKLLLVRKQLTGQAPGEQLDHQTLLQGVVVLEEFCKELAAIAFVKFPPHDPRQNVSPAPEGQV

SEQ ID NO: 807638 - protein, 759 aa, Homo sapiens; identical to SEQ ID NO: 807627

SEQ ID NO: 807639 - protein, 91 aa, Homo sapiens
RAVYEYPSCSDLCAFDTPDWVSGNGHARCQGAKQMAFQAARSLGPSWRSLGDSQVSTQTPDPHVLCAWPLLYWPFVARAKPVTQLQGQDGE

SEQ ID NO: 807640 - protein, 759 aa, Homo sapiens; identical to SEQ ID NO: 807627

SEQ ID NO: 807641 - protein, 131 aa, Homo sapiens
MLDILVYEEQQQAAAGEAGPCLEYLLQHKILETLCTLGKAEVGGPLRAGPGRGGRPLRAWPGRGGRPLCAGPGRGGRPSECWARLRWAVGSGQPGAPWIPGLSAYALPSPDTESGSSGERSKQDGHCGCLT

SEQ ID NO: 807642 - protein, 78 aa, Homo sapiens
LGTRRRDSYALLHREHRCGLALPSPGTLEGAGRKECAECHHSGVLGKVTCPVVQNWSRVHGDREPDRQKTQSPGPLHS

SEQ ID NO: 807643 - protein, 439 aa, Homo sapiens
MLTGVTDGIFCCLLGTPPNAVGPLESVESSDGYTFVEVKPGRVLRVKHAGPAPAAAPPPPSSASSDAAQGDLSGLVRCQRRITVYRNGRLLVENLGRAPRADLLHGQNGSGEPPAALEVELADPAGSDGRLAPGSAGSGSGSGSGGRRRRARRPKRTIHIDCEKRITSCKGAQADVVLFFIHGVGGSLAIWKEQLDFFVRLGYEVVAPDLAGHGASSAPQVAAAYTFYALAEDMRAIFKRYAKKRNVLIGHSYGVSFCTFLAHEYPDLVHKVIMINGGGPTALEPSFCSIFNMPTCVLHCLSPCLAWSFLKAGFARQGAKEKQLLKEGNAFNVSSFVLRAMMSGQYWPEGDEVYHAELTVPVLLVHGMHDKFVPVEEDQRMAEILLLAFLKLIDEGSHMVMLECPETVNTLLHEFLLWEPEPSPKALPEPLPAPPEDKK

SEQ ID NO: 807644 - protein, 439 aa, Homo sapiens; identical to SEQ ID NO: 807643

SEQ ID NO: 807645 - protein, 439 aa, Homo sapiens; identical to SEQ ID NO: 807643

SEQ ID NO: 807646 - protein, 439 aa, Homo sapiens; identical to SEQ ID NO: 807643

SEQ ID NO: 807647 - protein, 489 aa, Homo sapiens
MLTGVTDGIFCCLLGTPPNAVGPLESVESSDGYTFVEVKPGARRCLRGWKAIAPRGKPPVETAANGPPCDHLGPRPALPKEGTAFLPGPNKHRPITFPNSCESLGNASPRGGTRSSRGPFGGPRRCSGGRESPVYRNGRLLVENLGRAPRADLLHGQNGSGEPPAALEVELADPAGSDGRLAPGSAGSGSGSGSGGRRRRARRPKRTIHIDCEKRITSCKGAQADVVLFFIHGVGGSLAIWKEQLDFFVRLGYEVVAPDLAGHGASSAPQVAAAYTFYALAEDMRAIFKRYAKKRNVLIGHSYGVSFCTFLAHEYPDLVHKVIMINGGGPTALEPSFCSIFNMPTCVLHCLSPCLAWSFLKAGFARQGAKEKQLLKEGNAFNVSSFVLRAMMSGQYWPEGDEVYHAELTVPVLLVHGMHDKFVPVEEDQRMAEILLLAFLKLIDEGSHMVMLECPETVNTLLHEFLLWEPEPSPKALPEPLPAPPEDKK

SEQ ID NO: 807648 - protein, 225 aa, Homo sapiens
KGPAVSAAAGCPCADRQGQVPARVDAPGLTPRHHVNGASRRTLASPPGTPPPRLVHKVIMINGGGPTALEPSFCSIFNMPTCVLHCLSPCLAWSFLKAGFARQGAKEKQLLKEGNAFNVSSFVLRAMMSGQYWPEGDEVYHAELTVPVLLVHGMHDKFVPVEEDQRMAEILLLAFLKLIDEGSHMVMLECPETVNTLLHEFLLWEPEPSPKALPEPLPAPPEDKK

SEQ ID NO: 807649 - protein, 420 aa, Homo sapiens
ETSSSVHEQVADSGAQAVAFQSGGESSIVWNSQLKTLLAIGGWNFGTAPFTAMVSTPENRQTFITSVIKFLRQYEFDGLDFDWEYPGSRGSPPQDKHLFTVLVQEMREAFEQEAKQINKPRLMVTAAVAAGISNIQSGYEIPQLSQYLDYIHVMTYDLHGSWEGYTGENSPLYKYPTDTGSNAYLNVDYVMNYWKDNGAPAEKLIVGFPTYGHNFILSNPSNTGIGAPTSGAGPAGPYAKESGIWAYYEICTFLKNGATQGWDAPQEVPYAYQGNVWVGYDNVKSFDIKAQWLKHNKFGGAMVWAIDLDDFTGTFCNQGKFPLISTLKKALGLQSASCTAPAQPIEPITAAPSGSGNGSGSSSSGGSSGGSGFCAGRANGLYPVANNRNAFWHCVNGVTYQQNCQAGLVFDTSCDCCNWA

SEQ ID NO: 807650 - protein, 315 aa, Homo sapiens
MREAFEQEAKQINKPRLMVTAAVAAGISNIQSGYEIPQLSQYLDYIHVMTYDLHGSWEGYTGENSPLYKYPTDTGSNAYLNVDYVMNYWKDNGAPAEKLIVGFPTYGHNFILSNPSNTGIGAPTSGAGPAGPYAKESGIWAYYEICTFLKNGATQGWDAPQEVPYAYQGNVWVGYDNVKSFDIKAQWLKHNKFGGAMVWAIDLDDFTGTFCNQGKFPLISTLKKALGLQSASCTAPAQPIEPITAAPSGSGNGSGSSSSGGSSGGSGFCAGRANGLYPVANNRNAFWHCVNGVTYQQNCQAGLVFDTSCDCCNWA

SEQ ID NO: 807651 - protein, 476 aa, Homo sapiens
MTKLILLTGLVLILNLQLGSAYQLTCYFTNWAQYRPGLGRFMPDNIDPCLCTHLIYAFAGRQNNEITTIEWNDVTLYQAFNGLKNKNSQLKTLLAIGGWNFGTAPFTAMVSTPENRQTFITSVIKFLRQYEFDGLDFDWEYPGSRGSPPQDKHLFTVLVQEMREAFEQEAKQINKPRLMVTAAVAAGISNIQSGYEIPQLSQYLDYIHVMTYDLHGSWEGYTGENSPLYKYPTDTGSNAYLNVDYVMNYWKDNGAPAEKLIVGFPTYGHNFILSNPSNTGIGAPTSGAGPAGPYAKESGIWAYYEICTFLKNGATQGWDAPQEVPYAYQGNVWVGYDNVKSFDIKAQWLKHNKFGGAMVWAIDLDDFTGTFCNQGKFPLISTLKKALGLQSASCTAPAQPIEPITAAPSGSGNGSGSSSSGGSSGGSGFCAGRANGLYPVANNRNAFWHCVNGVTYQQNCQAGLVFDTSCDCCNWA

SEQ ID NO: 807652 - protein, 368 aa, Homo sapiens
MVSTPENRQTFITSVIKFLRQYEFDGLDFDWEYPGSRGSPPQDKHLFTVLVQEMREAFEQEAKQINKPRLMVTAAVAAGISNIQSGYEIPQLSQYLDYIHVMTYDLHGSWEGYTGENSPLYKYPTDTGSNAYLNVDYVMNYWKDNGAPAEKLIVGFPTYGHNFILSNPSNTGIGAPTSGAGPAGPYAKESGIWAYYEICTFLKNGATQGWDAPQEVPYAYQGNVWVGYDNVKSFDIKAQWLKHNKFGGAMVWAIDLDDFTGTFCNQGKFPLISTLKKALGLQSASCTAPAQPIEPITAAPSGSGNGSGSSSSGGSSGGSGFCAGRANGLYPVANNRNAFWHCVNGVTYQQNCQAGLVFDTSCDCCNWA

SEQ ID NO: 807653 - protein, 780 aa, Homo sapiens
MTAAAASNWGLITNIVNSIVGVSVLTMPFCFKQCGIVLGALLLVFCSWMTHQSCMFLVKSASLSKRRTYAGLAFHAYGKAGKMLVETSMIGLMLGTCIAFYVVIGDLGSNFFARLFGFQVGGTFRMFLLFAVSLCIVLPLSLQRNMMASIQSFSAMALLFYTVFMFVIVLSSLKHGLFSGQWLRRVSYVRWEGVFRCIPIFGMSFACQSQVLPTYDSLDEPSVKTMSSIFASSLNVVTTFYVMVGFFGYVSFTEATAGNVLMHFPSNLVTEMLRVGFMMSVAVGFPMMILPCRQALSTLLCEQQQKDGTFAAGGYMPPLRFKALTLSVVFGTMVGGILIPNVETILGLTGATMGSLICFICPALIYKKIHKNALSSQVVLWVGLGVLVVSTVTTLSVSEEVPEDLAEEAPGGRLGEAEGLMKVEAARLSAQDPVVAVAEDGREKPKLPKEREELEQAQIKGPVDVPGREDGKEAPEEAQLDRPGQGIAVPVGEAHRHEPPVPHDKVVVDEGQDREVPEENKPPSRHAGGKAPGVQGQMAPPLPDSEREKQEPEQGEVGKRPGQAQALEEAGDLPEDPQKVPEADGQPAVQPAKEDLGPGDRGLHPRPQAVLSEQQNGLAVGGGEKAKGGPPPGNAAGDTGQPAEDSDHGGKPPLPAEKPAPGPGLPPEPREQRDVERAGGNQAASQLEGKASALQPPASGPGSGSPLPQPWGDAQVILGSPARPPFSFQPPAEQTPRRAFCSLPISSLLSGNLLSALLPFKHLRHRHMACDYRFISLAPL

SEQ ID NO: 807654 - protein, 780 aa, Homo sapiens; identical to SEQ ID NO: 807653

SEQ ID NO: 807655 - protein, 678 aa, Homo sapiens
MTAAAASNWGLITNIVNSIVGVSVLTMPFCFKQCGIVLGALLLVFCSWMTHQSCMFLVKSASLSKRRTYAGLAFHAYGKAGKMLVETSMIGLMLGTCIAFYVVIGDLGSNFFARLFGFQVGGTFRMFLLFAVSLCIVLPLSLQRNMMASIQSFSAMALLFYTVFMFVIVLSSLKHGLFSGQWLRRVSYVRWEGVFRCIPIFGMSFACQSQVLPTYDSLDEPSVKTMSSIFASSLNVVTTFYVMVGFFGYVSFTEATAGNVLMHFPSNLVTEMLRVGFMMSVAVGFPMMILPCRQALSTLLCEQQQKDGTFAAGGYMPPLRFKALTLSVVFGTMVGGILIPNVETILGLTGATMGSLICFICPALIYKKIHKNALSSQVVLWVGLGVLVVSTVTTLSVSEEVPEDLAEEAPGGRLGEAEGLMKVEAARLSAQDPVVAVAEDGREKPKLPKEREELEQAQIKGPVDVPGREDGKEAPEEAQLDRPGQGIAVPVGEAHRHEPPVPHDKVVVDEGQDREVPEENKPPSRHAGGKAPGVQGQMAPPLPDSEREKQEPEQGEVGKRPGLPPEPREQRDVERAGGNQAASQLEGKASALQPPASGPGSGSPLPQPWGDAQVILGSPARPPFSFQPPAEQTPRRAFCSLPISSLLSGNLLSALLPFKHLRHRHMACDYRFISLAPL

SEQ ID NO: 807656 - protein, 760 aa, Homo sapiens
MTAAAASNWGLITNIVNSIVGVSVLTMPFCFKQCGIVLGALLLVFCSWMTHQSCMFLVKSASLSKRRTYAGLAFHAYGKAGKMLVETSMIGLMLGTCIAFYVVIGDLGSNFFARLFGFQVGGTFRMFLLFAVSLCIVLPLSLQRNMMASIQSFSAMALLFYTVFMFVIVLSSLKHGLFSGQWLRRVSYVRWEGVFRCIPIFGMSFACQSQVLPTYDSLDEPSVKTMSSIFASSLNVVTTFYVMVGFFGYVSFTEATAGNVLMHFPSNLVTEMLRVGFMMSVAVGFPMMILPCRQALSTLLCEQQQKDGTFAAGGYMPPLRFKALTLSVVFGTMVGGILIPNVETILGLTGATMGSLICFICPALIYKKIHKNALSSQVVLWVGLGVLVVSTVTTLSVSEEVPEDLAEEAPGGRLGEAEGLMKVEAARLSAQDPVVAVAEDGREKPKLPKEREELEQAQIKGPVDVPGREDGKEAPEEAQLDRPGQGIAVPVGEAHRHEPPVPHDKVVVDEGQDREVPEENKPPSRHAGGKAPGVQGQMAPPLPDSEREKQEPEQGEVGKRPGQAQALEEAGDLPEDPQKVPEADGQPAVQPAKEDLGPGDRGLHPRPQAVLSEQQNGLAVGGGEKAKGGPPPGNAAGDTGQPAEDSDHGGKPPLPAEKPAPGPGLPPEPREQRDVERAGGNQAASQLEGKASALQPPASGPGSGSPLPQPWGDAQVILGSPARPPFSFQPPAEQTPRRAFCSLPISSLLSGNRFISLAPL

SEQ ID NO: 807657 - protein, 378 aa, Homo sapiens
MTAAAASNWGLITNIVNSIVGVSVLTMPFCFKQCGIVLGALLLVFCSWMTHQSCMFLVKSASLSKRRTYAGLAFHAYGKAGKMLVETSMIGLMLGTCIAFYVVIGDLGSNFFARLFGFQVGGTFRMFLLFAVSLCIVLPLSLQRNMMASIQSFSAMALLFYTVFMFVIVLSSLKHGLFSGQWLRRVSYVRWEGVFRCIPIFGMSFACQSQVLPTYDSLDEPSVKTMSSIFASSLNVVTTFYVMVGFFGYVSFTEATAGNVLMHFPSNLVTEMLRVGFMMSVAVGFPMMILPCRQALSTLLCEQQQKDGTFAAGGYMPPLRFKALTLSVVFGTMVGGILIPNGKAGGLPCCRGVGPGASASTKTCTVTRPAQRPSSLVS

SEQ ID NO: 807658 - protein, 510 aa, Homo sapiens
MCLVCLAEPFQALLSRRVVEEISHFKTFCFSFVQQKDGTFAAGGYMPPLRFKALTLSVVFGTMVGGILIPNVETILGLTGATMGSLICFICPALIYKKIHKNALSSQVVLWVGLGVLVVSTVTTLSVSEEVPEDLAEEAPGGRLGEAEGLMKVEAARLSAQDPVVAVAEDGREKPKLPKEREELEQAQIKGPVDVPGREDGKEAPEEAQLDRPGQGIAVPVGEAHRHEPPVPHDKVVVDEGQDREVPEENKPPSRHAGGKAPGVQGQMAPPLPDSEREKQEPEQGEVGKRPGQAQALEEAGDLPEDPQKVPEADGQPAVQPAKEDLGPGDRGLHPRPQAVLSEQQNGLAVGGGEKAKGGPPPGNAAGDTGQPAEDSDHGGKPPLPAEKPAPGPGLPPEPREQRDVERAGGNQAASQLEGKASALQPPASGPGSGSPLPQPWGDAQVILGSPARPPFSFQPPAEQTPRRAFCSLPISSLLSGNLLSALLPFKHLRHRHMACDYRFISLAPL

SEQ ID NO: 807659 - protein, 143 aa, Homo sapiens
MTAAAASNWGLITNIVNSIVGVSVLTMPFCFKQCGIVLGALLLVFCSWMTHQSCMFLVKSASLSKRRTYAGLGPHKLPLLNSDQDSRPHRAGADLLSLCLSWTPDAFLRSCLQRALLFSPTRNSMEEAPQAWAVAGVQWLLSQ

SEQ ID NO: 807660 - protein, 780 aa, Homo sapiens; identical to SEQ ID NO: 807653

SEQ ID NO: 807661 - protein, 836 aa, Homo sapiens
MSPAPTGAPGTCVDSVSRWLVVAGSSHKAVDDRTGRRPEDLLRLARGRYVSTLLQLMTAAAASNWGLITNIVNSIVGVSVLTMPFCFKQCGIVLGALLLVFCSWMTHQSCMFLVKSASLSKRRTYAGLAFHAYGKAGKMLVETSMIGLMLGTCIAFYVVIGDLGSNFFARLFGFQVGGTFRMFLLFAVSLCIVLPLSLQRNMMASIQSFSAMALLFYTVFMFVIVLSSLKHGLFSGQWLRRVSYVRWEGVFRCIPIFGMSFACQSQVLPTYDSLDEPSVKTMSSIFASSLNVVTTFYVMVGFFGYVSFTEATAGNVLMHFPSNLVTEMLRVGFMMSVAVGFPMMILPCRQALSTLLCEQQQKDGTFAAGGYMPPLRFKALTLSVVFGTMVGGILIPNVETILGLTGATMGSLICFICPALIYKKIHKNALSSQVVLWVGLGVLVVSTVTTLSVSEEVPEDLAEEAPGGRLGEAEGLMKVEAARLSAQDPVVAVAEDGREKPKLPKEREELEQAQIKGPVDVPGREDGKEAPEEAQLDRPGQGIAVPVGEAHRHEPPVPHDKVVVDEGQDREVPEENKPPSRHAGGKAPGVQGQMAPPLPDSEREKQEPEQGEVGKRPGQAQALEEAGDLPEDPQKVPEADGQPAVQPAKEDLGPGDRGLHPRPQAVLSEQQNGLAVGGGEKAKGGPPPGNAAGDTGQPAEDSDHGGKPPLPAEKPAPGPGLPPEPREQRDVERAGGNQAASQLEGKASALQPPASGPGSGSPLPQPWGDAQVILGSPARPPFSFQPPAEQTPRRAFCSLPISSLLSGNLLSALLPFKHLRHRHMACDYRFISLAPL

SEQ ID NO: 807662 - protein, 743 aa, Homo sapiens
MTAAAASNWGLITNIVNSIVGVSVLTMPFCFKQCGIVLGALLLVFCSWMTHQSCMFLVKSASLSKRRTYAGLAFHAYGKAGKMLVETSMIGLMLGTCIAFYVVIGDLGSNFFARLFGFQVGGTFRMFLLFAVSLCIVLPLSLQRNMMASIQSFSAMALLFYTVFMFVIVLSSLKHGLFSGQWLRRVSYVRWEGVFRCIPIFGMSFACQSQVLPTYDSLDEPSVKTMSSIFASSLNVVTTFYVMVGFFGYVSFTEATAGNVLMHFPSNLVTEMLRVGFMMSVAVGFPMMILPCRQALSTLLCEQQWRPSWASQELTMGSLICFICPALIYKKIHKNALSSQVVLWVGLGVLVVSTVTTLSVSEEVPEDLAEEAPGGRLGEAEGLMKVEAARLSAQDPVVAVAEDGREKPKLPKEREELEQAQIKGPVDVPGREDGKEAPEEAQLDRPGQGIAVPVGEAHRHEPPVPHDKVVVDEGQDREVPEENKPPSRHAGGKAPGVQGQMAPPLPDSEREKQEPEQGEVGKRPGQAQALEEAGDLPEDPQKVPEADGQPAVQPAKEDLGPGDRGLHPRPQAVLSEQQNGLAVGGGEKAKGGPPPGNAAGDTGQPAEDSDHGGKPPLPAEKPAPGPGLPPEPREQRDVERAGGNQAASQLEGKASALQPPASGPGSGSPLPQPWGDAQVILGSPARPPFSFQPPAEQTPRRAFCSLPISSLLSGNLLSALLPFKHLRHRHMACDYRFISLAPL

SEQ ID NO: 807663 - protein, 616 aa, Homo sapiens
MTAAAASNWGLITNIVNSIVGVSVLTMPFCFKQCGIVLGALLLVFQVLPTYDSLDEPSVKTMSSIFASSLNVVTTFYVMVGFFGYVSFTEATAGNVLMHFPSNLVTEMLRVGFMMSVAVGFPMMILPCRQALSTLLCEQQQKDGTFAAGGYMPPLRFKALTLSVVFGTMVGGILIPNVETILGLTGATMGSLICFICPALIYKKIHKNALSSQVVLWVGLGVLVVSTVTTLSVSEEVPEDLAEEAPGGRLGEAEGLMKVEAARLSAQDPVVAVAEDGREKPKLPKEREELEQAQIKGPVDVPGREDGKEAPEEAQLDRPGQGIAVPVGEAHRHEPPVPHDKVVVDEGQDREVPEENKPPSRHAGGKAPGVQGQMAPPLPDSEREKQEPEQGEVGKRPGQAQALEEAGDLPEDPQKVPEADGQPAVQPAKEDLGPGDRGLHPRPQAVLSEQQNGLAVGGGEKAKGGPPPGNAAGDTGQPAEDSDHGGKPPLPAEKPAPGPGLPPEPREQRDVERAGGNQAASQLEGKASALQPPASGPGSGSPLPQPWGDAQVILGSPARPPFSFQPPAEQTPRRAFCSLPISSLLSGNLLSALLPFKHLRHRHMACDYRFISLAPL

SEQ ID NO: 807664 - protein, 108 aa, Homo sapiens
MCLVCLAEPFQALLSRRVVEEISHFKTFCFSFVQQKDGTFAAGGYMPPLRFKALTLSVVFGTMVGGILIPNGKAGGLPCCRGVGPGASASTKTCTVTRPAQRPSSLVS

SEQ ID NO: 807665 - protein, 472 aa, Homo sapiens [sequence omitted]

SEQ ID NO: 807666 - protein, 472 aa, Homo sapiens [sequence omitted]

SEQ ID NO: 807667 - protein, 312 aa, Homo sapiens
DSEDPQVSREREFVGTLYIQESGEEQEFAQDPRKVRDCRLSTQHEESADEQKGSEAEGLKGDIISVIIANKPEASLERQCVNLENEKGTKPPLQEAGSKKGRESVPTKPTPGERRYICAECGKAFSNSSNLTKHRRTHTGEKPYVCTKCGKAFSHSSNLTLHYRTHLVDRPYDCKCGKAFGQSSDLLKHQRMHTEEAPYQCKDCGKAFSGKGSLIRHYRIHTGEKPYQCNECGKSFSQHAGLSSHQRLHTGEKPYKCKECGKAFNHSSNFNKHHRIHTGEKPYWCHHCGKTFCSKSNLSKHQRVHTGEGEAP

SEQ ID NO: 807668 - protein, 385 aa, Homo sapiens
MTKVLGMAPVLGPRPPQEQVGPLMVKVEEKEEKGKYLPSLEMFRQRFRQFGYHDTPGPREALSQLRVLCCEWLRPEIHTKEQILELLVLEQFLTILPQELQAWVQEHCPESAEEAVTLLEDLERELDEPGHQVSTPPNEQKPVWEKISSSGTAKESPSSMQPQPLETSHKYESWGPLYIQESGEEQEFAQDPRKVRGEHTLGRNLTCAPSVGKLSATAQTSPSTTEHTWWTGPMTVSVEKLLGRAQTFLNIRECTQKRRHISAKIVARLSAGKAASFVTIGSTLGRSLISVTNVGRASVSMRASAPTRDSTPERSHISVRSVGKPSTTAPTSINTTESTPGKSPTGVITVERPSVASPIFPNISESTLEREKHRNFQALLLLSLF

SEQ ID NO: 807669 - protein, 472 aa, Homo sapiens [sequence omitted]

SEQ ID NO: 807670 - protein, 295 aa, Homo sapiens
METAAAVVKLERLEAALTRALRRLQPGSVAPGNGEEVISFATVTDSTSAYSSLLTFHLSTPRSHHLYHARLWLHVLPTLPGTLCLRIFRWGPRRRRQGSRTLLAEHHITNLGWHTLTLPSSGLRGEKSGVLKLQLDCRPLEGNSTVTGQPRRLLDTAGHQQPFLELKIRANEPGAGRARRRTPTCEPATPLCCRRDHYVDFQELGWRDWILQPEGYQLNYCSGQCPPHLAGSPGIAASFHSAVFSLLKANNPWPASTSCCVPTARRPLSLLYLDHNGNVVKTDVPDMVVEACGCS

SEQ ID NO: 807671 - protein, 350 aa, Homo sapiens
MRLPDVQLWLVLLWALVRAQGTGSVCPSCGGSKLAPQAERALVLELAKQQILDGLHLTSRPRITHPPPQAALTRALRRLQPGSVAPGNGEEVISFATVTDSTSAYSSLLTFHLSTPRSHHLYHARLWLHVLPTLPGTLCLRIFRWGPRRRRQGSRTLLAEHHITNLGWHTLTLPSSGLRGEKSGVLKLQLDCRPLEGNSTVTGQPRRLLDTAGHQQPFLELKIRANEPGAGRARRRTPTCEPATPLCCRRDHYVDFQELGWRDWILQPEGYQLNYCSGQCPPHLAGSPGIAASFHSAVFSLLKANNPWPASTSCCVPTARRPLSLLYLDHNGNVVKTDVPDMVVEACGCS

SEQ ID NO: 807672 - protein, 217 aa, Homo sapiens
PQVAATLNNLAVLYGKRGRYREAEPLCQRALEIREKVLGADHPDVAKQLNNLALLCQNQGKFEDVERHYARALSIYEALGGPHDPNVAKTKNNLASAYLKQNKYQQAEELYKEILHKEDLPAPLGAPNTGTAGDAEQALRRSSSLSKIRESIRRGSEKLVSRLRGEAAAGAAGMKRAMSLNTLNVDAPRAPGTQFPSWHLDKAPRTLSASTQDLSPH

SEQ ID NO: 807673 - protein, 445 aa, Homo sapiens
MMEESGIETTPPGTPPPNPAGLAATAMSSTPVPLAATSSFSSPNVSSMESFPPLAYSTPQPPLPPVRPSAPLPFVPPPAVPSVPPLVTSMPPPVSPSTAAAFGNPPVSHFPPSTSAPNTLLPAPPSGPPISGFSVGSTYDITRGHAGRAPQTPLMPSFSAPSGTGLLPTPITQQASLTSLAQGTGTTSAITFPEEQEDPRITRGQDEASAGGIWGFIKGVAGNPMVKSVLDKTKHSVESMITTLDPGMAPYIKSGGELDIVVTSNKEVKVAAVRDAFQEVFGLAVVVGEAGQSNIAPQPVGYAAGLKGAQERIDSLRRTGVIHEKQTAVSVENFIAELLPDKWFDIGCLVVEDPVHGIHLETFTQATPVPLEFVQQAQSLTPQDYNLRWSGLLVTVGEVLEKSLLNVSRTDWHMAFTGMSRRQMIYSAARAIAGMYKQRLPPRTV

SEQ ID NO: 807674 - protein, 445 aa, Homo sapiens; identical to SEQ ID NO: 807673

SEQ ID NO: 807675 - protein, 445 aa, Homo sapiens; identical to SEQ ID NO: 807673

SEQ ID NO: 807676 - protein, 445 aa, Homo sapiens; identical to SEQ ID NO: 807673

SEQ ID NO: 807677 - protein, 445 aa, Homo sapiens; identical to SEQ ID NO: 807673

SEQ ID NO: 807678 - protein, 662 aa, Homo sapiens
MLLCPAQKTVFRLQLTTAAQCLWVYLRDKQVVVFLAYPTRAPGRNNGVTSLHWPDPTLSLSWTQEAYTEYLRSIHYISQVLLEEVETTKEAGETVPPDTSKMLKLAQQCLERAQSTAAKLGKTRLKPTMPAAAPIPQPAGRHRRVYSDEGGKLSPFLPPEIFQKLQGAESQSCKKELTPLEEASLQNQKLKAAYEARMARLDPSQAMQKTSLTLSLQRQMMENLVIAKAREETLQRKMEERRLRLQEAANRRFCSQVALTPEEREQRALYAAILEYEQDHDWPKHWKAKLKRNPGDLSLVTSLVSHLLSLPDHPIAQLLRRLQCSVYSALYPAVSRAAAPAPGCCPPTPNPGSRRLRPSQSLHCMLSPPEPSAAPRPQDSPPTPPLQTRPVGSPSPLGDTASGLPDKDSSFEDLEQFLGTSERQGRGRGVQPEPQLQQLKTAVEEIHNAVDRLLSLTLLAFEGLNTAASKDRCLACIEEPFFSPLWPLLLALYRSVHRAREAALSRSMELYRNAPPTAIGIPTKLLPQNPEAKGATGYPYCAAAQELGLLVLESCPQKKLECIVRTLRIICVCAEDYCPTPEATPQAGPRPSLQLAIGADDLLPILSFVVLRSGLPQLVSECAALEEFIHEGYLIGEEGYCLTSLQSALSYVELLPRGGLAK

SEQ ID NO: 807679 - protein, 631 aa, Homo sapiens
MAAAAGDGTVKPLQSAMKLANGAIELDTGNRPREAYTEYLRSIHYISQVLLEEVETTKEAGETVPPDTSKMLKLAQQCLERAQSTAAKLGKTRLKPTMPAAAPIPQPAGRHRRVYSDEGGKLSPFLPPEIFQKLQGAESQSCKKELTPLEEASLQNQKLKAAYEARMARLDPSQAMQKTSLTLSLQRQMMENLVIAKAREETLQRKMEERRLRLQEAANRRFCSQVALTPEEREQRALYAAILEYEQDHDWPKHWKAKLKRNPGDLSLVTSLVSHLLSLPDHPIAQLLRRLQCSVYSALYPAVSRAAAPAPGCCPPTPNPGSRRLRPSQSLHCMLSPPEPSAAPRPQDSPPTPPLQTRPVGSPSPLGDTASGLPDKDSSFEDLEQFLGTSERQGRGRGVQPEPQLQQLKTAVEEIHNAVDRLLSLTLLAFEGLNTAASKDRCLACIEEPFFSPLWPLLLALYRSVHRAREAALSRSMELYRNAPPTAIGIPTKLLPQNPEAKGATGYPYCAAAQELGLLVLESCPQKKLECIVRTLRIICVCAEDYCPTPEATPQAGPRPSLQLAIGADDLLPILSFVVLRSGLPQLVSECAALEEFIHEGYLIGEEGYCLTSLQSALSYVELLPRGGLAK

SEQ ID NO: 807680 - protein, 830 aa, Homo sapiens
GVVWLRCGLSRGWRLRCCLCSVGVVVQLLRVGRASCCSWCCASVASSVCLTVSPSVAARGCGSLGRSPAPSAVSRALVLSPGVVRSGVGVGGFGGGVLCLPPAVDDVVVSVGLSPRGAARAAPRRRPAFPPPVSALPRGQWACLPFPLPHFISAVSNSGRADCDQPSCPSPRSWGNCAPRHLQDAETSTAVSGEGPVDGRQAWWVSCSRRLSWGIPQARISSVGCGPPLDPWFTHGWKTRLKPTMPAAAPIPQPAGRHRRVYSDEGGKLSPFLPPEIFQKLQGAESQSCKNSWPQSNPGEMRETPLVSRHHWASWGLDSSLSHFQRADATGGGLPGDSPSPRGGPWDVPASPGVGRGWEPRARSDPTLGPLTLHPAPEKDGGAPAAAPGGRQQVGLLPAPGAAAGRAWPRHPPRAFLPRRFCSQVALTPEEREQRALYAAILEYEQDHDWPKHWKAKLKRNPGDLSLVTSLVSHLLSLPDHPIAQLLRRLQCSVYSALYPAVSRAAAPAPGCCPPTPNPGSRRLRPSQSLHCMLSPPEPSAAPRPQDSPPTPPLQTRPVGSPSPLGDTASGLPDKDSSFEDLEQFLGTSERQGRGRGVQPEPQLQQLKTAVEEIHNAVDRLLSLTLLAFEGLNTAASKDRCLACIEEPFFSPLWPLLLALYRSVHRAREAALSRSMELYRNAPPTAIGIPTKLLPQNPEAKGATGYPYCAAAQELGLLVLESCPQKKLECIVRTLRIICVCAEDYCPTPEATPQAGPRPSLQLAIGADDLLPILSFVVLRSGLPQLVSECAALEEFIHEGYLIGEEGYCLTSLQSALSYVELLPRGGLAK

SEQ ID NO: 807681 - protein, 585 aa, Homo sapiens
MVAQRCSMPSYGKAGLWGHSRWEMGEAIPSARPCLCKTATSQRRKTRLKPTMPAAAPIPQPAGRHRRVYSDEGGKLSPFLPPEIFQKLQGAESQSCKKELTPLEEASLQNQKLKAAYEARMARLDPSQAMQKTSLTLSLQRQMMENLVIAKAREETLQRKMEERRLRLQEAANRRFCSQVALTPEEREQRALYAAILEYEQDHDWPKHWKAKLKRNPGDLSLVTSLVSHLLSLPDHPIAQLLRRLQCSVYSALYPAVSRAAAPAPGCCPPTPNPGSRRLRPSQSLHCMLSPPEPSAAPRPQDSPPTPPLQTRPVGSPSPLGDTASGLPDKDSSFEDLEQFLGTSERQGRGRGVQPEPQLQQLKTAVEEIHNAVDRLLSLTLLAFEGLNTAASKDRCLACIEEPFFSPLWPLLLALYRSVHRAREAALSRSMELYRNAPPTAIGIPTKLLPQNPEAKGATGYPYCAAAQELGLLVLESCPQKKLECIVRTLRIICVCAEDYCPTPEATPQAGPRPSLQLAIGADDLLPILSFVVLRSGLPQLVSECAALEEFIHEGYLIGEEGYCLTSLQSALSYVELLPRGGLAK

SEQ ID NO: 807682 - protein, 70 aa, Homo sapiens
MAAAAGDGTVKPLQSAMKLANGAIELDTGNRPRVRRGGGGAWPLRVAPGGTPARGGRGRGRLGLETWERA

SEQ ID NO: 807683 - protein, 465 aa, Homo sapiens
MARLDPSQAMQKTSLTLSLQRQMMENLVIAKAREETLQRKMEERRLRLQEAANRRFCSQVALTPEEREQRALYAAILEYEQDHDWPKHWKAKLKRNPGDLSLVTSLVSHLLSLPDHPIAQLLRRLQCSVYSALYPAVSRAAAPAPGCCPPTPNPGSRRLRPSQSLHCMLSPPEPSAAPRPQDSPPTPPLQTRPVGSPSPLGDTASGLPDKDSSFEDLEQFLGTSERQGRGRGVQPEPQLQQLKTAVEEIHNAVDRLLSLTLLAFEGLNTAASKDRCLACIEEPFFSPLWPLLLALYRSVHRAREAALSRSMELYRNAPPTAIGIPTKLLPQNPEAKGATGYPYCAAAQELGLLVLESCPQKKLECIVRTLRIICVCAEDYCPTPEATPQAGPRPSLQLAIGADDLLPILSFVVLRSGLPQLVSECAALEEFIHEGYLIGEEGYCLTSLQSALSYVELLPRGGLAK

SEQ ID NO: 807684 - protein, 465 aa, Homo sapiens; identical to SEQ ID NO: 807683

SEQ ID NO: 807685 - protein, 107 aa, Homo sapiens
MAGGYGVMGDDGSIDYTVHEAWNEATNVYLIVILVSFGLFMYAKRNKRRIMRIFSVPPTEETLSEPNFYDTISKIRLRQQLEMYSISRKYDYQQPQNQADSVQLSLE

SEQ ID NO: 807686 - protein, 107 aa, Homo sapiens; identical to SEQ ID NO: 807685

SEQ ID NO: 807687 - protein, 125 aa, Homo sapiens
VPPQARTAEQEAPGTRSPMAGGYGVMGDDGSIDYTVHEAWNEATNVYLIVILVSFGLFMYAKRNKRRIMRIFSVPPTEETLSEPNFYDTISKIRLRQQLEMYSISRKYDYQQPQNQADSVQLSLE

SEQ ID NO: 807688 - protein, 107 aa, Homo sapiens; identical to SEQ ID NO: 807685

SEQ ID NO: 807689 - protein, 104 aa, Homo sapiens
LSSYPRERVSHGYTVHEAWNEATNVYLIVILVSFGLFMYAKRNKRRIMRIFSVPPTEETLSEPNFYDTISKIRLRQQLEMYSISRKYDYQQPQNQADSVQLSLE

SEQ ID NO: 807690 - protein, 119 aa, Homo sapiens
PLFNHPFMPLLPMAGGYGVMGDDGSIDYTVHEAWNEATNVYLIVILVSFGLFMYAKRNKRRIMRIFSVPPTEETLSEPNFYDTISKIRLRQQLEMYSISRKYDYQQPQNQADSVQLSLE

SEQ ID NO: 807691 - protein, 70 aa, Homo sapiens
PWSLLTIHDDVSDRRYSEDEPGNFIVNKKPAGWVWWLTPVIPGLWEAKVGGSLGQEIETLLANTVKPRLY

SEQ ID NO: 807692 - protein, 125 aa, Homo sapiens; identical to SEQ ID NO: 807687

SEQ ID NO: 807693 - protein, 107 aa, Homo sapiens; identical to SEQ ID NO: 807685

SEQ ID NO: 807694 - protein, 137 aa, Homo sapiens
QEMTKAEGVQVRSVTVSRAPGPDSGVKSPGAEQRWPRAASGAGSVSGPASPLLPVPGGAASPGPAPRRPPRPGRGGKGGGRPPALGPVRSPKLRAPARSRRGAPRRRVELRVARFRKRTRASCGGPSAGAAGARREG

SEQ ID NO: 807695 - protein, 68 aa, Homo sapiens
QEMTKAEGVQVRSVTVSRAPGPDSGVKSPGAEQRWPRAASGAGSEQKENYEDIQCATYRGNFVRAQLL

SEQ ID NO: 807696 - protein, 107 aa, Homo sapiens; identical to SEQ ID NO: 807685

SEQ ID NO: 807697 - protein, 110 aa, Homo sapiens [sequence omitted]

SEQ ID NO: 807698 - protein, 106 aa, Homo sapiens
MLAVPVRLKVGSRKPEWGTNRLTSCPAKDPLDRRLQNLRDRERVPEPQRSLRPGVQEDSREHGQVPEVSDPQACGAGAGWRPGRLPGLSLAACLLLNQLGKLYLFP

SEQ ID NO: 807699 - protein, 88 aa, Homo sapiens
GLGCYRGSQRPPAPKGPWASEALIRAGLQDVSSPCPVEGRKPKTRVGDEQTYLLSRKRSTRSSSPKPERPRTGSRAAAFSQTWRSGRF

SEQ ID NO: 807700 - protein, 285 aa, Homo sapiens [sequence omitted]

SEQ ID NO: 807701 - protein, 285 aa, Homo sapiens [sequence omitted]

SEQ ID NO: 807702 - protein, 285 aa, Homo sapiens [sequence omitted]

SEQ ID NO: 807703 - protein, 330 aa, Homo sapiens
TTLLTGYGYEDPRGFNRRGLTRAAATAARGVTSSRRLLKDLEQKMMATPNQTACNAESPVALEEAKTSGAPGSPQTPPERHDSGGSLPLTPRMESHSEDEDLAGAVGGLGWNSRSPRTQSPGGCSAEAVLARKKHRRRPSKRKRHWRPYLELSWAEKQQRDERQSQRASRVREEMFAKGQPVAPYNTTQFLMNDRDPEEPNLDVPHGISHPGSSGESEAGDSDGRGRAHGEFQRKDFSETYERFHTESLQGRSKQELVRDYLELEKRLSQAEEETRRLQQLQACTGQQSCRQVEELAAEVQRLRTENQRLRQENQMWNREGCRCDEEPGT

SEQ ID NO: 807704 - protein, 285 aa, Homo sapiens [sequence omitted]

SEQ ID NO: 807705 - protein, 285 aa, Homo sapiens [sequence omitted]

SEQ ID NO: 807706 - protein, 285 aa, Homo sapiens [sequence omitted]

SEQ ID NO: 807707 - protein, 308 aa, Homo sapiens
LVLAGILGVTSSRRLLKDLEQKMMATPNQTACNAESPVALEEAKTSGAPGSPQTPPERHDSGGSLPLTPRMESHSEDEDLAGAVGGLGWNSRSPRTQSPGGCSAEAVLARKKHRRRPSKRKRHWRPYLELSWAEKQQRDERQSQRASRVREEMFAKGQPVAPYNTTQFLMNDRDPEEPNLDVPHGISHPGSSGESEAGDSDGRGRAHGEFQRKDFSETYERFHTESLQGRSKQELVRDYLELEKRLSQAEEETRRLQQLQACTGQQSCRQVEELAAEVQRLRTENQRLRQENQMWNREGCRCDEEPGT

SEQ ID NO: 807708 - protein, 524 aa, Homo sapiens
AQSLSHTHTHTHTHTHSLTLFCAVVKPTCPAGKLPERGTKEPGRGSGQAQQPTAVESGAQVRPHSRALRGPPNFLACRSGGFRAAQSLGLSSRAAQGHVAHAGRTLSRTRTLTETPALAGLSALPVSQLPVFAPLAAAAVAAEPLPPKELCLGATSGPGPVKCGGGGGGGGEGRGAPRFRCSAEELDYYLYGQQRMEIIPLNQHTSDPNNRCDMCADNRNGECPMHGPLHSLRRLVGTSSRCGRRAPAGAAGVAAGPASRGVPLHQYCARPGLRHLRGAEDPARHLDWTFPRRASAPREGAGRRREEHAASLGVNVPSTVMEAMCRQDALQPFNKSSKLAPTTQQRSVVFPQTPCSRNFSLLDKSGPIESGFNQINVKNQRVLASPTSTSQLHSEFSDWHLWKCGQCFKTFTQRILLQMHVCTQNPDRPYQCGHCSQSFSQPSELRNHVVTHSSDRPFKCGYCGRAFAGATTLNNHIRTHTGEKPFKCERCERSFTQATQLSRHQRMPNECKPITESPESIEVD

SEQ ID NO: 807709 - protein, 100 aa, Homo sapiens
MLKPGDPGGSAFLKVDPAYLQHWQQLFPHGGAGPLKGSGAAGLLSAPQPLQPPPPPPPPERAEPPPDSLRPRPASLSSASSTPASSSTSASSASSCAAAA

SEQ ID NO: 807710 - protein, 566 aa, Homo sapiens
AQSLSHTHTHTHTHTHSLTLFCAVVKPTCPAGKLPERGTKEPGRGSGQAQQPTAVESGAQVRPHSRALRGPPNFLACRSGGFRAAQSLGLSSRAAQGHVAHAGRTLSRTRTLTETPALAGLSALPVSQLPVFAPLAAAAVAAEPLPPKELCLGATSGPGPVKCGGGGGGGGEGRGAPRFRCSAEELDYYLYGQQRMEIIPLNQHTSDPNNRCDMCADNRNGECPMHGPLHSLRRLVGTSSAAAAAPPPELPEWLRDLPREVCLCTSTVPGLAYGICAAQRIQQGTWIGPFQGVLLPPEKVQAGAVRNTQHLWEIYDQDGTLQHFIDGGEPSKSSWMRYIRCARHCGEQNLTEFSTVNVPSTVMEAMCRQDALQPFNKSSKLAPTTQQRSVVFPQTPCSRNFSLLDKSGPIESGFNQINVKNQRVLASPTSTSQLHSEFSDWHLWKCGQCFKTFTQRILLQMHVCTQNPDRPYQCGHCSQSFSQPSELRNHVVTHSSDRPFKCGYCGRAFAGATTLNNHIRTHTGEKPFKCERCERSFTQATQLSRHQRMPNECKPITESPESIEVD

SEQ ID NO: 807711 - protein, 124 aa, Homo sapiens
ETPVLSWTLMGLFDSDVQVWNCQPFQMRPYQCGHCSQSFSQPSELRNHVVTHSSDRPFKCGYCGRAFAGATTLNNHIRTHTGEKPFKCERCERSFTQATQLSRHQRMPNECKPITESPESIEVD

SEQ ID NO: 807712 - protein, 405 aa, Homo sapiens
AQSLSHTHTHTHTHTHSLTLFCAVVKPTCPAGKLPERGTKEPGRGSGQAQQPTAVESGAQVRPHSRALRGPPNFLACRSGGFRAAQSLGLSSRAAQGHVAHAGRTLSRTRTLTETPALAGLSALPVSQLPVFAPLAAAAVAAEPLPPKELCLGATSGPGPVKCGGGGGGGGEGRGAPRFRCSAEELDYYLYGQQRMEIIPLNQHTSDPNNRCDMCADNRNGECPMHGPLHSLRRLVGTSSAAAAAPPPELPEWLRDLPREVCLCTSTVPGLAYGICAAQRIQQGTWIGPFQGVLLPPEKVQAGAVRNTQHLWEIYDQDGTLQHFIDGGEPSKSSWMRYIRCARHCGEQNLTVVQYSKCPFNGNGSHVQTRRPAALQQKQQTRPYHPAALRCFPPDSVQQELLSSG

SEQ ID NO: 807713 - protein, 111 aa, Homo sapiens
MFHGDPLYSPSFCCVSLAWPDTGCPSGDHGSRVRAFAESMLPSAPDASHFHVFHAHCSCTFYTVSSKQPGLDAGESGKGRKWFQFQNSKEKVEDLFCPVKIARTCKMYGAS

SEQ ID NO: 807714 - protein, 73 aa, Homo sapiens
LSHFTAREWRQPGWGGLKIWTQTVPLPTALPPLLPSRAGASGPCLGEMWTAPAARVRSHPERPPLNSHVSPFS

SEQ ID NO: 807715 - protein, 137 aa, Homo sapiens
PLPALPRQAGGSTQRRGPGSGQTWGKPVAAVPPGPRFPSSPAPVPAPPQAQSEAAPAGYGSRRAALQVHHDELWTVCWGSPTAALFRLPRRGADRAALVAAAAAVAAASAAPPGSPALGNRLHAGGPLPAPPPAPQG

SEQ ID NO: 807716 - protein, 194 aa, Homo sapiens
PLPALPRQAGGSTQRRGPGSGQTWGKPVAAVPPGPRFPSSPAPVPAPPQAQSEAAPAGYGSRRAALQVHHDELWTVCWGSPTAALFRLPRRGADRAALVAAAAAVAAASAAPPGSPALAQVVKGKRRSPFRSESGQYCPPRAGRKTGTPREPLPTKAQPPRHRWRPSTVCNTTTCCNRLLFTNFFFTYSQNSTN

SEQ ID NO: 807717 - protein, 114 aa, Homo sapiens
GPLGEDAVASVLDVNVVGTVRVLQDFLPDMKRPGSGRVLVTGSMGGLMGLPFNDVYCASKVRARRLMRESGGSAAALGGPVSQHPRLLNPQMGLGGLSSNNPLFKCSGYPQHKN

SEQ ID NO: 807718 - protein, 120 aa, Homo sapiens
GPLGEDAVASVLDVNVVGTVRVLQDFLPDMKRPGSGRVLVTGSMGGLMGLPFNDVYCASKVRARRLMRESGGSAAALGGPVSQHPRLLNPLNSDLEMPSTLSCGSRSGLCPAYICCVPGT

SEQ ID NO: 807719 - protein, 121 aa, Homo sapiens
LALATQILTGCDEVLEMLQQVTTALINSDIADREQRLKGLEQVTKATMLGHLLPVLLTSLMHPNLQTLIMADALMPQLVQLVLYTSQTALLLKTQCPVFAEVGCSPCGAPDQKCRLFPDER

SEQ ID NO: 807720 - protein, 165 aa, Homo sapiens
MNNRKEDMEITSHYRHLLRELNEQRQHGVLCDVCVVVEGKVFKAHKNVLLGSSRYFKTLYCQVQKTSEQATVTHLDIVTAQGFKAIIDFMYSAHLALTSRNVIEVMSAASFLQMTDIVQACHDFIKAALDISIKSDASDELAEFEIGASSSSSTEALISAVMAGR

SEQ ID NO: 807721 - protein, 98 aa, Homo sapiens
MSHGGPQIGLPSIAVSISNCSPHVTLWSTLDALMERSRMCWVQKAGQFLLTRDLKDIFSRSACVKVWSMGHLHQSHLSCVLKLQIPRSHPRLTESEYL

SEQ ID NO: 807722 - protein, 139 aa, Homo sapiens
MIFMGLKLGWEQMGHELGIWGWGESTPPRPGRLKGPLWHWAGAEASRKVTGVQDMMDQEEKTEEGSGPCAEAGSPDQEGFFNLLSHVQGDRMEGQRCSLQAGPGQTTKSLCERPRRERPHPRDGQPHGHAGQYPGPPHG

SEQ ID NO: 807723 - protein, 160 aa, Homo sapiens
MLANTEHTRNFRSCFCCVSCRLEGTAPAAPIQNEVSDLRCEAGSPDQEGFFNLLSHVQGDRMEGQRCSLQAGPGQTTKSQSDPTPEMDSLMDMLASTQGRRMDDQRVTVSSLPGFQPVGSKDGAQKRAGTLSPQPLLTPQDPTALGFRRNSSPQPPTQAP

SEQ ID NO: 807724 - protein, 135 aa, Homo sapiens
MDQEEKTEEGSGPCAEAGSPDQEGFFNLLSHVQGDRMEGQRCSLQAGPGQTTKSQSDPTPEMDSLMDMLASTQGRRMDDQRVTVSSLPGFQPVGSKDGAQKRAGTLSPQPLLTPQDPTALGFRRNSSPQPPTQAP

SEQ ID NO: 807725 - protein, 86 aa, Homo sapiens
ARSRWRCTPRRHAHRWEFRHTLPGLRAKQDRRAIIPPSSPGGSVPARYTAPTRCHRAATVWAWDLDPLAFCTSGFRGSSSSSSRLG

SEQ ID NO: 807726 - protein, 191 aa, Homo sapiens
MANNSPALTGNSQPQHQAAAAAAQQQQQCGGGGATKPAVSGKQGNVLPLWGNEKTMNLNPMILTNILSSPYFKVQLYELKTYHEVVDEIYFKVTHVEPWEKGSRKTAGQTGMCGGVRGVGTGGIVSTAFCLLYKLFTLKLTRKQVMGLITHTDSPYIRALGFMYIRYTQPPTDLWDWFESFLDDEEVCQQG

SEQ ID NO: 807727 - protein, 546 aa, Homo sapiens
MANNSPALTGNSQPQHQAAAAAAQQQQQCGGGGATKPAVSGKQGNVLPLWGNEKTMNLNPMILTNILSSPYFKVQLYELKTYHEVVDEIYFKVTHVEPWEKGSRKTAGQTGMCGGVRGVGTGGIVSTAFCLLYKLFTLKLTRKQVMGLITHTDSPYIRALGFMYIRYTQPPTDLWDWFESFLDDEEDLDVKAGGGCVMTIGEMLRSFLTKLEWFSTLFPRIPVPVQKNIDQQIKTRPRKIKKDGKEGAEEIDRHVERRRSRSPRRSLSPRRSPRRSRSRSHHREGHGSSSFDRELEREKERQRLEREAKEREKERRRSRSIDRGLERRRSRSRERHRSRSRSRDRKGDRRDRDREREKENERGRRRDRDYDKERGNEREKERERSRERSKEQRSRGEVEEKKHKEDKDDRRHRDDKRDSKKEKKHSRSRSRERKHRSRSRSRNAGKRSRSRSKEKSSKHKNESKEKSNKRSRSGSQGRTDSVEKSKKREHSPSKEKSRKRSRSKERSHKRDHSDSKDQSDKHDRRRSQSIEQESQEKQHKNKDETV

SEQ ID NO: 807728 - protein, 267 aa, Homo sapiens
WSSLGVELLGVQAMRLSVNKERQRLEREAKEREKERRRSRSIDRGLERRRSRSRERHRSRSRSRDRKGDRRDRDREREKENERGRRRDRDYDKERGNEREKERERSRERSKEQRSRGEVEEKKHKEDKDDRRHRDDKRDSKKEKKHSRSRSRERKHRSRSRSRNAGKRSRSRSKEKSSKHKNESKEKSNKRSRSGSQGRTDSVEKSKKREHSPSKEKSRKRSRSKERSHKRDHSDSKDQSDKHDRRRSQSIEQESQEKQHKNKDETV

SEQ ID NO: 807729 - protein, 522 aa, Homo sapiens
MANNSPALTGNSQPQHQAAAAAAQQQQQCGGGGATKPAVSGKQGNVLPLWGNEKTMNLNPMILTNILSSPYFKVQLYELKTYHEVVDEIYFKVTHVEPWEKGSRKTAGQTGMCGGVRGVGTGGIVSTAFCLLYKLFTLKLTRKQVMGLITHTDSPYIRALGFMYIRYTQPPTDLWDWFESFLDDEEDLDVKAGGGCVMTIGEMLRSFLTKLEWFSTLFPRIPVPVQKNIDQQIKTRPRKIKKDGKEGAEEIDRHVERRRSRSPRRSLSPRRSPRRSRSRSHHREGHGSSSFDRELEREKERQRLEREAKEREKERRRSRSIDRGLERRRSRSRERHRSRSRSRDRKGDRRDRDREREKENERGRRRDRDYDKERGNEREKERERSRERSKEQRSRGEVEEKKHKEDKDDRRHRDDKRDSKKEKKHSRSRSRERKHRSRSRSRNAGKRSRSRSKEKSSKMGRKVLEEIDRHVEQQTFKVSKEISESTEVPKKVKKRSHHREGHGSSSFDRELEREKEKKCRAA

SEQ ID NO: 807730 - protein, 113 aa, Homo sapiens
MANNSPALTGNSQPQHQAAAAAAQQQQQCGGGGATKPAVSGKQGNVLPLWGNEKTMNLNPMILTNILSSPYFKVQLYELKTYHEVVDEIYFKVTLREPWEKGSREMYSILPGI

SEQ ID NO: 807731 - protein, 349 aa, Homo sapiens
MTIGEMLRSFLTKLEWFSTLFPRIPVPVQKNIDQQIKTRPRKIKKDGKEGAEEIDRHVERRRSRSPRRSLSPRRSPRRSRSRSHHREGHGSSSFDRELEREKERQRLEREAKEREKERRRSRSIDRGLERRRSRSRERHRSRSRSRDRKGDRRDRDREREKENERGRRRDRDYDKERGNEREKERERSRERSKEQRSRGEVEEKKHKEDKDDRRHRDDKRDSKKEKKHSRSRSRERKHRSRSRSRNAGKRSRSRSKEKSSKHKNESKEKSNKRSRSGSQGRTDSVEKSKKREHSPSKEKSRKRSRSKERSHKRDHSDSKDQSDKHDRRRSQSIEQESQEKQHKNKDETV

SEQ ID NO: 807732 - protein, 122 aa, Homo sapiens [sequence omitted]

SEQ ID NO: 807733 - protein, 194 aa, Homo sapiens
YPPSHFQGDESGKTLGAGRTTPWDTSAEAVSWCRKDFGREQRRQKSGLWTSYLKALRSFSPTGYVRSFFSNSSSKRAGVQWCSHGSLQLGTPGLKPSSGLNLLSSWDYRDGDEGPQKRCLYTPNQAPVGATCPGLKSQPPDAASLCQFLYLLGWTLRASPRLGSRVGVGWGWCVREDLYVALIVGSVSSAWGMG

SEQ ID NO: 807734 - protein, 112 aa, Homo sapiens
GWHRAQVHSRWLSGGGRFSHIEFVLVVDFCPRPHQFIVFFTFDPRARTPALPCPTSPTQRSTDPARGRGPPHTLVPGLSGTGLPGSASEAQKGHKEGWKKRTKRNCSSHPLP

SEQ ID NO: 807735 - protein, 613 aa, Homo sapiens
ADARPRRAAWPAALASAAALAWPGGNVDIEQLDPRGRTPLHLATTLGHLECARVLLAHGADVGRENRSGWTGGQPCSPQPHSRGLPSIIDLWLAEGSCPVTLPRPPPVLQEAAQDFYVEMKWEFTSWVPLVSKICPSDTYKVWKSGQNLRVDTTLLGFDHMTWQRGNRSFVFRGQDTSAVVMEIDHDRRVVYTETLALAGQDRELLLAAAQPTEEQVLSRLTAPVVTTQLDTKNISFERNKTGILGWRSEKTEMVNGYEAKVYGASNVELITRTRTEHLSEQHKGKVKGCKTPLQSFLGIAEQHGGPQNGTLITQTLSQANPTAITAEEYFNPNFELGNRDMGRPMELTTKTQKFKAKLWLCEEHPLSLCEQVAPIIDLMAVSNALFAKLRDFITLRLPPGFPVKIEIPIFHILNARITFGNLNGCDEPVPSVRGSPSSETPSPGSDSSSVSSSSSTTSCRGCEISPALFEAPRGYSMMGGQREAATRDDDDDLLQFAIQQSLLEAGSEYDQVTIWEALTNSKPGTHPMSYEGRRQDRSAPPTPQRQPAPPASVPSPRPSSGPGSGGHVFRSYDEQLRLAMELSAQEQEERRRRARQEEEELERILRLSLTEQ

SEQ ID NO: 807736 - protein, 613 aa, Homo sapiens; identical to SEQ ID NO: 807735

SEQ ID NO: 807737 - protein, 552 aa, Homo sapiens
ARPDLRLLFCVSMVYTGQGGGFGGEAALSSVPSPVPGHTDPKPHALSWSRPCRPDQSKPPPTSLPPVPLVSKICPSDTYKVWKSGQNLRVDTTLLGFDHMTWQRGNRSFVFRGQDTSAVVMEIDHDRRVVYTETLALAGQDRELLLAAAQPTEEQVLSRLTAPVVTTQLDTKNISFERNKTGILGWRSEKTEMVNGYEAKVYGASNVELITRTRTEHLSEQHKGKVKGCKTPLQSFLGIAEQHGGPQNGTLITQTLSQANPTAITAEEYFNPNFELGNRDMGRPMELTTKTQKFKAKLWLCEEHPLSLCEQVAPIIDLMAVSNALFAKLRDFITLRLPPGFPVKIEIPIFHILNARITFGNLNGCDEPVPSVRGSPSSETPSPGSDSSSVSSSSSTTSCRGCEISPALFEAPRGYSMMGGQREAATRDDDDDLLQFAIQQSLLEAGSEYDQVTIWEALTNSKPGTHPMSYEGRRQDRSAPPTPQRQPAPPASVPSPRPSSGPGSGGHVFRSYDEQLRLAMELSAQEQEERRRRARQEEEELERILRLSLTEQ

SEQ ID NO: 807738 - protein, 106 aa, Homo sapiens
MVPRRVGSILGWGKHQTQVDWTQRARPGPGATPTPSHQLLLASVVVHPTCPHTETDSKTLHPMVLTPGSPLPHLTHPEKHRPRQGQGPTAHPCPGPVWDWPSRLSQ

SEQ ID NO: 807739 - protein, 244 aa, Homo sapiens
SSARYEAWVSLVIFACSQAQQLEWVKSRYPGLYSRIQEFACRGQFVPVGGTWVEMDGNLPSGEAMVRQFLQGQNFFLQEFGKMCSEFWLPDTFGYSAQLPQIMHGCGIRRFLTQKLSWNLVNSFPHHTFFWEGLDGSRVLVHFPPGDSYGMQGSVEEVLKTVANNRDKGRANHSAFLFGFGDGGGGPTQTMLDRLKRLSNTDGLPGCSYLLPRQLFSALGSDSRAVCPLVGGASWGWPWGFPLS

SEQ ID NO: 807740 - protein, 463 aa, Homo sapiens
YKIKQIIIILFQIALAQRGDLSDVEEEEEEEMDVDEATGAVKKLDGVGGSPPKSKLLFSNTAAQKLRGMDEVYNLFYVNNNWYIFMRLHQILCLRLLRICSQAERQIEEENREREWEREVLGIKRDKSDSPAIQLRLKEPMDVDVEDYYPAFLDMVRSLLDGNIDSSQYEDSLREMFTIHAYIAFTMDKLIQSIVRQLQHIVSDEICVQVTDLYLAENNNGATGGQLNTQNSRSLLESTYQRKAEQLMSDENCFKLMFIQSQGQVQLTIELLDTEEENSDDPVEAERWSDYVERYMNSDTTSPELREHLAQKPVFLPRNLRRIRKCQRGREQQEKEGKEGNSKKTMENVDSLDKLECRFKLNSYKMVYVIKSEDYMYRRTALLRAHQSHERVSKRLHQRFQAWVDKWTKEHVPREMAAETSKWLMGEGLEGLVPCTTTCDTETLHFVSINKYRVKYGTVFKAP

SEQ ID NO: 807741 - protein, 463 aa, Homo sapiens; identical to SEQ ID NO: 807740

SEQ ID NO: 807742 - protein, 463 aa, Homo sapiens; identical to SEQ ID NO: 807740

SEQ ID NO: 807743 - protein, 463 aa, Homo sapiens; identical to SEQ ID NO: 807740

SEQ ID NO: 807744 - protein, 1117 aa, Homo sapiens
MASRDSTVLYGEIHFSIGIVNAMTVLPPQTPEFLVMCKSQQYTFSKACNRVSRSNLGVKLYHPAHNTLISVRYENTYFRVVWLHVEANTTFRVHRQLEPEVSRLLLLRLGLQQLRLPPVLPNGLSLCLETFESSNRQISHFILRFSLRPTISDNIGEPQKQFLASNSAQSSDSSWASESRRCSKKSCPGLGGALWTPEPLVSCRGAERERQGPSGKRSESPAMAAAPALKHWRTTLERVEKFVSPLYFTDCNLRGRCGPWSPAAGRPQPCASSFPSGEKPKLQPPGPRDKVPAAGRAGAGEEGVGNGLCRGAARQPSWRRIQGKCGPTGQLAPRRKRGGLQHVPTGPSHAGFLGPAALWLCSPASCTPERLPYQEAVQRDFRPAQVGDSFGPTWWTCWFRVELTIPEAWVGQEVHLCWESDGEGLVWRDGEPVQGLTKEGEKTSYVLTDRLGERDPRRLECNGTISAHCDRRLPGSSNSPASASLLAEIYSLTLYVEVACNGLLGAGKGSMIAAPDPEKMFQLSRAELAVFHRDVHMLLVDLELLLGIAKGLGKDNQRSFQALYTANQMVNVCDPAQPETFPVAQALASRFFGQHGGESQHTIHATGHCHIDTAWLWPFKETVRKCARSWVTALQLMERNPEFIFACSQAQQLEWVKSRYPGLYSRIQEFACRGQFVPVGGTWVEMDGNLPSGEAMVRQFLQGQNFFLQEFGKMCSEFWAAGTFGTSDSPPDLAGVGLGVFTRMGGLGSLPADFFGRPVSGLATPATKHSTRAVRTANERGPGTYGGAQAAHTTLFLLCCYSLVASLITTRLNTRQRTVKHTKKKTPEATNYDNKTTNKHRQGDETRPTKTGQTGSEDSSARTEGDEAEGQRELTEEAREATGRARGETGGDARTAEKNTREKSGLTDKKQKGERRRKDSRVDRETKQNNRAPQTTEGEQETSNEGGDAEGGRGRQTQAGRSARREAREEPEESRGSERAKQESKAGQARDRARQGSKKRRATGRQRQSTEATAAKQSRRSETQGKETKREAEQRRQERAAGHWREERETGAEKEQRGRGEREERTDEAGPGRTRGNRQKGEQKSRDTRAEERSTQARERGERAENRRRQAREKQEE

SEQ ID NO: 807745 - protein, 463 aa, Homo sapiens; identical to SEQ ID NO: 807740

SEQ ID NO: 807746 - protein, 311 aa, Homo sapiens
YKIKQIIIILFQIALAQRGDLSDVEEEEEEEMDVDEATGAVKKLGGVGGSPPKSKLLFSNTAAQKLRGMDEVYNLFYVNNNWYIFMRLHQILCLRLLRICSQAERQIEEENREREWEREVLGIKRDKSDSPAIQLRLKEPMDVDVEDYYPAFLDMVRSLLDGNIDSSQYEDSLREMFTIHAYIAFTMDKLIQSIVRQLQHIVSDEICVQVTDLYLAENNNGATGGQLNTQNSRSLLESTYQRKAEQLMSDENCFKHSRGYDADKAADIIDGLRKNPSIAVPIVLKRLKMKEEEWREAQRGNKVWREQNEKY

SEQ ID NO: 807747 - protein, 463 aa, Homo sapiens; identical to SEQ ID NO: 807740

SEQ ID NO: 807748 - protein, 463 aa, Homo sapiens; identical to SEQ ID NO: 807740

SEQ ID NO: 807749 - protein, 463 aa, Homo sapiens; identical to SEQ ID NO: 807740

SEQ ID NO: 807750 - protein, 463 aa, Homo sapiens; identical to SEQ ID NO: 807740

SEQ ID NO: 807751 - protein, 963 aa, Homo sapiens
MRRASKTVSSFQLGSKFRQQLGFREPPVFQEKLPGTGRRPLDAGTFGFLPWSGTVAPGAFRKEERGPAMAAAPALKHWRTTLERVEKFVSPLYFTDCNLRGRCGPWSPAAGRPQPCASSFPSGEKPKLQPPGPRDKVPAAGRAGAGEEGVGNGLCRGAARQPSWRRIQGKCGPTGQLAPRRKRGGLQHVPTGPSHAGFLGPAALWLCSPASCTPERLPYQEAVQRDFRPAQVGDSFGPTWWTCWFRVELTIPEAWVGQEVHLCWESDGEGLVWRDGEPVQGLTKEGEKTSYVLTDRLGERDPRRLECNGTISAHCDRRLPGSSNSPASASLLAEIYSLTLYVEVACNGLLGAGKGSMIAAPDPEKMFQLSRAELAVFHRDVHMLLVDLELLLGIAKGLGKDNQRSFQALYTANQMVNVCDPAQPETFPVAQALASRFFGQHGGESQHTIHATGHCHIDTAWLWPFKETVRKCARSWVTALQLMERNPEFIFACSQAQQLEWVKSRYPGLYSRIQEFACRGQFVPVGGTWVEMDGNLPSGEAMVRQFLQGQNFFLQEFGKMCSEFWAAGTFGTSDSPPDLAGVGLGVFTRMGGLGSLPADFFGRPVSGLATPATKHSTRAVRTANERGPGTYGGAQAAHTTLFLLCCYSLVASLITTRLNTRQRTVKHTKKKTPEATNYDNKTTNKHRQGDETRPTKTGQTGSEDSSARTEGDEAEGQRELTEEAREATGRARGETGGDARTAEKNTREKSGLTDKKQKGERRRKDSRVDRETKQNNRAPQTTEGEQETSNEGGDAEGGRGRQTQAGRSARREAREEPEESRGSERAKQESKAGQARDRARQGSKKRRATGRQRQSTEATAAKQSRRSETQGKETKREAEQRRQERAAGHWREERETGAEKEQRGRGEREERTDEAGPGRTRGNRQKGEQKSRDTRAEERSTQARERGERAENRRRQAREKQEE

SEQ ID NO: 807752 - protein, 392 aa, Homo sapiens
YKIKQIIIILFQIALAQRGDLSDVEEEEEEEMDVDEATGAVKKLGGVGGSPPKSKLLFSNTAAQKLRGMDEVYNLFYVNNNWYIFMRLHQILCLRLLRICSQAERQIEEENREREWEREVLGIKRDKSDSPAIQLRLKEPMDVDVEDYYPAFLDMVRSLLDGNIDSSQYEDSLREMFTIHAYIAFTMDKLIQSIVRQLQHIVSDEICVQVTDLYLAENNNGATGGQLNTQNSRSLLESTYQRKAEQLMSDENCFKLMFIQSQGQVQLTIELLDTEEENSDDPVEAERWSDYVERYMNSDTTSPELREHLAQKPVFLPRNLRRIRKCQRGREQQEKEGKEGNSKKTMENVDSLDKLECRFKLNSYKMVYVIKSEDYMYRRTALLRAHQVRTSN

SEQ ID NO: 807753 - protein, 131 aa, Homo sapiens
MLRPATTTWAASRHTLMALAGASRWQCMVRPVSTLPPRAVVTRDIFSMAAQEWEVLCLPCSHCCFHSTMSASSLYPFVARKNKSDKRYRRIPRPGMRRADMPTYTAVWGPKNNSDTCFYNFFNIYFYKQVT

SEQ ID NO: 807754 - protein, 90 aa, Homo sapiens
MPNQGYQLGQRHKTFLNCSLTVGGLKSTDTSDTSFLTSASVAQTNFNYRWASKKLNTLWLKGHTQKLLHQGGLDRGLEISGLPEAGDCPE

SEQ ID NO: 807755 - protein, 792 aa, Homo sapiens
MAAINPWASWGALTDQSWGMTAVDPWASWALCPQYPAWHVEGSLEEGRRATGLPAAQVQEPVTFKDVAVDFTQEEWGQLDLVQRTLYRDVMLETYGHLLSVGNQIAKPEVISLLEQGEEPWSVEQACPQRTCPEWVRNLESKALIPAQSIFEEEQSHGMKLERYIWDDPWFSRLEVLGCKDQLEMYHMNQSTAMRQMVFMQKQVLSQRSSEFCGLGAEFSQNLNFVPSQRVSQIEHFYKPDTHAQSWRCDSAIMYADKVTCENNDYDKTVYQSIQPIYPARIQTGDNLFKCTDAVKSFNHIIHFGDHKGIHTGEKLYEYKECHQIFNQSPSFNEHPRLHVGENQYNYKEYENIFYFSSFMEHQKIGTVEKAYKYNEWEKVFGYDSFLTQHTSTYTAEKPYDCNECGTSFIWSSYLIQHKKTHTGEKPYECDKCGKVFRNRSAFTKHERTHTGIKPYECNKCGKAFSWNSHLIVHKRIHTGEKPYVCNECGKSFNWNSHLIGHQRTHTGEKPFECTECGKSFSWSSHLIAHMRMHTGEKPFKCDECEKAFRDYSALSKHERTHSGAKPYKCTECGKSFSWSSHLIAHQRTHTGEKPYNCQECGKAFRERSALTKHEIIHSGIKPYECNKCGKSCSQMAHLVRHQRTHTGEKPYECNKCGKSFSQSCHLVAHRRIHTGEKPYKCNQCERSFNCSSHLIAHRRTHTGEKPYRCNECGKAFNESSSLIVHLRNHTGEKPYKCNHCEKAFCKNSSLIIHQRMHSGEKRFICSECGKAFSGHSALLQHQRNHSEEKLN

SEQ ID NO: 807756 - protein, 998 aa, Homo sapiens
GKLTGCVAGNPCSHKAWPLERDLGTSPDVLSRRASQRRVARIRFLILKRITAVTFSQSCERQMEGSLESAENSPSSSRETRYHEAPFCGWANRGPRGRDLPRPFCSGRRRWRRVVWDRDNKVHPAAGFDAGARKVPTPPRQGEAARPRNLSWRRRCPTPEVPAWNYSSQQTPRRLRSTPGKQPPLSAAEVGICCVPGQVPGQSVLGMAAINPWASWGALTDQSWGMTAVDPWASWALCPQYPAWHVEGSLEEGRRATGLPAAQVQEPVTFKDVAVDFTQEEWGQLDLVQRTLYRDVMLETYGHLLSVGNQIAKPEVISLLEQGEEPWSVEQACPQRTCPEWVRNLESKALIPAQSIFEEEQSHGMKLERYIWDDPWFSRLEVLGCKDQLEMYHMNQSTAMRQMVFMQKQVLSQRSSEFCGLGAEFSQNLNFVPSQRVSQIEHFYKPDTHAQSWRCDSAIMYADKVTCENNDYDKTVYQSIQPIYPARIQTGDNLFKCTDAVKSFNHIIHFGDHKGIHTGEKLYEYKECHQIFNQSPSFNEHPRLHVGENQYNYKEYENIFYFSSFMEHQKIGTVEKAYKYNEWEKVFGYDSFLTQHTSTYTAEKPYDCNECGTSFIWSSYLIQHKKTHTGEKPYECDKCGKVFRNRSAFTKHERTHTGIKPYECNKCGKAFSWNSHLIVHKRIHTGEKPYVCNECGKSFNWNSHLIGHQRTHTGEKPFECTECGKSFSWSSHLIAHMRMHTGEKPFKCDECEKAFRDYSALSKHERTHSGAKPYKCTECGKSFSWSSHLIAHQRTHTGEKPYNCQECGKAFRERSALTKHEIIHSGIKPYECNKCGKSCSQMAHLVRHQRTHTGEKPYECNKCGKSFSQSCHLVAHRRIHTGEKPYKCNQCERSFNCSSHLIAHRRTHTGEKPYRCNECGKAFNESSSLIVHLRNHTGEKPYKCNHCEKAFCKNSSLIIHQRMHSGEKRFICSECGKAFSGHSALLQHQRNHSEEKLN

SEQ ID NO: 807757 - protein, 360 aa, Homo sapiens
MDSSNCKVIAPLLSQRYRRMVTKDGHSTLQMDGAQRGLAYLRDAWGILMDMRWRWMMLVFSASFVVHWLVFAVLWYVLAEMNGDLELDHDAPPENHTICVKYITSFTAAFSFSLETQLTIGYGTMFPSGDCPSAIALLAIQMLLGLMLEAFITGAFVAKIARPKNRAFSIRFTDTAVVAHMDGKPNLIFQVANTRPSPLTSVRVSAVLYQERENGKLYQTSVDFHLDGISSDECPFFIFPLTYYHSITPSSPLATLLQHENPSHFELVVFLSAMQEGTGEICQRRTSYLPSEIMLHHCFASLLTRGSKGEYQIKMENFDKTVPEFPTPLVSKSPNRTDLDIHINGQSIDNFQISETGLTE

SEQ ID NO: 807758 - protein, 360 aa, Homo sapiens; identical to SEQ ID NO: 807757

SEQ ID NO: 807759 - protein, 180 aa, Homo sapiens [sequence omitted]

SEQ ID NO: 807760 - protein, 360 aa, Homo sapiens; identical to SEQ ID NO: 807757

SEQ ID NO: 807761 - protein, 876 aa, Homo sapiens
MVTKDGHSTLQMDGAQRGLAYLRDAWGILMDMRWRWMMLVFSASFVVHWLVFAVLWYVLAEMNGDLELDHDAPPENHTICVKYITSFTAAFSFSLETQLTIGYGTMFPSGDCPSAIALLAIQMLLGLMLEAFITGAFVAKIARPKNRAFSIRFTDTAVVAHMDGKPNLIFQVANTRPSPLTSVRVSAVLYQERENGKLYQTSVDFHLDGISSDECPFFIFPLTYYHSITPSSPLATLLQHENPSHFELVVFLSAMQEGTGEICQRRTSYLPSEIMLHHCFASLLTRGSKGEYQIKMENFDKTVPEFPTPLVSKSPNRTDLDIHINGQSIDNFQISETGLTESRLIHFLMYEIHPASYAATFSLLYLMFSFFNANYSSLHHGNHAYAYIRMAELTIHILENITLYITKFVPAEINVTQLDRHLYRNVAGEFIRMWYDTSNEGKMDSEDLTQLNSKKINHESLIFICKLKQQFSFKPSSLGGMTTSLYLVNILLRAGIFFKTTKIIHLVLYTMKLEYSITSLIFNNYRTKINEKNNKVQIYTYNLKAFEHDTRTHTYMFTYLWQKVIREAPAQMEPVGWYFALQGDAKFYFKTVLHNNQTVIHLNDFSNLSKNIPPPMYDSFDHIKHHDGSEFINTKIYLSLYRYKALLRYNLSEKGKKSTVDKAKDNYGNKAFSNSNSCFQLQIVFSINTKSVFIHQEEVGLDELYYFFLNLIVYKNYVSSVFYFIYAKMSPFPYVQFKMIICMIFISIKKRETVLKTKQKPKKSPYQVSNRFVAVLFCNFPYSGFCGKNERLTFPTGDDLRQESSLEINTSRVKASRCEEQGSAASHIFLLFDQKEKKIKKNSGGGLRLIIAEEYQEHRNLIIVNFCCLKILDIHS

SEQ ID NO: 807762 - protein, 495 aa, Homo sapiens
MDIKNSPSSLNSPSSYNCSQSILPLEHGSIYIPSSYVDSHHEYPAMTFYSPAVMNYSIPSNVTNLEGGPGRQTTSPNVLWPTPGHLSPLVVHRQLSHLYAEPQKSPWCEARSLEHTLPVNRETLKRKVSGNRCASPVTGPGSKRDAHFCAVCSDYASGYHYGVWSCEGCKAFFKRSIQGHNDYICPATNQCTIDKNRRKSCQACRLRKCYEVGMVKCGSRRERCGYRLVRRQRSADEQLHCAGKAKRSGGHAPRVRELLLDALSPEQLVLTLLEAEPPHVLISRPSAPFTEASMMMSLTKLADKELVHMISWAKKIPGFVELSLFDQVRLLESCWMEVLMMGLMWRSIDHPGKLIFAPDLVLDRDEGKCVEGILEIFDMLLATTSRFRELKLQHKEYLCVKAMILLNSSMYPLVTATQDADSSRKLAHLLNAVTDALVWVIAKSGISSQQQSMRLANLLMLLSHVRHARAEKASQTLTSFGMKMETLLPEATMEQ

SEQ ID NO: 807763 - protein, 495 aa, Homo sapiens; identical to SEQ ID NO: 807762

SEQ ID NO: 807764 - protein, 323 aa, Homo sapiens
MDIKNSPSSLNSPSSYNCSQSILPLEHGSIYIPSSYVDSHHEYPAMTFYSPAVMNYSIPSNVTNLEGGPGRQTTSPNVLWPTPGHLSPLVVHRQLSHLYAEPQKSPWCEARSLEHTLPVNRETLKRKVSGNRCASPVTGPGSKRDAHFCAVCSDYASGYHYGVWSCEGCKAFFKRSIQGHNDYICPATNQCTIDKNRRKSCQACRLRKCYEVGMVKCGSRRERCGYRLVRRQRSADEQLHCAGKAKRSGGHAPRVRELLLDALSPEQLVLTLLEAEPPHVLISRPSAPFTEASMMMSLTKLADKELVHMISWAKKIPGMRGNA

SEQ ID NO: 807765 - protein, 394 aa, Homo sapiens
MTFYSPAVMNYSIPSNVTNLEGGPGRQTTSPNVLWPTPGHLSPLVVHRQLSHLYAEPQKSPWCEARSLEHTLPVNRETLKRKVSGNRCASPVTGPGSKRDAHFCAVCSDYASGYHYGVWSCEGCKAFFKRSIQGHNDYICPATNQCTIDKNRRKSCQACRLRKCYEVGMVKCGSRRERCGYRLVRRQRSADEQLHCAGKAKRSGGHAPRVRELLLDALSPEQLVLTLLEAEPPHVLISRPSAPFTEASMMMSLTKLADKELVHMISWAKKIPGMYPLVTATQDADSSRKLAHLLNAVTDALVWVIAKSGISSQQQSMRLANLLMLLSHVRHASNKGMEHLLNMKCKNVVPVYDLLLEMLNAHVLRGCKSSITGSECSPAEDSKSKEGSQNPQSQ

SEQ ID NO: 807766 - protein, 330 aa, Homo sapiens
MTFYSPAVMNYSIPSNVTNLEGGPGRQTTSPNVLWPTPGHLSPLVVHRQLSHLYAEPQKSPWCEARSLEHTLPVNRETLKRKVSGNRCASPVTGPGSKRDAHFCAVCSDYASGYHYGVWSCEGCKAFFKRSIQGHNDYICPATNQCTIDKNRRKSCQACRLRKCYEVGMVKCGSRRERCGYRLVRRQRSADEQLHCAGKAKRSGGHAPRVRELLLDALSPEQLVLTLLEAEPPHVLISRPSAPFTEASMMMSLTKLADKELVHMISWAKKIPGFVELSLFDQVRLLESCWMEVLMMGLMWRSIDHPGKLIFAPDLVLDRYVPSGHSDPGC

SEQ ID NO: 807767 - protein, 530 aa, Homo sapiens
MDIKNSPSSLNSPSSYNCSQSILPLEHGSIYIPSSYVDSHHEYPAMTFYSPAVMNYSIPSNVTNLEGGPGRQTTSPNVLWPTPGHLSPLVVHRQLSHLYAEPQKSPWCEARSLEHTLPVNRETLKRKVSGNRCASPVTGPGSKRDAHFCAVCSDYASGYHYGVWSCEGCKAFFKRSIQGHNDYICPATNQCTIDKNRRKSCQACRLRKCYEVGMVKCGSRRERCGYRLVRRQRSADEQLHCAGKAKRSGGHAPRVRELLLDALSPEQLVLTLLEAEPPHVLISRPSAPFTEASMMMSLTKLADKELVHMISWAKKIPGFVELSLFDQVRLLESCWMEVLMMGLMWRSIDHPGKLIFAPDLVLDRDEGKCVEGILEIFDMLLATTSRFRELKLQHKEYLCVKAMILLNSSMYPLVTATQDADSSRKLAHLLNAVTDALVWVIAKSGISSQQQSMRLANLLMLLSHVRHASNKGMEHLLNMKCKNVVPVYDLLLEMLNAHVLRGCKSSITGSECSPAEDSKSKEGSQNPQSQ

SEQ ID NO: 807768 - protein, 513 aa, Homo sapiens
MDIKNSPSSLNSPSSYNCSQSILPLEHGSIYIPSSYVDSHHEYPAMTFYSPAVMNYSIPSNVTNLEGGPGRQTTSPNVLWPTPGHLSPLVVHRQLSHLYAEPQKSPWCEARSLEHTLPVNRETLKRKVSGNRCASPVTGPGSKRDAHFCAVCSDYASGYHYGVWSCEGCKAFFKRSIQGHNDYICPATNQCTIDKNRRKSCQACRLRKCYEVGMVKCGSRRERCGYRLVRRQRSADEQLHCAGKAKRSGGHAPRVRELLLDALSPEQLVLTLLEAEPPHVLISRPSAPFTEASMMMSLTKLADKELVHMISWAKKIPGFVELSLFDQVRLLESCWMEVLMMGLMWRSIDHPGKLIFAPDLVLDRDEGKCVEGILEIFDMLLATTSRFRELKLQHKEYLCVKAMILLNSSMYPLVTATQDADSSRKLAHLLNAVTDALVWVIAKSGISSQQQSMRLANLLMLLSHVRHASSLSLSWRLFMLREASCHGVRQTPGGAHVSVSRSRSFEACQQPRE

SEQ ID NO: 807769 - protein, 485 aa, Homo sapiens
MTFYSPAVMNYSIPSNVTNLEGGPGRQTTSPNVLWPTPGHLSPLVVHRQLSHLYAEPQKSPWCEARSLEHTLPVNRETLKRKVSGNRCASPVTGPGSKRDAHFCAVCSDYASGYHYGVWSCEGCKAFFKRSIQGHNDYICPATNQCTIDKNRRKSCQACRLRKCYEVGMVKCGSRRERCGYRLVRRQRSADEQLHCAGKAKRSGGHAPRVRELLLDALSPEQLVLTLLEAEPPHVLISRPSAPFTEASMMMSLTKLADKELVHMISWAKKIPGFVELSLFDQVRLLESCWMEVLMMGLMWRSIDHPGKLIFAPDLVLDRDEGKCVEGILEIFDMLLATTSRFRELKLQHKEYLCVKAMILLNSSMYPLVTATQDADSSRKLAHLLNAVTDALVWVIAKSGISSQQQSMRLANLLMLLSHVRHASNKGMEHLLNMKCKNVVPVYDLLLEMLNAHVLRGCKSSITGSECSPAEDSKSKEGSQNPQSQ

SEQ ID NO: 807770 - protein, 330 aa, Homo sapiens; identical to SEQ ID NO: 807766

SEQ ID NO: 807771 - protein, 449 aa, Homo sapiens
VVGPHKRRTVKMAAGLRKRGRSGSAAQAEGLCKQWLQRAWQERRLLLREPRYTLLVAACLCLAEVGITFWVIHRVAYTEIDWKAYMAEVEGVINGTYDYTQLQGDTGPLVYPAGFVYIFMGLYYATSRGTDIRMAQNIFAVLYLATLLLVFLIYHQTCKVPPFVFFFMCCASYRVHSIFVLRLFNDPVAMVLLFLSINLLLAQRWGWGCCFFSLAVSVKMNVLLFAPGLLFLLLTQFGFRGALPKLGICAGLQVVLGLPFLLENPSGYLSRSFDLGRQFLFHWTVNWRFLPEALFLHRAFHLALLTAHLTLLLLFALCRWHRTGESILSLLRDPSKRKVPPQPLTPNQIVSTLFTSNFIGICFSRSLHYQFYVWYFHTLPYLLWAMPARWLTHLLRLLVLGLIELSWNTYPSTSCSSAALHICHAVILLQLWLGPQPFPKSTQHSKKAH

SEQ ID NO: 807772 - protein, 448 aa, Homo sapiens
SNLRLGSEAGCWAGLRKRGRSGSAAQAEGLCKQWLQRAWQERRLLLREPRYTLLVAACLCLAEVGITFWVIHRVAYTEIDWKAYMAEVEGVINGTYDYTQLQGDTGPLVYPAGFVYIFMGLYYATSRGTDIRMAQNIFAVLYLATLLLVFLIYHQTCKVPPFVFFFMCCASYRVHSIFVLRLFNDPVAMVLLFLSINLLLAQRWGWGCCFFSLAVSVKMNVLLFAPGLLFLLLTQFGFRGALPKLGICAGLQVVLGLPFLLENPSGYLSRSFDLGRQFLFHWTVNWRFLPEALFLHRAFHLALLTAHLTLLLLFALCRWHRTGESILSLLRDPSKRKVPPQPLTPNQIVSTLFTSNFIGICFSRSLHYQFYVWYFHTLPYLLWAMPARWLTHLLRLLVLGLIELSWNTYPSTSCSSAALHICHAVILLQLWLGPQPFPKSTQHSKKAH

SEQ ID NO: 807773 - protein, 449 aa, Homo sapiens; identical to SEQ ID NO: 807771

SEQ ID NO: 807774 - protein, 449 aa, Homo sapiens; identical to SEQ ID NO: 807771

SEQ ID NO: 807775 - protein, 449 aa, Homo sapiens; identical to SEQ ID NO: 807771

SEQ ID NO: 807776 - protein, 390 aa, Homo sapiens
MFPAQAKENAGFSGCGGDTEIDWKAYMAEVEGVINGTYDYTQLQGDTGPLVYPAGFVYIFMGLYYATSRGTDIRMAQNIFAVLYLATLLLVFLIYHQTCKVPPFVFFFMCCASYRVHSIFVLRLFNDPVAMVLLFLSINLLLAQRWGWGCCFFSLAVSVKMNVLLFAPGLLFLLLTQFGFRGALPKLGICAGLQVVLGLPFLLENPSGYLSRSFDLGRQFLFHWTVNWRFLPEALFLHRAFHLALLTAHLTLLLLFALCRWHRTGESILSLLRDPSKRKVPPQPLTPNQIVSTLFTSNFIGICFSRSLHYQFYVWYFHTLPYLLWAMPARWLTHLLRLLVLGLIELSWNTYPSTSCSSAALHICHAVILLQLWLGPQPFPKSTQHSKKAH

SEQ ID NO: 807777 - protein, 390 aa, Homo sapiens; identical to SEQ ID NO: 807776

SEQ ID NO: 807778 - protein, 415 aa, Homo sapiens
SNLRLGSEAGCWAGLRKRGRSGSAAQAEGLCKQWLQRAWQERRLLLREPRYTLLVAACLCLAEVGITFWVIHRVALYPAGFVYIFMGLYYATSRGTDIRMAQNIFAVLYLATLLLVFLIYHQTCKVPPFVFFFMCCASYRVHSIFVLRLFNDPVAMVLLFLSINLLLAQRWGWGCCFFSLAVSVKMNVLLFAPGLLFLLLTQFGFRGALPKLGICAGLQVVLGLPFLLENPSGYLSRSFDLGRQFLFHWTVNWRFLPEALFLHRAFHLALLTAHLTLLLLFALCRWHRTGESILSLLRDPSKRKVPPQPLTPNQIVSTLFTSNFIGICFSRSLHYQFYVWYFHTLPYLLWAMPARWLTHLLRLLVLGLIELSWNTYPSTSCSSAALHICHAVILLQLWLGPQPFPKSTQHSKKAH

SEQ ID NO: 807779 - protein, 606 aa, Homo sapiens
SNLRLGSEAGCWAGLRKRGRSGSAAQAEGLCKQWLQRAWQERRLLLREPRYTLLVAACLCLAEVGITFWVIHRVAYTEIDWKAYMAEVEGVINGTYDYTQLQGDTGPLVYPAGFVYIFMGLYYATSRGTDIRMAQNIFAVLYLATLLLVFLIYHQTCKVPPFVFFFMCCASYRVHSIFVLRLFNDPVAMVLLFLSINLLLAQRWGWGCCFFRSTPLPFWSPLVFCISISSQFPAAEGVKEEPRQHGSLRAPQSESRIYRKFLPCHPPTYTHALFPSCLPPRQHSLLELVLHILNTQYMLIRISRHRDYVSASCLLQALPSNSCECRSHLGVCWRGGGGEVAVVMVGGMSLGVVCMALELISTFLSPAHPSLAVSVKMNVLLFAPGLLFLLLTQFGFRGALPKLGICAGLQVVLGLPFLLENPSGYLSRSFDLGRQFLFHWTVNWRFLPEALFLHRAFHLALLTAHLTLLLLFALCRWHRTGESILSLLRDPSKRKVPPQPLTPNQIVSTLFTSNFIGICFSRSLHYQFYVWYFHTLPYLLWAMPARWLTHLLRLLVLGLIELSWNTYPSTSCSSAALHICHAVILLQLWLGPQPFPKSTQHSKKAH

SEQ ID NO: 807780 - protein, 245 aa, Homo sapiens
TEQAGRLSSLAVSVKMNVLLFAPGLLFLLLTQFGFRGALPKLGICAGLQVVLGLPFLLENPSGYLSRSFDLGRQFLFHWTVNWRFLPEALFLHRAFHLALLTAHLTLLLLFALCRWHRTGESILSLLRDPSKRKVPPQPLTPNQIVSTLFTSNFIGICFSRSLHYQFYVWYFHTLPYLLWAMPARWLTHLLRLLVLGLIELSWNTYPSTSCSSAALHICHAVILLQLWLGPQPFPKSTQHSKKAH

SEQ ID NO: 807781 - protein, 367 aa, Homo sapiens
SNLRLGSEAWVLGWAAETRPVRFRGPGRGTLQAMAAARLARAAPAAAGAALHAAGGRLPLPGGDTEIDWKAYMAEVEGVINGTYDYTQLQGDTGPLVYPAGFVYIFMGLYYATSRGTDIRMAQNIFAVLYLATLLLVFLIYHQTCKVPPFVFFFMCCASYRVHSIFVLRLFNDPVAMVLLFLSINLLLAQRWGWGCCFFSLAVSVKMNVLLFAPGLLFLLLTQFGFRGALPKLGICAGLRTGESILSLLRDPSKRKVPPQPLTPNQIVSTLFTSNFIGICFSRSLHYQFYVWYFHTLPYLLWAMPARWLTHLLRLLVLGLIELSWNTYPSTSCSSAALHICHAVILLQLWLGPQPFPKSTQHSKKAH

SEQ ID NO: 807782 - protein, 265 aa, Homo sapiens
SNLRLGSEAGCWAGLRKRGRSGSAAQAEGLCKQWLQRAWQERRLLLREPRYTLLVAACLCLAEVGITFWVIHRVAYTEIDWKAYMAEVEGVINGTYDYTQLQGDTGPLVYPAGFVYIFMGLYYATSRGTDIRMAQNIFAVLYLATLLLVFLIYHQTCKVPPFVFFFMCCASYRVHSIFVLRLFNDPVAMVLLFLSINLLLAQRWGWGCCFFRLLVLGLIELSWNTYPSTSCSSAALHICHAVILLQLWLGPQPFPKSTQHSKKAH

SEQ ID NO: 807783 - protein, 449 aa, Homo sapiens; identical to SEQ ID NO: 807771

SEQ ID NO: 807784 - protein, 449 aa, Homo sapiens; identical to SEQ ID NO: 807771

SEQ ID NO: 807785 - protein, 449 aa, Homo sapiens; identical to SEQ ID NO: 807771

SEQ ID NO: 807786 - protein, 449 aa, Homo sapiens; identical to SEQ ID NO: 807771

SEQ ID NO: 807787 - protein, 436 aa, Homo sapiens
SNLRLGSEAWVLGWAAETRPVRFRGPGRGTLQAMAAARLARAAPAAAGAALHAAGGRLPLPGGDTEIDWKAYMAEVEGVINGTYDYTQLQGDTGPLVYPAGFVYIFMGLYYATSRGTDIRMAQNIFAVLYLATLLLVFLIYHQTCKVPPFVFFFMCCASYRVHSIFVLRLFNDPVAMVLLFLSINLLLAQRWGWGCCFFSLAVSVKMNVLLFAPGLLFLLLTQFGFRGALPKLGICAGLQVVLGLPFLLENPSGYLSRSFDLGRQFLFHWTVNWRFLPEALFLHRAFHLALLTAHLTLLLLFALCRWHRTGESILSLLRDPSKRKVPPQPLTPNQIVSTLFTSNFIGICFSRSLHYQFYVWYFHTLPYLLWAMPARWLTHLLRLLVLGLIELSWNTYPSTSCSSAALHICHAVILLQLWLGPQPFPKSTQHSKKAH

SEQ ID NO: 807788 - protein, 386 aa, Homo sapiens
VVGPHKRRTVKMAAGLRKRGRSGSAAQAEGLCKQWLQRAWQERRLLLREPRYTLLVAACLCLAEVGITFWVIHRVAYTEIDWKAYMAEVEGVINGTYDYTQLQGDTGPLVYPAGFVYIFMGLYYATSRGTDIRMAQNIFAVLYLATLLLVFLIYHQTCKVPPFVFFFMCCASYRVHSIFVLRLFNDPVAMVLLFLSINLLLAQRWGWGCCFFSLAVSVKMNVLLFAPGLLFLLLTQFGFRGALPKLGICAGLQVVLGLPFLLENPSGYLSRSFDLGRQFLFHWTVNWRFLPEALFLHRAFHLALLTAHLTLLLLFALCRWHRTGESILSLLRDPSKRKVPPQPLTPNQIVSTLFTILLLLLFLSTIETVLLAGLLAQGNLGPRATD

SEQ ID NO: 807789 - protein, 403 aa, Homo sapiens
SNLRLGSEAWVLGWAAETRPVRFRGPGRGTLQAMAAARLARAAPAAAGAALHAAGGRLPLPGGVYPAGFVYIFMGLYYATSRGTDIRMAQNIFAVLYLATLLLVFLIYHQTCKVPPFVFFFMCCASYRVHSIFVLRLFNDPVAMVLLFLSINLLLAQRWGWGCCFFSLAVSVKMNVLLFAPGLLFLLLTQFGFRGALPKLGICAGLQVVLGLPFLLENPSGYLSRSFDLGRQFLFHWTVNWRFLPEALFLHRAFHLALLTAHLTLLLLFALCRWHRTGESILSLLRDPSKRKVPPQPLTPNQIVSTLFTSNFIGICFSRSLHYQFYVWYFHTLPYLLWAMPARWLTHLLRLLVLGLIELSWNTYPSTSCSSAALHICHAVILLQLWLGPQPFPKSTQHSKKAH

SEQ ID NO: 807790 - protein, 594 aa, Homo sapiens
SNLRLGSEAWVLGWAAETRPVRFRGPGRGTLQAMAAARLARAAPAAAGAALHAAGGRLPLPGGDTEIDWKAYMAEVEGVINGTYDYTQLQGDTGPLVYPAGFVYIFMGLYYATSRGTDIRMAQNIFAVLYLATLLLVFLIYHQTCKVPPFVFFFMCCASYRVHSIFVLRLFNDPVAMVLLFLSINLLLAQRWGWGCCFFRSTPLPFWSPLVFCISISSQFPAAEGVKEYQDSMGHSGLHKASPGSIESFCPAIPQIHTCPLSILSSSQTAFLVGISPSHSKYSVYAHSHLVGIETMYLPPAYSRLFPPTVVSVGPILEFVGVAAGGGCCGDGGGYVFGCCVHGPGAESPPFLSPAHPSLAVSVKMNVLLFAPGLLFLLLTQFGFRGALPKLGICAGLQVVLGLPFLLENPSGYLSRSFDLGRQFLFHWTVNWRFLPEALFLHRAFHLALLTAHLTLLLLFALCRWHRTGESILSLLRDPSKRKVPPQPLTPNQIVSTLFTSNFIGICFSRSLHYQFYVWYFHTLPYLLWAMPARWLTHLLRLLVLGLIELSWNTYPSTSCSSAALHICHAVILLQLWLGPQPFPKSTQHSKKAH

SEQ ID NO: 807791 - protein, 655 aa, Homo sapiens
SNLRLGSEAGCWAGLRKRGRSGSAAQAEGLCKQWLQRAWQERRLLLREPRYTLLVAACLCLAEVGITFWVIHRVAYTEIDWKAYMAEVEGVINGTYDYTQLQGDTGPLVYPAGFVYIFMGLYYATSRGTDIRMAQNIFAVLYLATLLLVFLIYHQTCKVPPFVFFFMCCASYRVHSIFVLRLFNDPVAMVLLFLSINLLLAQRWGWGCCFFLEHIPFHILQLCCPAHMPCRHPAAALAGPAAFPQEHPTQQESPLKSTPFPQDLSLPSGPGVGWTLPFQINLAKSKKKKKKKKKKKKKKKKKKREGRARARDAEQRNNIKERERENERGESRGAKERGRDLTQAGTRRDEEDGDARTDDAEEKRGSARAHIAEKRRRDRKEETEGERKTEAGGGGKKNGGRARKQRGGAPNGGRDTPHKKRGGETAARARRGEEDKNKKHREERRGVRTTRSAGNASEARPPTSERRQTMQGTTQAKRGEEEKTAGKTPGRRSTPTGRRERKRKRTKARDRRDTDNKVGRGGTPRAKTLGAPHQRGEHRTKRTDEGTTERGHNKGGGRKRRRKKPTTEEGGGGRGRSRRAGGGKKKRGARRRGATQHKGQRNNEERSRDPQKEEERTPPNTKRTTRKPKQNSATPTTPPTPKNAEGERNAAAARE

SEQ ID NO: 807792 - protein, 79 aa, Homo sapiens
SNLRLGSEAWVLGWAAETRPVRFRGPGRGTLQAMAAARLARAAPAAAGAALHAAGGRLPLPGGGGHHLLGHSQGGIHRD

SEQ ID NO: 807793 - protein, 127 aa, Homo sapiens
MTTNLDLKVSMLSFISATCLLLCLNLFVAQVHWHTRDAMESDLLWTYYLNWCSDIFYMFAGIISLLNYLTSRSPACDENVTVIPTERSRLGVGPVTTVSPAKDEGPRSEMESLSVREKNLPKSGLWW

SEQ ID NO: 807794 - protein, 68 aa, Homo sapiens
VRELTAKMERREHLTLTFHSPEVPKIKGNRKYQRIISNIPGPSFSSLSLPYLLALAGSSALGSLIEEA

SEQ ID NO: 807795 - protein, 104 aa, Homo sapiens
MSALQESRRELMVQLEELMKLLKAQATGSPHTSPTHGGGRPMPMPVRSTSAGSTPTHCPQDSLSGVGGDVQEAFAQAEEGAEEEEEKMQNGKDRGKGSSAGLLV

SEQ ID NO: 807796 - protein, 623 aa, Homo sapiens
MIEESGNKRKTMAEKRQLFIEMRAQNFDVIRLSTYRTACKLRFVQKRCNLHLVDIWNMIEAFRDNGLNTLDHTTEISVSRLETVISSIYYQLNKRLPSTHQISVEQSISLLLNFMIAAYDSEGRGKLTVFSVKAMLATMCGGKMLDKLRYVFSQMSDSNGLMIFSKFDQFLKEVLKLPTAVFEGPSFGYTEHSVRTCFPQQRKIMLNMFLDTMMADPPPQCLVWLPLMHRLAHVENVFHPVECSYCRCESMMGFRYRCQQCHNYQLCQNCFWRGHAGGPHSNQHQMKEHSSWKSPAKKLSHAISKSLGCVPTREPPHPVFPEQPEKPLDLAHIVPPRPLTNMNDTMVSHMSSGVPTPTKRLQYSQDIPSHLADEHALIASYVARLQHCARVLDSPSRLDEEHRLIARYAARLAAEAGNVTRPPTDLSFNFDANKQQRQLIAELENKNREILQEIQRLRLEHEQASQPTPEKAQQNPTLLAELRLLRQRKDELEQRMSALQESRRELMVQLEELMKLLKERQAQATGSPHTSPTHGGGRPMPMPVRSTSAGSTPTHCPQDSLSGVGGDVQEAFAQGTRRNLRNDLLVAADSITNTMSSLVKELHSAEEGAEEEEEKMQNGKDRG

SEQ ID NO: 807797 - protein, 531 aa, Homo sapiens
MIEESGNKRKTMAEKRQLFIEMRAQNFDVIRLSTYRTACKLRFVQKRCNLHLVDIWNMIEAFRDNGLNTLDHTTEISVSRLETVISSIYYQLNKRLPSTHQISVEQSISLLLNFMIAAYDSEGRGKLTVFSVKAMLATMCGGKMLDKLRYVFSQMSDSNGLMIFSKFDQFLKEVLKLPTAVFEGPSFGYTEHSVRTCFPQQRKIMLNMFLDTMMADPPPQCLVWLPLMHRLAHVENVFHPVECSYCRCESMMGFRYRCQQCHNYQLCQNCFWRGHAGGPHSNQHQMKEHSSWKSPAKKLSHAISKSLGCVPTREPPHPVFPEQPEKPLDLAHIVPPRPLTNMNDTMVSHMSSGVPTPTKSVLDSPSRLDEEHRLIARYAARLAAEAGNVTRPPTDLSFNFDANKQQRQLIAELENKNREILQEIQRLRLEHEQASQPTPEKAQQNPTLLAELRLLRQRKDELEQRMSALQESRRELMVQLEELMKLLKERSRLRPQGHHIHRPPMEAAGQCPCQCAPRLPAPPPPTVRRTR

SEQ ID NO: 807798 - protein, 493 aa, Homo sapiens
ALIHWTIVSEGFNHVPDINMIEAFRDNGLNTLDHTTEISVSRLETVISSIYYQLNKRLPSTHQISVEQSISLLLNFMIAAYDSEGRGKLTVFSVKAMLATMCGGKMLDKLRYVFSQMSDSNGLMIFSKFDQFLKEVLKLPTAVFEGPSFGYTEHSVRTCFPQQRKIMLNMFLDTMMADPPPQCLVWLPLMHRLAHVENVFHPVECSYCRCESMMGFRYRCQQCHNYQLCQNCFWRGHAGGPHSNQHQMKEHSSWKSPAKKLSHAISKSLGCVPTREPPHPVFPEQPEKPLDLAHIVPPRPLTNMNDTMVSHMSSGVPTPTKSVLDSPSRLDEEHRLIARYAARLAAEAGNVTRPPTDLSFNFDANKQQRQLIAELENKNREILQEIQRLRLEHEQASQPTPEKAQQNPTLLAELRLLRQRKDELEQRMSALQESRRELMVQLEELMKLLKERSRLRPQGHHIHRPPMEAAGQCPCQCAPRLPAPPPPTVRRTR

SEQ ID NO: 807799 - protein, 327 aa, Homo sapiens
MLNMFLDTMMADPPPQCLVWLPLMHRLAHVENVFHPVECSYCRCESMMGFRYRCQQCHNYQLCQNCFWRGHAGGPHSNQHQMKEHSSWKSPAKKLSHAISKSLGCVPTREPPHPVFPEQPEKPLDLAHIVPPRPLTNMNDTMVSHMSSGVPTPTKSVLDSPSRLDEEHRLIARYAARLAAEAGNVTRPPTDLSFNFDANKQQRQLIAELENKNREILQEIQRLRLEHEQASQPTPEKAQQNPTLLAELRLLRQRKDELEQRMSALQESRRELMVQLEELMKLLKERSRLRPQGHHIHRPPMEAAGQCPCQCAPRLPAPPPPTVRRTR

SEQ ID NO: 807800 - protein, 280 aa, Homo sapiens
MGFRYRCQQCHNYQLCQNCFWRGHAGGPHSNQHQMKEHSSWKSPAKKLSHAISKSLGCVPTREPPHPVFPEQPEKPLDLAHIVPPRPLTNMNDTMVSHMSSGVPTPTKSVLDSPSRLDEEHRLIARYAARLAAEAGNVTRPPTDLSFNFDANKQQRQLIAELENKNREILQEIQRLRLEHEQASQPTPEKAQQNPTLLAELRLLRQRKDELEQRMSALQESRRELMVQLEELMKLLKERSRLRPQGHHIHRPPMEAAGQCPCQCAPRLPAPPPPTVRRTR

SEQ ID NO: 807801 - protein, 666 aa, Homo sapiens
MIEESGNKRKTMAEKRQLFIEMRAQNFDVIRLSTYRTACKLRFVQKRCNLHLVDIWNMIEAFRDNGLNTLDHTTEISVSRLETVISSIYYQLNKRLPSTHQISVEQSISLLLNFMIAAYDSEGRGKLTVFSVKAMLATMCGGKMLDKLRYVFSQMSDSNGLMIFSKFDQFLKEVLKLPTAVFEGPSFGYTEHSVRTCFPQQRKIMLNMFLDTMMADPPPQCLVWLPLMHRLAHVENVFHPVECSYCRCESMMGFRYRCQQCHNYQLCQNCFWRGHAGGPHSNQHQMKEHSSWKSPAKKLSHAISKSLGCVPTREPPHPVFPEQPEKPLDLAHIVPPRPLTNMNDTMVSHMSSGVPTPTKRLQYSQDIPSHLADEHALIASYVARLQHCARVLDSPSRLDEEHRLIARYAARLAAEAGNVTRPPTDLSFNFDANKQQRQLIAELENKNREILQEIQRLRLEHEQASQPTPEKAQQNPTLLAELRLLRQRKDELEQRMSALQESRRELMVQLEELMKLLKERQAQATGSPHTSPTHGGGRPMPMPVRSTSAGSTPTHCPQDSLSGVGGDVQEAFAQGTRRNLRNDLLVAADSITNTMSSFHRTPGPGLQAARRHSTRQGEGSQSRWEAGRGCVAQLVGLPLHSPACTSTFITPLRAWSHLRIRNSPGG

SEQ ID NO: 807802 - protein, 456 aa, Homo sapiens
MIEESGNKRKTMAEKRQLFIEMRAQNFDVIRLSTYRTACKLRFVQKRCNLHLVDIWNMIEAFRDNGLNTLDHTTEISVSRLETVISSIYYQLNKRLPSTHQISVEQSISLLLNFMIAAYDSEGRGKLTVFSVKAMLATMCGGKMLDKLRYVFSQMSDSNGLMIFSKFDQFLKEVLKLPTAVFEGPSFGYTEHSVRTCFPQQRKIMLNMFLDTMMADPPPQCLVWLPLMHRLAHVENVFHPVECSYCRCESMMGFRYRCQQCHNYQLCQNCFWRGHAGGPHSNQHQMKEHSSWKSPAKKLSHAISKSLGCVPTREPPHPVFPEQPEKPLDLAHIVPPRPLTNMNDTMVSHMSSGVPTPTKSVLDSPSRLDEEHRLIARYAARLAAEAGNVTRPPTDLSFNFDANKQQRQLIAELENKNREILQEIQRLRLEHEQASQPTPEKAQQNPTLLAELRLLR

SEQ ID NO: 807803 - protein, 318 aa, Homo sapiens
MIEESGNKRKTMAEKRQLFIEMRAQNFDVIRLSTYRTACKLRFVQKRCNLHLVDIWNMIEAFRDNGLNTLDHTTEISVSRLETVISSIYYQLNKRLPSTHQISVEQSISLLLNFMIAAYDSEGRGKLTVFSVKAMLATMCGGKMLDKLRYVFSQMSDSNGLMIFSKFDQFLKEVLKLPTAVFEGPSFGYTEHSVRTCFPQQRKIMLNMFLDTMMADPPPQCLVWLPLMHRLAHVENVFHPVECSYCRCESMMGFRYRCQQCHNYQLCQNCFWRGHAGGPHSNQHQMKEHSSWHQSCTGECIFCFHVWEDHCVLCDPVV

SEQ ID NO: 807804 - protein, 221 aa, Homo sapiens [sequence omitted]

SEQ ID NO: 807805 - protein, 193 aa, Homo sapiens
MIEESGNKRKTMAEKRQLFIEMRAQNFDVIRLSTYRTACKLRFVQKRCNLHLVDIWNMIEAFRDNGLNTLDHTTEISVSRLETVISSIYYQLNKRLPSTHQISVEQSISLLLNFMIAAYDSEGRGKLTVFSVKAMLATMCGGKMLDKLRYVFSQMSDSNGLMIFSKFDHTRAALESASSASMCGKITVFSVTQ

SEQ ID NO: 807806 - protein, 109 aa, Homo sapiens
RVTGEARKPLGWVGQGSPFEIVWGMRRPGRDLSVLFLPMLPQVSRGAGHRGSSGEYKESSASPRPLPPSSASSLPLPSCSHRSLARAVLTGEDARAQLSLPFAHPSHVP

SEQ ID NO: 807807 - protein, 527 aa, Homo sapiens
MIEESGNKRKTMAEKRQLFIEMRAQNFDVIRLSTYRTACKLRFVQKRCNLHLVDIWNMIEAFRDNGLNTLDHTTEISVSRLETVISSIYYQLNKRLPSTHQISVEQSISLLLNFMIAAYDSEGRGKLTVFSVKAMLATMCGGKMLDKLRYVFSQMSDSNGLMIFSKFDQFLKEVLKLPTAVFEGPSFGYTEHSVRTCFPQQRKIMLNMFLDTMMADPPPQCLVWLPLMHRLAHVENVFHPVECSYCRCESMMGFRYRCQQCHNYQLCQNCFWRGHAGGPHSNQHQMKEHSSWKSPAKKLSHAISKSLGCVPTREPPHPVFPEQPEKPLDLAHIVPPRPLTNMNDTMVSHMSSGVPTPTKRLQYSQDIPSHLADEHALIASYVARLQHCARVLDSPSRLDEEHRLIARYAARLAAEAGNVTRPPTDLSFNFDANKQQRQLIAELENKNREILQEIQRLRLEHEQASQPTPEKAQQNPTLLAELRLLRQRKDELEQRMSALQESRRELMVQLEELMKLLKERRKSKSRQ

SEQ ID NO: 807808 - protein, 531 aa, Homo sapiens; identical to SEQ ID NO: 807797

SEQ ID NO: 807809 - protein, 561 aa, Homo sapiens
MIEESGNKRKTMAEKRQLFIEMRAQNFDVIRLSTYRTACKLRFVQKRCNLHLVDIWNMIEAFRDNGLNTLDHTTEISVSRLETVISSIYYQLNKRLPSTHQISVEQSISLLLNFMIAAYDSEGRGKLTVFSVKAMLATMCGGKMLDKLRYVFSQMSDSNGLMIFSKFDQFLKEVLKLPTAVFEGPSFGYTEHSVRTCFPQQRKIMLNMFLDTMMADPPPQCLVWLPLMHRLAHVENVFHPVECSYCRCESMMGFRYRCQQCHNYQLCQNCFWRGHAGGPHSNQHQMKEHSSWKSPAKKLSHAISKSLGCVPTREPPHPVFPEQPEKPLDLAHIVPPRPLTNMNDTMVSHMSSGVPTPTKRLQYSQDIPSHLADEHALIASYVARLQHCARVLDSPSRLDEEHRLIARYAARLAAEAGNVTRPPTDLSFNFDANKQQRQLIAELENKNREILQEIQRLRLEHEQASQPTPEKAQQNPTLLAELRLLRQRKDELEQRMSALQESRRELMVQLEELMKLLKERSRLRPQGHHIHRPPMEAAGQCPCQCAPRLPAPPPPTVRRTR

SEQ ID NO: 807810 - protein, 394 aa, Homo sapiens
MSSPLVLADKLRYVFSQMSDSNGLMIFSKFDQFLKEVLKLPTAVFEGPSFGYTEHSVRTCFPQQRKIMLNMFLDTMMADPPPQCLVWLPLMHRLAHVENVFHPVECSYCRCESMMGFRYRCQQCHNYQLCQNCFWRGHAGGPHSNQHQMKEHSSWKSPAKKLSHAISKSLGCVPTREPPHPVFPEQPEKPLDLAHIVPPRPLTNMNDTMVSHMSSGVPTPTKSVLDSPSRLDEEHRLIARYAARLAAEAGNVTRPPTDLSFNFDANKQQRQLIAELENKNREILQEIQRLRLEHEQASQPTPEKAQQNPTLLAELRLLRQRKDELEQRMSALQESRRELMVQLEELMKLLKERSRLRPQGHHIHRPPMEAAGQCPCQCAPRLPAPPPPTVRRTR

SEQ ID NO: 807811 - protein, 352 aa, Homo sapiens
MSYDYQLTEQPANYDLYKNDATRKIMLNMFLDTMMADPPPQCLVWLPLMHRLAHVENVFHPVECSYCRCESMMGFRYRCQQCHNYQLCQNCFWRGHAGGPHSNQHQMKEHSSWKSPAKKLSHAISKSLGCVPTREPPHPVFPEQPEKPLDLAHIVPPRPLTNMNDTMVSHMSSGVPTPTKSVLDSPSRLDEEHRLIARYAARLAAEAGNVTRPPTDLSFNFDANKQQRQLIAELENKNREILQEIQRLRLEHEQASQPTPEKAQQNPTLLAELRLLRQRKDELEQRMSALQESRRELMVQLEELMKLLKERSRLRPQGHHIHRPPMEAAGQCPCQCAPRLPAPPPPTVRRTR

SEQ ID NO: 807812 - protein, 190 aa, Homo sapiens
MNDTMVSHMSSGVPTPTKSVLDSPSRLDEEHRLIARYAARLAAEAGNVTRPPTDLSFNFDANKQQRQLIAELENKNREILQEIQRLRLEHEQASQPTPEKAQQNPTLLAELRLLRQRKDELEQRMSALQESRRELMVQLEELMKLLKERSRLRPQGHHIHRPPMEAAGQCPCQCAPRLPAPPPPTVRRTR

SEQ ID NO: 807813 - protein, 306 aa, Homo sapiens
MIEESGNKRKTMAEKRQLFIEMRAQNFDVIRLSTYRTACKLRFVQKRCNLHLVDIWNMIEAFRDNGLNTLDHTTEISVSRLETVISSIYYQLNKRLPSTHQISVEQSISLLLNFMIAAYDSEGRGKLTVFSVKAMLATMCGGKMLDKLRYVFSQMSDSNGLMIFSKFDQFLKEVLKLPTAVFEGPSFGYTEHSVRTCFPQQRKIMLNMFLDTMMADPPPQCLVWLPLMHRLAHVENVFHPVECSYCRCESMMGFRYRCQQCHNYQLCQNCFWRGHAGGPHSNQHQMKEHSSWLCFICVLSVNLFDQ

SEQ ID NO: 807814 - protein, 165 aa, Homo sapiens
MTFLLLRSICLHGCLGLATVVESMTLPCCHTWVGKVNKRVTGEARKPLGWVGQGSPFEIVWGMRRPGRDLSVLFLPMLPQVSRGAGHRGSSGTEDEEQAGADMAKARSSPRGTFLSIFPPHTWTRLAGCQTSLHPPGRGEPEPVGSGEGLRGTASGPPPAQPCMY

SEQ ID NO: 807815 - protein, 155 aa, Homo sapiens
MAEGEITTFTALTEKFNLPPGNYKKPKLLYCSNGGHFLRILPDGTVDGTRDRSDQHIQLQLSAESVGEVYIKSTETGQYLAMDTDGLLYGSQTPNEECLFLERLEENHYNTYISKKHAEKNWFVGLKKNGSCKRGPRTHYGQKAILFLPLPVSSD

SEQ ID NO: 807816 - protein, 155 aa, Homo sapiens; identical to SEQ ID NO: 807815

SEQ ID NO: 807817 - protein, 155 aa, Homo sapiens; identical to SEQ ID NO: 807815

SEQ ID NO: 807818 - protein, 155 aa, Homo sapiens; identical to SEQ ID NO: 807815

SEQ ID NO: 807819 - protein, 155 aa, Homo sapiens; identical to SEQ ID NO: 807815

SEQ ID NO: 807820 - protein, 155 aa, Homo sapiens; identical to SEQ ID NO: 807815

SEQ ID NO: 807821 - protein, 96 aa, Homo sapiens
RRAPPPPLLQQQLLCKVVAGARSGVPSLPPSHAMSQGSPGVPGPHMMYRQKEKEKESNATHCAWPLVSRGFGVLAQCFSNTEVLADHLGTWFEWRF

SEQ ID NO: 807822 - protein, 60 aa, Homo sapiens
MAEGEITTFTALTEKFNLPPGNYKKPKLLYCSNGGHFLRILPDGTVDGTRDRSDQHTDTK

SEQ ID NO: 807823 - protein, 468 aa, Homo sapiens
RPPAARSGSRPVLTARGPRPRGAGAMVRGRISRLSVRDVRFPTSLGGHGADAMHTDPDYSAAYVVIETDAEDGIKGCGITFTLGKGTEVVVCAVNALAHHVLNKDLKDIVGDFRGFYRQLTSDGQLRWIGPEKGVVHLATAAVLNAVWDLWAKQEGKPVWKLLVDMDPRMLVSCIDFRYITDVLTEEDALEILQKGQIGKKEREKQMLAQGYPAYTTSCAWLGYSDDTLKQLCAQALKDGWTRFKVKVGADLQDDMRRCQIIRDMIGPEKTLMMDANQRWDVPEAVEWMSKLAKFKPLWIEEPTSPDDILGHATISKALVPLGIGIATGEQCHNRVIFKQLLQAKALQFLQIDSCRLGSVNENLSVLLMAKKFEIPVCPHAGGVGLCELVQHLIIFDYISVSASLENRVCEYVDHLHEHFKYPVMIQRASYMPPKDPGYSTEMKEESVKKHQYPDGEVWKKLLPAQEN

SEQ ID NO: 807824 - protein, 361 aa, Homo sapiens
MQKMESRGVELPSLWEKALKLIGPEKGVVHLATAAVLNAVWDLWAKQEGKPVWKLLVDMDPRMLVSCIDFRYITDVLTEEDALEILQKGQIGKKEREKQMLAQGYPAYTTSCAWLGYSDDTLKQLCAQALKDGWTRFKVKVGADLQDDMRRCQIIRDMIGPEKTLMMDANQRWDVPEAVEWMSKLAKFKPLWIEEPTSPDDILGHATISKALVPLGIGIATGEQCHNRVIFKQLLQAKALQFLQIDSCRLGSVNENLSVLLMAKKFEIPVCPHAGGVGLCELVQHLIIFDYISVSASLENRVCEYVDHLHEHFKYPVMIQRASYMPPKDPGYSTEMKEESVKKHQYPDGEVWKKLLPAQEN

SEQ ID NO: 807825 - protein, 214 aa, Homo sapiens
RPPAARSGSRPVLTARGPRPRGAGAMVRGRISRLSVRDVRFPTSLGGHGADAMHTDPDYSAAYVVIETDAEDGIKGCGITFTLGKGTEVVVCAVNALAHHVLNKDLKDIVGDFRGFYRQLTSDGQLRWIGPEKGVVHLATAAVLNAVWDLWAKQEGKPVWKLLVDMDPRMLVSCIDFRYITDVLTEEDALGEFGSFLGYTMCTHSSGMLCFLKE

SEQ ID NO: 807826 - protein, 468 aa, Homo sapiens; identical to SEQ ID NO: 807823

SEQ ID NO: 807827 - protein, 400 aa, Homo sapiens
RPPAARSGSRPVLTARGPRPRGAGAMVRGRISRLSVRDVRFPTSLGGHGADAMHTDPDYSAAYVVIETDAEDGIKGCGITFTLGKGTEVVVCAVNALAHHVLNKDLKDIVGDFRGFYRQLTSDGQLRWIGPEKGVVHLATAAVLNAVWDLWAKQEGKPVWKLLVDMDPRMLVSCIDFRYITDVLTEEDALEILQKGQIGKKEREKQMLAQGYPAYTTSCAWLGYSDDTLKQLCAQALKDGWTRFKVKVGADLQDDMRRCQIIRDMIGPEKTLMMDANQRWDVPEAVEWMSKLAKFKPLWIEEPTSPDDILGHATISKALVPLGIGIATGEQVSDAPNRWMTSPWGQYTLTSDRGHSCVLGSITCCTLSWEIFIILETGSFYQSLESDIEKVCGYFSNLYD

SEQ ID NO: 807828 - protein, 468 aa, Homo sapiens; identical to SEQ ID NO: 807823

SEQ ID NO: 807829 - protein, 468 aa, Homo sapiens; identical to SEQ ID NO: 807823

SEQ ID NO: 807830 - protein, 504 aa, Homo sapiens
RPPAARSGSRPVLTARGPRPRGAGAMVRGRISRLSVRDVRFPTSLGGHGADAMVSADAMVSADAMVSADAMVSADAMVSADAMVSADAMHTDPDYSAAYVVIETDAEDGIKGCGITFTLGKGTEVVVCAVNALAHHVLNKDLKDIVGDFRGFYRQLTSDGQLRWIGPEKGVVHLATAAVLNAVWDLWAKQEGKPVWKLLVDMDPRMLVSCIDFRYITDVLTEEDALEILQKGQIGKKEREKQMLAQGYPAYTTSCAWLGYSDDTLKQLCAQALKDGWTRFKVKVGADLQDDMRRCQIIRDMIGPEKTLMMDANQRWDVPEAVEWMSKLAKFKPLWIEEPTSPDDILGHATISKALVPLGIGIATGEQCHNRVIFKQLLQAKALQFLQIDSCRLGSVNENLSVLLMAKKFEIPVCPHAGGVGLCELVQHLIIFDYISVSASLENRVCEYVDHLHEHFKYPVMIQRASYMPPKDPGYSTEMKEESVKKHQYPDGEVWKKLLPAQEN

SEQ ID NO: 807831 - protein, 303 aa, Homo sapiens
MDPRMLVSCIDFRYITDVLTEEDALEILQKGQIGKKEREKQMLAQGYPAYTTSCAWLGYSDDTLKQLCAQALKDGWTRFKVKVGADLQDDMRRCQIIRDMIGPEKTLMMDANQRWDVPEAVEWMSKLAKFKPLWIEEPTSPDDILGHATISKALVPLGIGIATGEQCHNRVIFKQLLQAKALQFLQIDSCRLGSVNENLSVLLMAKKFEIPVCPHAGGVGLCELVQHLIIFDYISVSASLENRVCEYVDHLHEHFKYPVMIQRASYMPPKDPGYSTEMKEESVKKHQYPDGEVWKKLLPAQEN

SEQ ID NO: 807832 - protein, 455 aa, Homo sapiens
RPPAARSGSRPVLTARGPRPRGAGAMVRGRISRLSVRDVRFPTSLGGHGADAMHTDPDYSAAYVVIETDAEDGIKGCGITFTLGKGTEVVVCAVNALAHHVLNKDLKDIVGDFRGFYRQLTSDGQLRWIGPEKGVVHLATAAVLNAVWDLWAKQEGKPVWKLLVDMDPRMLVSCIDFRYITDVLTEEDALEKQMLAQGYPAYTTSCAWLGYSDDTLKQLCAQALKDGWTRFKVKVGADLQDDMRRCQIIRDMIGPEKTLMMDANQRWDVPEAVEWMSKLAKFKPLWIEEPTSPDDILGHATISKALVPLGIGIATGEQCHNRVIFKQLLQAKALQFLQIDSCRLGSVNENLSVLLMAKKFEIPVCPHAGGVGLCELVQHLIIFDYISVSASLENRVCEYVDHLHEHFKYPVMIQRASYMPPKDPGYSTEMKEESVKKHQYPDGEVWKKLLPAQEN

SEQ ID NO: 807833 - protein, 480 aa, Homo sapiens
RPPAARSGSRPVLTARGPRPRGAGAMVRGRISRLSVRDVRFPTSLGGHGADAMVSADAMVSADAMVSADAMVSADAMVSADAMVSADAMVSADAMVSADAMVARHTDPDYSAAYVVIETDAEDGIKGCGITFTLGKGTEVVVCAVNALAHHVLNKDLKDIVGDFRGFYRQLTSDGQLRWDPRMLVSCIDFRYITDVLTEEDALEILRHVKFVKYEEKQMLAQGYPAYTTSCAWLGYSDDTLKQLCAQALKDGWTRFKVKVGADLQDDMRRCQIIRDMIGPEKTLMMDANQRWDVPEAVEWMSKLAKFKPLWIEEPTSPDDILGHATISKALVPLGIGIATGEQCHNRVIFKQLLQAKALQFLQIDSCRLGSVNENLSVLLMAKKFEIPVCPHAGGVGLCELVQHLIIFDYISVSASLENRVCEYVDHLHEHFKYPVMIQRASYMPPKDPGYSTEMKEESVKKHQYPDGEVWKKLLPAQEN

SEQ ID NO: 807834 - protein, 468 aa, Homo sapiens; identical to SEQ ID NO: 807823

SEQ ID NO: 807835 - protein, 213 aa, Homo sapiens
MRRCQIIRDMIGPEKTLMMDANQRWDVPEAVEWMSKLAKFKPLWIEEPTSPDDILGHATISKALVPLGIGIATGEQCHNRVIFKQLLQAKALQFLQIDSCRLGSVNENLSVLLMAKKFEIPVCPHAGGVGLCELVQHLIIFDYISVSASLENRVCEYVDHLHEHFKYPVMIQRASYMPPKDPGYSTEMKEESVKKHQYPDGEVWKKLLPAQEN

SEQ ID NO: 807836 - protein, 143 aa, Homo sapiens
GRLLLLNSRPRRLKQLLQAKALQFLQIDSCRLGSVNENLSVLLMAKKFEIPVCPHAGGVGLCELVQHLIIFDYISVSASLENRVCEYVDHLHEHFKYPVMIQRASYMPPKDPGYSTEMKEESVKKHQYPDGEVWKKLLPAQEN

SEQ ID NO: 807837 - protein, 394 aa, Homo sapiens
RPPAARSGSRPVLTARGPRPRGAGAMVRGRISRLSVRDVRFPTSLGGHGADAMHTDPDYSAAYVVIETDAEDGIKGCGITFTLGKGTEVVVCAVNALAHHVLNKDLKDIVGDFRGFYRQLTSDGQLRWIGPEKGVVHLATAAVLNAVWDLWAKQEGKPVWKLLVDMDPRMLVSCIDFRYITDVLTEEDALEILQKGQIGKKEREKQMLAQGYPAYTTSCAWLGYSDDTLKQLCAQALKDGWTRFKVKVGADLQDDMRRCQIIRDMIGPEKTLMMDANQRWDVPEAVEWMSKLAKFKPLWIEEPTSPDDILGHATISKVGKRLLLLWQLIFLFSFPECWGQILKFLHLFPLAFPVEVAEIIVMCDKYRGYRPDIPFSTSAYTLPLFLFVLDKVSC

SEQ ID NO: 807838 - protein, 181 aa, Homo sapiens
RPPAARSGSRPVLTARGPRPRGAGAMVRGRISRLSVRDVRFPTSLGGHGADAMHTDPDYSAAYVVIETDAEDGIKGCGITFTLGKGTEVVVCAVNALAHHVLNKDLKDIVGDFRGFYRQLTSDGQLRWIGPEKGVVHLGLAFFFFFFLVFLVEMRFHHIGQACLELLTSDHLPALASQSAG

SEQ ID NO: 807839 - protein, 294 aa, Homo sapiens
RPPAARSGSRPVLTARGPRPRGAGAMVRGRISRLSVRDVRFPTSLGGHGADAMVSADAMVSADAMVSADAMVSADAMVSADAMVSADAMVSADAMVSADAMVSADAMVSADAMVSADAMVSADAMHTDPDYSAAYVVIETDAEDGIKGCGITFTLGKGTEVVVCAVNALAHHVLNKDLKDIVGDFRGFYKSRSTVQGTLTNGLVETRACPMSDRGRSRGVRIVAKEENKPVWDSLWTMAPDDWYESGPSHSCPCTRGGPRPADRNHLPQPTEPMKAPRAPLLQPPLVRMAEGPS

SEQ ID NO: 807840 - protein, 403 aa, Homo sapiens
RPPAARSGSRPVLTARGPRPRGAGAMVRGRISRLSVRDVRFPTSLGGHGADAMHTDPDYSAAYVVIETDAEDGIKGCGITFTLGKGTEVVVCAVNALAHHVLNKDLKDIVGDFRGFYRQLTSDGQLRWIGPEKGVVHLATAAVLNAVWDLWAKQEGKPVWKLLVDMASSPPVTCQDPRMLVSCIDFRYITDVLTEEDALEILQKGQIGKKEREKQMLAQGYPAYTTSCAWLGYSDDTLKQLCAQALKDGWTRFKVKVGADLQDDMRRCQIIRDMIGPEKTLMMDANQRWDVPEAVEWMSKLAKFKPLWIEEPTSPDDILGHATISKVGKRLLLLWQLIFLFSFPECWGQILKFLHLFPLAFPVEVAEIIVMCDKYRGYRPDIPFSTSAYTLPLFLFVLDKVSC

SEQ ID NO: 807841 - protein, 167 aa, Homo sapiens
RPPAARSGSRPVLTARGPRPRGAGAMVRGRISRLSVRDVRFPTSLGGHGADAMHTDPDYSAAYVVIETDAEDGIKGCGITFTLGKGTEVVVCAVNALAHHVLNKDLKDIVGDFRGFYRQLTSDGQLRWIGPEKGVVHLATAAVLNAVWDLWAKQEGKPVWKLLVDMG

SEQ ID NO: 807842 - protein, 468 aa, Homo sapiens; identical to SEQ ID NO: 807823

SEQ ID NO: 807843 - protein, 299 aa, Homo sapiens
MLVSCIDFRYITDVLTEEDALEILQKGQIGKKEREKQMLAQGYPAYTTSCAWLGYSDDTLKQLCAQALKDGWTRFKVKVGADLQDDMRRCQIIRDMIGPEKTLMMDANQRWDVPEAVEWMSKLAKFKPLWIEEPTSPDDILGHATISKALVPLGIGIATGEQCHNRVIFKQLLQAKALQFLQIDSCRLGSVNENLSVLLMAKKFEIPVCPHAGGVGLCELVQHLIIFDYISVSASLENRVCEYVDHLHEHFKYPVMIQRASYMPPKDPGYSTEMKEESVKKHQYPDGEVWKKLLPAQEN

SEQ ID NO: 807844 - protein, 319 aa, Homo sapiens
RPPAARSGSRPVLTARGPRPRGAGAMVRGRISRLSVRDVRFPTSLGGHGADAMHTDPDYSAAYVVIETDAEDGIKGCGITFTLGKGTEVVVCAVNALAHHVLNKDLKDIVGDFRGFYRQLTSDGQLRWIGPEKGVVHLATAAVLNAVWDLWAKQEGKPVWKLLVDMDPRMLVSCIDFRYITDVLTEEDALEILQKGQIGKKEREKQMLAQGYPAYTTSCAWLGYSDDTLKQLCAQALKDGWTRFKVKVGADLQDDMRRCQIIRDMIGPEKTLMMDANQRWDVPEAVEWMSKLAKFKPLWIEEPTSPDDILGHATISKGV

SEQ ID NO: 807845 - protein, 393 aa, Homo sapiens
RPPAARSGSRPVLTARGPRPRGAGAMVRGRISRLSVRDVRFPTSLGGHGADAMIGPEKGVVHLATAAVLNAVWDLWAKQEGKPVWKLLVDMDPRMLVSCIDFRYITDVLTEEDALEILQKGQIGKKEREKQMLAQGYPAYTTSCAWLGYSDDTLKQLCAQALKDGWTRFKVKVGADLQDDMRRCQIIRDMIGPEKTLMMDANQRWDVPEAVEWMSKLAKFKPLWIEEPTSPDDILGHATISKALVPLGIGIATGEQCHNRVIFKQLLQAKALQFLQIDSCRLGSVNENLSVLLMAKKFEIPVCPHAGGVGLCELVQHLIIFDYISVSASLENRVCEYVDHLHEHFKYPVMIQRASYMPPKDPGYSTEMKEESVKKHQYPDGEVWKKLLPAQEN

SEQ ID NO: 807846 - protein, 392 aa, Homo sapiens
RPPAARSGSRPVLTARGPRPRGAGAMVRGRISRLSVRDVRFPTSLGGHGADAMHTDPDYSAAYVVIETDAEDGIKGCGITFTLGKGTEVDWSRKGRGAPGDSGRPKRGVGLVGQAGGKACLEVTCGHEKQMLAQGYPAYTTSCAWLGYSDDTLKQLCAQALKDGWTRFKVKVGADLQDDMRRCQIIRDMIGPEKTLMMDANQRWDVPEAVEWMSKLAKFKPLWIEEPTSPDDILGHATISKALVPLGIGIATGEQCHNRVIFKQLLQAKALQFLQIDSCRLGSVNENLSVLLMAKKFEIPVCPHAGGVGLCELVQHLIIFDYISVSASLENRVCEYVDHLHEHFKYPVMIQRASYMPPKDPGYSTEMKEESVKKHQYPDGEVWKKLLPAQEN

SEQ ID NO: 807847 - protein, 273 aa, Homo sapiens
MLTALCFHKKQMLAQGYPAYTTSCAWLGYSDDTLKQLCAQALKDGWTRFKVKVGADLQDDMRRCQIIRDMIGPEKTLMMDANQRWDVPEAVEWMSKLAKFKPLWIEEPTSPDDILGHATISKALVPLGIGIATGEQCHNRVIFKQLLQAKALQFLQIDSCRLGSVNENLSVLLMAKKFEIPVCPHAGGVGLCELVQHLIIFDYISVSASLENRVCEYVDHLHEHFKYPVMIQRASYMPPKDPGYSTEMKEESVKKHQYPDGEVWKKLLPAQEN

SEQ ID NO: 807848 - protein, 70 aa, Homo sapiens
GEGGAVHVGRSAAGAWAGTPQKEICRALVRNGAGGGSSAVLTFSSADTQSPPARMCSPGHPLPVLSLHMA

SEQ ID NO: 807849 - protein, 400 aa, Homo sapiens; identical to SEQ ID NO: 807827

SEQ ID NO: 807850 - protein, 236 aa, Homo sapiens
RPPAARSGSRPVLTARGPRPRGAGAMVRGRISRLSVRDVRFPTSLGGHGADAMHTDPDYSAAYVVIETDAEDGIKGCGITFTLGKGTEVVVCAVNALAHHVLNKDLKDIVGDFRGFYRQLTSDGQLRWIGPEKGVVHLATAAVLNAVWDLWAKQEGKPVWKLLVDMVSSIVNVTIVSVNEMDIIDEHFKYPVMIQRASYMPPKDPGYSTEMKEESVKKHQYPDGEVWKKLLPAQEN

SEQ ID NO: 807851 - protein, 218 aa, Homo sapiens
RPPAARSGSRPVLTARGPRPRGAGAMVRGRISRLSVRDVRFPTSLGGHGADAMVSADAMVSADAMVSADAMVSADAMVSADAMVSADAMVSADAMVSADAMVSADAMVSADAMVSADAMVSADAMHTDPDYSAAYVVIETDAEDGIKGCGITFTLGKGTEVVVCAVNALAHHVLNKDLKDIVGDFRGFYRQLTSDGQLRWIGPEKAVHLAPIGILYIN

SEQ ID NO: 807852 - protein, 226 aa, Homo sapiens
AAGFAPCWGFGGGGGAGARFLVTQAAGPRTHGAGRAGHLFGARGGGRRGREIRPDGPRGACADRHCQLLTPQVPPGPRGPRSGVACPARAAGPRDDGQWTDGARSSAHARQGGTFRPPGTGAPRPDAAVCEWARGDSPAGRTPEHEAVEEDAVGCADSRGTCQRLSQARRSQRGGRGASGSGREGSVTPQAVTPVPQPAPRSYRSPTADTPIPPLPNSRHPPQSHS

SEQ ID NO: 807853 - protein, 331 aa, Homo sapiens
MLSPERLALPDYEYLAQRHVLTYMEDAVCQLLENREDISQYGIARFFTEYFNSVCQGTHILFREFSFVQATPHNRVSFLRAFWRCFRTVGKNGDLLTMKEYHCLLQLLCPDFPLELTQKAARIVLMDDAMDCLMSFSDFLFAFQIQFYYSEFLDSVAAIYEDLLSGKNPNTVIVPTSSSGQHRQRPALGGAGTLEGVEASLFYQCLENLCDRHKYSCPPPALVKEALSNVQRLTFYGFLMALSKHRGINQALGALPDKGDLMHDPAMDEELERLLAQVPGLVNSVTASPEASCLPSRTPPRVGSPWRPLHHSRKVDGESDGSTEETDESET

SEQ ID NO: 807854 - protein, 95 aa, Homo sapiens
DQGEDPPDDSHPHRGWMGALHPAPRGGRPEGEVRRAQRGPRAEFGTSPNKVHLLTATPLRGRTRIATQGLAPSRVTPATQVPGGHNRCGLLENSQ

SEQ ID NO: 807855 - protein, 326 aa, Homo sapiens
MLSPERLALPDYEYLAQRHVLTYMEDAVCQLLENREDISQYGIARFFTEYFNSVCQGTHILFREFSFVQATPHNRVSFLRAFWRCFRTVGKNGDLLTMKEYHCLLQLLCPDFPLELTQKAARIVLMDDAMDCLMSFSDFLFAFQIQFYYSEFLDSVAAIYEDLLSGKNPNTVIVPTSSSGQHRQRPALGGAGTLEGVEASLFYQCLENLCDRHKYSCPPPALVKEALSNVQRLTFYGFLMALSKHRGINQALGALPDKGDLMHDPAMDEELERLVSVKWEDTAPLWGPDGSDTAVPHLGPTPLVCNIPHLPGKGLGASGGLRCPSL

SEQ ID NO: 807856 - protein, 331 aa, Homo sapiens; identical to SEQ ID NO: 807853

SEQ ID NO: 807857 - protein, 337 aa, Homo sapiens
MLSPERLALPDYEYLAQRHVLTYMEDAVCQLLENREDISQYGIARFFTEYFNSVCQGTHILFREFSFVQATPHNRVSFLRAFWRCFRTVGKNGDLLTMKEYHCLLQLLCPDFPLELTQKAARIVLMDDAMDCLMSFSDFLFAFQIQFYYSEFLDSVAAIYEDLLSGKNPNTVIVPTSSSGQHRQRPALGGAGTLEGVEASLFYQCLENLCDRHKYSCPPPALVKEALSNVQRLTFYGFLMALSKHRGINQALGALPDKGDLMHDPAMDEELERLLLPFFRLAQVPGLVNSVTASPEASCLPSRTPPRVGSPWRPLHHSRKVDGESDGSTEETDESET

SEQ ID NO: 807858 - protein, 328 aa, Homo sapiens
MGQGPDWPLKLQVNLGSGSRRAGALKPPRSKDAESGAPSPTGLRVSGFNSVCQGTHILFREFSFVQATPHNRVSFLRAFWRCFRTVGKNGDLLTMKEYHCLLQLLCPDFPLELTQKAARIVLMDDAMDCLMSFSDFLFAFQIQFYYSEFLDSVAAIYEDLLSGKNPNTVIVPTSSSGQHRQRPALGGAGTLEGVEASLFYQCLENLCDRHKYSCPPPALVKEALSNVQRLTFYGFLMALSKHRGINQALGALPDKGDLMHDPAMDEELERLLAQVPGLVNSVTASPEASCLPSRTPPRVGSPWRPLHHSRKVDGESDGSTEETDESET

SEQ ID NO: 807859 - protein, 306 aa, Homo sapiens
AGTGRSGGMDAESGAPSPTGLRVSGFNSVCQGTHILFREFSFVQATPHNRVSFLRAFWRCFRTVGKNGDLLTMKEYHCLLQLLCPDFPLELTQKAARIVLMDDAMDCLMSFSDFLFAFQIQFYYSEFLDSVAAIYEDLLSGKNPNTVIVPTSSSGQHRQRPALGGAGTLEGVEASLFYQCLENLCDRHKYSCPPPALVKEALSNVQRLTFYGFLMALSKHRGINQALGALPDKGDLMHDPAMDEELERLLAQVPGLVNSVTASPEASCLPSRTPPRVGSPWRPLHHSRKVDGESDGSTEETDESET

SEQ ID NO: 807860 - protein, 353 aa, Homo sapiens
MLSPERLALPDYEYLAQRHVLTYMEDAVCQLLENREDISQYGIARFFTEYALQKLDLLNCVTYFSGTSGSTCFNSVCQGTHILFREFSFVQATPHNRVSFLRAFWRCFRTVGKNGDLLTMKEYHCLLQLLCPDFPLELTQKAARIVLMDDAMDCLMSFSDFLFAFQIQFYYSEFLDSVAAIYEDLLSGKNPNTVIVPTSSSGQHRQRPALGGAGTLEGVEASLFYQCLENLCDRHKYSCPPPALVKEALSNVQRLTFYGFLMALSKHRGINQALGALPDKGDLMHDPAMDEELERLLAQVPGLVNSVTASPEASCLPSRTPPRVGSPWRPLHHSRKVDGESDGSTEETDESET

SEQ ID NO: 807861 - protein, 329 aa, Homo sapiens
SCHNSEASPAMWNSQRHVLTYMEDAVCQLLENREDISQYGIARFFTEYFNSVCQGTHILFREFSFVQATPHNRVSFLRAFWRCFRTVGKNGDLLTMKEYHCLLQLLCPDFPLELTQKAARIVLMDDAMDCLMSFSDFLFAFQIQFYYSEFLDSVAAIYEDLLSGKNPNTVIVPTSSSGQHRQRPALGGAGTLEGVEASLFYQCLENLCDRHKYSCPPPALVKEALSNVQRLTFYGFLMALSKHRGINQALGALPDKGDLMHDPAMDEELERLLAQVPGLVNSVTASPEASCLPSRTPPRVGSPWRPLHHSRKVDGESDGSTEETDESET

SEQ ID NO: 807862 - protein, 323 aa, Homo sapiens
MGQGPDWPLKLQVNLGSGSRRAGALKPPRSKDAESGAPSPTGLRVSGFNSVCQGTHILFREFSFVQATPHNRVSFLRAFWRCFRTVGKNGDLLTMKEYHCLLQLLCPDFPLELTQKAARIVLMDDAMDCLMSFSDFLFAFQIQFYYSEFLDSVAAIYEDLLSGKNPNTVIVPTSSSGQHRQRPALGGAGTLEGVEASLFYQCLENLCDRHKYSCPPPALVKEALSNVQRLTFYGFLMALSKHRGINQALGALPDKGDLMHDPAMDEELERLVSVKWEDTAPLWGPDGSDTAVPHLGPTPLVCNIPHLPGKGLGASGGLRCPSL

SEQ ID NO: 807863 - protein, 247 aa, Homo sapiens
MELPGSSLNNLLTMKEYHCLLQLLCPDFPLELTQKAARIVLMDDAMDCLMSFSDFLFAFQIQFYYSEFLDSVAAIYEDLLSGKNPNTVIVPTSSSGQHRQRPALGGAGTLEGVEASLFYQCLENLCDRHKYSCPPPALVKEALSNVQRLTFYGFLMALSKHRGINQALGALPDKGDLMHDPAMDEELERLLAQVPGLVNSVTASPEASCLPSRTPPRVGSPWRPLHHSRKVDGESDGSTEETDESET

SEQ ID NO: 807864 - protein, 253 aa, Homo sapiens
MLSPERLALPDYEYLDLLTMKEYHCLLQLLCPDFPLELTQKAARIVLMDDAMDCLMSFSDFLFAFQIQFYYSEFLDSVAAIYEDLLSGKNPNTVIVPTSSSGQHRQRPALGGAGTLEGVEASLFYQCLENLCDRHKYSCPPPALVKEALSNVQRLTFYGFLMALSKHRGINQALGALPDKGDLMHDPAMDEELERLLAQVPGLVNSVTASPEASCLPSRTPPRVGSPWRPLHHSRKVDGESDGSTEETDESET

SEQ ID NO: 807865 - protein, 251 aa, Homo sapiens
MQRPNVFLSISTSDLLTMKEYHCLLQLLCPDFPLELTQKAARIVLMDDAMDCLMSFSDFLFAFQIQFYYSEFLDSVAAIYEDLLSGKNPNTVIVPTSSSGQHRQRPALGGAGTLEGVEASLFYQCLENLCDRHKYSCPPPALVKEALSNVQRLTFYGFLMALSKHRGINQALGALPDKGDLMHDPAMDEELERLLAQVPGLVNSVTASPEASCLPSRTPPRVGSPWRPLHHSRKVDGESDGSTEETDESET

SEQ ID NO: 807866 - protein, 304 aa, Homo sapiens
AFCLLPQFRGLPSHVELFNSVCQGTHILFREFSFVQATPHNRVSFLRAFWRCFRTVGKNGDLLTMKEYHCLLQLLCPDFPLELTQKAARIVLMDDAMDCLMSFSDFLFAFQIQFYYSEFLDSVAAIYEDLLSGKNPNTVIVPTSSSGQHRQRPALGGAGTLEGVEASLFYQCLENLCDRHKYSCPPPALVKEALSNVQRLTFYGFLMALSKHRGINQALGALPDKGDLMHDPAMDEELERLLLPFFRLAQVPGLVNSVTASPEASCLPSRTPPRVGSPWRPLHHSRKVDGESDGSTEETDESET

SEQ ID NO: 807867 - protein, 118 aa, Homo sapiens
MEALLSVQEASRCPPGFFPSSGWPRSQAWSTRSQPVQRPVACLPGPLPGLALPGDLSIIPEKWMERVMAPLKRQTSRRLEESKGSCPQRPVPAPTQPLVCPPSLLSSTLLCCPLLLTR

SEQ ID NO: 807868 - protein, 303 aa, Homo sapiens
MLSPERLALPDYEYLAQRHVLTYMEDAVCQLLENREDISQYGIARFFTEYFNSVCQGTHILFREFSFVQATPHNRVSFLRAFWRCFRTVGKNGDLLTMKEYHCLLQLLCPDFPLELTQKAARIVLMDDAMDCLMSFSDFLFAFQIQFYYSEFLDSVAAIYEDLLSGKNPNTVIVPTSSSGQHRQRPALGGAGTLEGVEASLFYQCLENLCDRHKYSCPPPALVKEALSNVQRLTFYGFLMALSKHRGINQALGALPDKGDLMHDPAMDEELERLNSIKGENPNSHAGPCTIKGDTCDASTRRT

SEQ ID NO: 807869 - protein, 326 aa, Homo sapiens
MLSPERLALPDYEYLAQRHVLTYMEDAVCQLLENREDISQYGIARFFTEYFNSVCQGTHILFREFSFVQATPHNRVSFLRAFWRCFRTVGKNGDLLTMKEYHCLLQLLCPDFPLELTQKAARIVLMDDAMDCLMSFSDFLFAFQIQFYYSEFLDSVAAIYEDLLSGKNPNTVIVPTSSSGQHRQRPALGGAGTLEGVEASLFYQCLENLCDRHKYSCPPPALVKEALSNVQRLTFYGFLMALSKHRGINQALGALPDKGDLMHDPAMDEELERLVVRSKLHRTSRQHRAKEPGAFGFQRREKQEALERVSSASVPTPYHYRWEPRE

SEQ ID NO: 807870 - protein, 333 aa, Homo sapiens
MLSPERLALPDYEYLAQRHVLTYMEDAVCQLLENREDISQYGIARFFTEYFNSVCQGTHILFREFSFVQATPHNRVSFLRAFWRCFRTVGKNGDLLTMKEYHCLLQLLCPDFPLELTQKAARIVLMDDAMDCLMSFSDFLFAFQIQFYYSEFLDSVAAIYEDLLSGKNPNTVIVPTSSSGQHRQRPALGGAGTLEGVEASLFYQCLENLCDRHKYSCPPPALVKEALSNVQRLTFYGFLMALSKHRGINQALGKSELSSRQPLLPHNTGSSWPLLATRLQRGRGITISALTSQGRTQSQGAGIWRQNMALTHSHGRGQPSLPAALPQHETTSP

SEQ ID NO: 807871 - protein, 235 aa, Homo sapiens
MLSPERLALPDYEYLAQRHVLTYMEDAVCQLLENREDISQYGIARFFTEYFNSVCQGTHILFREFSFVQATPHNRVSFLRAFWRCFRTVGKNGDLLTMKEYHCLLQLLCPDFPLELTQKAARIVLMDDAMDCLMSFSDFLFAFQIQFYYSEFLDSVAAIYEDLLSGKNPNTVIVPTSSSGQHRQRPALGGAGTLEGVEASLFYQCLENLCDRHKYSSGHRQRIIGLQSVRDYVVL

SEQ ID NO: 807872 - protein, 238 aa, Homo sapiens
MLSPERLALPDYEYLAQRHVLTYMEDAVCQLLENREDISQYGIARFFTEYFNSVCQGTHILFREFSFVQATPHNRVSFLRAFWRCFRTVGKNGDLLTMKEYHCLLQLLCPDFPLELTQKAARIVLMDDAMDCLMSFSDFLFAFQIQFYYSGECSGAPSGSAQDPVSLSCPAALPICVPGTHVSLPHFLWGCASLRVANRMSSVQWWSQDSVCRADFLSLLKTLNTAVFSVSNATNQFK

SEQ ID NO: 807873 - protein, 227 aa, Homo sapiens
MLSPERLALPDYEYLAQRHVLTYMEDAVCQLLENREDISQYGIARFFTEYFNSVCQGTHILFREFSFVQATPHNRVSFLRAFWRCFRTVGKNGDLLTMKEYHCLLQLLCPDFPLELTQKAARIVLMDDAMDCLMSFSDFLFAFQIQFYYSGTALTLILTTALRESPFRDKLTEVVASHAAHKWWRPDLKADSKASVPNLAAILLPSRVSPLATDRAFGCTFSSTPQL

SEQ ID NO: 807874 - protein, 148 aa, Homo sapiens
MLSPERLALPDYEYLAQRHVLTYMEDAVCQLLENREDISQYGIARFFTEYFNSVCQGTHILFREFSFVQATPHNRVSFLRAFWRCFRTVGKNGDLLTMKEYHCLLQLLCPDFPLELTQKAARYVSWTLETNSALCGPLLPRETWSVYK

SEQ ID NO: 807875 - protein, 141 aa, Homo sapiens
MLSPERLALPDYEYLAQRHVLTYMEDAVCQLLENREDISQYGIARFFTEYFNSVCQGTHILFREFSFVQATPHNRVSFLRAFWRCFRTVGKNGGKSSQILFPSFLPSFLSSFLPSSLSLSFSLSFPLFLFQTFSFVPINIV

SEQ ID NO: 807876 - protein, 250 aa, Homo sapiens
MGQGPDWPLKLQVNLGSGSRRAGALKPPRSKDAESGAPSPTGLRVSGFNSVCQGTHILFREFSFVQATPHNRVSFLRAFWRCFRTVGKNGDLLTMKEYHCLLQLLCPDFPLELTQKAARIVLMDDAMDCLMSFSDFLFAFQIQFYYSEFLDSVAAIYEDLLSGAKRKKPPKNKQRVGLSVGPRKPGFRFPRGGGTKDKIPEANIRKPPWPPFGGAPGVAAVCLKPDPWGNDGPGLAPTRAGDPDHWHYSF

SEQ ID NO: 807877 - protein, 110 aa, Homo sapiens
MALSKHRGINQALGALPDKGDLMHDPAMDEELERLVGQVQGWSTRVTSSPEACCCFRTSGVVSWRPFHYRGKGCEDGWSLKEDGWDLGQAAQACCFTTWGPPFSLGRLAR

SEQ ID NO: 807878 - protein, 93 aa, Homo sapiens
LVPVGVVGWMLSPERLALPDYEYLGMLETITLLNVRYMKGHTSSALLVKWRGCQNRSAPWFSCPKVLQIDTSATCPHLHGGCSVPAARKQGRY

SEQ ID NO: 807879 - protein, 1445 aa, Homo sapiens
MRRLLEPCWWILFLKITSSVLHYVVCFPALTEGYVGALHENRHGSAVQIRRRKASGDPYWAYSGAYGPEHWVTSSVSCGGRHQSPIDILDQYARVGEEYQELQLDGFDNESSNKTWMKNTGKTVAILLKDDYFVSGAGLPGRFKAEKVEFHWGHSNGSAGSEHSINGRRFPVEMQIFFYNPDDFDSFQTAISENRIIGAMAIFFQVSPRDNSALDPIIHGLKGVVHHEKETFLDPFVLRDLLPASLGSYYRYTGSLTTPPCSEIVEWIVFRRPVPISYHQLEAFYSIFTTEQQDHVKSVEYLRNNFRPQQRLHDRVVSKSAVRDSWNHDMTDFLENPLGTEASKVCSSPPIHMKVQPLNQTALQVSWSQPETIYHPPIMNYMISYSWTKNEDEKEKTFTKDSDKDLKATISHVSPDSLYLFRVQAVCRNDMRSDFSQTMLFQANTTRIFQGTRIVKTGVPTASPASSADMAPISSGSSTWTSSGIPFSFVSMATGMGPSSSGSQATVASVVTSTLLAGLGFGGGGISSFPSTVWPTRLPTAASASKQAARPVLATTEALASPGPDGDSSPTKDGEGTEEGEKDEKSESEDGEREHEEDGEKDSEKKEKSGVTHAAEERNQTEPSPTPSSPNRTAEGGHQTIPGHEQDHTAVPTDQTGGRRDAGPGLDPDMVTSTQVPPTATEEQYAGSDPKRPEMPSKKPMSRGDRFSEDSRFITVNPAEKNTSGMISRPAPGRMEWIIPLIVVSALTFVCLILLIAVLVYWRGCNKIKSKGFPRRFREVPSSGERGEKGSRKCFQTAHFYVEDSSSPRVVPNESIPIIPIPDDMEAIPVKQFVKHIGELYSNNQHGFSEDFEEVQRCTADMNITAEHSNHPENKHKNRYINILAYDHSRVKLRPLPGKDSKHSDYINANYVDGYNKAKAYIATQGPLKSTFEDFWRMIWEQNTGIIVMITNLVEKGRRKCDQYWPTENSEEYGNIIVTLKSTKIHACYTVRRFSIRNTKVKKGQKGNPKGRQNERVVIQYHYTQWPDMGVPEYALPVLTFVRRSSAARMPETGPVLVHCSAGVGRTGTYIVIDSMLQQIKDKSTVNVLGFLKHIRTQRNYLVQTEEQYIFIHDALLEAILGKETEVSSNQLHSYVNSILIPGVGGKTRLEKQFKLVTQCNAKYVECFSAQKECNKEKNRNSSVVPSERARVGLAPLPGMKGTDYINASYIMGYYRSNEFIITQHPLPHTTKDFWRMIWDHNAQIIVMLPDNQSLAEDEFVYWPSREESMNCEAFTVTLISKDRLCLSNEEQIIIHDFILEATQDDYVLEVRHFQCPKWPNPDAPISSTFELINVIKEEALTRDGPTIVHDEYGAVSAGMLCALTTLSQQLENENAVDVFQVAKMINLMRPGVFTDIEQYQFIYKAMLSLVSTKENGNGPMTVDKNGAVLIADESDPAESMESLV

SEQ ID NO: 807880 - protein, 1445 aa, Homo sapiens; identical to SEQ ID NO: 807879

SEQ ID NO: 807881 - protein, 1416 aa, Homo sapiens
MRRLLEPCWWILFLKITSSVLHYVVCFPALTEGYVGALHENRHGSAVQIRRRKASGDPYWAYSGAYGPEHWVTSSVSCGGRHQSPIDILDQYARVGEEYQELQLDGFDNESSNKTWMKNTGKTVAILLKDDYFVSGAGLPGRFKAEKVEFHWGHSNGSAGSEHSINGRRFPVEMQIFFYNPDDFDSFQTAISENRIIGAMAIFFQVSPRDNSALDPIIHGLKGVVHHEKETFLDPFVLRDLLPASLGSYYRYTGSLTTPPCSEIVEWIVFRRPVPISYHQLEAFYSIFTTEQQDHVKSVEYLRNNFRPQQRLHDRVVSKSAVRDSWNHDMTDFLENPLGTEASKVCSSPPIHMKVQPLNQTALQVSWSQPETIYHPPIMNYMISYSWTKNEDEKEKTFTKDSDKDLKATISHVSPDSLYLFRVQAVCRNDMRSDFSQTMLFQANTTRIFQGTRIVKTGVPTASPASSADMAPISSGSSTWTSSGIPFSFVSMATGMGPSSSGSQATVASVVTSTLLAGLGFGGGGISSFPSTVWPTRLPTAASASKQAARPVLATTEALASPGPDGDSSPTKDGEGTEEGEKDEKSESEDGEREHEEDGEKDSEKKEKSGVTHAAEERNQTEPSPTPSSPNRTAEGGHQTIPGHEQDHTAVPTDQTGGRRDAGPGLDPDMVTSTQVPPTATEEQYAGSDPKRPEMPSKKPMSRGDRFSEDSRFITVNPAEKNTSGMISRPAPGRMEWIIPLIVVSALTFVCLILLIAVLVYWRKCFQTAHFYVEDSSSPRVVPNESIPIIPIPDDMEAIPVKQFVKHIGELYSNNQHGFSEDFEEVQRCTADMNITAEHSNHPENKHKNRYINILAYDHSRVKLRPLPGKDSKHSDYINANYVDGYNKAKAYIATQGPLKSTFEDFWRMIWEQNTGIIVMITNLVEKGRRKCDQYWPTENSEEYGNIIVTLKSTKIHACYTVRRFSIRNTKVKKGQKGNPKGRQNERVVIQYHYTQWPDMGVPEYALPVLTFVRRSSAARMPETGPVLVHCSAGVGRTGTYIVIDSMLQQIKDKSTVNVLGFLKHIRTQRNYLVQTEEQYIFIHDALLEAILGKETEVSSNQLHSYVNSILIPGVGGKTRLEKQFKLVTQCNAKYVECFSAQKECNKEKNRNSSVVPSERARVGLAPLPGMKGTDYINASYIMGYYRSNEFIITQHPLPHTTKDFWRMIWDHNAQIIVMLPDNQSLAEDEFVYWPSREESMNCEAFTVTLISKDRLCLSNEEQIIIHDFILEATQDDYVLEVRHFQCPKWPNPDAPISSTFELINVIKEEALTRDGPTIVHDEYGAVSAGMLCALTTLSQQLENENAVDVFQVAKMINLMRPGVFTDIEQYQFIYKAMLSLVSTKENGNGPMTVDKNGAVLIADESDPAESMESLV

SEQ ID NO: 807882 - protein, 621 aa, Homo sapiens
MEAIPVKQFVKHIGELYSNNQHGFSEDFEEVQRCTADMNITAEHSNHPENKHKNRYINILAYDHSRVKLRPLPGKDSKHSDYINANYVDGYNKAKAYIATQGPLKSTFEDFWRMIWEQNTGIIVMITNLVEKGRRKCDQYWPTENSEEYGNIIVTLKSTKIHACYTVRRFSIRNTKVKKGQKGNPKGRQNERVVIQYHYTQWPDMGVPEYALPVLTFVRRSSAARMPETGPVLVHCSAGVGRTGTYIVIDSMLQQIKDKSTVNVLGFLKHIRTQRNYLVQTEEQYIFIHDALLEAILGKETEVSSNQLHSYVNSILIPGVGGKTRLEKQFKLVTQCNAKYVECFSAQKECNKEKNRNSSVVPSERARVGLAPLPGMKGTDYINASYIMGYYRSNEFIITQHPLPHTTKDFWRMIWDHNAQIIVMLPDNQSLAEDEFVYWPSREESMNCEAFTVTLISKDRLCLSNEEQIIIHDFILEATQDDYVLEVRHFQCPKWPNPDAPISSTFELINVIKEEALTRDGPTIVHDEYGAVSAGMLCALTTLSQQLENENAVDVFQVAKMINLMRPGVFTDIEQYQFIYKAMLSLVSTKENGNGPMTVDKNGAVLIADESDPAESMESLV

SEQ ID NO: 807883 - protein, 1246 aa, Homo sapiens
MRRLLEPCWWILFLKITSSVLHYVVCFPALTEGYVGALHENRHGSAVQIRRRKASGDPYWAYSGAYGPEHWVTSSVSCGGRHQSPIDILDQYARVGEEYQELQLDGFDNESSNKTWMKNTGKTVAILLKDDYFVSGAGLPGRFKAEKVEFHWGHSNGSAGSEHSINGRRFPVEMQIFFYNPDDFDSFQTAISENRIIGAMAIFFQVSPRDNSALDPIIHGLKGVVHHEKETFLDPFVLRDLLPASLGSYYRYTGSLTTPPCSEIVEWIVFRRPVPISYHQLEAFYSIFTTEQQDHVKSVEYLRNNFRPQQRLHDRVVSKSAVRDSWNHDMTDFLENPLGTEASKVCSSPPIHMKVQPLNQTALQVSWSQPETIYHPPIMNYMISYSWTKNEDEKEKTFTKDSDKDLKATISHVSPDSLYLFRVQAVCRNDMRSDFSQTMLFQANTTRIFQGTRIVKTGVPTASPASSADMAPISSGSSTWTSSGIPFSFVSMATGMGPSSSGSQATVASVVTSTLLAGLGFGGGGISSFPSTVWPTRLPTAASASKQAARPVLATTEALASPGPDGDSSPTKDGEGTEEGEKDEKSESEDGEREHEEDGEKDSEKKEKSGVTHAAEERNQTEPSPTPSSPNRTAEGGHQTIPGHEQDHTAVPTDQTGGRRDAGPGLDPDMVTSTQVPPTATEEQYAGSDPKRPEMPSKKPMSRGDRFSEDSRFITVNPAEKNTSGMISRPAPGRMEWIIPLIVVSALTFVCLILLIAVLVYWRKCFQTAHFYVEDSSSPRVVPNESIPIIPIPDDMEAIPVKQFVKHIGELYSNNQHGFSEDFEEVQRCTADMNITAEHSNHPENKHKNRYINILAYDHSRVKLRPLPGKDSKHSDYINANYVDGYNKAKAYIATQGPLKSTFEDFWRMIWEQNTGIIVMITNLVEKGRRKCDQYWPTENSEEYGNIIVTLKSTKIHACYTVRRFSIRNTKVKKGQKGNPKGRQNERVVIQYHYTQWPDMGVPEYALPVLTFVRRSSAARMPETGPVLVHCSAGVGRTGTYIVIDSMLQQIKDKSTVNVLGFLKHIRTQRNYLVQTEEQYIFIHDALLEAILGKETEVSSNQLHSYVNSILIPGVGGKTRLEKQFKLVTQCNAKYVECFSAQKECNKEKNRNSSVVPSERARVGLAPLPGMKGTDYINASYIMGYYRSNEFIITQHPLPHTTKDFWRMIWDHNAQIIVMLPDNQSLAEDEFVSAAVFGKKGILYNA

SEQ ID NO: 807884 - protein, 177 aa, Homo sapiens
MFHVSFRYIFGLPPLILVLLPVASSDCDIEGKDGKQYESVLMVSIDQLLDSMKEIGSNCLNNEFNFFKRHICDANKEGMFLFRAARKLRQFLKMNSTGDFDLHLLKVSEGTTILLNCTGQVKGRKPAALGEAQPTKSLEENKSLKEQKKLNDLCFLKRLLQEIKTCWNKILMGTKEH

SEQ ID NO: 807885 - protein, 133 aa, Homo sapiens
MFHVSFRYIFGLPPLILVLLPVASSDCDIEGKDGKQYESVLMVSIDQLLDSMKEIGSNCLNNEFNFFKRHICDANKVKGRKPAALGEAQPTKSLEENKSLKEQKKLNDLCFLKRLLQEIKTCWNKILMGTKEH

SEQ ID NO: 807886 - protein, 126 aa, Homo sapiens
MKEIGSNCLNNEFNFFKRHICDANKEGMFLFRAARKLRQFLKMNSTGDFDLHLLKVSEGTTILLNCTGQVKGRKPAALGEAQPTKSLEENKSLKEQKKLNDLCFLKRLLQEIKTCWNKILMGTKEH

SEQ ID NO: 807887 - protein, 116 aa, Homo sapiens
MKEIGSNCLNNEFNFFKRHICDANKEGMFLFRAARKLRQFLKMNSTGDFDLHLLKVSEGTTILLNCTGQVKGRKPAALGEAQPTKSLSSGLQKQFTFYRSNGRHTHSFHCKLSFLH

SEQ ID NO: 807888 - protein, 106 aa, Homo sapiens
MKEIGSNCLNNEFNFFKRHICDANKEGMFLFRAARKLRQFLKMNSTGDFDLHLLKVSEGTTILLNCTGQVKGRKPAALGEAQPTKSLVELIIPSCMPPLLSSTSNS

SEQ ID NO: 807889 - protein, 827 aa, Homo sapiens
LQDGYFSHRPKEKVRTDSNNENSVPKDFENVDNSNFAPRTQKQKHQPELAKKPPSRQKELLKRKLEQQEKGKGHTFPGKGPGEVLPPGDRAAANSSHGKDVSRPPQARKTGGSSPETKYDQPPKCDISGKEAISALSRAKSKHCRQEIGETYCRHKLGLLMPEKVTRFCPLEGKANKNVQWDEDSVEYMPANPVRIAFVLVVHGRASRQLQRMFKAIYHKDHFYYIHVDKRSNYLHRQVLQVSRQYSNVRVTPWRMATIWGGASLLSTYLQSMRDLLEMTDWPWDFFINLSAADYPIRTNDQLVAFLSRYRDMNFLKSHGRDNARFIRKQGLDRLFLECDAHMWRLGDRRIPEGIAVDGGSDWFLLNRRFVEYVTFSTDDLVTKMKQFYSYTLLPAESFFHTVLENSPHCDTMVDNNLRITNWNRKLGCKCQYKHIVDWCGCSPNDFKPQDFHRFQQTARPTFFARKFEAVVNQEIIGQLDYYLYGNYPAGTPGLRSYWENVYDEPDGIHSLSDVTLTLYHSFARLGLRRAETSLHTDGENSCRYYPMGHPASVHLYFLADRFQGFLIKHHATNLAVSKLETLETWVMPKKVFKIASPPSDFGRLQFSEVGTDWDAKERLFRNFGGLLGPMDEPVGMQKWGKGPNVTVTVIWVDPVNVIAATYDILIESTAEFTHYKPPLNLPLRPGVWTVKILHHWVPVAETKFLVAPLTFSNRQPIKPEEALKLHNGPLRNAYMEQSFQSLNPVLSLPINPAQVEQARRNAASTGTALEGWLDSLVGGMWTAMDICATGPTACPVMQTCSQTAWSSFSPDPKSELGAVKPDGRLR

SEQ ID NO: 807890 - protein, 827 aa, Homo sapiens; identical to SEQ ID NO: 807889

SEQ ID NO: 807891 - protein, 374 aa, Homo sapiens
MVQQTARPTFFARKFEAVVNQEIIGQLDYYLYGNYPAGTPGLRSYWENVYDEPDGIHSLSDVTLTLYHSFARLGLRRAETSLHTDGENSCRYYPMGHPASVHLYFLADRFQGFLIKHHATNLAVSKLETLETWVMPKKVFKIASPPSDFGRLQFSEVGTDWDAKERLFRNFGGLLGPMDEPVGMQKWGKGPNVTVTVIWVDPVNVIAATYDILIESTAEFTHYKPPLNLPLRPGVWTVKILHHWVPVAETKFLVAPLTFSNRQPIKPEEALKLHNGPLRNAYMEQSFQSLNPVLSLPINPAQVEQARRNAASTGTALEGWLDSLVGGMWTAMDICATGPTACPVMQTCSQTAWSSFSPDPKSELGAVKPDGRLR

SEQ ID NO: 807892 - protein, 466 aa, Homo sapiens
LQDGYFSHRPKEKVRTDSNNENSVPKDFENVDNSNFAPRTQKQKHQPELAKKPPSRQKELLKRKLEQQEKGKGHTFPGKGPGEVLPPGDRAAANSSHGKDVSRPPQARKTGGSSPETKYDQPPKCDISGKEAISALSRAKSKHCRQEIGETYCRHKLGLLMPEKVTRFCPLEGKANKNVQWDEDSVEYMPANPVRIAFVLVVHGRASRQLQRMFKAIYHKDHFYYIHVDKRSNYLHRQVLQVSRQYSNVRVTPWRMATIWGGASLLSTYLQSMRDLLEMTDWPWDFFINLSAADYPIRTNDQLVAFLSRYRDMNFLKSHGRDNARFIRKQGLDRLFLECDAHMWRLGDRRIPEGIAVDGGSDWFLLNRRFVEYVTFSTDDLVTKMKQFYSYTLLPAESFFHTVLENSPHCDTMVDNNLRITNWNRKLGCKCQYKHIVDWCGCSPNDFKPQDFHRFQVRLSHGLPAS

SEQ ID NO: 807893 - protein, 107 aa, Homo sapiens
FSCCSELLLLLKSKLLWLKLTSARFPPKAQPSGRSPCPGYLLRYLFRTQGLCKCQFDKHCPDQPWVQTPALPFGSFFCFSWLGDSGASLESHGRGPFPMEAAALGEL

SEQ ID NO: 807894 - protein, 206 aa, Homo sapiens
APLFPRPSPRPFLFPAPRLFPGGGSGSGGPHSSERREEAASRMKCKPNQTRTYDPEGFKKRAACLCFRSEREDEVLLVSSSRYPDRWIVPGGGMEPEEEPGGAAVREVYEEAGVKGKLGRLLGVFEQNQDRKHRTYVYVLTVTELLEDWEDSVSIGRKREWFKVEDAIKVLQCHKPVHAEYLEKLKLGGSPTNGNSMAPSSPDSDP

SEQ ID NO: 807895 - protein, 352 aa, Homo sapiens [sequence omitted]

SEQ ID NO: 807896 - protein, 352 aa, Homo sapiens [sequence omitted]

SEQ ID NO: 807897 - protein, 182 aa, Homo sapiens
SWGRKSGLSRKLRAGFLPGFCRVSPCGSWVVETLVKMACAAARSPADQDRFICIYPAYLNNKKTIAEGRRIPISKAVENPTATEIQDVCSAVGLNVFLEKNKMYSREWNRDVQYRGRVRVQLKQEDGSLCLVQFPSRKSVMLYAAEMIPKLKTRTQKTGGADQSLQQGEGSKKGKGKKQEVT

SEQ ID NO: 807898 - protein, 182 aa, Homo sapiens; identical to SEQ ID NO: 807897

SEQ ID NO: 807899 - protein, 266 aa, Homo sapiens
SWGRKSGLSRKLRAGFLPGFCRVSPCGSWVVETLVKMACAAARSPADQDRFICIYPAYLNNKKTIAEGRRIPISKAVENPTATEIQDVCSAVGLNVFLEKNKMYSREWNRDVQYRGRVRVQLKQEDGSLCLVQFPSRKSVMLYAAEMIPKLKTRTQKTGGADQSLQQGEGSKTTNKQKSRDSRSLSRQLDVHQGAPSVDRDAAGLTSIGGRPPPPRVVLWGQAGPPSMADHAARYSTTGRPGDTGPPWLEWTSSTAARHGGAQPNM

SEQ ID NO: 807900 - protein, 149 aa, Homo sapiens
SWGRKSGLSRKLRAGFLPGFCRVSPCGSWVVETLVKMACAAARSPADQDRFICIYPAYLNNKKTIAEGRRIPISKAVENPTATEIQDVCSAVGLNVFLEKNKMYSREWNRDVQYRGRVRVQLKQEDGSLCLVQFPSHYTLSLTSGSVSQ

SEQ ID NO: 807901 - protein, 100 aa, Homo sapiens
SWGRKSGLSRKLRAGFLPGFCRVSPCGSWVVETLVKMACAAARSPADQDRFICIYPAYLNNKKTIAEGRRIPISKAVENPTATEIQDVCSAVGLNVFLEV

SEQ ID NO: 807902 - protein, 149 aa, Homo sapiens; identical to SEQ ID NO: 807900

SEQ ID NO: 807903 - protein, 140 aa, Homo sapiens
SWGRKSGLSRKLRAGFLPGFCRVSPCGSWVVETLVKMACAAARSPADQDRFICIYPAYLNNKKTIAEGRRIPISKAVENPTATEIQDVCSAVGLNVFLEKNKMYSREWNRDVQYRGRVRVQLKQEDGSLCLVQFPSRKLV

SEQ ID NO: 807904 - protein, 140 aa, Homo sapiens
FFFETGSCSVAQAGVQWHDHSSTQPQSAGLKQSSHFSLLSNWDYRHTPPRPANIFIFCRDGVSYVVQASLEFLGSSEPPILASQNVGNQIFCCIQGEQGGREREREREGDRGRQREREGDRGRQREREGKRQRETEGENT

SEQ ID NO: 807905 - protein, 603 aa, Homo sapiens
HPITTHYRARAAARAVCRSPEGEDGNEMVFCDKCNVCVHQACYGILKVPTGSWLCRTCALGVQPKCLLCPKRGGALKPTRSGTKWVHVSCALWIPEVSIGCPEKMEPITKISHIPASRWALSCSLCKECTGTCIQCSMPSCVTAFHVTCAFDHGLEMRTILADNDEVKFKSFCQEHSDGGPRNEPTSEPTEPSQAGEDLEKVTLRKQRLQQLEEDFYELVEPAEVAERLDLAEALVDFIYQYWKLKRKANANQPLLTPKTDEVDNLAQQEQDVLYRRLKLFTHLRQDLERVRNLCYMVTRRERTKHAICKLQEQIFHLQMKLIEQDLCRAGLSTSFPIDGTFFNSWLAQSVQITAENMAMSEWPLNNGHREDPAPGLLSEELLQDEETLLSFMRDPSLRPGDPARKARGRTRLPAKKKPPPPPPQDGPGSRTTPDKAPKKTWGQDAGSGKGGQGPPTRKPPRRTSSHLPSSPAAGDCPILATPESPPPLAPETPDEAASVAADSDVQVPGPAASPKPLGRLRPPRESKVTRRLPGARPDAGMGPPSAVAERPKVSLHFDTETDGYFSDGEMSDSDVEAEDGGVQRGPREAGAEEVVRMGVLAS

SEQ ID NO: 807906 - protein, 111 aa, Homo sapiens
MEEKRRKYSISSDNSDTTDSHATSTSASRCSKLPSSTKSGWPRQNEKKPSEVFRTDLITAMKIPDSYQLSPDDYYILADPWRQEWEKGVQVPAGAEAIPEPVVRMSQAAQA

SEQ ID NO: 807907 - protein, 791 aa, Homo sapiens
MEEKRRKYSISSDNSDTTDSHATSTSASRCSKLPSSTKSGWPRQNEKKPSEVFRTDLITAMKIPDSYQLSPDDYYILADPWRQEWEKGVQVPAGAEAIPEPVVRILPPLEGPPAQASPSSTMLGEGSQPDWPGGSRYDLDEIDAYWLELINSELKEMERPELDELTLERVLEELETLCHQNMARAIETQEGLGIEYDEDVVCDVCRSPEGEDGNEMVFCDKCNVCVHQACYGILKVPTGSWLCRTCALGVQPKCLLCPKRGGALKPTRSGTKWVHVSCALWIPEVSIGCPEKMEPITKISHIPASRWALSCSLCKECTGTCIQCSMPSCVTAFHVTCAFDHGLEMRTILADNDEVKFKSFCQEHSDGGPRNEPTSEPTEPSQAGEDLEKVTLRKQRLQQLEEDFYELVEPAEVAERLDLAEALVDFIYQYWKLKRKANANQPLLTPKTDEVDNLAQQEQDVLYRRLKLFTHLRQDLERVRNLCYMVTRRERTKHAICKLQEQIFHLQMKLIEQDLCRAGLSTSFPIDGTFFNSWLAQSVQITAENMAMSEWPLNNGHREDPAPGLLSEELLQDEETLLSFMRDPSLRPGDPARKARGRTRLPAKKKPPPPPPQDGPGSRTTPDKAPKKTWGQDAGSGKGGQGPPTRKPPRRTSSHLPSSPAAGDCPILATPESPPPLAPETPDEAASVAADSDVQVPGPAASPKPLGRLRPPRESKVTRRLPGARPDAGMGPPSAVAERPKVSLHFDTETDGYFSDGEMSDSDVEAEDGGVQRGPREAGAEEVVRMGVLAS

SEQ ID NO: 807908 - protein, 813 aa, Homo sapiens
MIISRYRLLFQSVARSGTCRNMMEEKRRKYSISSDNSDTTDSHATSTSASRCSKLPSSTKSGWPRQNEKKPSEVFRTDLITAMKIPDSYQLSPDDYYILADPWRQEWEKGVQVPAGAEAIPEPVVRILPPLEGPPAQASPSSTMLGEGSQPDWPGGSRYDLDEIDAYWLELINSELKEMERPELDELTLERVLEELETLCHQNMARAIETQEGLGIEYDEDVVCDVCRSPEGEDGNEMVFCDKCNVCVHQACYGILKVPTGSWLCRTCALGVQPKCLLCPKRGGALKPTRSGTKWVHVSCALWIPEVSIGCPEKMEPITKISHIPASRWALSCSLCKECTGTCIQCSMPSCVTAFHVTCAFDHGLEMRTILADNDEVKFKSFCQEHSDGGPRNEPTSEPTEPSQAGEDLEKVTLRKQRLQQLEEDFYELVEPAEVAERLDLAEALVDFIYQYWKLKRKANANQPLLTPKTDEVDNLAQQEQDVLYRRLKLFTHLRQDLERVRNLCYMVTRRERTKHAICKLQEQIFHLQMKLIEQDLCRAGLSTSFPIDGTFFNSWLAQSVQITAENMAMSEWPLNNGHREDPAPGLLSEELLQDEETLLSFMRDPSLRPGDPARKARGRTRLPAKKKPPPPPPQDGPGSRTTPDKAPKKTWGQDAGSGKGGQGPPTRKPPRRTSSHLPSSPAAGDCPILATPESPPPLAPETPDEAASVAADSDVQVPGPAASPKPLGRLRPPRESKVTRRLPGARPDAGMGPPSAVAERPKVSLHFDTETDGYFSDGEMSDSDVEAEDGGVQRGPREAGAEEVVRMGVLAS

SEQ ID NO: 807909 - protein, 760 aa, Homo sapiens
MLFYEDPSITGLEERKEASDVFRTDLITAMKIPDSYQLSPDDYYILADPWRQEWEKGVQVPAGAEAIPEPVVRILPPLEGPPAQASPSSTMLGEGSQPDWPGGSRYDLDEIDAYWLELINSELKEMERPELDELTLERVLEELETLCHQNMARAIETQEGLGIEYDEDVVCDVCRSPEGEDGNEMVFCDKCNVCVHQACYGILKVPTGSWLCRTCALGVQPKCLLCPKRGGALKPTRSGTKWVHVSCALWIPEVSIGCPEKMEPITKISHIPASRWALSCSLCKECTGTCIQCSMPSCVTAFHVTCAFDHGLEMRTILADNDEVKFKSFCQEHSDGGPRNEPTSEPTEPSQAGEDLEKVTLRKQRLQQLEEDFYELVEPAEVAERLDLAEALVDFIYQYWKLKRKANANQPLLTPKTDEVDNLAQQEQDVLYRRLKLFTHLRQDLERVRNLCYMVTRRERTKHAICKLQEQIFHLQMKLIEQDLCRAGLSTSFPIDGTFFNSWLAQSVQITAENMAMSEWPLNNGHREDPAPGLLSEELLQDEETLLSFMRDPSLRPGDPARKARGRTRLPAKKKPPPPPPQDGPGSRTTPDKAPKKTWGQDAGSGKGGQGPPTRKPPRRTSSHLPSSPAAGDCPILATPESPPPLAPETPDEAASVAADSDVQVPGPAASPKPLGRLRPPRESKVTRRLPGARPDAGMGPPSAVAERPKVSLHFDTETDGYFSDGEMSDSDVEAEDGGVQRGPREAGAEEVVRMGVLAS

SEQ ID NO: 807910 - protein, 834 aa, Homo sapiens
MEEKRRKYSISSDNSDTTDSHATSTSASRCSKLPSSTKSGWPRQNEKKPSEVFRTDLITAMKIPDSYQLSPDDYYILADPWRQEWEKGVQVPAGAEAIPEPVVRILPPLEGPPAQASPSSTMLGEGSQPDWPGGSRYDLDEIDAYWLELINSELKEMERPELDELTLERVLEELETLCHQNMARAIETQEGLGIEYDEDVVCDVCRSPEGEDGNEMVFCDKCNVCVHQACYGILKVPTGSWLCRTCALGVQPKCLLCPKRGGALKPTRSGTKWVHVSCALWIPEVSIGCPEKMEPITKISHIPASRWALSCSLCKECTGTCIQCSMPSCVTAFHVTCAFDHGLEMRTILADNDEVKFKSFCQEHSDGGPRNEPTSEPTEPSQAGEDLEKVTLRKQRLQQLEEDFYELVEPAEVAERLDLAEALVDFIYQYWKLKRKANANQPLLTPKTDEVDNLAQQEQDVLYRRLKLFTHLRQDLERVRNLCYMVTRRERTKHAICKLQEQIFHLQMKLIEQDLCRERSGRRAKGKKSDSKRKGCEGSKGSTEKKEKVKAGPDSVLGQLAGLSTSFPIDGTFFNSWLAQSVQITAENMAMSEWPLNNGHREDPAPGLLSEELLQDEETLLSFMRDPSLRPGDPARKARGRTRLPAKKKPPPPPPQDGPGSRTTPDKAPKKTWGQDAGSGKGGQGPPTRKPPRRTSSHLPSSPAAGDCPILATPESPPPLAPETPDEAASVAADSDVQVPGPAASPKPLGRLRPPRESKVTRRLPGARPDAGMGPPSAVAERPKVSLHFDTETDGYFSDGEMSDSDVEAEDGGVQRGPREAGAEEVVRMGVLAS

SEQ ID NO: 807911 - protein, 706 aa, Homo sapiens
MEEKRRKYSISSDNSDTTDSHATSTSASRCSKLPSSTKSGWPRQNEKKPSEVFRTDLITAMKIPDSYQLSPDDYYILADPWRQEWEKGVQVPAGAEAIPEPVVRILPPLEGPPAQASPSSTMLGEGSQPDWPGGSRYDLDEIDAYWLELINSELKEMERPELDELTLERVLEELETLCHQNMARAIETQEGLGIDVPCLPASQQFHVTCAFDHGLEMRTILADNDEVKFKSFCQEHSDGGPRNEPTSEPTEPSQAGEDLEKVTLRKQRLQQLEEDFYELVEPAEVAERLDLAEALVDFIYQYWKLKRKANANQPLLTPKTDEVDNLAQQEQDVLYRRLKLFTHLRQDLERVRNLCYMVTRRERTKHAICKLQEQIFHLQMKLIEQDLCRERSGRRAKGKKSDSKRKGCEGSKGSTEKKEKVKAGPDSVLGQLAGLSTSFPIDGTFFNSWLAQSVQITAENMAMSEWPLNNGHREDPAPGLLSEELLQDEETLLSFMRDPSLRPGDPARKARGRTRLPAKKKPPPPPPQDGPGSRTTPDKAPKKTWGQDAGSGKGGQGPPTRKPPRRTSSHLPSSPAAGDCPILATPESPPPLAPETPDEAASVAADSDVQVPGPAASPKPLGRLRPPRESKVTRRLPGARPDAGMGPPSAVAERPKVSLHFDTETDGYFSDGEMSDSDVEAEDGGVQRGPREAGAEEVVRMGVLAS

SEQ ID NO: 807912 - protein, 415 aa, Homo sapiens
LLVHKRVLVQYWKLKRKANANQPLLTPKTDEVDNLAQQEQDVLYRRLKLFTHLRQDLERVRNLCYMVTRRERTKHAICKLQEQIFHLQMKLIEQDLCRERSGRRAKGKKSDSKRKGCEGSKGSTEKKEKVKAGPDSVLGQLAGLSTSFPIDGTFFNSWLAQSVQITAENMAMSEWPLNNGHREDPAPGLLSEELLQDEETLLSFMRDPSLRPGDPARKARGRTRLPAKKKPPPPPPQDGPGSRTTPDKAPKKTWGQDAGSGKGGQGPPTRKPPRRTSSHLPSSPAAGDCPILATPESPPPLAPETPDEAASVAADSDVQVPGPAASPKPLGRLRPPRESKVTRRLPGARPDAGMGPPSAVAERPKVSLHFDTETDGYFSDGEMSDSDVEAEDGGVQRGPREAGAEEVVRMGVLAS

SEQ ID NO: 807913 - protein, 834 aa, Homo sapiens; identical to SEQ ID NO: 807910

SEQ ID NO: 807914 - protein, 246 aa, Homo sapiens
MAMSEWPLNNGHREDPAPGLLSEELLQDEETLLSFMRDPSLRPGDPARKARGRTRLPAKKKPPPPPPQDGPGSRTTPDKAPKKTWGQDAGSGKGGQGPPTRKPPRRTSSHLPSSPAAGDCPILATPESPPPLAPETPDEAASVAADSDVQVPGPAASPKPLGRLRPPRESKVTRRLPGARPDAGMGPPSAVAERPKVSLHFDTETDGYFSDGEMSDSDVEAEDGGVQRGPREAGAEEVVRMGVLAS

SEQ ID NO: 807915 - protein, 882 aa, Homo sapiens
MEEKRRKYSISSDNSDTTDSHATSTSASRCSKLPSSTKSGWPRQNEKKPSEVFRTDLITAMKIPDSYQLSPDDYYILADPWRQEWEKGVQVPAGAEAIPEPVVRILPPLEGPPAQASPSSTMLGEGSQPDWPGGSRYDLDEIDAYWLELINSELKEMERPELDELTLERVLEELETLCHQNMARAIETQEGLGIEYDEDVVCDVCRSPEGEDGNEMVFCDKCNVCVHQACYGILKVPTGSWLCRTCALGVQPKCLLCPKRGGALKPTRSGTKWVHVSCALWIPEVSIGCPEKMEPITKISHIPASRWALSCSLCKECTGTCIQCSMPSCVTAFHVTCAFDHGLEMRTILADNDEVKFKSFCQEHSDGGPRNEPTSEPTEPSQAGEDLEKVTLRKQRLQQLEEDFYELVEPAEVAERLDLAEALVDFIYQYWKLKRKANANQPLLTPKTDEVDNLAQQEQDVLYRRLKLFTHLRQDLERVRNLCYMVTRRERTKHAICKLQEQIFHLQMKLIEQDLCRERSGRRAKGKKSDSKRKGCEGSKGSTEKKEKVKAGPDSVLGQLGELRAMLACRHGRLDHHHACSSVCPAEGQLHRVGELRLKSGNQALACPAGLSTSFPIDGTFFNSWLAQSVQITAENMAMSEWPLNNGHREDPAPGLLSEELLQDEETLLSFMRDPSLRPGDPARKARGRTRLPAKKKPPPPPPQDGPGSRTTPDKAPKKTWGQDAGSGKGGQGPPTRKPPRRTSSHLPSSPAAGDCPILATPESPPPLAPETPDEAASVAADSDVQVPGPAASPKPLGRLRPPRESKVTRRLPGARPDAGMGPPSAVAERPKVSLHFDTETDGYFSDGEMSDSDVEAEDGGVQRGPREAGAEEVVRMGVLAS

SEQ ID NO: 807916 - protein, 145 aa, Homo sapiens
LPTGSDSEGEGATSLAPCLGLAGVLPRASAHIVGLWILALLHWLLLWTGLLLSLCPAEPRCLLGWLAAARGGGWPFIWGALSLPGQALEQSSSGSCLHLQDVQQAARRRMPATHPPPVPSLSPVGHSRFCLFPVYCPQCRGLCCP

SEQ ID NO: 807917 - protein, 337 aa, Homo sapiens
MEEKRRKYSISSDNSDTTDSHATSTSASRCSKLPSSTKSGWPRQNEKKPSEVFRTDLITAMKIPDSYQLSPDDYYILADPWRQEWEKGVQVPAGAEAIPEPVVRILPPLEGPPAQASPSSTMLGEGSQPDWPGGSRYDLDEIDAYWLELINSELKEMERPELDELTLERVLEELETLCHQNMARAIETQEGLGIEYDEDVVCDVCRSPEGEDGNEMVFCDKCNVCVHQACYGILKVPTGSWLCRTCALGVQPKCLLCPKRGGALKPTRSGTKWVHVSCALWIPEVSIGCPEKMEPITKISHIPASRWALSCSLSPVGHSRFCLFPVYCPQCRGLCCP

SEQ ID NO: 807918 - protein, 152 aa, Homo sapiens
MISGLSGRKSSTGSPTSPLNAEKLESEEDVSQAFLEAVAEEKPHVKPYFSKTIRDLEVVEGSAARFDCKIEGYPDPEVVWFKDDQSIRESRHFQIDYDEDGNCSLIISDVCGDDDAKYTCKAVNSLGEATCTAELIVETMEEGEGEGEEEEE

SEQ ID NO: 807919 - protein, 90 aa, Homo sapiens
CRTHAFRIEGYPDPEVVWFKDDQSIRESRHFQIDYDEDGNCSLIISDVCGDDDAKYTCKAVNSLGEATCTAELIVETMEEGEGEGEEEEE

SEQ ID NO: 807920 - protein, 79 aa, Homo sapiens
HSARYADLNVSSSIRESRHFQIDYDEDGNCSLIISDVCGDDDAKYTCKAVNSLGEATCTAELIVETMEEGEGEGEEEEE

SEQ ID NO: 807921 - protein, 79 aa, Homo sapiens
LEDPSQLRANPKSIRESRHFQIDYDEDGNCSLIISDVCGDDDAKYTCKAVNSLGEATCTAELIVETMEEGEGEGEEEEE

SEQ ID NO: 807922 - protein, 152 aa, Homo sapiens; identical to SEQ ID NO: 807918

SEQ ID NO: 807923 - protein, 152 aa, Homo sapiens; identical to SEQ ID NO: 807918

SEQ ID NO: 807924 - protein, 152 aa, Homo sapiens; identical to SEQ ID NO: 807918

SEQ ID NO: 807925 - protein, 152 aa, Homo sapiens; identical to SEQ ID NO: 807918

SEQ ID NO: 807926 - protein, 152 aa, Homo sapiens; identical to SEQ ID NO: 807918

SEQ ID NO: 807927 - protein, 152 aa, Homo sapiens; identical to SEQ ID NO: 807918

SEQ ID NO: 807928 - protein, 127 aa, Homo sapiens
RPPTTTTARIQASNDVRGHVKPYFSKTIRDLEVVEGSAARFDCKIEGYPDPEVVWFKDDQSIRESRHFQIDYDEDGNCSLIISDVCGDDDAKYTCKAVNSLGEATCTAELIVETMEEGEGEGEEEEE

SEQ ID NO: 807929 - protein, 106 aa, Homo sapiens
MCPKLSLRLLLRKSLIAARFDCKIEGYPDPEVVWFKDDQSIRESRHFQIDYDEDGNCSLIISDVCGDDDAKYTCKAVNSLGEATCTAELIVETMEEGEGEGEEEEE

SEQ ID NO: 807930 - protein, 90 aa, Homo sapiens; identical to SEQ ID NO: 807919

SEQ ID NO: 807931 - protein, 152 aa, Homo sapiens; identical to SEQ ID NO: 807918

SEQ ID NO: 807932 - protein, 162 aa, Homo sapiens
MISGLSGRKSSTGSPTSPLNAEKLESEEDVSQAFLEAVAEEKPHVKPYFSKTIRDLEVVEGSAARFDCKIEGYPDPEVVWFKDDQSIRESRHFQIDYDEDGNCSLIISDVCGDDDAKYTCKAVNSLGEATCTAELIVETMVFRISIFQPWKTRARLSINNGV

SEQ ID NO: 807933 - protein, 117 aa, Homo sapiens
LGSLLWQNLGSQEVLVPGNSCFSGAGLYSLQPLALPSWNQGQRLSPTLVSIFQKTGNAVRAIGRLSSMAMISGLSGRKSSTGSPTSPLNAEKLESEGRRSFSSQLVRKKGLGNKGAF

SEQ ID NO: 807934 - protein, 57 aa, Homo sapiens
MGLGWSPERPRCRVGAAAAAAAAAAAAAAGAAAVLTAAAEAGDTCTCKCAHDLCVHS

SEQ ID NO: 807935 - protein, 143 aa, Homo sapiens
FDLWELQLNVRFVFGQRKAISFGLFTPLASVNNAAMNKDMQIPAGAPALSSFQNTPEVELLHRVIPGCPAAPSHGEIPALGERTGSVLSDTCSHSSSVPSPIGQVRLLQALPSVAVRFLCRAGISIPHTLLLFVCLFPVSQGI

SEQ ID NO: 807936 - protein, 201 aa, Homo sapiens
GSWEPDVSGSAAWLASAAFGMATFSGPAGPILSLNPQEDVEFQKEVAQVRKRITQRKKQEQLTPGVVYVRHLPNLLDETQIFSYFSQFGTVTRFRLSRSKRTGNSKGYAFVEFESEDVAKIVAETMNNYLFGERLLECHFMPPEKVHKELFKDWNIPFKQPSYPSVKRYNRNRTLTQKLRMEERFKKKERLLRKKLAKKRN

SEQ ID NO: 807937 - protein, 201 aa, Homo sapiens; identical to SEQ ID NO: 807936

SEQ ID NO: 807938 - protein, 201 aa, Homo sapiens; identical to SEQ ID NO: 807936

SEQ ID NO: 807939 - protein, 201 aa, Homo sapiens; identical to SEQ ID NO: 807936

SEQ ID NO: 807940 - protein, 201 aa, Homo sapiens; identical to SEQ ID NO: 807936

SEQ ID NO: 807941 - protein, 201 aa, Homo sapiens; identical to SEQ ID NO: 807936

SEQ ID NO: 807942 - protein, 201 aa, Homo sapiens; identical to SEQ ID NO: 807936

SEQ ID NO: 807943 - protein, 201 aa, Homo sapiens; identical to SEQ ID NO: 807936

SEQ ID NO: 807944 - protein, 201 aa, Homo sapiens; identical to SEQ ID NO: 807936

SEQ ID NO: 807945 - protein, 201 aa, Homo sapiens; identical to SEQ ID NO: 807936

SEQ ID NO: 807946 - protein, 1004 aa, Homo sapiens
MVQLYNLHPFGSQQVVPCKLEPDRFCGGGRDALFVAAGCKVEAFAVAGQELCQPRCAFSTLGRVLRLAYSEAGDYLVAIEEKNKATFLRAYVNWRNKRTENSRVCIRMIGHNVEGPFSKAFRDQMYIIEMPLSEAPLCISCCPVKGDLLVGCTNKLVLFSLKYQIINEEFSLLDFERSLIIHIDNITPVEVSFCVGYVAVMSDLEVLIVKLESGPKNGERVHHHPHKTNNRIRRTEEGISNEISQLESDDFVICQKPLELLGEKSEQSGLSVTLESTGLADEKRKYSHFQHLLYRRFAPDISSYVLSDDIKLHSLQLLPIYQTGSLTSDGKNLSQEKELLSLFCFFSLPHVGYLYMVVKSVELMSVYQYPEKSQQAVLTPQFLHVITSNNLQCFTVRCSAAAAREEDPYMDTTLKACPPVSMDVCALRIQLFIGLKAICHFKNHIILLTKAEPEAIPERRQSPKRLLSRKDTSVKIKIPPVAEAGWNLYIVNTISPVQLYKEMVDYSNTYKTVKTQSCIHLLSEAHLLVRAALMDASQLEPGEKAELLEAFKESCGHLGDCYSRLDSQHSHLTLPYYKMSGLSMAEVLARTDWTVEDGLQKYERGLIFYINHSLYENLDEELNEELAAKVVQMFYVAEPKQVPHILCSPSMKNINPLTAMSYLRKLDTSGFSSILVTLTKAAVALKMGDLDMHRNEMKSHSEMKLVCGFILEPRLLIQQRKGQIVPTELALHLKETQPGLLVASVLGLQKNNKIGIEEADSFFKVLCAKDEDTIPQLLVDFWEAQLVACLPDVVLQELFFKLTSQYIWRLSKRQPPDTTPLRTSEDLINACSHYGLIYPWVHVVISSDSLADKNYTEDLSKLQSLICGPSFDIASIIPFLEPLSEDTIAGLSVHVLCRTRLKEYEQCIDILLERCPEAVIPYANHELKEENRTLWWKKLLPELCQRIKCGGEKYQLYLSSLKETLSIVAVELELKDFMNVLPEDGTATFFLPYLLYCSRKKPLT

SEQ ID NO: 807947 - protein, 272 aa, Homo sapiens
MVQLYNLHPFGSQQVVPCKLEPDRFCGGGRDALFVAAGCKVEAFAVAGQELCQPRCAFSTLGRVLRLAYSEAGISNEISQLESDDFVICQKPLELLGEKSEQSGLSVTLESTGLADEKRKYSHFQHLLYRRFAPDISSYVLSDDIKLHSLQLLPIYQTGSLTSDGKNLSQEKELLSLFCFFSLPHVGYLYMVVKSVELMSVYQYPEKSQQAVLTPQFLHVITSYQPAGCPVRAQSAGPLERNSLLLPPVGFPPLPAGLRHKTRFYAYTPLRL

SEQ ID NO: 807948 - protein, 890 aa, Homo sapiens
MVQLYNLHPFGSQQVVPCKLEPDRFCGGGRDALFVAAGCKVEAFAVAGQELCQPRCAFSTLGRVLRLAYSEAGDYLVAIEEKNKATFLRAYVNWRNKRTENSRVCIRMIGHNVEGPFSKAFRDQMYIIEMPLSEAPLCISCCPVKGDLLVGCTNKLVLFSLKYQIINEEFSLLDFERSLIIHIDNITPVEVSFCVGYVAVMSDLEVLIVKLESGPKNGERVHHHPHKTNNRIRRTEEGISNEISQLESDDFVICQKPLELLGEKSEQSGLSVTLESTGLADEKRKYSHFQHLLYRRFAPDISSYVLSDDIKLHSLQLLPIYQTGSLTSDGKNLSQEKELLSLFCFFSLPHVGYLYMVVKSVELMSVYQYPEKSQQAVLTPQFLHVITSNNLQCFTVRCSAAAAREEDPYMDTTLKACPPVSMDVCALRIQLFIGLKAICHFKNHIILLTKAEPEAIPERRQSPKRLLSRKDTSVKIKIPPVAEAGWNLYIVNTISPVQLYKEMVDYSNTYKTVKTQSCIHLLSEAHLLVRAALMDASQLEPGEKAELLEAFKESCGHLGDCYSRLDSQHSHLTLPYYKMSGLSMAEVLARTDWTVEDGLQKYERGLIFYINHSLYENLDEELNEELAAKVVQMFYVAEPKQVPHILCSPSMKNINPLTAMSYLRKLDTSGFSSILVTLTKAAVALKMGDLDMHRNEMKSHSEMKLVCGFILEPRLLIQQRKGQIVPTELALHLKETQPGLLVASVLGLQKNNKIGIEEADSFFKVLCAKDEDTIPQLLVDFWEAQLVACLPDVVLQELFFKLTSQYIWRLSKRQPPDTTPLRTSEDLINACSHYGLIYPWVHVVISSDSLADKNYTEDLSKLQLPLFRSWSHFQKTLLPASVSMFCVVHA

SEQ ID NO: 807949 - protein, 689 aa, Homo sapiens
MVQLYNLHPFGSQQVVPCKLEPDRFCGGGRDALFVAAGCKVEAFAVAGQELCQPRCAFSTLGRVLRLAYSEAGISNEISQLESDDFVICQKPLELLGEKSEQSGLSVTLELHSLQLLPIYQTGSLTSDGKNLSQEKELLSLFCFFSLPHVGYLYMVVKSVELMSVYQYPEKSQQAVLTPQFLHVITSNNLQCFTVRCSAAAAREEDPYMDTTLKACPPVSMDVCALRIQLFIGLKAICHFKNHIILLTKAEPEAIPERRQSPKRLLSRKDTSVKIKIPPVAEAGWNLYIVNTISPVQLYKEMVDYSNTYKTVKTQSCIHLLSEAHLLVRAALMDASQLEPGEKAELLEAFKESCGHLGDCYSRLDSQHSHLTLPYYKMSGLSMAEVLARTDWTVEDGLQKYERGLIFYINHSLYENLDEELNEELAAKVVQMFYVAEPKQVPHILCSPSMKNINPLTAMSYLRKLDTSGFSSILVTLTKAAVALKMGDLDMHRNEMKSHSEMKLVCGFILEPRLLIQQRKGQIVPTELALHLKETQPGLLVASVLGLQKNNKIGIEEADSFFKVLCAKDEDTIPQLLVDFWEAQLVACLPDVVLQELFFKLTSQYIWRLSKRQPPDTTPLRTSEDLINACSHYGLIYPWVHVVISSDSLADKNYTEDLSKLQLPLFRSWSHFQKTLLPASVSMFCVVHA

SEQ ID NO: 807950 - protein, 331 aa, Homo sapiens
KYWISSTTRSAHLTLPYYKMSGLSMAEVLARTDWTVEDGLQKYERGLIFYINHSLYENLDEELNEELAAKVVQMFYVAEPKQVPHILCSPSMKNINPLTAMSYLRKLDTSGFSSILVTLTKAAVALKMGDLDMHRNEMKSHSEMKLVCGFILEPRLLIQQRKGQIVPTELALHLKETQPGLLVASVLGLQKNNKIGIEEADSFFKVLCAKDEDTIPQLLVDFWEAQLVACLPDVVLQELFFKLTSQYIWRLSKRQPPDTTPLRTSEDLINACSHYGLIYPWVHVVISSDSLADKNYTEDLSKLQLPLFRSWSHFQKTLLPASVSMFCVVHA

SEQ ID NO: 807951 - protein, 1004 aa, Homo sapiens; identical to SEQ ID NO: 807946

SEQ ID NO: 807952 - protein, 1020 aa, Homo sapiens
MVQLYNLHPFGSQQVVPCKLEPDRFCGGGRDALFVAAGCKVEAFAVAGQELCQPRCAFSTLGRVLRLAYSEAGDYLVAIEEKNKATFLRAYVNWRNKRTENSRVCIRMIGHNVEGPFSKAFRDQMYIIEMPLSEAPLCISCCPVKGDLLVGCTNKLVLFSLKYQIINEEFSLLDFERSLIIHIDNITPVEVSFCVGYVAVMSDLEVLIVKLESGPKNGERVHHHPHKTNNRIRRTEEGISNEISQLESDDFVICQKPLELLGEKSEQSGLSVTLESTGLADEKRKYSHFQHLLYRRFAPDISSYVLSDDIKLHSLQLLPIYQTGSLTSDGKNLSQEKELLSLFCFFSLPHVGYLYMVVKSVELMSVYQYPEKSQQAVLTPQFLHVITSNNLQCFTVRCSAAAAREEDPYMDTTLKACPPVSMDVCALRIQLFIGLKAICHFKNHIILLTKAEPEAIPERRQSPKRLLSRKDTSVKIKIPPVAEAGWNLYIVNTISPVQLYKEMVDYSNTYKTVKTQSCIHLLSEAHLLVRAALMDASQLEPGEKAELLEAFKESCGHLGDCYSRLDSQHSHLTLPYYKMSGLSMAEVLARTDWTVEDGLQKYERGLIFYINHSLYENLDEELNEELAAKVVQMFYVAEPKQVPHILCSPSMKNINPLTAMSYLRKLDTSGFSSILVTLTKAAVALKMGDLDMHRNEMKSHSEMKLVCGFILEPRLLIQQRKGQIVPTELALHLKETQPGLLVASVLGLQKNNKIGIEEADSFFKVLCAKDEDTIPQLLVDFWEAQLVACLPDVVLQELFFKLTSQYIWRLSKRQPPDTTPLRTSEDLINACSHYGLIYPWVHVVISSDSLADKNYTEDLSKLQSLICGPSFDIASIIPFLEPLSEDTIAGLSVHVLCRTRLKEYEQCIDILLERCPEAVIPYANHELKEENRTLWWKKLLPELCQRIKCGGEKYQLYLSSLKETLSIVAVELELKDFTTSIQFIPSSTSKTMLKQSKLSSLTLRAKSRSTYYNFHLRFSI

SEQ ID NO: 807953 - protein, 467 aa, Homo sapiens
MVQLYNLHPFGSQQVVPCKLEPDRFCGGGRDALFVAAGCKVEAFAVAGQELCQPRCAFSTLGRVLRLAYSEAGDYLVAIEEKNKATFLRAYVNWRNKRTENSRVCIRMIGHNVEGPFSKAFRDQMYIIEMPLSEAPLCISCCPVKGDLLVGCTNKLVLFSLKYQIINEEFSLLDFERSLIIHIDNITPVEVSFCVGYVAVMSDLEVLIVKLESGPKNGERVHHHPHKTNNRIRRTEEGISNEISQLESDDFVICQKPLELLGEKSEQSGLSVTLESTGLADEKRKYSHFQHLLYRRFAPDISSYVLSDDIKLHSLQLLPIYQTGSLTSDGKNLSQEKELLSLFCFFSLPHVGYLYMVVKSVELMSVYQYPEKSQQAVLTPQFLHVITSNNLQCFTVRCSAAAAREEDPYMDTTLKACPPVSMDVCALRIQLFIGLKAICHFKNHIILLTKAEPEAIPERRQSPKRLL

SEQ ID NO: 807954 - protein, 117 aa, Homo sapiens
MKWTRVGPTEKKLPTHGSLTLQQRPCHSTCQPLPACRGAGAERFVPLLEPGKGTGSLLESWEVQPRFYIKIQRLAHVLGECSYSSGMKVLSVPYPPSFSPVLHTHIPGSLSLVRRLN

SEQ ID NO: 807955 - protein, 149 aa, Homo sapiens
MPTTTALRWTAAARVRRKGRGGWVPAALRSVSQDRVPGCTVMGGETRSPENAVDFTGRCYFTKICKCKLKDIACLKCGNIVGYHVIVPCSSCLLSCNNGHFWMFHSQAVYDINRLDSTGVNVLLWGNLPEIEESTDEDVLNISAEECIR

SEQ ID NO: 807956 - protein, 73 aa, Homo sapiens
VLGWDPGCPPGLGDTGGGRPMITRDANDDCPTVDRGCPCAEERERRLGAGCAAVREPGQSPRLYSDGRRDSQS

SEQ ID NO: 807957 - protein, 149 aa, Homo sapiens
MSTNICSFKDRCVSILCCKFCKQVLSSRGMKAVLLADTEIDLFSTDIPPTNAVDFTGRCYFTKICKCKLKDIACLKCGNIVGYHVIVPCSSCLLSCNNGHFWMFHSQAVYDINRLDSTGVNVLLWGNLPEIEESTDEDVLNISAEECIR

SEQ ID NO: 807958 - protein, 149 aa, Homo sapiens; identical to SEQ ID NO: 807957

SEQ ID NO: 807959 - protein, 149 aa, Homo sapiens; identical to SEQ ID NO: 807957

SEQ ID NO: 807960 - protein, 149 aa, Homo sapiens; identical to SEQ ID NO: 807957

SEQ ID NO: 807961 - protein, 121 aa, Homo sapiens
MTGAVLLADTEIDLFSTDIPPTNAVDFTGRCYFTKICKCKLKDIACLKCGNIVGYHVIVPCSSCLLSCNNGHFWMFHSQAVYDINRLDSTGVNVLLWGNLPEIEESTDEDVLNISAEECIR

SEQ ID NO: 807962 - protein, 120 aa, Homo sapiens
MKAVLLADTEIDLFSTDIPPTNAVDFTGRCYFTKICKCKLKDIACLKCGNIVGYHVIVPCSSCLLSCNNGHFWMFHSQAVYDINRLDSTGVNVLLWGNLPEIEESTDEDVLNISAEECIR

SEQ ID NO: 807963 - protein, 120 aa, Homo sapiens; identical to SEQ ID NO: 807962

SEQ ID NO: 807964 - protein, 140 aa, Homo sapiens
MSTNICSFKDRCVSILCCKFCKQVLSSRGMKAVLLADTEIDLFSTDIPPTNAVDFTGRCYFTKICKCKLKDIACLKCGNIVGYHVIVPCSSCLLSCNNGHFWMFHSQAVYDINRLDSTDFCKMPRGELGLFLFSNLPFTE

SEQ ID NO: 807965 - protein, 432 aa, Homo sapiens
SLPLPPLSARCLLSSCCQELTASRAGILCSLCAQSPTMSANATLKPLCPILEQMSRLQSHSNTSIRYIDHAAVLLHGLASLLGLVENGVILFVVGCRMRQTVVTTWVLHLALSDLLASASLPFFTYFLAVGHSWELGTTFCKLHSSIFFLNMFASGFLLSAISLDRCLQVVRPVWAQNHRTVAAAHKVCLVLWALAVLNTVPYFVFRDTISRLDGRIMCYYNVLLLNPGPDRDATCNSRQAALAVSKFLLAFLVPLAIIASSHAAVSLRLQHRGRRRPGRFVRLVAAVVAAFALCWGPYHVFSLLEARAHANPGLRPLVWRGLPFVTSLAFFNSVANPVLYVLTCPDMLRKLRRSLRTVLESVLVDDSELGGAGSSRRRRTSSTARSASPLALCSRPEEPRGPARLLGWLLGSCAASPQTGPLNRALSSTSS

SEQ ID NO: 807966 - protein, 212 aa, Homo sapiens
SGRDDQGRRAQCSAARCGRPSGGVMEDERSFSDICGGRLALQRRYYSPSCREFCLSCPRLSLRSLTAVTCTVWLAAYGLFTLCENSMILSAAIFITLLGLLGYLHFVKIDQETLLIIDSLGIQMTSSYASGKESTTFIEMGKVKDIVINEAIYMQKVIYYLCILLKDPVEPHGISQVVPVFQSAKPRLDCLIEVYRSCQEILAHQKATSTSP

SEQ ID NO: 807967 - protein, 231 aa, Homo sapiens
SGRDDQGRRAQCSAARCGRPSGGVMEDERSFSDICGGRLALQRRYYSPSCREFCLSCPRLSLRSLTAVTCTVWLAAYGLFTLCENSMILSAAIFITLLGLLGYLHFVKIDQETLLIIDSLGIQMTSSYASGKESTTFIEMGKVKDIVINEAIYMQKVIYYLCILLKDPVEPHGISQVVPVFQRQSLTLSPRLECSDNHHSLQPPPPGLKKSSCLSLLRTWDYRVPSPGWTA

SEQ ID NO: 807968 - protein, 157 aa, Homo sapiens
SGRDDQGRRAQCSAARCGRPSGGVMEDERSFSDICGGRLALQRRYYSPSCREFCLSCPRLSLRSLTAVTCTVWLAAYGLFTLCENSMILSAAIFITLLGLLGYLHFVKIDQETLLIIDSLGIQMTSSYASGKESTTFIEMGKVKDIVINEAIYMVSI

SEQ ID NO: 807969 - protein, 184 aa, Homo sapiens
SGRDDQGRRAQCSAARCGRPSGGVMEDERSFSDICGGRLALQRRYYSPSCREFCLSCPRLSLRSLTAVTCTVWLAAYGLFTLCENSMILSAAIFITLLGLLGYLHFVKIDQETLLIIDSLGIQMTSSYASGKESTTFIEMGKVKDIVINEAIYMSAKPRLDCLIEVYRSCQEILAHQKATSTSP

SEQ ID NO: 807970 - protein, 101 aa, Homo sapiens
YYSPSCREFCLSCPRLSLRSLTAVTCTVWLAAYGLFTLCEVMASRPLPALEGGGSALGGSLGSLVEPGPLVGPSYSDRTGGRELTGSGDDIPLLDSSLNDV

SEQ ID NO: 807971 - protein, 212 aa, Homo sapiens; identical to SEQ ID NO: 807966

SEQ ID NO: 807972 - protein, 217 aa, Homo sapiens
SGRDDQGRRAQCSAARCGRPSGGVMEDERSFSDICGGRLALQRRYYSPSCREFCLSCPRLSLRSLTAVTCTVWLAAYGLFTLCENSMILSAAIFITLLGLLGYLHFVKIDQETLLIIDSLGIQMTSSYASGKESTTFIEMGKVKDIVINEAIYMQKVIYYLCILLKDPVEPHGISQVVPVFQAAWCIHSKLATRPSCFLNRTLPGPSGQPSQEPIPC

SEQ ID NO: 807973 - protein, 214 aa, Homo sapiens
AAAADIRKALLILHDSPHSAARTARRRYYSPSCREFCLSCPRLSLRSLTAVTCTVWLAAYGLFTLCENSMILSAAIFITLLGLLGYLHFVKIDQETLLIIDSLGIQMTSSYASGKESTTFIEMGKVKDIVINEAIYMQKVIYYLCILLKDPVEPHGISQVVPVFQRQSLTLSPRLECSDNHHSLQPPPPGLKKSSCLSLLRTWDYRVPSPGWTA

SEQ ID NO: 807974 - protein, 96 aa, Homo sapiens
VRLKPLNSVRRIGEISYLSRSLLLNGSQICINEAYIQNQKVIYYLCILLKDPVEPHGISQVVPVFQSAKPRLDCLIEVYRSCQEILAHQKATSTSP

SEQ ID NO: 807975 - protein, 336 aa, Homo sapiens
MIYTCHRDKNCVINKVTRNRCQYCRLQKCFEVGMSKESVRNDRNKKKKETSKQECTESYEMTAELDDLTEKIRKAHQETFPSLCQLGKYTTNSSADHRVRLDLGLWDKFSELATKCIIKIVEFAKRLPGFTGLTIADQITLLKAACLDILILRICTRYTPEQDTMTFSDGLTLNRTQMHNAGFGPLTDLVFTFANQLLPLEMDDTETGLLSAICLICGDRQDLEEPTKVDKLQEPLLEALKIYIRKRRPSKPHMFPKILMKITDLRSISAKGAERVITLKMEIPGSMPPLIQEMLENSEGHEPLTPSSSGNTAEHSPSISPSSVENSGVSQSPLVQ

SEQ ID NO: 807976 - protein, 448 aa, Homo sapiens
MFDCMDVLSVSPGQILDFYTASPSSCMLQEKALKACFSGLTQTEWQHRHTAQSIETQSTSSEELVPSPPSPLPPPRVYKPCFVCQDKSSGYHYGVSACEGCKGFFRRSIQKNMIYTCHRDKNCVINKVTRNRCQYCRLQKCFEVGMSKESVRNDRNKKKKETSKQECTESYEMTAELDDLTEKIRKAHQETFPSLCQLGKYTTNSSADHRVRLDLGLWDKFSELATKCIIKIVEFAKRLPGFTGLTIADQITLLKAACLDILILRICTRYTPEQDTMTFSDGLTLNRTQMHNAGFGPLTDLVFTFANQLLPLEMDDTETGLLSAICLICGDRQDLEEPTKVDKLQEPLLEALKIYIRKRRPSKPHMFPKILMKITDLRSISAKGAERVITLKMEIPGSMPPLIQEMLENSEGHEPLTPSSSGNTAEHSPSISPSSVENSGVSQSPLVQ

SEQ ID NO: 807977 - protein, 66 aa, Homo sapiens
RPPGPLDIPEIAAHNCTFPGQETSPAGERGPPPSPEPRPAEPATRSPAAIRPSRQLKKSLSRDLEK

SEQ ID NO: 807978 - protein, 215 aa, Homo sapiens
RPPGPLDIPEIAAHNCTFPGQETSPAGERGPPPSLSPLPALPPRSGPAARCAPSPPTLPAPCGGRALPAAEEGRGLGTCCRFPPAEFGPAPPGFQVGAVEGGSLPLHPGSRLRVRASWRVPCIPHFPPAQPSLGRLMIALAVSVKIPTLRGLRTLRGQRGGRLCGIRRGPGHILPVQEINNDYKIAKEVTFKRSGEVRWPNKSLYQSSSPQEHQI

SEQ ID NO: 807979 - protein, 207 aa, Homo sapiens
MALLFARSLRLCRWGAKRLGVASTEAQRGVSFKLEEKTAHSSLALFRDDTGVKYGLVGLEPTKVALNVERFREWAVVLADTAVTSGRHYWEVTVKRSQQFRIGVADVDMSRDSCIGVDDRSWVFTYAQRKWYTMLANEKAPVEGIGQPEKVGLLLEYEAQKLSLVDVSQVSVVHTLQTDFRGPVVPAFALWDGELLTHSGLEVPEGL

SEQ ID NO: 807980 - protein, 207 aa, Homo sapiens; identical to SEQ ID NO: 807979

SEQ ID NO: 807981 - protein, 207 aa, Homo sapiens; identical to SEQ ID NO: 807979

SEQ ID NO: 807982 - protein, 152 aa, Homo sapiens
MALLFARSLRLCRWGAKRLGVASTEAQRGVSFKLEEKTAHSSLALFRDDTGVKYGLVGLEPTKVALNVERFREWAVVLADTAVTSGRHYWEVTVKRSQQFRIGVADVDMSRDSCIGVDDRSWVFTYAQRKWYTMLANEKPPFPHPPTLLPIS

SEQ ID NO: 807983 - protein, 179 aa, Homo sapiens
MCPTLNDLERDSLKGHGPNEKDGRAVVRSPFKHSTVILLQLSEFYKHLEASLCAAGRDWPPHTSPCSASQGQSLVRAQEKRACRRQGAGVSIALSQTEPEHFISYISGFSVFPDPKDFLASHAHGPSAGGAPSLLLLLPCALLHRLLRPDAPAHPRSLVPSVLQRERRPCGRPGLGHRL

SEQ ID NO: 807984 - protein, 90 aa, Homo sapiens
PKLIWSLHVRPMFKVSVELQIFKLGNSYQREKHNGGREEVTKVATQKHRQSPLNWTSSHFGEVIPITDRQDRVNAPILPENKERDESVRP

SEQ ID NO: 807985 - protein, 223 aa, Homo sapiens; identical to SEQ ID NO: 806206

SEQ ID NO: 807986 - protein, 108 aa, Homo sapiens
MHETQHTTHTLLPQVSLTCVALGNRHVMAELFFVQTRTHLPLQDLRFLTTLLASRRLLHPAEDAIPRGPERLDMGGMWQSSWKTLEQVSQQNSSPPSRHTSHSSKFLI

SEQ ID NO: 807987 - protein, 159 aa, Homo sapiens
MHETQHTTHTLLPQVSLTCVALGNRHVMAELFFVQTRCGVLSVPLKCGAEEQAPFSTFPCPCACSWFSRVRGKEKAWGLHLIYQLFLRTHLPLQDLRFLTTLLASRRLLHPAEDAIPRGPERLDMGGMWQSSWKTLEQVSQQNSSPPSRHTSHSSKFLI

SEQ ID NO: 807988 - protein, 212 aa, Homo sapiens
FPPRVFLPDPGPGSRPGASWWGERREPICPQGARGAGPAPARHMAAATSLRTPRRRAQLARGPSEAPGRPGAKQQLSGEAPASGDRDVPPHFPLPVSYYVGTLGTHTEIKRVAEEKVTLPCHHQLGLPEKDTLDIEWLLTDNEGNQKVVITYSSRHVYNNLTEEQKGRVAFASNFLAGDASLQIEPLKPSDEGRYTCKVKNSAGATCGAMSS

SEQ ID NO: 807989 - protein, 862 aa, Homo sapiens
MLRNSTFKNMQRRHTTLREKGRRQAIRGPAYMFNEKGTSLTPEEERFLDSAEYGNIPVVRKMLEESKTLNFNCVDYMGQNALQLAVGNEHLEVTELLLKKENLARVGDALLLAISKGYVRIVEAILNHPAFAQGQRLTLSPLEQELRDDDFYAYDEDGTRFSHDITPIILAAHCQEYEIVHILLLKGARIERPHDYFCKCNECTEKQRKDSFSHSRSRMNAYKGLASAAYLSLSSEDPVLTALELSNELARLANIETEFKNDYRKLSMQCKDFVVGVLDLCRDTEEVEAILNGDVNFQVWSDHHRPSLSRIKLAIKYEVKKFVAHPNCQQQLLTMWYENLSGLRQQSIAVKFLAVFGVSIGLPFLAIAYWIAPCSKLGRTLRSPFMKFVAHAVSFTIFLGLLVVNASDRFEGVKTLPNETFTDYPKQIFRVKTTQFSWTEMLIMKWVLGMIWSECKEIWEEGPREYVLHLWNLLDFGMLSIFVASFTARFMAFLKATEAQLYVDQHVQDDTLHNVSLPPEVAYFTYARDKWWPSDPQIISEGLYAIAVVLSFSRIAYILPANESFGPLQISLGRTVKDIFKFMVIFIMVFVAFMIGMFNLYSYYRGAKYNPAFTTVEESFKTLFWSIFGLSEVISVVLKYDHKFIENIGYVLYGVYNVTMVVVLLNMLIAMINNSYQEIEEDADVEWKFARAKLWLSYFDEGRTLPAPFNLVPSPKSFYYLIMRIKMCLIKLCKSKAKSCENDLEMGMLNSKFKKTRYQAGMRNSENLTANNTLSKPTRYQKIMKRLIKRYVLKAQVDRENDEVNEGELKEIKQDISSLRYELLEEKSQATGELADLIQQLSEKFGKNLNKDHLRVNKGKDI

SEQ ID NO: 807990 - protein, 140 aa, Homo sapiens
MRIKMCLIKLCKSKAKSCENDLEMGMLNSKFKKTRYQAGMRNSENLTANNTLSKPTRYQKIMKRLIKRYVLKAQVDRENDEVNEGELKEIKQDISSLRYELLEEKSQATGELADLIQQLSEKFGKNLNKDHLRVNKGKDI

SEQ ID NO: 807991 - protein, 828 aa, Homo sapiens
MNSDQDVALKLAQERAEIVAKYDRGREGAEIEPWEDADYLVYKVTDRFGFLHEEELPDHNVAVERQKHLEIERTTKWLKMLKGWEKYKNTEKFHRRIYKGIPLQLRGEVWALLLEIPKMKEETRDLYSKLKHRARGCSPDIRQIDLDVNRTFRDHIMFRDRYGVKQQSLFHVLAAYSIYNTEVGYCQGMSQITALLLMYMNEEDAFWALVKLFSGPKHAMHGFFVQGFPKLLRFQEHHEKILNKFLSKLKQHLDSQEIYTSFYTMKWFFQCFLDRTPFTLNLRIWDIYIFEGERVLTAMSYTILKLHKKHLMKLSMEELVEFFQETLAKDFFFEDDFVIEQLQISMTELKRAKLDLPEPGKEDEYPKKPLGQLPPELQSWGVHHLSNGQRSVGRPSPLASGRRESGAPHRRHEHSPHPQSRTGTPERAQPPRRKSVEEESKKLKDEADFQRKLPSGPQDSSRQYNHAAANQNSNATSNIRKEFVPKWNKPSDVSATERTAKYTMEGKGRAAHPALAVTVPGPAEVRVSNVRPKMKALDAEDGKRGSTASQYDNVPGPELDSGASVEEALERAYSQSPRHALYPPSPRKHAEPSSSPSKVSNKFTFKVQPPSHARYPSQLDGEARGLAHPPSYSNPPVYHGNSPKHFPTANSSFASPQFSPGTQLNPSRRPHGSTLSVSASPEKSYSRPSPLVLPSSRIEVLPVDTGAGGYSGNSGSPKNGKLIIPPVDYLPDNRTWSEVSYTYRPETQGQSWTRDASRGNLPKYSAFQLAPFQDHGLPAVSVDSPVRYKASPAAEDASPSGYPYSGPPPPAYHYRNRDGLSIQESVLL

SEQ ID NO: 807992 - protein, 102 aa, Homo sapiens
MMTICGVVRSYNFSTCYCECLINGSTSVKSIISQYQELHFGLHVLSQIYVVQVTLYHVNGEKSGYYEISNINQMYMWSCNVIEGTQCSQTLMQYLVLLSQIF

SEQ ID NO: 807993 - protein, 65 aa, Homo sapiens
MRKLPWQDQEVKDYVICCMINIWNVKYNSIHCVANLLAGLVLYQEDVGIHVVDGVLEDIRLGMEV

SEQ ID NO: 807994 - protein, 765 aa, Homo sapiens
MNSDQDVALKLAQERAEIVAKYDRGREGAEIEPWEDADYLVYKVTDRFGFLHEEELPDHNVAVERQKHLEIERTTKWLKMLKGWEKYKNTEKFHRRIYKGIPLQLRGEVWALLLEIPKMKEETRDLYSKLKHRARGCSPDIRQIDLDVNRTFRDHIMFRDRYGVKQQSLFHVLAAYSIYNTEVGYCQGMSQITALLLMYMNEEDAFWALVKLFSGPKHAMHGFFVQGFPKLLRFQEHHEKILNKFLSKLKQHLDSQEIYTSFYTMKWFFQCFLDRTPFTLNLRIWDIYIFEGERVLTAMSYTILKLHKKHLMKLSMEELVEFFQETLAKDFFFEDDFVIEQLQISMTELKRAKLDLPEPGKEDEYPKKPLGQLPPELQSWGVHHLSNGQRSVGRPSPLASGRRESGAPHRRHEHSPHPQSRTGTPERAQPPRRKSVEEESKKLKDEADFQRKLPSGPQDSSRQYNHAAANQNSNATSNIRKEFVPKWNKPSDVSATERTAKYTMEGKGRAAHPALAVTVPGPAEVRVSNVRPKMKALDAEDGKRGSTASQYDNVPGPELDSGASVEEALERAYSQSPRHALYPPSPRKHAEPSSSPSKVSNKFTFKVQPPSHARYPSQLDGEARGLAHPPSYSNPPVYHGNSPKHFPTANSSFASPQFSPGTQLNPSRRPHGSTLSVSASPEKSYSRPSPLVLPSSRIEVLPVDTGAGGYSGNSGSPKNGKLIIPPVDYLPDNRTWSEVSYTYRPETQGQSWTRDASRGNLPFCR

SEQ ID NO: 807995 - protein, 828 aa, Homo sapiens; identical to SEQ ID NO: 807991

SEQ ID NO: 807996 - protein, 341 aa, Homo sapiens
VGPTAAAVDGVELVLGEGVSHVVVVAKDEHAPCQVAHLGTQLRREGAAVALLVLVRAAAPAAQHVAPVGWAAHPRPRTPRSLARALRCPGPRRLQPRRPGYPPRPAHGPRGGRRGAVGAPQTLEAEAERKALVEAHAGPQPEDEPQYSMEAKPEEHQPQDERSPLHGRAGAAGIILKRGGLPADHRTPRSPRSPARFPFKELPRDAPGTSPSSPTPRLSGGPARPHGRPPSGPGLARPGPGLAGRGPGLPPTQYGRQDVRDAPRPRPSPGPRPNSQAPPPWAVRSPMGWRGEQEPRRPARELPANGRAARQRPPDAGHRRDPRPPGLGWIGSLGRACVRQS

SEQ ID NO: 807997 - protein, 341 aa, Homo sapiens; identical to SEQ ID NO: 807996

SEQ ID NO: 807998 - protein, 94 aa, Homo sapiens
GQKEPMFMAAEVTLSEPAHTSKQAEACEAGAEFLTPTSALQGTCGPVGAQTANLGLNVDMPVMRVASVAPARQSRMNVGFFSRSQMELGRVSLT

SEQ ID NO: 807999 - protein, 130 aa, Homo sapiens
GWGKAPVMEKQSPALGVTGSQVVDTLFPLGRPRRNFRSSPGNPAIALPEVAWPTVRNPEAGTRLRWIEAAMLEAAGLLPVIQPRSRWVLTRSHLVDSRQGTQDSHLLPPPMRLLEEGRPEGEASLTLLFA

SEQ ID NO: 808000 - protein, 465 aa, Homo sapiens
MTLSTEMSDASGLAEETDIDVVGEGEDEEDEEEEDDDEGGGGGPRLAVPAQRRRRRRSYAGEDELEDLEEEEDDDDILLAPPAGGSPAPPGPAPAAGAGAGGGGGGGGAGGGGSAGSGAKNPLVKPPYSYIALITMAILQSPKKRLTLSEICEFISGRFPYYREKFPAWQNSIRHNLSLNDCFVKIPREPGNPGKGNYWTLDPESADMFDNGSFLRRRKRFKRQPLLPPNAAAAESLLLRGAGAAGGAGDPAAAAALFPPAPPPPPHAYGYGPYGCGYGLQLPPYAPPSALFAAAAAAAAAAAFHPHSPPPPPPPHGAAAELARTAFGYRPHPLGAALPGPLPASAAKAGGPGASALARSPFSIESIIGGSLGPAAAAAAAAQAAAAAQASPSPSPVAAPPAPGSSGGGCAAQAAVGPAAALTRSLVAAAAAAASSVSSSAALGTLHQGTALSSVENFTARISNC

SEQ ID NO: 808001 - protein, 393 aa, Homo sapiens
MTLSTEMSDASGLAEETDIDVVGEGEDEEDEEEEDDDEGGGSAGSGAKNPLVKPPYSYIALITMAILQSPKKRLTLSEICEFISGRFPYYREKFPAWQNSIRHNLSLNDCFVKIPREPGNPGKGNYWTLDPESADMFDNGSFLRRRKRFKRQPLLPPNAAAAESLLLRGAGAAGGAGDPAAAAALFPPAPPPPPHAYGYGPYGCGYGLQLPPYAPPSALFAAAAAAAAAAAFHPHSPPPPPPPHGAAAELARTAFGYRPHPLGAALPGPLPASAAKAGGPGASALARSPFSIESIIGGSLGPAAAAAAAAQAAAAAQASPSPSPVAAPPAPGSSGGGCAAQAAVGPAAALTRSLVAAAAAAASSVSSSAALGTLHQGTALSSVENFTARISNC

SEQ ID NO: 808002 - protein, 153 aa, Homo sapiens
MTLSTEMSDASGLAEETDIDVVGEGEDEEDEEEEDDDEGGGSAGSGAKNPLVKPPYSYIALITMAILQSPKKRLTLSEICEFISGRFPYYREKFPAWQNSIRHNLSLNDCFVKIPREPGNPGKGNYWTLDPEVRRLGDSAPRDCPVQCRELYC

SEQ ID NO: 808003 - protein, 80 aa, Homo sapiens
MVDPPGLQEEGKKPMEFSDKTVNSPGAPFGSAGPSIYAKPTYATAPQPPTWGREEEGAGEGSPPCPGTRGSLDVWQMKNN

SEQ ID NO: 808004 - protein, 465 aa, Homo sapiens; identical to SEQ ID NO: 808000

SEQ ID NO: 808005 - protein, 195 aa, Homo sapiens
MTLSTEMSDASGLAEETDIDVVGEGEDEEDEEEEDDDEGGGSAGSGAKNPLVKPPYSYIALITMAILQSPKKRLTLSEICEFISGRFPYYREKFPAWQNSIRHNLSLNDCFVKIPREPGNPGKGNYWTLDPESADMFDNGSFLRRRKRFKRQPLLPPNAAAAAASSVSSSAALGTLHQGTALSSVENFTARISNC

SEQ ID NO: 808006 - protein, 393 aa, Homo sapiens; identical to SEQ ID NO: 808001

SEQ ID NO: 808007 - protein, 158 aa, Homo sapiens [sequence omitted]

SEQ ID NO: 808008 - protein, 68 aa, Homo sapiens
TSNITSEFTSNITSEFTSNAPRDAELIEPWRPSLGELLARPEALTPSNLFLLAVLGALASASATVLAW

SEQ ID NO: 808009 - protein, 239 aa, Homo sapiens
MTHALQELAAAQGSFEVAFPDAAEKMKKVITQLKEAQACIPPCGLQEFARRFLCSGCYSRVCDLPLDCPVQDVTVTRGDQAMFSCIVNFQLPKEEITYSWKFAGGGLRTQDLSYFRDMPRAEGYLARIRPAQLTHRGTFSCVIKQDQRPLARLYFFLNVTGPPPRAETELQASFREVLRWAPRDAELIEPWRPSLGELLARPEALTPSNLFLLAVLGALASASATVLAWMFFRWYCSGN

SEQ ID NO: 808010 - protein, 158 aa, Homo sapiens [sequence omitted]

SEQ ID NO: 808011 - protein, 186 aa, Homo sapiens
MTHALQELAAAQGSFEVAFPDAAEKMKKVITQLKEAQACIPPCGLQEFARRFLCSGCYSRVCDLPLDCPVQDVTVTRGDQAMFSCIVNFQLPKEEITYSWKFAGGGLRTQDLSYFRDMPRAEGYLARIRPAQLTHRGTFSCVIKQDQRPLARLYFFLNGGAGRGRVSERGRERGGARAWLTCAPPQ

SEQ ID NO: 808012 - protein, 105 aa, Homo sapiens [sequence omitted]

SEQ ID NO: 808013 - protein, 186 aa, Homo sapiens; identical to SEQ ID NO: 808011

SEQ ID NO: 808014 - protein, 239 aa, Homo sapiens; identical to SEQ ID NO: 808009

SEQ ID NO: 808015 - protein, 561 aa, Homo sapiens
MAPEIHMTGPMCLIENTNGELVANPEALKILSAITQPVVVVAIVGLYRTGKSYLMNKLAGKNKGFSLGSTVKSHTKGIWMWCVPHPKKPEHTLVLLDTEGLGDVKKGDNQNDSWIFTLAVLLSSTLVYNSMGTINQQAMDQLYYVTELTHRIRSKSSPDENENEDSADFVSFFPDFVWTLRDFSLDLEADGQPLTPDEYLEYSLKLTQGSFAQLEKLQDEELDPEFVQQVADFCSYIFSNSKTKTLSGGIKVNGPRLESLVLTYINAISRGDLPCMENAVLALAQIENSAAVQKAIAHYDQQMGQKVQLPAETLQELLDLHRVSEREATEVYMKNSFKDVDHLFQKKLAAQLDKKRDDFCKQNQEASSDRCSALLQVIFSPLEEEVKAGIYSKPGGYCLFIQKLQDLEKKYYEEPRKGIQAEEILQTYLKSKESVTDAILQTDQILTEKEKEIEVECVKAESAQASAKMVEEMQIKYQQMMEEKEKSYQEHVKQLTEKMERERAQLLEEQEKTLTSKLQEQARVLKERCQGESTQLQNEIQKLQKTLKKKTKRYMSHKLKI

SEQ ID NO: 808016 - protein, 461 aa, Homo sapiens
MQVQRRDPIYVTELTHRIRSKSSPDENENEDSADFVSFFPDFVWTLRDFSLDLEADGQPLTPDEYLEYSLKLTQGTSQKDKNFNLPRLCIRKFFPKKKCFVFDLPIHRRKLAQLEKLQDEELDPEFVQQVADFCSYIFSNSKTKTLSGGIKVNGPRLESLVLTYINAISRGDLPCMENAVLALAQIENSAAVQKAIAHYDQQMGQKVQLPAETLQELLDLHRVSEREATEVYMKNSFKDVDHLFQKKLAAQLDKKRDDFCKQNQEASSDRCSALLQVIFSPLEEEVKAGIYSKPGGYCLFIQKLQDLEKKYYEEPRKGIQAEEILQTYLKSKESVTDAILQTDQILTEKEKEIEVECVKAESAQASAKMVEEMQIKYQQMMEEKEKSYQEHVKQLTEKMERERAQLLEEQEKTLTSKLQEQARVLKERCQGESTQLQNEIQKLQKTLKKKTKRYMSHKLKI

SEQ ID NO: 808017 - protein, 461 aa, Homo sapiens; identical to SEQ ID NO: 808016

SEQ ID NO: 808018 - protein, 595 aa, Homo sapiens
MAPEIHMTGPMCLIENTNGELVANPEALKILSAITQPVVVVAIVGLYRTGKSYLMNKLAGKNKGFSLGSTVKSHTKGIWMWCVPHPKKPEHTLVLLDTEGLGDVKKGDNQNDSWIFTLAVLLSSTLVYNSMGTINQQAMDQLYYVTELTHRIRSKSSPDENENEDSADFVSFFPDFVWTLRDFSLDLEADGQPLTPDEYLEYSLKLTQGTSQKDKNFNLPRLCIRKFFPKKKCFVFDLPIHRRKLAQLEKLQDEELDPEFVQQVADFCSYIFSNSKTKTLSGGIKVNGPRLESLVLTYINAISRGDLPCMENAVLALAQIENSAAVQKAIAHYDQQMGQKVQLPAETLQELLDLHRVSEREATEVYMKNSFKDVDHLFQKKLAAQLDKKRDDFCKQNQEASSDRCSALLQVIFSPLEEEVKAGIYSKPGGYCLFIQKLQDLEKKYYEEPRKGIQAEEILQTYLKSKESVTDAILQTDQILTEKEKEIEVECVKAESAQASAKMVEEMQIKYQQMMEEKEKSYQEHVKQLTEKMERERAQLLEEQEKTLTSKLQEQARVLKERCQGESTQLQNEIQKLQKTLKKKTKRYMSHKLKI

SEQ ID NO: 808019 - protein, 516 aa, Homo sapiens
MWCVPHPKKPEHTLVLLDTEGLGDVKKGDNQNDSWIFTLAVLLSSTLVYNSMGTINQQAMDQLYYVTELTHRIRSKSSPDENENEDSADFVSFFPDFVWTLRDFSLDLEADGQPLTPDEYLEYSLKLTQGTSQKDKNFNLPRLCIRKFFPKKKCFVFDLPIHRRKLAQLEKLQDEELDPEFVQQVADFCSYIFSNSKTKTLSGGIKVNGPRLESLVLTYINAISRGDLPCMENAVLALAQIENSAAVQKAIAHYDQQMGQKVQLPAETLQELLDLHRVSEREATEVYMKNSFKDVDHLFQKKLAAQLDKKRDDFCKQNQEASSDRCSALLQVIFSPLEEEVKAGIYSKPGGYCLFIQKLQDLEKKYYEEPRKGIQAEEILQTYLKSKESVTDAILQTDQILTEKEKEIEVECVKAESAQASAKMVEEMQIKYQQMMEEKEKSYQEHVKQLTEKMERERAQLLEEQEKTLTSKLQEQARVLKERCQGESTQLQNEIQKLQKTLKKKTKRYMSHKLKI

SEQ ID NO: 808020 - protein, 430 aa, Homo sapiens
MAPEIHMTGPMCLIENTNGELVANPEALKILSAITQPVVVVAIVGLYRTGKSYLMNKLAGKNKGFSLGSTVKSHTKGIWMWCVPHPKKPEHTLVLLDTEGLGDVKKGDNQNDSWIFTLAVLLSSTLVYNSMGTINQQAMDQLYYVTELTHRIRSKSSPDENENEDSADFVSFFPDFVWTLRDFSLDLEADGQPLTPDEYLEYSLKLTQGTSQKDKNFNLPRLCIRKFFPKKKCFVFDLPIHRRKLAQLEKLQDEELDPEFVQQVADFCSYIFSNSKTKTLSGGIKVNGLAEEILQTYLKSKESVTDAILQTDQILTEKEKEIEVECVKAESAQASAKMVEEMQIKYQQMMEEKEKSYQEHVKQLTEKMERERAQLLEEQEKTLTSKLQEQARVLKERCQGESTQLQNEIQKLQKTLKKKTKRYMSHKLKI

SEQ ID NO: 808021 - protein, 510 aa, Homo sapiens
MAPEIHMTGPMCLIENTNGELVANPEALKILSAITQPVVVVAIVGLYRTGKSYLMNKLAGKNKGFSLGSTVKSHTKGIWMWCVPHPKKPEHTLVLLDTEGLGDVKKGDNQNDSWIFTLAVLLSSTLVYNSMGTINQQAMDQLYYVTELTHRIRSKSSPDENENEDSADFVSFFPDFVWTLRDFSLDLEADGQPLTPDEYLEYSLKLTQGTSQKDKNFNLPRLCIRKFFPKKKCFVFDLPIHRRKLAQLEKLQDEELDPEFVQQVADFCSYIFSNSKTKTLSGGIKVNGPRLESLVLTYINAISRGDLPCMENAVLALAQIENSAAVQKAIAHYDQQMGQKVQLPAETLQELLDLHRVSEREATEVYMKNSFKDVDHLFQKKLAAQLDKKRDDFCKQNQEASSDRCSALLQVIFSPLEEEVKAGIYSKPGGYCLFIQKLQDLEKKYYEEPRKGIQAEEILQTYLKSKESVTDAILQTDQILTEKEKEIEVECVKAESAQASAKMVRVIKNM

SEQ ID NO: 808022 - protein, 296 aa, Homo sapiens
MQVQRRDPIYVTELTHRIRSKSSPDENENEDSADFVSFFPDFVWTLRDFSLDLEADGQPLTPDEYLEYSLKLTQGTSQKDKNFNLPRLCIRKFFPKKKCFVFDLPIHRRKLAQLEKLQDEELDPEFVQQVADFCSYIFSNSKTKTLSGGIKVNGLAEEILQTYLKSKESVTDAILQTDQILTEKEKEIEVECVKAESAQASAKMVEEMQIKYQQMMEEKEKSYQEHVKQLTEKMERERAQLLEEQEKTLTSKLQEQARVLKERCQGESTQLQNEIQKLQKTLKKKTKRYMSHKLKI

SEQ ID NO: 808023 - protein, 142 aa, Homo sapiens
MAPEIHMTGPMCLIENTNGELVANPEALKILSAITQPVVVVAIVGLYRTGKSYLMNKLAGKNKGFSLGSTVKSHTKGIWMWCVPHPKKPEHTLVLLDTEGLGDVKKGDNQNDSWIFTLAVLLSSTLVYNSMGTINQQAMDQL

SEQ ID NO: 808024 - protein, 166 aa, Homo sapiens
MVGRRTGKPAYSHFLLLTLCSLGPKAEEILQTYLKSKESVTDAILQTDQILTEKEKEIEVECVKAESAQASAKMVEEMQIKYQQMMEEKEKSYQEHVKQLTEKMERERAQLLEEQEKTLTSKLQEQARVLKERCQGESTQLQNEIQKLQKTLKKKTKRYMSHKLKI

SEQ ID NO: 808025 - protein, 571 aa, Homo sapiens
MAPEIHMTGPMCLIENTNGELVANPEALKILSAITQPVVVVAIVGLYRTGKSYLMNKLAGKNKGFSLGSTVKSHTKGIWMWCVPHPKKPEHTLVLLDTEGLGDVKKGDNQNDSWIFTLAVLLSSTLVYNSMGTINQQAMDQLYYVTELTHRIRSKSSPDENENEDSADFVSFFPDFVWTLRDFSLDLEADGQPLTPDEYLEYSLKLTQGTSQKDKNFNLPRLCIRKFFPKKKCFVFDLPIHRRKLAQLEKLQDEELDPEFVQQVADFCSYIFSNSKTKTLSGGIKVNGPRLESLVLTYINAISRGDLPCMENAVLALAQIENSAAVQKAIAHYDQQMGQKVQLPAETLQELLDLHRVSEREATEVYMKNSFKDVDHLFQKKLAAQLDKKRDDFCKQNQEASSDRCSALLQVIFSPLEEEVKAGIYSKPGGYCLFIQKLQDLEKKYYEEPRKGIQAEEILQTYLKSKESVTDAILQTDQILTEKEKEIEVECVKAESAQASAKMVEEMQIKYQQMMEEKEKSYQEHVKQLTEKMERERAQLLEEQEKTLTSKLQVSKCITLWFVFLFSLCSS

SEQ ID NO: 808026 - protein, 509 aa, Homo sapiens
MAPEIHMTGPMCLIENTNGELVANPEALKILSAITQPVVVVAIVGLYRTGKSYLMNKLAGKNKGFSLGSTVKSHTKGIWMWCVPHPKKPEHTLVLLDTEGLGDVKKGDNQNDSWIFTLAVLLSSTLVYNSMGTINQQAMDQLYYVTELTHRIRSKSSPDENENEDSADFVSFFPDFVWTLRDFSLDLEADGQPLTPDEYLEYSLKLTQGTSQKDKNFNLPRLCIRKFFPKKKCFVFDLPIHRRKLAQLEKLQDEELDPEFVQQVADFCSYIFSNSKTKTLSGGIKVNGPRLESLVLTYINAISRGDLPCMENAVLALAQIENSAAVQKAIAHYDQQMGQKVQLPAETLQELLDLHRVSEREATEVYMKNSFKDVDHLFQKKLAAQLDKKRDDFCKQNQEASSDRCSALLQVIFSPLEEEVKAGIYSKPGGYCLFIQKLQDLEKKYYEEPRKGIQAEEILQTYLKSKESVTDAILQTDQILTEKEKEIEVECVKAESAQASAKMVGGIAS

SEQ ID NO: 808027 - protein, 290 aa, Homo sapiens
MAPEIHMTGPMCLIENTNGELVANPEALKILSAITQPVVVVAIVGLYRTGKSYLMNKLAGKNKGFSLGSTVKSHTKGIWMWCVPHPKKPEHTLVLLDTEGLGDVKKGDNQNDSWIFTLAVLLSSTLVYNSMGTINQQAMDQLYYVTELTHRIRSKSSPDENENEDSADFVSFFPDFVWTLRDFSLDLEADGQPLTPDEYLEYSLKLTQGTSQKDKNFNLPRLCIRKFFPKKKCFVFDLPIHRRKLAQLEKLQDEELDPEFVQQVADFCSYIFSNSKTKTLSGGIKVNGPR

SEQ ID NO: 808028 - protein, 202 aa, Homo sapiens
MEAEAGGLEELTDEEMAALGKEELVRRLRREEAARLAALVQRGRLMQEVNRQLQGHLGEIRELKQLNRRLQAENRELRDLCCFLDSERQRGRRAARQWQLFGTQASRAVREDLGGCWQKLAELEGRQEELLRENLALKELCLALGEEWGPRGGPSGAGGSGAGPAPELALPPCGPRDLGDGSSSTGSVGSPDQLPLACSPDD

SEQ ID NO: 808029 - protein, 202 aa, Homo sapiens; identical to SEQ ID NO: 808028

SEQ ID NO: 808030 - protein, 202 aa, Homo sapiens; identical to SEQ ID NO: 808028

SEQ ID NO: 808031 - protein, 189 aa, Homo sapiens
MEAEAGGLEELTDEEMAALGKEELVRRLRREEAARLAALVQRGRLMQEVNRQLQGHLGEIRELKQLNRRLQAENRELRDLCCFLDSERQRGRRAARQWQLFGTQASRAVREDLGGCWQKLAELEGRQEELLRENLALKELCLALGEEWGPRGGPSGAGGSGAGPAPELALPPCGPRDLGDGSSSTGSMD

SEQ ID NO: 808032 - protein, 196 aa, Homo sapiens
MEAEAGGLEELTDEEMAALGKEELVRRLRREEAARLAALVQRGRLMQEVNRQLQGHLGEIRELKQLNRRLQAENRELRDLCCFLDSERQRGRRAARQWQLFGTQASRAVREDLGGCWQKLAELEGRQEELLQAMEAPALAAWAVRISCPWPVPPMIEGTASSTPTPARIAPRAPGPLWTSGPGRRPGCAGGAAGMD

SEQ ID NO: 808033 - protein, 139 aa, Homo sapiens
MAEAVLIDLFGLKLNSQKNCHQTLLKTLNAVQYHHAAKAKFLCIMCCSNISYERDGEQDNCEIETSNGLSALLEEFEIVSCPSMAATLYTIKQKIDEKNLSSIKIFSYMDLLQEQVGYLIYQLLAHSISSVVPNGEIPR

SEQ ID NO: 808034 - protein, 215 aa, Homo sapiens
MAEAVLIDLFGLKLNSQTAKAKFLCIMCCSNISYERDGEQDNCEIETSNGLSALLEEFEIVSCPSMAATLYTIKQKIDEKNLSSIKVIVPRHRKTLMKAFIDQLFTDVYNFEFEDLQVTFRGGLFKQSIEINVITAQELRGIQNEIETFLRSLPALRGKLTIITSSLIPDIFIHGFTTRTGGISYIPTLSSFNLFSSSKRRDPKVVVQDKDSSFQ

SEQ ID NO: 808035 - protein, 364 aa, Homo sapiens
MSANSSRVGQLLLQGSACIRWKQDVEGAVYHLANCLLLLGFMGGSGVYGCFYLFGFLSAGYLCCVLWGWFSACGLDIVLWSFLLAVVCLLQLAHLVYRLREDTLPEEFDLLYKTLCLPLQVPLQTYKEIVHCCEEQVLTLATEQTYAVEGETPINRLSLLLSGRVRVSQDGQFLHYIFPYQFMDSPEWESLQPSEEGVFQVTLTAETSCSYISWPRKSLHLLLTKERYISCLFSALLGYDISEKLYTLNDKLFAKFGLRFDIRLPSLYHVLGPTAADAGPESEKGDEEVCEPAVSPPQATPTSLQQTPPCSTPPATTNFPAPPTRARLSRPDSGILASRIPLQSYSQVISRGQAPLAPTHTPEL

SEQ ID NO: 808036 - protein, 107 aa, Homo sapiens
MGFSPLFISFILLIIIHHTQFPLILLEFLSRATLKLYPGDRPLWLQPTRLNFKDHWTIFSVASAALFCVHRMATDRHASFPTHWKAHRQGERGHRRCQHCRYSKDLK

SEQ ID NO: 808037 - protein, 130 aa, Homo sapiens
MTSRRSSTLSMTSSLLSLGCALTSAFPASTMSWVPLLQMLDQSPRRVMRKSVSQLCPLLRPHPPLSSKHPLVLPLQLPPTFLHLLPGPGCPGQTVAYWGEDSTSLVLEDFEEVSGSESFMDYRSDGEYMR

SEQ ID NO: 808038 - protein, 254 aa, Homo sapiens
KEVFKFSMKCDYVPSFLPKATGSIPSRKGGVGSEKPEVPLQTYKEIVHCCEEQVLTLATEQTYAVEGETPINRLSLLLSGRVRVSQDGQFLHYIFPYQFMDSPEWESLQPSEEGVFQVTLTAETSCSYISWPRKSLHLLLTKERYISCLFSALLGYDISEKLYTLNDKLFAKFGLRFDIRLPSLYHVLGPTAADAGPESEKGDEEVCEPAVSPPQATPTSLQQTPPCSTPPATTNFPAPPTRARLSRPDSGILG

SEQ ID NO: 808039 - protein, 155 aa, Homo sapiens
MDSPEWESLQPSEEGVFQVTLTAETSCSYISWPRKSLHLLLTKERYISCLFSALLGYDISEKLYTLNDKLFAKFGLRFDIRLPSLYHVLGPTAADAGPESEKGDEEVCEPAVSPPQATPTSLQQTPPCSTPPATTNFPAPPTRARLSRPDSGILG

SEQ ID NO: 808040 - protein, 166 aa, Homo sapiens [sequence omitted]

SEQ ID NO: 808041 - protein, 166 aa, Homo sapiens [sequence omitted]

SEQ ID NO: 808042 - protein, 130 aa, Homo sapiens; identical to SEQ ID NO: 808037

SEQ ID NO: 808043 - protein, 228 aa, Homo sapiens
MSWVPLLQMLDQSEKGDEEVCEPAVSPPQATPTSLQQTPPCSTPPATTNFLLSGRVRVSQDGQFLHYIFPYQFMDSPEWESLQPSEEGVFQVTLTAETSCSYISWPRKSLHLLLTKERYISCLFSALLGYDISEKLYTLNDKLFAKFGLRFDIRLPSLYHVLGPTAADAGPESEKGDEEVCEPAVSPPQATPTSLQQTPPCSTPPATTNFPAPPTRARLSRPDSGILG

SEQ ID NO: 808044 - protein, 130 aa, Homo sapiens; identical to SEQ ID NO: 808037

SEQ ID NO: 808045 - protein, 135 aa, Homo sapiens
RIRNEFWHRGPLLRPHPPLSSKHPLVLPLQLPPTFLHLLPGPGCPGQTVAYWLLEFLSRATLKLYPGDRPLWLQPTRLNFKDHWTIFSVASAALFCVHRMATDRHASFPTHWKAHRQGERGHRRCQHCRYSKDLK

SEQ ID NO: 808046 - protein, 130 aa, Homo sapiens; identical to SEQ ID NO: 808037

SEQ ID NO: 808047 - protein, 181 aa, Homo sapiens
MTSRRSSTLSMTSSLLSLGCALTSAFPASTMSWVPLLQMLDQSPRRVMRKSVSQLCPLLRPHPPLSSKHPLVLPLQLPPTFLHLLPGPGCPGQTVAYWLLEFLSRATLKLYPGDRPLWLQPTRLNFKDHWTIFSVASAALFCVHRMATDRHASFPTHWKAHRQGERGHRRCQHCRYSKDLK

SEQ ID NO: 808048 - protein, 130 aa, Homo sapiens; identical to SEQ ID NO: 808037

SEQ ID NO: 808049 - protein, 135 aa, Homo sapiens
MTSRRSSTLSMTSSLLSLGCALTSAFPASTMSWVPLLQMLDQSPRRVMRKSVSQLCPLLRPHPPLSSKHPLVLPLQLPPTFLHLLPGPGCPGQTVAYWLLEFLSRATLKLYPGDRPLWLQPTRLFSHPLEGSQAR

SEQ ID NO: 808050 - protein, 130 aa, Homo sapiens; identical to SEQ ID NO: 808037

SEQ ID NO: 808051 - protein, 86 aa, Homo sapiens
VLAHLRISPAPAANNSLLEFLSRATLKLYPGDRPLWLQPTRLNFKDHWTIFSVASAALFCVHRMATDRHASSVNSGGYETHLTGLL

SEQ ID NO: 808052 - protein, 423 aa, Homo sapiens
MAMVVSSWRDPQDDVAGGNPGGPNPAAQAARGGGGGAGEQQQQAGSGAPHTPQTPGQPGAPATPGTAGDKGQGPPGSGQSQQHIECVVCGDKSSGKHYGQFTCEGCKSFFKRSVRRNLTYTCRANRNCPIDQHHRNQCQYCRLKKCLKVGMRREAVQRGRMPPTQPNPGQYALTNGDPLNGHCYLSGYISLLLRAEPYPTSRYGSQCMQPNNIMGIENICELAARLLFSAVEWARNIPFFPDLQITDQVSLLRLTWSELFVLNAAQCSMPLHVAPLLAAAGLHASPMSADRVVAFMDHIRIFQEQVEKLKALHVDSAEYSCLKAIVLFTSDACGLSDAAHIESLQEKSQCALEEYVRSQYPNQPSRFGKLLLRLPSLRTVSSSVIEQLFFVRLVGKTPIETLIRDMLLSGSSFNWPYMSIQCS

SEQ ID NO: 808053 - protein, 347 aa, Homo sapiens
PNQSIEKCICFLLHVFGHYVSATWPDTSVADRTRPIDEFELEIRYVSGRGRTRIDQHHRNQCQYCRLKKCLKVGMRREAVQRGRMPPTQPNPGQYALTNGDPLNGHCYLSGYISLLLRAEPYPTSRYGSQCMQPNNIMGIENICELAARLLFSAVEWARNIPFFPDLQITDQVSLLRLTWSELFVLNAAQCSMPLHVAPLLAAAGLHASPMSADRVVAFMDHIRIFQEQVEKLKALHVDSAEYSCLKAIVLFTSDACGLSDAAHIESLQEKSQCALEEYVRSQYPNQPSRFGKLLLRLPSLRTVSSSVIEQLFFVRLVGKTPIETLIRDMLLSGSSFNWPYMSIQCS

SEQ ID NO: 808054 - protein, 423 aa, Homo sapiens; identical to SEQ ID NO: 808052

SEQ ID NO: 808055 - protein, 272 aa, Homo sapiens
MAMVVSSWRDPQDDVAGGNPGGPNPAAQAARGGGGGAGEQQQQAGSGAPHTPQTPGQPGAPATPGTAGDKGQGPPGSGQSQQHIECVVCGDKSSGKHYGQFTCEGCKSFFKRSVRRNLTYTCRANRNCPIDQHHRNQCQYCRLKKCLKVGMRREAVQRGRMPPTQPNPGQYALTNGDPLNGHCYLSGYISLLLRAEPYPTSRYGSQCMQPNNIMGIENICELAARLLFSAVEWARNIPFFPDLQITDQVSLLRLTWSELFVLNAAHAHWRST

SEQ ID NO: 808056 - protein, 423 aa, Homo sapiens; identical to SEQ ID NO: 808052

SEQ ID NO: 808057 - protein, 309 aa, Homo sapiens
MQRNRNTCRANRNCPIDQHHRNQCQYCRLKKCLKVGMRREAVQRGRMPPTQPNPGQYALTNGDPLNGHCYLSGYISLLLRAEPYPTSRYGSQCMQPNNIMGIENICELAARLLFSAVEWARNIPFFPDLQITDQVSLLRLTWSELFVLNAAQCSMPLHVAPLLAAAGLHASPMSADRVVAFMDHIRIFQEQVEKLKALHVDSAEYSCLKAIVLFTSDACGLSDAAHIESLQEKSQCALEEYVRSQYPNQPSRFGKLLLRLPSLRTVSSSVIEQLFFVRLVGKTPIETLIRDMLLSGSSFNWPYMSIQCS

SEQ ID NO: 808058 - protein, 273 aa, Homo sapiens
MFGYSVQRGRMPPTQPNPGQYALTNGDPLNGHCYLSGYISLLLRAEPYPTSRYGSQCMQPNNIMGIENICELAARLLFSAVEWARNIPFFPDLQITDQVSLLRLTWSELFVLNAAQCSMPLHVAPLLAAAGLHASPMSADRVVAFMDHIRIFQEQVEKLKALHVDSAEYSCLKAIVLFTSDACGLSDAAHIESLQEKSQCALEEYVRSQYPNQPSRFGKLLLRLPSLRTVSSSVIEQLFFVRLVGKTPIETLIRDMLLSGSSFNWPYMSIQCS

SEQ ID NO: 808059 - protein, 108 aa, Homo sapiens [sequence omitted]

SEQ ID NO: 808060 - protein, 41 aa, Homo sapiens
MPPTQPNPGQYALTNGDPLNGHCYLSGYISLLLRAEPYPTS

SEQ ID NO: 808061 - protein, 617 aa, Homo sapiens
MAFPHRPDAPELPDFSMLKRLARDQLIYLLEQLPGKKDLFIEADLMSPLDRIANVSILKQHEVDKLYKVENKPALSSNEQLCFLVRPRIKNMRYIASLVNADKLAGRTRKYKVIFSPQKFYACEMVLEEEGIYGDVSCDEWAFSLLPLDVDLLSMELPEFFRDYFLEGDQRWINTVAQALHLLSTLYGPFPNCYGIGRCAKMAYELWRNLEEEEDGETKGRRPEIGHIFLLDRDVDFVTALCSQVVYEGLVDDTFRIKCGSVDFGPEVTSSDKSLKVLLNAEDKVFNEIRNEHFSNVFGFLSQKARNLQAQYDRRRGMDIKQMKNFVSQELKGLKQEHRLLSLHIGACESIMKKKTKQDFQELIKTEHALLEGFNIRESTSYIEEHIDRQVSPIESLRLMCLLSITENGLIPKDYRSLKTQYLQSYGPEHLLTFSNLRRAGLLTEQAPGDTLTAVESKVSKLVTDKAAGKITDAFSSLAKRSNFRAISKKLNLIPRVDGEYDLKVPRDMAYVFGGAYVPLSCRIIEQVLERRSWQGLDEVVRLLNCSDFAFTDMTKEDKASSESLRLILVVFLGGCTFSEISALRFLGREKGYRFIFLTTAVTNSARLMEAMSEVKA

SEQ ID NO: 808062 - protein, 102 aa, Homo sapiens
MAYVFGGAYVPLSCRIIEQVLERRSWQGLDEVVRLLNCSDFAFTDMTKEDKASSESLRLILVVFLGGCTFSEISALRFLGREKGKREQKGENWPALYLGNKV

SEQ ID NO: 808063 - protein, 617 aa, Homo sapiens; identical to SEQ ID NO: 808061

SEQ ID NO: 808064 - protein, 533 aa, Homo sapiens
MAFPHRPDAPELPDFSMLKRLARDQLIYLLEQLPGKKDLFIEADLMSPLDRIANVSILKQHEVDKLYKVENKPALSSNEQLCFLVRPRIKNMRYIASLVNADKLAGRTRKYKVIFSPQKFYACEMVLEEEGIYGDVSCDEWAFSLLPLDVDLLSMELPEFFRDYFLEGDQRWINTVAQALHLLSTLYGPFPNCYGIGRCAKMAYELWRNLEEEEDGETKGRRPEIGHIFLLDRDVDFVTALCSQVVYEGLVDDTFRIKCGSVDFGPEVTSSDKSLKVLLNAEDKVFNEIRNEHFSNVFGFLSQKARNLQAQYDRRRGMDIKQMKNFVSQELKGLKQEHRLLSLHIGACESIMKKKTKQDFQELIKTEHALLEGFNIRESTSYIEEHIDRQVSPIESLRLMCLLSITENGLIPKDYRSLKTQYLQSYGPEHLLTFSNLRRAGLLTEQAPGDTLTAVESKVSKLVTDKAAGKITDAFSSLAKRSNFRAISKKLNLIPRVDGEYDLKVPRDMAYVFGGAYVPLSCRIIEQATGSFS

SEQ ID NO: 808065 - protein, 109 aa, Homo sapiens [sequence omitted]

SEQ ID NO: 808066 - protein, 155 aa, Homo sapiens
MERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 808067 - protein, 558 aa, Homo sapiens
MAVMPVRGPWVKLSAGPLVLHYCVSLKDYIKKYNKLKQNECTSQIQFTGVYPEEGTKEAREPERINMTDHKECHAEGIPKPQLGWLKNGIDITPKLSKQLTLQANGSEVHISNVRYEDTGAYTCIAKNEAGVDEDISSLFVEDSARKTLANILWREEGLGIGNMFYVFYEDGIKVIQPIECEFQRHIKPSEKLLGFQDEVCPKAEGDEVQRCVWASAVNVKDKFIYVAQPTLDRVLIVDVQSQKVVQAVSTDPVPVKLHYDKSHDQVWVLSWGTLEKTSPTLQVITLASGNVPHHTIHTQPVGKQFDRVDDFFIPTTTLIITHMRFGFILHKDEAALQKIDLETMSYIKTINLKDYKCVPQSLAYTHLGGYYFIGCKPDSTGAVSPQVMVDGVTDSVIGFNSDVTGTPYVSPDGHYLVSINDVKGLVRVQYITIRGEIQEAFDIYTNLHISDLAFQPSFTEAHQYNIYGSSSTQTDVLFVELSSGKVKMIKSLKEPLKAEEWPWNRKNRQIQDSGLFGQYLMTPSKDSLFILDGRLNKLNCEITEVEKGNTVIWVGDA

SEQ ID NO: 808068 - protein, 439 aa, Homo sapiens
MFKCWSVVLVLGFIFLESEGRPTKEGGYGLKSYQPLMRLRHKQEKNQESSRVKGFMIQDGPFGSCENKYCGLGRHCVTSRETGQAECACMDLCKRHYKPVCGSDGEFYENHCEVHRAACLKKQKITIVHNEDCFFKGDKCKTTEYSKMKNMLLDLQNQKYIMQENENPNGDDISRKKLLVDQMFKYFDADSNGLVDINELTQVIKQEELGKDLFDCTLYVLLKYDDFNADKHLALEEFYRAFQVIQLSLPEDQKLSITAATVGQSAVLSCAIQGTLRPPIIWKRNNIILNNLDLEDINDFGDDGSLYITKVTTTHVGNYTCYADGYEQVYQTHIFQVNVPPVIRVYPESQAREPGVTASLRCHAEGIPKPQLGWLKNGIDITPKLSKQLTLQANGSEVHISNVRYEDTGAYTCIAKNEAGVDEDISSLFVEDSARKTRS

SEQ ID NO: 808069 - protein, 66 aa, Homo sapiens
DKCKTTEYSKMKNMLLDLQNQKYIMQENENPNGDDISRKKLLVDQMFKYFDADSNGLVDINELTQV

SEQ ID NO: 808070 - protein, 847 aa, Homo sapiens
MFKCWSVVLVLGFIFLESEGRPTKEGGYGLKSYQPLMRLRHKQEKNQESSRVKGFMIQDGPFGSCENKYCGLGRHCVTSRETGQAECACMDLCKRHYKPVCGSDGEFYENHCEVHRAACLKKQKITIVHNEDCFFKGDKCKTTEYSKMKNMLLDLQNQKYIMQENENPNGDDISRKKLLVDQMFKYFDADSNGLVDINELTQVIKQEELGKDLFDCTLYVLLKYDDFNADKHLALEEFYRAFQVIQLSLPEDQKLSITAATVGQSAVLSCAIQGTLRPPIIWKRNNIILNNLDLEDINDFGDDGSLYITKVTTTHVGNYTCYADGYEQVYQTHIFQVNVPPVIRVYPESQAREPGVTASLRCHAEGIPKPQLGWLKNGIDITPKLSKQLTLQANGSEVHISNVRYEDTGAYTCIAKNEAGVDEDISSLFVEDSARKTLANILWREEGLGIGNMFYVFYEDGIKVIQPIECEFQRHIKPSEKLLGFQDEVCPKAEGDEVQRCVWASAVNVKDKFIYVAQPTLDRVLIVDVQSQKVVQAVSTDPVPVKLHYDKSHDQVWVLSWGTLEKTSPTLQVITLASGNVPHHTIHTQPVGKQFDRVDDFFIPTTTLIITHMRFGFILHKDEAALQKIDLETMSYIKTINLKDYKCVPQSLAYTHLGGYYFIGCKPDSTGAVSPQVMVDGVTDSVIGFNSDVTGTPYVSPDGHYLVSINDVKGLVRVQYITIRGEIQEAFDIYTNLHISDLAFQPSFTEAHQYNIYGSSSTQTDVLFVELSSGKVKMIKSLKEPLKAEEWPWNRKNRQIQDSGLFGQYLMTPSKDSLFILDGRLNKLNCEITEVEKGNTVIWVGDA

SEQ ID NO: 808071 - protein, 252 aa, Homo sapiens
ERCRLKKFINIMNKNAKFRFGFILHKDEAALQKIDLETMSYIKTINLKDYKCVPQSLAYTHLGGYYFIGCKPDSTGAVSPQVMVDGVTDSVIGFNSDVTGTPYVSPDGHYLVSINDVKGLVRVQYITIRGEIQEAFDIYTNLHISDLAFQPSFTEAHQYNIYGSSSTQTDVLFVELSSGKVKMIKSLKEPLKAEEWPWNRKNRQIQDSGLFGQYLMTPSKDSLFILDGRLNKLNCEITEVEKGNTVIWVGDA

SEQ ID NO: 808072 - protein, 877 aa, Homo sapiens
MLTRLQVLTLALFSKGFLLSLGDHNFLRREIKIEGDLVLGGLFPINEKGTGTEECGRINEDRGIQRLEAMLFAIDEINKDDYLLPGVKLGVHILDTCSRDTYALEQSLEFVRASLTKVDEAEYMCPDGSYAIQENIPLLIAGVIGGSYSSVSIQVANLLRLFQIPQISYASTSAKLSDKSRYDYFARTVPPDFYQAKAMAEILRFFNWTYVSTVASEGDYGETGIEAFEQEARLRNICIATAEKVGRSNIRKSYDSVIRELLQKPNARVVVLFMRSDDSRELIAAASRANASFTWVASDGWGAQESIIKGSEHVAYGAITLELASQPVRQFDRYFQSLNPYNNHRNPWFRDFWEQKFQCSLQNKRNHRRVCDKHLAIDSSNYEQESKIMFVVNAVYAMAHALHKMQRTLCPNTTKLCDAMKILDGKKLYKDYLLKINFTAPFNPNKDADSIVKFDTFGDGMGRYNVFNFQNVGGKYSYLKVGHWAETLSLDVNSIHWSRNSVPTSQCSDPCAPNEMKNMQPGDVCCWICIPCEPYEYLADEFTCMDCGSGQWPTADLTGCYDLPEDYIRWEDAWAIGPVTIACLGFMCTCMVVTVFIKHNNTPLVKASGRELCYILLFGVGLSYCMTFFFIAKPSPVICALRRLGLGSSFAICYSALLTKTNCIARIFDGVKNGAQRPKFISPSSQVFICLGLILVQIVMVSVWLILEAPGTRRYTLAEKRETVILKCNVKDSSMLISLTYDVILVILCTVYAFKTRKCPENFNEAKFIGFTMYTTCIIWLAFLPIFYVTSSDYRVQTTTMCISVSLSGFVVLGCLFAPKVHIILFQPQKNVVTHRLHLNRFSVSGTGTTYSQSSASTYVPTVCNGREVLDSTTSSL

SEQ ID NO: 808073 - protein, 303 aa, Homo sapiens
MDPEVTLLLQCPGGGLPQEQIQAELSPAHDRRPLPGGDEAITAIWETRLKAQPWLFDAPKFRLHSATLAPIGSRGPQLLLRLGLTSYRDFLGTNWSSSAAWLRQQGATDWGDTQAYLADPLGVGAALATADDFLVFLRRSRQVAEAPGLVDVPGGHPEPQALCPGGSPQHQDLAGQLVVHELFSSVLQEICDEVNLPLLTLSQPLLLGIARNETSAGRASAEFYVQCSLTSEQVRKHYLSGGPEAHESTGIFFVETQNVRRLPETEMWAELCPSAKGAIILYNRVQGSPTGAALGSPALLPPL

SEQ ID NO: 808074 - protein, 181 aa, Homo sapiens
FGTRGGTRRLSCPVQTMDPEVTLLLQCPGGGLPQEQIQAELSPAHDRRPLPGGDEAITAIWETRLKAQPWLFDAPKFRLHSATLAPIGSRGPQLLLRLGLTSYRDFLGTNWSSSAAWLRQQGATDWGDTQAYLADPLGVGAALATADDFLVFLRRSRQVAEAPGLVDVPGGHPEPQVQPDF

SEQ ID NO: 808075 - protein, 303 aa, Homo sapiens; identical to SEQ ID NO: 808073

SEQ ID NO: 808076 - protein, 303 aa, Homo sapiens; identical to SEQ ID NO: 808073

SEQ ID NO: 808077 - protein, 319 aa, Homo sapiens
FGTRGGTRRLSCPVQTMDPEVTLLLQCPGGGLPQEQIQAELSPAHDRRPLPGGDEAITAIWETRLKAQPWLFDAPKFRLHSATLAPIGSRGPQLLLRLGLTSYRDFLGTNWSSSAAWLRQQGATDWGDTQAYLADPLGVGAALATADDFLVFLRRSRQVAEAPGLVDVPGGHPEPQALCPGGSPQHQDLAGQLVVHELFSSVLQEICDEVNLPLLTLSQPLLLGIARNETSAGRASAEFYVQCSLTSEQVRKHYLSGGPEAHESTGIFFVETQNVRRLPETEMWAELCPSAKGAIILYNRVQGSPTGAALGSPALLPPL

SEQ ID NO: 808078 - protein, 315 aa, Homo sapiens
TYLLLGQAPARALQQQGHLRIHGLKGQLPQEQIQAELSPAHDRRPLPGGDEAITAIWETRLKAQPWLFDAPKFRLHSATLAPIGSRGPQLLLRLGLTSYRDFLGTNWSSSAAWLRQQGATDWGDTQAYLADPLGVGAALATADDFLVFLRRSRQVAEAPGLVDVPGGHPEPQALCPGGSPQHQDLAGQLVVHELFSSVLQEICDEVNLPLLTLSQPLLLGIARNETSAGRASAEFYVQCSLTSEQVRKHYLSGGPEAHESTGIFFVETQNVRRLPETEMWAELCPSAKGAIILYNRVQGSPTGAALGSPALLPPL

SEQ ID NO: 808079 - protein, 334 aa, Homo sapiens
MDPEVTLLLQCPGGGLPQEQIQAELSPAHDRRPLPGGDEAITAIWETRLKAQPWLFDAPKFRLHSATLAPIGSRGPQLLLRLGLTSYRDFLGTNWSSSAAWLRQQGATDWGDTQAYLADPLGVGAALATADDFLVFLRRSRQVAEAPGLVDVPGGHPEPQLDLWLSVRERTPDSGSLTLLHCATSDPQGQQALCPGGSPQHQDLAGQLVVHELFSSVLQEICDEVNLPLLTLSQPLLLGIARNETSAGRASAEFYVQCSLTSEQVRKHYLSGGPEAHESTGIFFVETQNVRRLPETEMWAELCPSAKGAIILYNRVQGSPTGAALGSPALLPPL

SEQ ID NO: 808080 - protein, 270 aa, Homo sapiens
MDPEVTLLLQCPGGGLPQEQIQAELSPAHDRRPLPGGDEAITAIWETRLKAQPWLFDAPKFRLHSATLAPIGSRGPQLLLRLGLTSYRDFLGTNWSSSAAWLRQQGATDWGDTQAYLADPLGVGAALATADDFLVFLRRSRQVAEAPGLVDVPGGHPEPQVNLPLLTLSQPLLLGIARNETSAGRASAEFYVQCSLTSEQVRKHYLSGGPEAHESTGIFFVETQNVRRLPETEMWAELCPSAKGAIILYNRVQGSPTGAALGSPALLPPL

SEQ ID NO: 808081 - protein, 114 aa, Homo sapiens
MDPEVTLLLQCPGGGLPQEQIQAELSPAHDRRPLPGGDEAITAIWETRLKAQPWLFDAPKFRLHSATLGWWTYLVGTLSLRPCALVAAPSTRTSLGSWWYMNSFPVSFRRSVMR

SEQ ID NO: 808082 - protein, 132 aa, Homo sapiens
MDPEVTLLLQCPGGGLPQEQIQAELSPAHDRRPLPGGDEAITAIWETRLKAQPWLFDAPKFRLHSATLAPIGSRGPQLLLRLGLTSYRDFLGTNWSSSAAWLRQQGATDWGDTQAYLADPLGVGAALATGAA

SEQ ID NO: 808083 - protein, 166 aa, Homo sapiens
MDPEVTLLLQCPGGGLPQEQIQAELSPAHDRRPLPGGDEAITAIWETRLKAQPWLFDAPKFRLHSATLAPIGSRGPQLLLRLGLTSYRECSLTSEQVRKHYLSGGPEAHESTGIFFVETQNVRRLPETEMWAELCPSAKGAIILYNRVQGSPTGAALGSPALLPPL

SEQ ID NO: 808084 - protein, 128 aa, Homo sapiens
MWAVALIGGPPPTPPSTAVNLPLLTLSQPLLLGIARNETSAGRASAEFYVQCSLTSEQVRKHYLSGGPEAHESTGIFFVETQNVRRLPETEMWAELCPSAKGAIILYNRVQGSPTGAALGSPALLPPL

SEQ ID NO: 808085 - protein, 80 aa, Homo sapiens
MDPEVTLLLQCPGGGLPQEQIQAELSPAHDRRPLPGGDEAITAIWETRLKAQPWLFDAPKFRLHSATLILYRYEALLNLD

SEQ ID NO: 808086 - protein, 303 aa, Homo sapiens; identical to SEQ ID NO: 808073

SEQ ID NO: 808087 - protein, 303 aa, Homo sapiens; identical to SEQ ID NO: 808073

SEQ ID NO: 808088 - protein, 334 aa, Homo sapiens; identical to SEQ ID NO: 808079

SEQ ID NO: 808089 - protein, 226 aa, Homo sapiens
MDPEVTLLLQCPGGGLPQEQIQAELSPAHDRRPLPGGDEAITAIWETRLKAQPWLFDAPKFRLHSATLAPIGSRGPQLLLRLGLTSYRDFLGTNWSSSAAWLRQQGATDWGDTQAYLADPLGVGAALATADDFLVFLRRSRQVAEAPGLVDVPGGHPEPQALCPGGSPQHQDLAGQLVVHELFSSVLQEICDEVNLPLLTLSQPLLLGIARNETSAGRASAEFYVQ

SEQ ID NO: 808090 - protein, 270 aa, Homo sapiens; identical to SEQ ID NO: 808080

SEQ ID NO: 808091 - protein, 111 aa, Homo sapiens [sequence omitted]

SEQ ID NO: 808092 - protein, 177 aa, Homo sapiens
ERQVEGAYGGEHGVGRLAAYLALLAALRVRLSPAKKQRGQRDDSGECPGERDHDVGDALAGAERVFHVARDGPVAVQAMAVTFQMLAVQQSTSHAIQSWHSLRPSCQRRPDSSCTRLSGMTSAATRTSETAMDATRLWGTRWKVRTRRMVASTSRFQANVAATRKPSKSKTSIRRMH

SEQ ID NO: 808093 - protein, 446 aa, Homo sapiens
METQADLVSQEPQALLDSALPSKVPAFSDKDSLGDEMLAAALLKAKSQELVTFEDVAVYFIRKEWKRLEPAQRDLYRDVMLENYGNVFSLDRETRTENDQEISEDTRSHGVLLGRFQKDISQGLKFKEAYEREVSLKRPLGNSPGERLNRKMPDFGQVTVEEKLTPRGERSEKYNDFGNSFTVNSNLISHQRLPVGDRPHKCDECSKSFNRTSDLIQHQRIHTGEKPYECNECGKAFSQSSHLIQHQRIHTGEKPYECSDCGKTFSCSSALILHRRIHTGEKPYECNECGKTFSWSSTLTHHQRIHTGEKPYACNECGKAFSRSSTLIHHQRIHTGEKPYECNECGKAFSQSSHLYQHQRIHTGEKPYECMECGGKFTYSSGLIQHQRIHTGENPYECSECGKAFRYSSALVRHQRIHTGEKPLNGIGMSKSSLRVTTELNIREST

SEQ ID NO: 808094 - protein, 387 aa, Homo sapiens [sequence omitted]

SEQ ID NO: 808095 - protein, 387 aa, Homo sapiens [sequence omitted]

SEQ ID NO: 808096 - protein, 387 aa, Homo sapiens [sequence omitted]

SEQ ID NO: 808097 - protein, 455 aa, Homo sapiens
ASSPLTASTPRFVLSPVCGSVTGSNRAWSVSGPPNLSSLPPGSASSFSFKTRFPLSLHPGDQRAPCPSMETQADLVSQEPQALLDSALPSKVPAFSDKDSLGDEMLAAALLKAKSQELVTFEDVAVYFIRKEWKRLEPAQRDLYRDVMLENYGNVFSLDRETRTENDQEISEDTRSHGVLLGRFQKDISQGLKFKEAYEREVSLKRPLGNSPGERLNRKMPDFGQVTVEEKLTPRGERSEKYNDFGNSFTVNSNLISHQRLPVGDRPHKCDECSKSFNRTSDLIQHQRIHTGEKPYECNECGKAFSQSSHLIQHQRIHTGEKPYECSDCGKTFSCSSALILHRRIHTGEKPYECNECGKTFSWSSTLTHHQRIHTGEKPYACNECGKAFSRSSTLIHHQRIHTEALPTFVTLIRLLPSVDPIVTNEAAFPAESLATIFALIWRLFCVHSLMFKKV

SEQ ID NO: 808098 - protein, 131 aa, Homo sapiens
METQADLVSQEPQALLDSALPSKVPAFSDKDSLGDEMLAAALLKAKSQELVTFEDVAVYFIRKEWKRLEPAQRDLYRDVMLENYGNVFSLDWIHVCLTTQKVMLAWLTGTLSVAKGLCSSELASVEPPDTF

SEQ ID NO: 808099 - protein, 138 aa, Homo sapiens
MDPHLLSWTPVSLPPPCPPFLPSQMCIFHPILSDFFGAAIHIPHPEIACQHVLFQELVTFEDVAVYFIRKEWKRLEPAQRDLYRDVMLENYGNVFSLDWIHVCLTTQKVMLAWLTGTLSVAKGLCSSELASVEPPDTF

SEQ ID NO: 808100 - protein, 117 aa, Homo sapiens [sequence omitted]

SEQ ID NO: 808101 - protein, 394 aa, Homo sapiens
MDPHLLSWTPVSLPPPCPPFLPSQMCIFHPILSDFFGAAIHIPHPEIACQHVLFQELVTFEDVAVYFIRKEWKRLEPAQRDLYRDVMLENYGNVFSLDRETRTENDQEISEDTRSHGVLLGRFQKDISQGLKFKEAYEREVSLKRPLGNSPGERLNRKMPDFGQVTVEEKLTPRGERSEKYNDFGNSFTVNSNLISHQRLPVGDRPHKCDECSKSFNRTSDLIQHQRIHTGEKPYECNECGKAFSQSSHLIQHQRIHTGEKPYECSDCGKTFSCSSALILHRRIHTGEKPYECNECGKTFSWSSTLTHHQRIHTGEKPYACNECGKAFSRSSTLIHHQRIHTEALPTFVTLIRLLPSVDPIVTNEAAFPAESLATIFALIWRLFCVHSLMFKKV

SEQ ID NO: 808102 - protein, 119 aa, Homo sapiens [sequence omitted]

SEQ ID NO: 808103 - protein, 394 aa, Homo sapiens; identical to SEQ ID NO: 808101

SEQ ID NO: 808104 - protein, 354 aa, Homo sapiens
FRLGTRLRGESAEGQELVTFEDVAVYFIRKEWKRLEPAQRDLYRDVMLENYGNVFSLDRETRTENDQEISEDTRSHGVLLGRFQKDISQGLKFKEAYEREVSLKRPLGNSPGERLNRKMPDFGQVTVEEKLTPRGERSEKYNDFGNSFTVNSNLISHQRLPVGDRPHKCDECSKSFNRTSDLIQHQRIHTGEKPYECNECGKAFSQSSHLIQHQRIHTGEKPYECSDCGKTFSCSSALILHRRIHTGEKPYECNECGKTFSWSSTLTHHQRIHTGEKPYACNECGKAFSRSSTLIHHQRIHTEALPTFVTLIRLLPSVDPIVTNEAAFPAESLATIFALIWRLFCVHSLMFKKV

SEQ ID NO: 808105 - protein, 52 aa, Homo sapiens
MCIFHPILSDFFGAAIHIPHPEIACQHVLFQELVTFEDVAVYFIRKEWKRLE

SEQ ID NO: 808106 - protein, 118 aa, Homo sapiens
MEEKYGGDVLAGPGGGGGLGPVDVPSARLTKYIVLLCFTKFLKAVGLFESYDLLKAVHIVQFIFILKLGTAFFMVLFQKPFSSGKTITKHQIIGSLKIPGRKEFKDKKLNDPRKLVGN

SEQ ID NO: 808107 - protein, 132 aa, Homo sapiens
MEEKYGGDVLAGPGGGGGLGPVDVPSARLTKYIVLLCFTKFLKAVGLFESYDLLKAVHIVQFIFILKLGTAFFMVLFQKPFSSGKTITKHQWIKIFKHAVAGCIISLLWFFGLTLCGPLRTLLLFEHSDIVV

SEQ ID NO: 808108 - protein, 112 aa, Homo sapiens
DSPRSEREGQRANCQIGARAGARERERERGRERKSERGKESANEGAERAPAATLLQHGQRQRPPSVHSTSRAACPLELLCIKDRSPICTHTPPPPPMHSSSSSFSRQLLGKK

SEQ ID NO: 808109 - protein, 66 aa, Homo sapiens
PPPPPPPPPLPPPRRPCTWAAPGSSPGPSAALPSTQRQACPPLEEKTREKRTKEAFLQSKEGGAKK

SEQ ID NO: 808110 - protein, 306 aa, Homo sapiens
MATAASNPYLPGNSLLAAGSIVHSDAAGAGGGGGGGGGGGGGGAGGGGGGMQPGSAAVTSGAYRGDPSSVKMVQSDFMQGAMADSNGGHMLSHAHQWVTALPHAAAAAAAAAAAAVEASSPWSGSAVGMAGSPQQPPQPPPPPPQGPDVKGGAGRDDLHAGTALHHRGPPHLGPPPPPPHQGHPGGWGAAAAAAAAAAAAAAAAHLPSMAGGLGRSGLQPRPIRRPPLHPETGMPALGGENAGETDQGGIFAVQGRRGQKIKSIINTQTVLYTYITNKTGREKGGDHEISFILWWCFVFVFVFKEG

SEQ ID NO: 808111 - protein, 500 aa, Homo sapiens [sequence omitted]

SEQ ID NO: 808112 - protein, 128 aa, Homo sapiens
MRENGKIHNDRCHRLTTANKASLSACVGPTSTTSLKHSKSKKESKKETLLTLFLHLLLLTGRLWYLMAGSSPSGPTLENRRKRRVVDLPAVVAEGMVLVAKIGATVAAATGVPVLKIVFCEGNPTTQL

SEQ ID NO: 808113 - protein, 142 aa, Homo sapiens
LFSGRCTAAAPQAEKPGAGEAAAAAAMAGIELERCQQQANEVTEIMRNNFGKVLERGVKLAELQQRSDQLLDMSSTFNKTTQNLAQKKCWENIRYRICVGLVVVGVLLIILIVLLVVFLPQSSDSSSAPRTQDAGIASGPGN

SEQ ID NO: 808114 - protein, 142 aa, Homo sapiens; identical to SEQ ID NO: 808113

SEQ ID NO: 808115 - protein, 580 aa, Homo sapiens
MGCFCAVPEEFYCEVLLLDESKLTLTTQQQGIKKSTKGSVVLDHVFHHVNLVEIDYFGLRYCDRSHQTYWLDPAKTLAEHKELINTGPPYTLYFGIKFYAEDPCKLKEEITRYQFFLQVKQDVLQGRLPCPVNTAAQLGAYAIQSELGDYDPYKHTAGYVSEYRFVPDQKEELEEAIERIHKTLMGQIPSEAELNYLRTAKSLEMYGVDLHPVYGENKSEYFLGLTPVGVVVYKNKKQVGKYFWPRITKVHFKETQFELRVLGKDCNETSFFFEARSKTACKHLWKCSVEHHTFFRMPENESNSLSRKLSKFGSIRYKHRYSGRTALQMSRDLSIQLPRPDQNVTRSRSKTYPKRIAQTQPAESNTISRITANMENGENEGTIKIIAPSPVKSFKKAKNENSPDTQRSKSHAPWEENGPQSGLYNSPSDRTKSPKFPYTRRRNPSCGSDNDSVQPVRRRKAHNSGEDSDLKQRRRSRSRCNTSSGSESENSNREHRKKRNRIRQENDMVDSAPQWEAVLRRQKEKNQADPNSRRSRHRSRSRSPDIQAKEELWKHIQKELVDPSGLSEEQLKEIPYTKIE

SEQ ID NO: 808116 - protein, 686 aa, Homo sapiens
MGCFCAVPEEFYCEVLLLDESKLTLTTQQQGIKKSTKGSVVLDHVFHHVNLVEIDYFGLRYCDRSHQTYWLDPAKTLAEHKELINTGPPYTLYFGIKFYAEDPCKLKEEITRYQFFLQVKQDVLQGRLPCPVNTAAQLGAYAIQSELGDYDPYKHTAGYVSEYRFVPDQKEELEEAIERIHKTLMGQIPSEAELNYLRTAKSLEMYGVDLHPVYGENKSEYFLGLTPVGVVVYKNKKQVGKYFWPRITKVHFKETQFELRVLGKDCNETSFFFEARSKTACKHLWKCSVEHHTFFRMPENESNSLSRKLSKFGSIRYKHRYSGRTALQMSRDLSIQLPRPDQNVTRSRSKTYPKRIAQTQPAESNTISRITANMENGENEGTIKIIAPSPVKSFKKAKNENSPDTQRSKSHAPWEENGPQSGLYNSPSDRTKSPKFPYTRRRNPSCGSDNDSVQPVRRRKAHNSGEDSDLKQRRRSRSRCNTSSGSESENSNREHRKKRNRIRQENDMVDSAPQWEAVLRRQKEKNQADPNSRRSRHRSRSRSPDIQAKEELWKHIQKELVDPSGLSEEQLKEIPYTKIETQGDPIRIRHSHSPRSYRQYRRSQCSDGERSVLSEVNSKTDLVPPLPVTHSSDAQGSGDATVHQRRNGSKDSLMEEKPQTSTNNLAGKHTAKTIKTIQASRLKTEN

SEQ ID NO: 808117 - protein, 580 aa, Homo sapiens; identical to SEQ ID NO: 808115

SEQ ID NO: 808118 - protein, 179 aa, Homo sapiens
MVDSAPQWEAVLRRQKEKNQADPNSRRSRHRSRSRSPDIQAKEELWKHIQKELVDPSGLSEEQLKEIPYTKIETQGDPIRIRHSHSPRSYRQYRRSQCSDGERSVLSEVNSKTDLVPPLPVTHSSDAQGSGDATVHQRRNGSKDSLMEEKPQTSTNNLAGKHTAKTIKTIQASRLKTEN

SEQ ID NO: 808119 - protein, 395 aa, Homo sapiens
MLPAVGSADEEEDPAEEDCPELVPIETTQSEEEEKSGLGAKIPVTIITGYLGAGKTTLLNYILTEQHSKRVAVILNEFGEGSALEKSLAVSQGGELYEEWLELRNGCLCCSVKDSGLRAIENLMQKKGKFDYILLETTGLADPGAVASMFWVDAELGSDIYLDGIITIVDSKYGLKHLTEEKPDGLINEATRQVALADAILINKTDLVPEEDVKKLRTTIRSINGLGQILETQRSRVDLSNVLDLHAFDSLSGISLQKKLQHVPGTQPHLDQSIVTITFEVPGNAKEEHLNMFIQNLLWEKNVRNKDNHCMEVIRLKGLVSIKDKSQQVIVQGVHELYDLEETPVSWKDDTERTNRLVLLGRNLDKDILKQLFIATVTETEKQWTTRFQEDQVCT

SEQ ID NO: 808120 - protein, 376 aa, Homo sapiens
MLPAVGSADEEEDPAEEDCPELVPIETTQSEEEEKSGLGAKIPVTIITGYLGAGKTTLLNYILTEQHSKRVAVILNEFGEGSALEKSLAVSQGGELYEEWLELRNGCLCCSVKDSGLRAIENLMQKKGKFDYILLETTGLADPGAVASMFWVDAELGSDIYLDGIITIVDSKYGLKHLTEEKPDGLINEATRQVALADAILINKTDLVPEEDVKKLRTTIRSINGLGQILETQRSSLQKKLQHVPGTQPHLDQSIVTITFEVPGNAKEEHLNMFIQNLLWEKNVRNKDNHCMEVIRLKGLVSIKDKSQQVIVQGVHELYDLEETPVSWKDDTERTNRLVLLGRNLDKDILKQLFIATVTETEKQWTTRFQEDQVCT

SEQ ID NO: 808121 - protein, 96 aa, Homo sapiens
GGISERRDVMTSGPGRPGVACWACAAAVRRVGPSGSAEVGTCCRPECYRLLDLRMRRRILRRRIVLNWFPLRRRKARRRKSLASAPRSQSQLSPGI

SEQ ID NO: 808122 - protein, 213 aa, Homo sapiens
MLPAVGSADEEEDPAEEDCPELVPIETTQSEEEEKSGLGAKIPVTIITGYLGAGKTTLLNYILTEQHSKRVAVILNEFGEGSALEKSLAVSQGGELYEEWLELRNGCLCCSVKDSGLRAIENLMQKKGKFDYILLETTGLADPGAVASMFWVDAELGSDIYLDGIITIVDSKYGLKHLTEEKPDGLINEATRQVALAEIGPPPNFFPFSKFFF

SEQ ID NO: 808123 - protein, 395 aa, Homo sapiens; identical to SEQ ID NO: 808119

SEQ ID NO: 808124 - protein, 359 aa, Homo sapiens
MYFKRAARAFPVLLTGAGKTTLLNYILTEQHSKRVAVILNEFGEGSALEKSLAVSQGGELYEEWLELRNGCLCCSVKDSGLRAIENLMQKKGKFDYILLETTGLADPGAVASMFWVDAELGSDIYLDGIITIVDSKYGLKHLTEEKPDGLINEATRQVALADAILINKTDLVPEEDVKKLRTTIRSINGLGQILETQRSRVDLSNVLDLHAFDSLSGISLQKKLQHVPGTQPHLDQSIVTITFEVPGNAKEEHLNMFIQNLLWEKNVRNKDNHCMEVIRLKGLVSIKDKSQQVIVQGVHELYDLEETPVSWKDDTERTNRLVLLGRNLDKDILKQLFIATVTETEKQWTTRFQEDQVCT

SEQ ID NO: 808125 - protein, 361 aa, Homo sapiens
MLPAVGSADEEEDPAEEDCPELVPIETTQSEEEEKSGLGAKIPVTIITGYLGAGKTTLLNYILTEQHSKRVAVILNEFGEGSALEKSLAVSQGGELYEEWLELRNGCLCCSVKDSGLRAIENLMQKKGKFDYILLETTGLADPGAVASMFWVDAELGSDIYLDGIITIVDSKYGLKHLTEEKPDGLINEATRQVALADAILINKTDLVPEEDVKKLRTTISLQKKLQHVPGTQPHLDQSIVTITFEVPGNAKEEHLNMFIQNLLWEKNVRNKDNHCMEVIRLKGLVSIKDKSQQVIVQGVHELYDLEETPVSWKDDTERTNRLVLLGRNLDKDILKQLFIATVTETEKQWTTRFQEDQVCT

SEQ ID NO: 808126 - protein, 367 aa, Homo sapiens
MLPAVGSADEEEDPAEEDCPELVPIETTQSEEEEKSGLGAKIPVTIITGYLGAGKTTLLNYILTEQHSKRVAVILNEFGEGSALEKSLAVSQGGELYEEWLELRNGCLCCSVKDSGLRAIENLMQKKGKFDYILLETTGLADPGAVASMFWVDAELGSDIYLDVITIVDSDQYGFTPFNKKEKPDGLIMKLLDPYMDYGQILETQQIRVDLSNVLDLHAFDSLSGISLQKKLQHVPGTQPHLDQSIVTITFEVPGNAKEEHLNMFIQNLLWEKNVRNKDNHCMEVIRLKGLVSIKDKSQQVIVQGVHELYDLEETPVSWKDDTERTNRLVLLGRNLDKDILKQLFIATVTETEKQWTTRFQEDQVCT

SEQ ID NO: 808127 - protein, 113 aa, Homo sapiens
MLPAVGSADEEEDPAEEDCPELVPIETTQSEEEEKSGLGAKIPVTIITGYLGAGKTTLLNYILTEQHSKRVAVILNEFGEGSALEKSLAVSQGGELYEEWLELRNGCLCCSVK

SEQ ID NO: 808128 - protein, 146 aa, Homo sapiens
MLPAVGSADEEEDPAEEDCPELVPIETTQSEEEEKSGLGAKIPVTIITGYLGAGKTTLLNYILTEQHSKRVAVILNEFGEGSALEKSLAVSQGGELYEEWLELRNGCLCCSVKDSGLRAIENLMQKKGKFDYILLETTGLADPGKK

SEQ ID NO: 808129 - protein, 101 aa, Homo sapiens
RRGCTGHLQLPARYSGCSWDPTASPGAAPAASPVQHVLESRAGPSPTVGSPSVSRMMSETLPSGSRSSWLLLSSNCTAISIASLMLVPEEHALSSISDGLY

SEQ ID NO: 808130 - protein, 583 aa, Homo sapiens
GSLCLSPCDPKSAGKMRLLLRPGGTWGALVKFSILANSNEDGKRVSPWRERLSIMKRRPWEFPGDPESGAGARPPRPVSGLRRWLDHSKHCLSVETEADSGQAGPYENWMLEPALATGEELPELTLLTTLLEGPGDKTQPPEEETLSQAPESEEEQKKKALERSMYVLSELVETEKMYVDDLGQIVEGYMATMAAQGVPESLRGRDRIVFGNIQQIYEWHRDYFLQELQRCLKDPDWLAQLFIKHERRLHMYVVYCQNKPKSEHVVSEFGDSYFEELRQQLGHRLQLNDLLIKPVQRIMKYQLLLKDFLKYYNRAGMDTADLEQAVEVMCFVPKRCNDMMTLGRLRGFEGKLTAQGKLLGQDTFWVTEPEAGGLLSSRGRERRVFLFEQIIIFSEALGGGVRGGTQPGYVYKNSIKVSCLGLEGNLQGDPCRFALTSRGPEGGIQRYVLQAADPAISQAWIKHVAQILESQRDFLNALQSPIEYQRRESQTNSLGRPRGPGVGSPGRIQLGDQAQGSTHTPINGSLPSLLLSPKGEVARALLPLDKQALGDIPQAPHDSPPVSPTPKTPPCQARLAKLDEDEL

SEQ ID NO: 808131 - protein, 574 aa, Homo sapiens
GGRCACPRVIRKVLAKCGCCFARGGRESYSIAGSEGSISASAASGLAAPSGPSSGLSSGPCSPGPPGPVSGLRRWLDHSKHCLSVETEADSGQAGPYENWMLEPALATGEELPELTLLTTLLEGPGDKTQPPEEETLSQAPESEEEQKKKALERSMYVLSELVETEKMYVDDLGQIVEGYMATMAAQGVPESLRGRDRIVFGNIQQIYEWHRDYFLQELQRCLKDPDWLAQLFIKHERRLHMYVVYCQNKPKSEHVVSEFGDSYFEELRQQLGHRLQLNDLLIKPVQRIMKYQLLLKDFLKYYNRAGMDTADLEQAVEVMCFVPKRCNDMMTLGRLRGFEGKLTAQGKLLGQDTFWVTEPEAGGLLSSRGRERRVFLFEQIIIFSEALGGGVRGGTQPGYVYKNSIKVSCLGLEGNLQGDPCRFALTSRGPEGGIQRYVLQAADPAISQAWIKHVAQILESQRDFLNALQSPIEYQRRESQTNSLGRPRGPGVGSPGRIQLGDQAQGSTHTPINGSLPSLLLSPKGEVARALLPLDKQALGDIPQAPHDSPPVSPTPKTPPCQARLAKLDEDEL

SEQ ID NO: 808132 - protein, 602 aa, Homo sapiens
GGRCACPRVIRKVLAKCGCCFARGGRESYSIAGSEGSISASAASGLAAPSGPSSGLSSGPCSPGPPGPVSGLRRWLDHSKHCLSVETEADSGQAGPYENWMLEPALATGEELPELTLLTTLLEGPGDKTQPPEEETLSQAPESEEEQKKKALERSMYVLSELVETEKMYVDDLGQIVEGYMATMAAQGVPESLRGRDRIVFGNIQQIYEWHRDYFLQELQRCLKDPDWLAQLFIKHERRLHMYVVYCQNKPKSEHVVSEFGDSYFEVSELRCLGGKEDRTGAFQAAYPPCPCPQELRQQLGHRLQLNDLLIKPVQRIMKYQLLLKDFLKYYNRAGMDTADLEQAVEVMCFVPKRCNDMMTLGRLRGFEGKLTAQGKLLGQDTFWVTEPEAGGLLSSRGRERRVFLFEQIIIFSEALGGGVRGGTQPGYVYKNSIKVSCLGLEGNLQGDPCRFALTSRGPEGGIQRYVLQAADPAISQAWIKHVAQILESQRDFLNALQSPIEYQRRESQTNSLGRPRGPGVGSPGRIQLGDQAQGSTHTPINGSLPSLLLSPKGEVARALLPLDKQALGDIPQAPHDSPPVSPTPKTPPCQARLAKLDEDEL

SEQ ID NO: 808133 - protein, 711 aa, Homo sapiens
GGRCACPRVIRKVLAKCGCCFARGGRESYSIAGSEGSISASAASGLAAPSGPSSGLSSGPCSPGPPGPVSGLRRWLDHSKHCLSVETEADSGQAGPYENWMLEPALATGEELPELTLLTTLLEGPGDKTQPPEEETLSQAPESEEEQKKKALERSMYVLSELVETEKMYVDDLGQIVEGYMATMAAQGVPESLRGRDRIVFGNIQQIYEWHRDVSGGTLTAEVLERGPHLVVLYPNISPLRLKECLEKFCRAHYQGRQLETAGSGRGGGCEMYLTCCFSTNPSSYFLQELQRCLKDPDWLAQLFIKHVRLEGAGPGAGLRNGLGFSGDASSLLAHPALSYNITPVRSAGCICMWCTVRISPSQSMWCQSLGTATLRSVAEMSWWEGGQNWGFPGCITTLSLPQELRQQLGHRLQLNDLLIKPVQRIMKYQLLLKDFLKYYNRAGMDTADLEQAVEVMCFVPKRCNDMMTLGRLRGFEGKLTAQGKLLGQDTFWVTEPEAGGLLSSRGRERRVFLFEQIIIFSEALGGGVRGGTQPGYVYKNSIKVSCLGLEGNLQGDPCRFALTSRGPEGGIQRYVLQAADPAISQAWIKHVAQILESQRDFLNALQSPIEYQRRESQTNSLGRPRGPGVGSPGRIQLGDQAQGSTHTPINGSLPSLLLSPKGEVARALLPLDKQALGDIPQAPHDSPPVSPTPKTPPCQARLAKLDEDEL

SEQ ID NO: 808134 - protein, 615 aa, Homo sapiens
GGRCACPRVIRKVLAKCGCCFARGGRESYSIAGSEGSISASAASGLAAPSGPSSGLSSGPCSPGPPGPVSGLRRWLDHSKHCLSVETEADSGQAGPYENWMLEPALATGEELPELTLLTTLLEGPGDKTQPPEEETLSQAPESEEEQKKKALERSMYVLSELVETEKMYVDDLGQIVEGYMATMAAQGVPESLRGRDRIVFGNIQQIYEWHRDYFLQELQRCLKDPDWLAQLFIKHERRLHMYVVYCQNKPKSEHVVSEFGDSYFEELRQQLGHRLQLNDLLIKPVQRIMKYQLLLKDFLKYYNRAGMDTADLEQAVEVMCFVPKRCNDMMTLGRLRGFEGKLTAQGKLLGQDTFWVTEPEAGGLLSSRGRERRVFLFEQIIIFSEALGGGVRGGTQPGYVYKNSIKVGRRPRGRAWRERGHEASERMSQRSQGGPEESGAVSYLPIQVSCLGLEGNLQGDPCRFALTSRGPEGGIQRYVLQAADPAISQAWIKHVAQILESQRDFLNALQSPIEYQRRESQTNSLGRPRGPGVGSPGRIQLGDQAQGSTHTPINGSLPSLLLSPKGEVARALLPLDKQALGDIPQAPHDSPPVSPTPKTPPCQARLAKLDEDEL

SEQ ID NO: 808135 - protein, 374 aa, Homo sapiens
TGEVVCGGGYMATMAAQGVPESLRGRDRIVFGNIQQIYEWHRDYFLQELQRCLKDPDWLAQLFIKHELRQQLGHRLQLNDLLIKPVQRIMKYQLLLKDFLKYYNRAGMDTADLEQAVEVMCFVPKRCNDMMTLGRLRGFEGKLTAQGKLLGQDTFWVTEPEAGGLLSSRGRERRVFLFEQIIIFSEALGGGVRGGTQPGYVYKNSIKVSCLGLEGNLQGDPCRFALTSRGPEGGIQRYVLQAADPAISQAWIKHVAQILESQRDFLNALQSPIEYQRRESQTNSLGRPRGPGVGSPGRIQLGDQAQGSTHTPINGSLPSLLLSPKGEVARALLPLDKQALGDIPQAPHDSPPVSPTPKTPPCQARLAKLDEDEL

SEQ ID NO: 808136 - protein, 291 aa, Homo sapiens
NQLRYLYVNAAAAQDFLKYYNRAGMDTADLEQAVEVMCFVPKRCNDMMTLGRLRGFEGKLTAQGKLLGQDTFWVTEPEAGGLLSSRGRERRVFLFEQIIIFSEALGGGVRGGTQPGYVYKNSIKVSCLGLEGNLQGDPCRFALTSRGPEGGIQRYVLQAADPAISQAWIKHVAQILESQRDFLNALQSPIEYQRRESQTNSLGRPRGPGVGSPGRIQLGDQAQGSTHTPINGSLPSLLLSPKGEVARALLPLDKQALGDIPQAPHDSPPVSPTPKTPPCQARLAKLDEDEL

SEQ ID NO: 808137 - protein, 288 aa, Homo sapiens
GGRCACPRVIRKVLAKCGCCFARGGRESYSIAGSEGSISASAASGLAAPSGPSSGLSSGPCSPGPPGPVSGLRRWLDHSKHCLSVETEADSGQAGPYENWMLEPALATGEELPELTLLTTLLEGPGDKTQPPEEETLSQAPESEEEQKKKALERSMYVLSELVETEKMYVDDLGQIVEGYMATMAAQGVPESLRGRDRIVFGNIQQIYEWHRDYFLQELQRCLKDPDWLAQLFIKHERRLHMYVVYCQNKPLVTSPRLPMTLLQSLQLQKPLPAKPDLPSWMKMSCNW

SEQ ID NO: 808138 - protein, 403 aa, Homo sapiens
GGRCACPRVIRKVLAKCGCCFARGGRESYSIAGSEGSISASAASGLAAPSGPSSGLSSGPCSPGPPGPVSGLRRWLDHSKHCLSVETEADSGQAGPYENWMLEPALATGEELPELTLLTTLLEGPGDKTQPPEEETLSQAPESEEEQKKKALERSMYVLSELVETEKMYVDDLGQIVEGYMATMAAQGVPESLRGRDRIVFGNIQQIYEWHRDYFLQELQRCLKDPDWLAQLFIKHERRLHMYVVYCQNKPKSEHVVSEFGDSYFEELRQQLGHRLQLNDLLIKPVQRIMKYQLLLKDFLKYYNRAGMDTADLEQAVEVMCFVPKRCNDMMTLGRLRGFEGKLTAQGKLLGQDTFWVTEPEAGGLLSSRGRERRVFLFEQIIIFSEALGGGVRGGTQLDEDEL

SEQ ID NO: 808139 - protein, 348 aa, Homo sapiens
GGRCACPRVIRKVLAKCGCCFARGGRESYSIAGSEGSISASAASGLAAPSGPSSGLSSGPCSPGPPGPVSGLRRWLDHSKHCLSVETEADSGQAGPYENWMLEPALATGEELPELTLLTTLLEGPGDKTQPPEEETLSQAPESEEEQKKKALERSMYVLSELVETEKMYVDDLGQIVEGYMATMAAQGVPESLRGRDRIVFGNIQQIYEWHRDYFLQELQRCLKDPDWLAQLFIKHERRLHMYVVYCQNKPKSEHVVSEFGDSYFEELRQQLGHRLQLNDLLIKPVQRIMKYQLLLKDFLKYYNRAGMDTADLEQAVEVMCFVPKRCNDMMTLGRLRGFEGKRPGYRA

SEQ ID NO: 808140 - protein, 184 aa, Homo sapiens
GTDEISIEGEMADVLDLHEAGGEDFAMDEDGDESIHKLKEKAKKRKGRGFGSEEGSRARMREDYDSVEQDGDEPGPQRSVEGWILFVTGVHEEATEEDIHDKFAEYGEIKNIHLNLDRRTGYLKGYTLVEYETYKEAQAAMEGLNGQDLMGQPISVDWCFVRGPPKGKRRGGRRRSRSPDRRRR

SEQ ID NO: 808141 - protein, 110 aa, Homo sapiens
GADGMTRPARSTRTGVHEEATEEDIHDKFAEYGEIKNIHLNLDRRTGYLKGYTLVEYETYKEAQAAMEGLNGQDLMGQPISVDWCFVRGPPKGKRRGGRRRSRSPDRRRR

SEQ ID NO: 808142 - protein, 184 aa, Homo sapiens; identical to SEQ ID NO: 808140

SEQ ID NO: 808143 - protein, 184 aa, Homo sapiens; identical to SEQ ID NO: 808140

SEQ ID NO: 808144 - protein, 184 aa, Homo sapiens; identical to SEQ ID NO: 808140

SEQ ID NO: 808145 - protein, 184 aa, Homo sapiens; identical to SEQ ID NO: 808140

SEQ ID NO: 808146 - protein, 132 aa, Homo sapiens
QQRCPRQEGDPSDSVEQDGDEPGPQRSVEGWILFVTGVHEEATEEDIHDKFAEYGEIKNIHLNLDRRTGYLKGYTLVEYETYKEAQAAMEGLNGQDLMGQPISVDWCFVRGPPKGKRRGGRRRSRSPDRRRR

SEQ ID NO: 808147 - protein, 184 aa, Homo sapiens; identical to SEQ ID NO: 808140

SEQ ID NO: 808148 - protein, 126 aa, Homo sapiens
GTDEISIEGEMADVLDLHEAGGEDFAMDEDGDESIHKLKEKAKKRKGRGFGSEEGSRARMREDYDSVEQDGDEPGPQRSVEGWILFVTGVHEEATEEDIHDKFAEYGEIKNIHLNLDRRTGYLKVS

SEQ ID NO: 808149 - protein, 184 aa, Homo sapiens; identical to SEQ ID NO: 808140

SEQ ID NO: 808150 - protein, 65 aa, Homo sapiens
VLVRGHQKEVAEDAAEVQTGDVADRSSVVQVFSSRFHLTMQPWTNRTGVELAVFIFNLLPYMRSI

SEQ ID NO: 808151 - protein, 184 aa, Homo sapiens; identical to SEQ ID NO: 808140

SEQ ID NO: 808152 - protein, 184 aa, Homo sapiens; identical to SEQ ID NO: 808140

SEQ ID NO: 808153 - protein, 240 aa, Homo sapiens
GTDEISIEGEMADVLDLHEAGGEDFAMDEDGDESIHKLKEKAKKRKGRGFGSEEGSRARMREDYDSVEQDGDEPGPQRSVEGWILFVTGVHEEATEEDIHDKFAEYGEIKNIHLNLDRRTGYLKGYTLVEYETYKEAQAAMEGLNGQDLMGQPISVDWCFVRGPPKGKRRQANLPGCKEAFLQKGQNGGSGASSFFRIALVALPHSCNFKKQDGPTDTSSNSKNSIIDNSLLKNTSECVL

SEQ ID NO: 808154 - protein, 126 aa, Homo sapiens; identical to SEQ ID NO: 808148

SEQ ID NO: 808155 - protein, 147 aa, Homo sapiens [sequence omitted]

SEQ ID NO: 808156 - protein, 69 aa, Homo sapiens
GRSHFRLVSNLQSPVVTGIEKSATKVKKDKINSFLVSSKTARERYQALSLALSSVSPSSEPPHITLNKQ

SEQ ID NO: 808157 - protein, 215 aa, Homo sapiens
HLSCWVLRNVLIDTWSLSLWSLQFSGVQLWEHGLKFYSILGQSGCSSNTGLSPRRADLNGSNMETVIGRGLKTTDGLAVDWVARNLYWTDTGRNTIEASRLDGSCRKVLINNSLDEPRAIAVFPRKGYLFWTDWGHIAKIERANLDGSERKVLINTDLGWPNGLTLDYDTRRIYWVDAHLDRIESADLNGKLRQVLVGHVSHPFALTQAGLKAER

SEQ ID NO: 808158 - protein, 555 aa, Homo sapiens
TYLLFSSRGSIRRISLDTSDHTDVHVPVPELNNVISLDYDSVDGKVYYTDVFLDVIRRADLNGSNMETVIGRGLKTTDGLAVDWVARNLYWTDTGRNTIEASRLDGSCRKVLINNSLDEPRAIAVFPRKGYLFWTDWGHIAKIERANLDGSERKVLINTDLGWPNGLTLDYDTRRIYWVDAHLDRIESADLNGKLRQVLVGHVSHPFALTQQDRWIYWTDWQTKSIQRVDKYSGRNKETVLANVEGLMDIIVVSPQRQTGTNACGVNNGGCTHLCFARASDFVCACPDEPDSQPCSLVPGLVPPAPRATGMSEKSPVLPNTPPTTLYSSTTRTRTSLEEVEGRCSERDARLGLCARSNDCCSCCSRGRTSYQLRHWWTPQYSADFGGDCSFDAVQVTSHKKSKFTDPGMGNLTYSNPSYRTSTQEVKIEAIPKPAMYNQLCYKKEGGPDHNYTKEKIKIVEGICLLSGDDAEWDDLKQLRSSRGGLLRDHVCMKTDTVSIQASSGSLDDTETEQLLQEEQSECSSVHTAATPERRGSLPDTGWKHERKLSSESQV

SEQ ID NO: 808159 - protein, 555 aa, Homo sapiens; identical to SEQ ID NO: 808158

SEQ ID NO: 808160 - protein, 555 aa, Homo sapiens; identical to SEQ ID NO: 808158

SEQ ID NO: 808161 - protein, 555 aa, Homo sapiens; identical to SEQ ID NO: 808158

SEQ ID NO: 808162 - protein, 553 aa, Homo sapiens
TYLLFSSRGSIRRISLDTSDHTDVHVPVPELNNVISLDYDSVDGKVYYTDVFLDVIRRADLNGSNMETVIGRGLKTTDGLAVDWVARNLYWTDTGRNTIEASRLDGSCRKVLINNSLDEPRAIAVFPRKGYLFWTDWGHIAKIERANLDGSERKVLINTDLGWPNGLTLDYDTRRIYWVDAHLDRIESADLNGKLRQVLVGHVSHPFALTQQDRWIYWTDWQTKSIQRVDKYSGRNKETVLANVEGLMDIIVVSPQRQTGTNACGVNNGGCTHLCFARASDFVCACPDEPDSQPCSLVPGLVPPAPRATGMSEKSPVLPNTPPTTLYSSTTRTRTSLEEVEGRCSERDARLGLCARSNDCCSCCSRGRTSYQLRHWWTPQYSADFGGDCSFDAVQVTSHKKSKFTDPGMGNLTYSNPSYRTSTQEVKIEAIPKPAMYNQLCYKKEGGPDHNYTKEKIKIVEGICLLSGDDAEWDDLKQLRSSRGGLLRDHVCMKTDTVSIQASSGSLDDTETEQLLQEEQSECSSVHTAATPERRGFCLADPCCGKPAYRHHF

SEQ ID NO: 808163 - protein, 395 aa, Homo sapiens
TYLLFSSRGSIRRISLDTSDHTDVHVPVPELNNVISLDYDSVDGKVYYTDVFLDVIRRADLNGSNMETVIGRGLKTTDGLAVDWVARNLYWTDTGRNTIEASRLDGSCRKVLINNSLDEPRAIAVFPRKGYLFWTDWGHIAKIERANLDGSERKVLINTDLGWPNGLTLDYDTRRIYWVDAHLDRIESADLNGKLRQVLVGHVSHPFALTQQDRWIYWTDWQTKSIQRVDKYSGRNKETVLANVEGLMDIIVVSPQRQTGTNACGVNNGGCTHLCFARASDFVCACPDEPDSQPCSLVPGLVPPAPRATGMSEKSPVLPNTPPTTLYSSTTRTRTSLEEVEGRCSERDARLGLCARSNDAVPAAPGEGLHISYAIGGLLSILLILVVIAALMLYR

SEQ ID NO: 808164 - protein, 130 aa, Homo sapiens
TYLLFSSRGSIRRISLDTSDHTDVHVPVPELNNVISLDYDSVDGKVYYTDVFLDVIRRADLNGSNMETVIGRGLKTTDGLAVDWVARNLYWTDTGRNTIEASRLDGSCRKVLINNSLDEPRAIAVFPRKG

SEQ ID NO: 808165 - protein, 445 aa, Homo sapiens
MYYQQALMRSTVKSSVSLGGIVKYSEQFSSNDAIMSGCLPSNPWITDDTQFWDLNAKLVEIPTKMRVERWAFNFSELIRDPKGRQSFQYFLKKEFSGENLGFWEACEDLKYGDQSKVKEKAEEIYKLFLAPGARRWINIDGKTMDITVKGLKHPHRYVLDAAQTHIYMLMKKDSYARYLKSPIYKDMLAKAIEPQETTKKSSTLPFMRRHLRSSPSPVILRQLEEEAKAREAANTVDITQPGQHMAPSPHLTVYTGTCMPPSPSSPFSSSCRSPRKPFASPSRFIRRPSTTICPSPIRVALESSSGLEQKGECSGSMAPRGPSVTESSEASLDTSWPRSRPRAPPKARMALSFSRFLRRGCLASPVFARLSPKCPAVSHGRVQPLGDVGQQLPRLKSKRVANFFQIKMDVPTGSGTCLMDSEDAGTGESGDRATEKEVICPWESL

SEQ ID NO: 808166 - protein, 674 aa, Homo sapiens
MTIRHQGQQYRPRMAFLQKIEALVKDMQNPETGVRMQNQRVLVTSVPHAMTGSDVLQWIVQRLWISSLEAQNLGNFIVRYGYIYPLQDPKNLILKPDGSLYRFQTPYFWPTQQWPAEDTDYAIYLAKRNIKKKGILEEYEKENYNFLNQKMNYKWDFVIMQAKEQYRAGKERNKADRYALDCQEKAYWLVHRCPPGMDNVLDYGLDRVTNPNEVKVNQKQTVVAVKKEIMYYQQALMRSTVKSSVSLGGIVKYSEQFSSNDAIMSGCLPSNPWITDDTQFWDLNAKLVEIPTKMRVERWAFNFSELIRDPKGRQSFQYFLKKEFSGENLGFWEACEDLKYGDQSKVKEKAEEIYKLFLAPGARRWINIDGKTMDITVKGLKHPHRYVLDAAQTHIYMLMKKDSYARYLKSPIYKDMLAKAIEPQETTKKSSTLPFMRRHLRSSPSPVILRQLEEEAKAREAANTVDITQPGQHMAPSPHLTVYTGTCMPPSPSSPFSSSCRSPRKPFASPSRFIRRPSTTICPSPIRVALESSSGLEQKGECSGSMAPRGPSVTESSEASLDTSWPRSRPRAPPKARMALSFSRFLRRGCLASPVFARLSPKCPAVSHGRVQPLGDVGQQLPRLKSKRVANFFQIKMDVPTGSGTCLMDSEDAGTGESGDRATEKEVICPWESL

SEQ ID NO: 808167 - protein, 898 aa, Homo sapiens [sequence omitted]

SEQ ID NO: 808168 - protein, 898 aa, Homo sapiens [sequence omitted]

SEQ ID NO: 808169 - protein, 898 aa, Homo sapiens [sequence omitted]

SEQ ID NO: 808170 - protein, 874 aa, Homo sapiens
MAAAAAEEGMEPRALQYEQTLMYGRYTQDLGAFAKEEAARIRLGGPEPWKGPPSSRAAPELLEYGRSRCARCRVCSVRCHKFLVSRVGEDWIFLVLLGLLMALVSWVMDYAIAACLQAQQWMSRGLNTSILLQYLAWVTYPVVLITFSAGFTQILAPQAVGSGIPEMKTILRGVVLKEYLTLKTFIAKVIGLTCALGSGMPLGKEGPFVHIASMCAALLSKFLSLFGGIYENESRNTEMLAAACAVGVGCCFAAPIGGVLFSIEVTSTFFAVRNYWRGFFAATFSAFIFRVLAVWNRDEETITALFKTRFRLDFPFDLQELPAFAVIGIASGFGGALFVYLNRKIVQVMRKQKTINRFLMRKRLLFPALVTLLISTLTFPPGFGQFMAGQLSQKETLVTLFDNRTWVRQGLVEELEPPSTSQAWNPPRANVFLTLVIFILMKAAFGRLVGESMAAWFPDGIHTDSSTYRIVPGGYAVVGAAALAGAVTHTVSTAVIVFELTGQIAHILPVMIAVILANAVAQSLQPSLYDSIIRIKKLPYLPELGWGRHQQYRVRVEDIMVRDVPHVALSCTFRDLRLALHRTKGRMLALVESPESMILLGSIERSQVVALLGAQLSPARRRQHMQERRATQTSPLSDQEGPPSPEASVCFQVNTEDSAFPAARGETHKPLKPALKRGPSVTRNLGESPTGSAESAGIALRSLFCGSPPPEAASEKLESCEKRKLKRVRISLASDADLEGEMSPEEILEWEEQQLDEPVNFSDCKIDPAPFQLVERTSLHKTHTIFSLLGVDHAYVTSIGRLIGIVTLKELRKAIEGSVTAQGVKVRPPLASFRDSATSSSDTETTEVHALWGPHSRHGLPREGSPSDSDDKCQ

SEQ ID NO: 808171 - protein, 920 aa, Homo sapiens
MAAAAAEEGMEPRALQYEQTLMYGRYTQDLGAFAKEEAARIRLGGPEPWKGPPSSRAAPELLEYGRSRCARCRVCSVRCHKFLVSRVGEDWIFLVLLGLLMALVSWVMDYAIAACLQAQQWMSRGLNTSILLQYLAWVTYPVVLITFSAGFTQILAPQAVGSGIPEMKTILRGVVLKEYLTLKTFIAKVIGLTCALGSGMPLGKEGPFVHIASMCAALLSKFLSLFGGIYENESRNTEMLAAACAVGVGCCFAAPIGGVLFSIEVTSTFFAVRNYWRGFFAATFSAFIFRVLAVWNRDEETITALFKTRFRLDFPFDLQELPAFAVIGIASGFGGALFVYLNRKIVQVMRKQKTINRFLMRNPEICEATQPLATHDCCETYDSRRLLFPALVTLLISTLTFPPGFGQFMAGQLSQKETLVTLFDNRTWVRQGLVEELEPPSTSQAWNPPRANVFLTLVIFILMKFWMSALATTIPVPCGAFMPVFVIGAAFGRLVGESMAAWFPDGIHTDSSTYRIVPGGYAVVGAAALAGAVTHTVSTAVIVFELTGQIAHILPVMIAVILANAVAQSLQPSLYDSIIRIKKLPYLPELGWGRHQQYRVRVEDIMVRDVPHVALSCTFRDLRLALHRTKGRMLALVESPESMILLGSIERSQVVALLGAQLSPARRRQHMQERRATQTSPLSDQEGPPSPEASVCFQVNTEDSAFPAARGETHKPLKPALKRGPSVTRNLGESPTGSAESAGIALRSLFCGSPPPEAASEKLESCEKRKLKRVRISLASDADLEGEMSPEEILEWEEQQLDEPVNFSDCKIDPAPFQLVERTSLHKTHTIFSLLGVDHAYVTSIGRLIGIVTLKELRKAIEGSVTAQGVKVRPPLASFRDSATSSSDTETTEVHALWGPHSRHGLPREGSPSDSDDKCQ

SEQ ID NO: 808172 - protein, 753 aa, Homo sapiens
MSRGLNTSILLQYLAWVTYPVVLITFSAGFTQILAPQAVGSGIPEMKTILRGVVLKEYLTLKTFIAKVIGLTCALGSGMPLGKEGPFVHIASMCAALLSKFLSLFGGIYENESRNTEMLAAACAVGVGCCFAAPIGGVLFSIEVTSTFFAVRNYWRGFFAATFSAFIFRVLAVWNRDEETITALFKTRFRLDFPFDLQELPAFAVIGIASGFGGALFVYLNRKIVQVMRKQKTINRFLMRKRLLFPALVTLLISTLTFPPGFGQFMAGQLSQKETLVTLFDNRTWVRQGLVEELEPPSTSQAWNPPRANVFLTLVIFILMKAAFGRLVGESMAAWFPDGIHTDSSTYRIVPGGYAVVGAAALAGAVTHTVSTAVIVFELTGQIAHILPVMIAVILANAVAQSLQPSLYDSIIRIKKLPYLPELGWGRHQQYRVRVEDIMVRDVPHVALSCTFRDLRLALHRTKGRMLALVESPESMILLGSIERSQVVALLGAQLSPARRRQHMQERRATQTSPLSDQEGPPSPEASVCFQVNTEDSAFPAARGETHKPLKPALKRGPSVTRNLGESPTGSAESAGIALRSLFCGSPPPEAASEKLESCEKRKLKRVRISLASDADLEGEMSPEEILEWEEQQLDEPVNFSDCKIDPAPFQLVERTSLHKTHTIFSLLGVDHAYVTSIGRLIGIVTLKELRKAIEGSVTAQGVKVRPPLASFRDSATSSSDTETTEVHALWGPHSRHGLPREGSPSDSDDKCQ

SEQ ID NO: 808173 - protein, 666 aa, Homo sapiens
MAAAAAEEGMEPRALQYEQTLMYGRYTQDLGAFAKEEAARIRLGGPEPWKGPPSSRAAPELLEYGRSRCARCRVCSVRCHKFLVSRVGEDWIFLVLLGLLMALVSWVMDYAIAACLQAQQWMSRGLNTSILLQYLAWVTYPVVLITFSAGFTQILAPQAVGSGIPEMKTILRGVVLKEYLTLKTFIAKVIGLTCALGSGMPLGKEGPFVHIASMCAALLSKFLSLFGGIYENESRNTEMLAAACAVGVGCCFAAPIGGVLFSIEVTSTFFAVRNYWRGFFAATFSAFIFRVLAVWNRDEETITALFKTRFRLDFPFDLQELPAFAVIGIASGFGGALFVYLNRKIVQVMRKQKTINRFLMRKRLLFPALVTLLISTLTFPPGFGQFMAGQLSQKETLVTLFDNRTWVRQGLVEELEPPSTSQAWNPPRANVFLTLVIFILMKAAFGRLVGESMAAWFPDGIHTDSSTYRIVPGGYAVVGAAALAGAVTHTVSTAVIVFELTGQIAHILPVMIAVILANAVAQSLQPSLYDSIIRIKKLPYLPELGWGRHQQYRVRVEDIMVRDVPHVALSCTFRDLRLALHRTKGRMLALVESPESMILLGSIERSQVVALLGAQLSPARRRQHMQERRATQTSPLSDQEGPPSPEASVCFQTWGASFSQFILPGI

SEQ ID NO: 808174 - protein, 131 aa, Homo sapiens
GKSVRLASSGMTRRDPLTNKVALVTASTELGFSPYNVSKTALLGLNKTLAIELAPRNIRVNCLAPGLIKTSFSRMLWMDKEKEESMKETLRIRRLGEPEDSLGIVSFLCSEDASYLTGETVMVGGGTPSRL

SEQ ID NO: 808175 - protein, 423 aa, Homo sapiens
MASALEQFVNSVRQLSAQGQMTQLCELINKSGELLAKNLSHLDTVLGALDVQEHSLGVLAVLFVKFSMPSVPDFETLFSQVQLFISTCNGEHIRYATDTFAGLCHQLTNALVERKQPLRGIGILKQAIDKMQMNTNQLTSIHADLCQLCLLAKCFKPALPYLDVDMMDICKENGAYDAKHFLCYYYYGGMIYTGLKNFERALYFYEQAITTPAMAVSHIMLESYKKYILVSLILLGKVQQLPKYTSQIVGRFIKPLSNAYHELAQVYSTNNPSELRNLVNKHSETFTRDNNMGLVKQCLSSLYKKNIQRLTKTFLTLSLQDMASRVQLSGPQEAEKYVLHMIEDGEIFASINQKDGMVSFHDNPEKYNNPAMLHNIDQEMLKCIELDERLKAMDQEITVNPQFVQKSMGSQEDDSGNKPSSYS

SEQ ID NO: 808176 - protein, 102 aa, Homo sapiens
MASRVQLSGPQEAEKYVLHMIEDGEIFASINQKDGMVSFHDNPEKYNNPAMLHNIDQEMLKCIELDERLKAMDQEITVNPQFVQKSMGSQEDDSGNKPSSYS

SEQ ID NO: 808177 - protein, 253 aa, Homo sapiens
MPSVPDFETLFSQVQLFISTCNGEHIRYATDTFAGLCHQLTNALVERKQPLRGIGILKQAIDKMQMNTNQLTSIHADLCQLCLLAKCFKPALPYLDVDMMDICKENGAYDAKHFLCYYYYGGMIYTGLKNFERALYFYEQAITTPAMAVSHIMLESYKKYILVSLILLGKVQQLPKYTSQIVGRFIKPLSNAYHELAQVYSTNNPSELRNLVNKHSETFTRDNNMGLVKQCLSSLYKKNIQRLTKVRKVPPSQ

SEQ ID NO: 808178 - protein, 423 aa, Homo sapiens; identical to SEQ ID NO: 808175

SEQ ID NO: 808179 - protein, 423 aa, Homo sapiens; identical to SEQ ID NO: 808175

SEQ ID NO: 808180 - protein, 403 aa, Homo sapiens
MTQLCELINKSGELLAKNLSHLDTVLGALDVQEHSLGVLAVLFVKFSMPSVPDFETLFSQVQLFISTCNGEHIRYATDTFAGLCHQLTNALVERKQPLRGIGILKQAIDKMQMNTNQLTSIHADLCQLCLLAKCFKPALPYLDVDMMDICKENGAYDAKHFLCYYYYGGMIYTGLKNFERALYFYEQAITTPAMAVSHIMLESYKKYILVSLILLGKVQQLPKYTSQIVGRFIKPLSNAYHELAQVYSTNNPSELRNLVNKHSETFTRDNNMGLVKQCLSSLYKKNIQRLTKTFLTLSLQDMASRVQLSGPQEAEKYVLHMIEDGEIFASINQKDGMVSFHDNPEKYNNPAMLHNIDQEMLKCIELDERLKAMDQEITVNPQFVQKSMGSQEDDSGNKPSSYS

SEQ ID NO: 808181 - protein, 403 aa, Homo sapiens; identical to SEQ ID NO: 808180

SEQ ID NO: 808182 - protein, 356 aa, Homo sapiens
MPSVPDFETLFSQVQLFISTCNGEHIRYATDTFAGLCHQLTNALVERKQPLRGIGILKQAIDKMQMNTNQLTSIHADLCQLCLLAKCFKPALPYLDVDMMDICKENGAYDAKHFLCYYYYGGMIYTGLKNFERALYFYEQAITTPAMAVSHIMLESYKKYILVSLILLGKVQQLPKYTSQIVGRFIKPLSNAYHELAQVYSTNNPSELRNLVNKHSETFTRDNNMGLVKQCLSSLYKKNIQRLTKTFLTLSLQDMASRVQLSGPQEAEKYVLHMIEDGEIFASINQKDGMVSFHDNPEKYNNPAMLHNIDQEMLKCIELDERLKAMDQEITVNPQFVQKSMGSQEDDSGNKPSSYS

SEQ ID NO: 808183 - protein, 446 aa, Homo sapiens
MASALEQFVNSVRQLSAQGQMTQLCELINKSGELLAKNLSHLDTVLGALDVQEHSLGVLAVLFVKFSMPSVPDFETLFSQVQLFISTCNGEHIRYATDTFAGLCHQLTNALVERKQGQHKIQCAAIFENLSERDVISGQPLRGIGILKQAIDKMQMNTNQLTSIHADLCQLCLLAKCFKPALPYLDVDMMDICKENGAYDAKHFLCYYYYGGMIYTGLKNFERALYFYEQAITTPAMAVSHIMLESYKKYILVSLILLGKVQQLPKYTSQIVGRFIKPLSNAYHELAQVYSTNNPSELRNLVNKHSETFTRDNNMGLVKQCLSSLYKKNIQRLTKTFLTLSLQDMASRVQLSGPQEAEKYVLHMIEDGEIFASINQKDGMVSFHDNPEKYNNPAMLHNIDQEMLKCIELDERLKAMDQEITVNPQFVQKSMGSQEDDSGNKPSSYS

SEQ ID NO: 808184 - protein, 396 aa, Homo sapiens
MASALEQFVNSVRQLSAQGQMTQLCELINKSGELLAKNLSHLDTVLGALDVQEHSLGVLAVLFVKFSMPSVPDFETLFSQVQLFISTCNGEHIRYATDTFAGLCHQLTNALVERKQPLRGIGILKQAIDKMQMNTNQLTSIHADLCQLCLLAKCFKPALPYLDVDMMDICKENGAYDAKHFLCYYYYGGMIYTGLKNFERALYFYEQAITTPAMAVSHIMLESYKKYILVSLILLGKVQQLPKYTSQIVGRFIKPLSNAYHELAQVYSTNNPSELRNLVNKHSETFTRDNNMGLVKQCLSSLYKKNIQRLTKTFLTLSLQDMASRVQLSGPQEAEKYVLHMIEDGEIFASINQKDGMVSFHDNPEKYNNPAMLHNIDQESMGSQEDDSGNKPSSYS

SEQ ID NO: 808185 - protein, 318 aa, Homo sapiens
MGSTFDMQQTLPLRGIGILKQAIDKMQMNTNQLTSIHADLCQLCLLAKCFKPALPYLDVDMMDICKENGAYDAKHFLCYYYYGGMIYTGLKNFERALYFYEQAITTPAMAVSHIMLESYKKYILVSLILLGKVQQLPKYTSQIVGRFIKPLSNAYHELAQVYSTNNPSELRNLVNKHSETFTRDNNMGLVKQCLSSLYKKNIQRLTKTFLTLSLQDMASRVQLSGPQEAEKYVLHMIEDGEIFASINQKDGMVSFHDNPEKYNNPAMLHNIDQEMLKCIELDERLKAMDQEITVNPQFVQKSMGSQEDDSGNKPSSYS

SEQ ID NO: 808186 - protein, 454 aa, Homo sapiens
MASALEQFVNSVRQLSAQGQMTQLCELINKSGELLAKNLSHLDTVLGALDVQEHSLGVLAVLFVKFSMPSVPDFETLFSQVQLFISTCNGEHIRYATDTFAGLCHQLTNALVERKQPLRGIGILKQAIDKMQMNTNQLTSIHADLCQLCLLAKCFKPALPYLDVDMMDICKENGAYDAKHFLCYYYYGGMIYTGLKNFERALYFYEQAITTPAMAVSHIMLESYKKYILVSLILLGKVQQLPKYTSQIVGRFIKRQSLAMLARLVLNSWPQAVLLRLPPRVLGLQPLSNAYHELAQVYSTNNPSELRNLVNKHSETFTRDNNMGLVKQCLSSLYKKNIQRLTKTFLTLSLQDMASRVQLSGPQEAEKYVLHMIEDGEIFASINQKDGMVSFHDNPEKYNNPAMLHNIDQEMLKCIELDERLKAMDQEITVNPQFVQKSMGSQEDDSGNKPSSYS

SEQ ID NO: 808187 - protein, 365 aa, Homo sapiens
MASALEQFVNSVRQLSAQGQMTQLCELINKSGELLAKNLSHLDTVLGALDVQEHSLGVLAVLFVKFSMPSVPDFETLFSQVQLFISTCNGEHIRYATDTFAGLCHQLTNALVERKQPLRGIGILKQAIDKMQMNTNQLTSIHADLCQLCLLAKCFKPALPYLDVDMMDICKENGAYDAKHFLCYYYYGGMIYTGLKNFERALYFYEQAITTPAMAVSHIMLESYKKYILVSLILLGKVQQLPKYTSQIVGRFIKTFLTLSLQDMASRVQLSGPQEAEKYVLHMIEDGEIFASINQKDGMVSFHDNPEKYNNPAMLHNIDQEMLKCIELDERLKAMDQEITVNPQFVQKSMGSQEDDSGNKPSSYS

SEQ ID NO: 808188 - protein, 363 aa, Homo sapiens
MASALEQFVNSVRQLSAQGQMTQLCELINKSGELLAKNLSHLDTVLGALDVQEHSLGVLAVLFVKFSMPSVPDFETLFSQVQLFISTCNGEHIRYATDTFAGLCHQLTNALVERKQPLRGIGILKQAIDKMQMNTNQLTSIHADLCQAITTPAMAVSHIMLESYKKYILVSLILLGKVQQLPKYTSQIVGRFIKPLSNAYHELAQVYSTNNPSELRNLVNKHSETFTRDNNMGLVKQCLSSLYKKNIQRLTKTFLTLSLQDMASRVQLSGPQEAEKYVLHMIEDGEIFASINQKDGMVSFHDNPEKYNNPAMLHNIDQEMLKCIELDERLKAMDQEITVNPQFVQKSMGSQEDDSGNKPSSYS

SEQ ID NO: 808189 - protein, 132 aa, Homo sapiens
MGLVKQCLSSLYKKNIQRLTKTFLTLSLQDMASRVQLSGPQEAEKYVLHMIEDGEIFASINQKDGMVSFHDNPEKYNNPAMLHNIDQEMLKCIELDERLKAMDQEITVNPQFVQKSMGSQEDDSGNKPSSYS

SEQ ID NO: 808190 - protein, 551 aa, Homo sapiens
MEEELPLFSGDSGKPVQATLSSLKMLDVGKWPIFSLCSEEELQLIRQACVFGSAGNEVLYTTVNDEIFVLGTNCCGCLGLGDVQSTIEPRRLDSLNGKKIACLSYGSGPHIVLATTEGEVFTWGHNAYSQLGNGTTNHGLVPCHISTNLSNKQVIEVACGSYHSLVLTSDGEVFAWGYNNSGQVGSGSTVNQPIPRRVTGCLQNKVVVTIACGQMCCMAVVDTGEVYVWGYNGNGQLGLGNSGNQPTPCRVAALQGIRVQRVACGYAHTLVLTDEGQVYAWGANSYGQLGTGNKSNQSYPTPVTVEKDRIIEIAACHSTHTSAAKTQGGHVYMWGQCRGQSVILPHLTHFSCTDDVFACFATPAVTWRLLSVEPDDHLTVAESLKREFDNPDTADLKFLVDGKYIYAHKVLLKIRCEHFRSSLEDNEDDIVEMSEFSYPVYRAFLEYLYTDSISLSPEEAVGLLDLATFYRENRLKKLCQQTIKQGICEENAIALLSAAVKYDAQDLEEFCFRFCINHLTVVTQTSGFAEMDHDLLKNFISKASRVGAFKN

SEQ ID NO: 808191 - protein, 527 aa, Homo sapiens
MLDVGKWPIFSLCSEEELQLIRQACVFGSAGNEVLYTTVNDEIFVLGTNCCGCLGLGDVQSTIEPRRLDSLNGKKIACLSYGSGPHIVLATTEGEVFTWGHNAYSQLGNGTTNHGLVPCHISTNLSNKQVIEVACGSYHSLVLTSDGEVFAWGYNNSGQVGSGSTVNQPIPRRVTGCLQNKVVVTIACGQMCCMAVVDTGEVYVWGYNGNGQLGLGNSGNQPTPCRVAALQGIRVQRVACGYAHTLVLTDEGQVYAWGANSYGQLGTGNKSNQSYPTPVTVEKDRIIEIAACHSTHTSAAKTQGGHVYMWGQCRGQSVILPHLTHFSCTDDVFACFATPAVTWRLLSVEPDDHLTVAESLKREFDNPDTADLKFLVDGKYIYAHKVLLKIRCEHFRSSLEDNEDDIVEMSEFSYPVYRAFLEYLYTDSISLSPEEAVGLLDLATFYRENRLKKLCQQTIKQGICEENAIALLSAAVKYDAQDLEEFCFRFCINHLTVVTQTSGFAEMDHDLLKNFISKASRVGAFKN

SEQ ID NO: 808192 - protein, 527 aa, Homo sapiens; identical to SEQ ID NO: 808191

SEQ ID NO: 808193 - protein, 309 aa, Homo sapiens
MEEELPLFSGDSGKPVQATLSSLKMLDVGKWPIFSLCSEEELQLIRQACVFGSAGNEVLYTTVNDEIFVLGTNCCGCLGLGDVQSTIEPRRLDSLNGKKIACLSYGSGPHIVLATTEGEVFTWGHNAYSQLGNGTTNHGLVPCHISTNLSNKQVIEVACGSYHSLVLTSDGEVFAWGYNNSGQVGSGSTVNQPIPRRVTGCLQNKVVVTIACGQMCCMAVVDTGEVYVWGYNGNGQLGLGNSGNQPTPCRVAALQGIRVQRVACGYAHTLVLTDEGQVYAWGANSYGQLGTGNKSNQSYPTPVTVEKDR

SEQ ID NO: 808194 - protein, 538 aa, Homo sapiens
MSFSATILFSPPSGSEARCCCCACKSETNGGNTGSQGGNPPPSTPITVTGHGLAVQSSEQLLHVIYQRVDKAVGLAEAALGLARANNELLKRLQEEVGDLRQGKVSIPDEDGESRAHSSPPEEPGPLKESPGEAFKALSAVEEECDSVGSGVQVVIEELRQLGAASVGPGPLGFPATQRDMRLPGCTLAASEAAPLLNPLVDDYVASEGAVQRVLVPAYAKQLSPATQLAIQRATPETGPENGTKLPPPRPEDMLNAAAALDSALEESGPGSTGELRHSLGLTVSPCRTRGSGQKNSRRKRDLVLSKLVHNVHNHITNDKRFNGSESIKSSWNISVVKFLLEKLKQELVTSPHNYTDKELKGACVAYFLTKRREYRNSLNPFKGLKEKEEKKLRSRRYRLFANRSSIMRHFGPEDQRLWNDVTEELMSDEEDSLNEPGVWVARPPRFRAQRLTELCYHLDANSKHGTKANRVYGPPSDRLPSAEAQLLPPELYNPNFQEEEDEGGDENAPGSPSFDQPHKTCCPDLNSFIEIKVEKDE

SEQ ID NO: 808195 - protein, 538 aa, Homo sapiens; identical to SEQ ID NO: 808194

SEQ ID NO: 808196 - protein, 498 aa, Homo sapiens
MSFSATILFSPPSGSEARCCCCACKSETNGGNTGSQGGNPPPSTPITVTGHGLAVQSSEQLLHVIYQRVDKAVGLAEAALGLARANNELLKRLQEEVGDLRQGKVSIPDEDGESRAHSSPPEEPGPLKESPGEAFKALSAVEEECDSVGSGVQVVIEELRQLGAASVGPGPLGFPATQRDMRLPGCTLAASEAAPLLNPLVDDYVASEGAVQRVLVPAYAKQLSPATQLAIQRATPETGPENGTKLPPPRPEDMLNAAAALDSALEESGPGSTGELRHSLGLTVSPCRTRGSGQKNSRRKRDLVLSKLVHNVHNHITNDKRFNGSESIKSSWNISVVKFLLEKLKQELVTSPHNYTDKELKGACVAYFLTKRREYRNSLNPFKGLKEKEEKKLRSRRYRLFANRSSIMRHFGPEDQRLWNDVTEELMSDEEDSLNEPDRLPSAEAQLLPPELYNPNFQEEEDEGGDENAPGSPSFDQPHKTCCPDLNSFIEIKVEKDE

SEQ ID NO: 808197 - protein, 538 aa, Homo sapiens; identical to SEQ ID NO: 808194

SEQ ID NO: 808198 - protein, 358 aa, Homo sapiens
MRLPGCTLAASEAAPLLNPLVDDYVASEGAVQRVLVPAYAKQLSPATQLAIQRATPETGPENGTKLPPPRPEDMLNAAAALDSALEESGPGSTGELRHSLGLTVSPCRTRGSGQKNSRRKRDLVLSKLVHNVHNHITNDKRFNGSESIKSSWNISVVKFLLEKLKQELVTSPHNYTDKELKGACVAYFLTKRREYRNSLNPFKGLKEKEEKKLRSRRYRLFANRSSIMRHFGPEDQRLWNDVTEELMSDEEDSLNEPGVWVARPPRFRAQRLTELCYHLDANSKHGTKANRVYGPPSDRLPSAEAQLLPPELYNPNFQEEEDEGGDENAPGSPSFDQPHKTCCPDLNSFIEIKVEKDE

SEQ ID NO: 808199 - protein, 520 aa, Homo sapiens
MSFSATILFSPPSGSEARCCCCACKSETNGGNTGSQGGNPPPSTPITVTGHGLAVQSSEQLLHVIYQRVDKAVGLAEAALGLARANNELLKRLQEEVGDLRQGKVSIPDEDGESRAHSSPPEEPGPLKESPGEAFKALSAVEEECDSVGSGVQVVIEELRQLGAASVGPGPLGFPATQRDMRLPGCTLAASEAAPLLNPLVDDYVASEGAVQRVLVPAYAKQLSPATQLAIQRATPETGPAALDSALEESGPGSTGELRHSLGLTVSPCRTRGSGQKNSRRKRDLVLSKLVHNVHNHITNDKRFNGSESIKSSWNISVVKFLLEKLKQELVTSPHNYTDKELKGACVAYFLTKRREYRNSLNPFKGLKEKEEKKLRSRRYRLFANRSSIMRHFGPEDQRLWNDVTEELMSDEEDSLNEPGVWVARPPRFRAQRLTELCYHLDANSKHGTKANRVYGPPSDRLPSAEAQLLPPELYNPNFQEEEDEGGDENAPGSPSFDQPHKTCCPDLNSFIEIKVEKDE

SEQ ID NO: 808200 - protein, 538 aa, Homo sapiens; identical to SEQ ID NO: 808194

SEQ ID NO: 808201 - protein, 358 aa, Homo sapiens; identical to SEQ ID NO: 808198

SEQ ID NO: 808202 - protein, 198 aa, Homo sapiens
PNLRLGDSCLGSQIEPSQCCTGTLGWPWGAQEMRKHLAPSKRSARKNGVQIRVESAGCGKMACECGGGQYPEGPVRPRFPGALSPFVASAALELEGERSLQEEQEVEQRKQPVPRLLLHLGHSPDPDQRVQQEQQPSGQGVKEDQSLHAGRSTLPTSPCLRPQDPAGRARSPPVSRNMTSTETCCCLWSLLTLSARCR

SEQ ID NO: 808203 - protein, 145 aa, Homo sapiens
VFGDLQKPGHGGPAQGPPCLSPQAPRRQRLTGKELPGLVGAAEVHGPLQHPEVRPGQGPWTAVLEGLVAAQMVTGREARAGGLPSVSDLVAAPRATPAALAMTRSERRPLASGPPFPLHAPLSSAASADLSAATWFCAERKKKVF

SEQ ID NO: 808204 - protein, 670 aa, Homo sapiens
EAERRSGSAARAVSVPRVRVATMEVKGKKQFTGKSTKTAQEKNRFHKNSDSGSSKTFPTRKVAKEGGPKVTSRNFEKSITKLGKKGVKQFKNKQQGDKSPKNKFQPANKFNKKRKFQPDGRSDESAAKKPKWDDFKKKKKELKQSRQLSDKTNYDIVVRAKQMWEILRRKDCDKEKRVKLMSDLQKLIQGKIKTIAFAHDSTRVIQCYIQYGNEEQRKQAFEELRDDLVELSKAKYSRNIVKKFLMYGSKPQIAEIIRSFKGHVRKMLRHAEASAIVEYAYNDKAILEQRNMLTEELYGNTFQLYKSADHRTLDKVLEVQPEKLELIMDEMKQILTPMAQKEAVIKHSLVHKVFLDFFTYAPPKLRSEMIEAIREAVVYLAHTHDGARVAMHCLWHGTPKDRKVIVKTMKTYVEKVANGQYSHLVLLAAFDCIDDTKLVKQIIISEIISSLPSIVNDKYGRKVLLYLLSPRDPAHTVREIIEVLQKGDGNAHSKKDTEVRRRELLESISPALLSYLQEHAQEVVLDKSACVLVSDILGSATGDVQPTMNAIASLAATGLHPGGKDGELHIAEHPAGHLVLKWLIEQDKKMKENGREGCFAKTLVEHVGMKNLKSWASVNRGAIILSSLLQSCDLEVANKVKAALKSLIPTLEKTKSTSKGIEILLEKLST

SEQ ID NO: 808205 - protein, 670 aa, Homo sapiens; identical to SEQ ID NO: 808204

SEQ ID NO: 808206 - protein, 654 aa, Homo sapiens
EAERRSGSAARAVSVPRVRVATMEVKGKKQFTGKSTKTAQEKNRFHKNSDSGSSKTFPTRKVAKEGGPKVTSRNFEKSITKLGKKGVKQFKNKQQGDKSPKNKFQPANKFNKKRKFQPDGRSDESAAKKPKWDDFKKKKKELKQSRQLSDKTNYDIVVRAKQMWEILRRKDCDKEKRVKLMSDLQKLIQGKIKTIAFAHDSTRVIQCYIQYGNEEQRKQAFEELRDDLVELSKAKYSRNIVKKFLMYGSKPQIAEIIRSFKGHVRKMLRHAEASAIVEYAYNDKAILEQRNMLTEELYGNTFQLYKSADHRTLDKVLEVQPEKLELIMDEMKQILTPMAQKEAVIKHSLVHKVFLDFFTYAPPKLRSEMIEAIREAVVYLAHTHDGARVAMHCLWHGTPKDRKVIVKTMKTYVEKVANGQYSHLVLLAAFDCIDDTKLVKQIIISEIISSLPSIVNDKYGRKVLLYLLSPRDPAHTVREIIEVLQKGDGNAHSKKDTEVRRRELLESISPALLSYLQEHAQEVVLDKSACVLVSDILGSATGDVQPTMNAIASLAATGLHPGGKDGELHIAEHPAGHLVLKWLIEQDKKMKENGREGCFAKTLVEHVGMKNLKSWASVNRGAIILSSLLQSCDLEVVNKDTTHTCTHSTHTRTQ

SEQ ID NO: 808207 - protein, 341 aa, Homo sapiens
EAERRSGSAARAVSVPRVRVATMEVKGKKQFTGKSTKTAQEKNRFHKNSDSGSSKTFPTRKVAKEGGPKVTSRNFEKSITKLGKKGVKQFKNKQQGDKSPKNKFQPANKFNKKRKFQPDGRSDESAAKKPKWDDFKKKKKELKQSRQLSDKTNYDIVVRAKQMWEILRRKDCDKEKRVKLMSDLQKLIQGKIKTIAFAHDSTRVIQCYIQYGNEEQRKQAFEELRDDLVELSKAKYSRNIVKKFLMYGSKPQIAEIIRSFKGHVRKMLRHAEASAIVEYAYNDKAILEQRNMLTEELYGNTFQLYKSADHRTLDKVLEVQPEKLELIMDEMKQILTPMAQK

SEQ ID NO: 808208 - protein, 275 aa, Homo sapiens
MPKVFLVKRRSLGVSVRSWDELPDEKRADTYIPVGLGRLLHDPPEDCRSDGGSSSGSGSSSAGEPGGAESSSSPHAPESETPEPGDAEGPDGHLATKQRPVARSKIKFTTGTCSDSVVHSCDLCGKGFRLQRMLNRHLKCHNQVKRHLCTFCGKGFNDTFDLKRHVRTHTGIRPYKCNVCNKAFTQRCSLESHLKKIHGVQQQYAYKQRRDKLYVCEDCGYTGPTQEDLYLHVNSAHPGSSFLKKTSKKLAALLQGKLTSAHQENTSLSEEEERK

SEQ ID NO: 808209 - protein, 275 aa, Homo sapiens; identical to SEQ ID NO: 808208

SEQ ID NO: 808210 - protein, 295 aa, Homo sapiens
SRASLTRRAPAAPGSWHTSDDLLEEGDRSDTRGCAGCPGRTRTRPWEGQRAPQLGLGRLLHDPPEDCRSDGGSSSGSGSSSAGEPGGAESSSSPHAPESETPEPGDAEGPDGHLATKQRPVARSKIKFTTGTCSDSVVHSCDLCGKGFRLQRMLNRHLKCHNQVKRHLCTFCGKGFNDTFDLKRHVRTHTGIRPYKCNVCNKAFTQRCSLESHLKKIHGVQQQYAYKQRRDKLYVCEDCGYTGPTQEDLYLHVNSAHPGSSFLKKTSKKLAALLQGKLTSAHQENTSLSEEEERK

SEQ ID NO: 808211 - protein, 53 aa, Homo sapiens
MTCTNVGIAISPAGKSVLPVGSPPWLELQFPTSLLRSVSVDLNVDPSLQIDIP

SEQ ID NO: 808212 - protein, 170 aa, Homo sapiens
MKFTTGTCSDSVVHSCDLCGKGFRLQRMLNRHLKCHNQVKRHLCTFCGKGFNDTFDLKRHVRTHTGIRPYKCNVCNKAFTQRCSLESHLKKIHGVQQQYAYKQRRDKLYVCEDCGYTGPTQEDLYLHVNSAHPGSSFLKKTSKKLAALLQGKLTSAHQENTSLSEEEERK

SEQ ID NO: 808213 - protein, 157 aa, Homo sapiens
MKCIPYSVLLKDLEMRNLRELEDLIIEAVYTDIIQGKLDQRNQLLEVDFCIGRDIRKKDINNIVKTLHEWCDGCEAVLLGIEQQVLRANQYKENHNRTQQQVEAEVTNIKKTLKATASSSAQEMEQQLAERECPPHAEQRQPTKKMSKVKGLVSSRH

SEQ ID NO: 808214 - protein, 116 aa, Homo sapiens
MKCIPYSVLLKDLEMRNLRELEDLIIEAVYTDIIQGKLDQRNQLLEVDFCIGRDIRKKDINNIVKTLHEWCDGCEAVLLGIEQQVLRANQYKENHNRTQQQVEAEVTNIRMVTLVP

SEQ ID NO: 808215 - protein, 264 aa, Homo sapiens
MAGEQKPSSNLLEQFILLAKGTSGSALTALISQVLEAPGVYVFGELLELANVQELAEGANAAYLQLLNLFAYGTYPDYIANKESLPELSTAQQNKLKHLTIVSLASRMKCIPYSVLLKDLEMRNLRELEDLIIEAVYTDIIQGKLDQRNQLLEVDFCIGRDIRKKDINNIVKTLHEWCDGCEAVLLGIEQQVLRANQYKENHNRTQQQVEAEVTNIKKTLKATASSSAQEMEQQLAERECPPHAEQRQPTKKMSKVKGLVSSRH

SEQ ID NO: 808216 - protein, 264 aa, Homo sapiens; identical to SEQ ID NO: 808215

SEQ ID NO: 808217 - protein, 308 aa, Homo sapiens
MAGEQKPSSNLLEQFILLAKGTSGSALTALISQVLEAPGVYVFGELLELANVQELAEGANAAYLQLLNLFAYGTYPDYIANKESLPELSTAQQNKLKHLTIVSLASRMKCIPYSVLLKDLEMRNLRELEDLIIEAVYTDIIQGKLDQRNQLLEVDFCIGRDIRKKDINNIVKTLHEWCDGCEAVLLGIEQQVLRANQYKENHNRTQQQVEAEVTNIKKTLKATASSSAQEMEQQLAERECPPHAEQRQPTKKMSKVKGPSCPLELPANACSPKIFNSSWLHLGRDGGIDAPLSAEGPVAASVFSPLLG

SEQ ID NO: 808218 - protein, 264 aa, Homo sapiens; identical to SEQ ID NO: 808215

SEQ ID NO: 808219 - protein, 118 aa, Homo sapiens
AWYHSPHDGTRAGEECPLLTRGGASFTIIPGGWLKLPPAYNQPDKMTWSKRKTGRETRYHSPHDGAVISSQASRCAAFPLLPHPLLAAPVQAVEGRDAGLCLLNPRVFSLLSPAPISN

SEQ ID NO: 808220 - protein, 264 aa, Homo sapiens; identical to SEQ ID NO: 808215

SEQ ID NO: 808221 - protein, 264 aa, Homo sapiens; identical to SEQ ID NO: 808215

SEQ ID NO: 808222 - protein, 157 aa, Homo sapiens; identical to SEQ ID NO: 808213

SEQ ID NO: 808223 - protein, 209 aa, Homo sapiens
MAGEQKPSSNLLEQFILLAKGTSGSALTALISQVLEAPGVYVFGELLELANVQECIPYSVLLKDLEMRNLRELEDLIIEAVYTDIIQGKLDQRNQLLEVDFCIGRDIRKKDINNIVKTLHEWCDGCEAVLLGIEQQVLRANQYKENHNRTQQQVEAEVTNIKKTLKATASSSAQEMEQQLAERECPPHAEQRQPTKKMSKVKGLVSSRH

SEQ ID NO: 808224 - protein, 106 aa, Homo sapiens
MQFIKVDLVICHPTAYGPCKPVWKPIFYNLQESTESDVFGSNIFSRVPMDYGIRQHRACFPAVSSAPRNFLKEAGRVNEVPPGVLQFLLPTGQGESGGSLSVDAVT

SEQ ID NO: 808225 - protein, 152 aa, Homo sapiens [sequence omitted]

SEQ ID NO: 808226 - protein, 144 aa, Homo sapiens [sequence omitted]

SEQ ID NO: 808227 - protein, 535 aa, Homo sapiens
MGRGFLGFPSLAGSAPRRILYLGDTPKAGARADGEDLTTLSDPLGKEGRRRDPGPAPPCRLVPGAKTQRARRPPGARPCPLPSAGQPAQLRRAGGAAGMARVAWGLLWLLLGSAGAQYEKYSFRGFPPEDLMPLAAAYGHALEQYEGESWRESARYLEAALRLHRLLRDSEAFCHANCSGPAPAAKPDPDGGRADEWACELRLFGRVLERAACLRRCKRTLPAFQVPYPPRQLLRDFQSRLPYQYLHYALFKANRLEKAVAAAYTFLQRNPKHELTAKYLNYYQGMLDVADESLTDLEAQPYEAVFLRAVKLYNSGDFRSSTEDMERALSEYLAVFARCLAGCEGAHEQVDFKDFYPAIADLFAESLQCKVDCEANLTPNVGGYFVDKFVATMYHYLQFAYYKLNDVRQAARSAASYMLFDPKDSVMQQNLVYYRFHRARWGLEEEDFQPREEAMLYHNQTAELRELLEFTHMYLQSDDEMELEETEPPLEPEDALSDAEFEGEGDYEEGMYADWWQEPDAKGDEAEAEPEPELA

SEQ ID NO: 808228 - protein, 437 aa, Homo sapiens
MARVAWGLLWLLLGSAGAQYEKYSFRGFPPEDLMPLAAAYGHALEQYEGESWRESARYLEAALRLHRLLRDSEAFCHANCSGPAPAAKPDPDGGRADEWACELRLFGRVLERAACLRRCKRTLPAFQVPYPPRQLLRDFQSRLPYQYLHYALFKANRLEKAVAAAYTFLQRNPKHELTAKYLNYYQGMLDVADESLTDLEAQPYEAVFLRAVKLYNSGDFRSSTEDMERALSEYLAVFARCLAGCEGAHEQVDFKDFYPAIADLFAESLQCKVDCEANLTPNVGGYFVDKFVATMYHYLQFAYYKLNDVRQAARSAASYMLFDPKDSVMQQNLVYYRFHRARWGLEEEDFQPREEAMLYHNQTAELRELLEFTHMYLQSDDEMELEETEPPLEPEDALSDAEFEGEGDYEEGMYADWWQEPDAKGDEAEAEPEPELA

SEQ ID NO: 808229 - protein, 535 aa, Homo sapiens; identical to SEQ ID NO: 808227

SEQ ID NO: 808230 - protein, 419 aa, Homo sapiens
MGRGFLGFPSLAGSAPRRILYLGDTPKAGARADGEDLTTLSDPLGKEGRRRDPGPAPPCRLVPGAKTQRARRPPGARPCPLPSAGQPAQLRRAGGAAGMARVAWGLLWLLLGSAGAQYEKYSFRGFPPEDLMPLAAAYGHALEQYEGESWRESARYLEAALRLHRLLRDSEAFCHANCSGPAPAAKPDPDGGRADEWACELRLFGRVLERAACLRRCKRTLPAFQVPYPPRQLLRDFQSRLPYQYLHYALFKANRLEKAVAAAYTFLQRNPKHELTAKYLNYYQGMLDVADESLTDLEAQPYEAVFLRAVKLYNSGDFRSSTEDMERALSEYLAVFARCLAGCEGAHEQVDFKDFYPAIADLFAESLQCKVDCEANLTPNVGGYFVDKFVATMYHYLQFAYYKSMAPPSPAWAAARTIY

SEQ ID NO: 808231 - protein, 537 aa, Homo sapiens
MGRGFLGFPSLAGSAPRRILYLGDTPKAGARADGEDLTTLSDPLGKEGRRRDPGPAPPCRLVPGAKTQRARRPPGARPCPLPSAGQPAQLRRAGGAAGMARVAWGLLWLLLGSAGAQYEKYSFRGFPPEDLMPLAAAYGHALEQYEGESWRESARYLEAALRLHRLLRDSEAFCHANCSGPAPAAKPDPDGGRADEWACELRLFGRVLERAACLRRCKRTLPAFQVPYPPRQLLRDFQSRLPYQYLHYALFKANRLEKAVAAAYTFLQRNPKHELTAKYLNYYQGMLDVADESLTDLEAQPYEVGWRVRRRLVEEELVEEGRCWGRPDSPCHAAFQAVFLRAVKLYNSGDFRSSTEDMERALSEYLAVFARCLAGCEGAHEQVDFKDFYPAIAGICHPDHGGRSSHPQGPVRQMSPSCTWSTANAEEPAGRKALSVEKDAGCRGPSGSVQGAGSEAMLYHNQTAELRELLEFTHMYLQSDDEMELEETEPPLEPEDALSDAEFEGEGDYEEGMYADWWQEPDAKGDEAEAEPEPELA

SEQ ID NO: 808232 - protein, 316 aa, Homo sapiens
MGRGFLGFPSLAGSAPRRILYLGDTPKAGARADGEDLTTLSDPLGKEGRRRDPGPAPPCRLVPGAKTQRARRPPGARPCPLPSAGQPAQLRRAGGAAGMARVAWGLLWLLLGSAGAQYEKYSFRGFPPEDLMPLAAAYGHALEQYEGESWRESARYLEAALRLHRLLRDSEAFCHANCSGPAPAAKPDPDGGRADEWACELRLFGRVLERAACLRRCKRTLPAFQVPYPPRQLLRDFQSRLPYQYLHYALFKANRLEKAVAAAYTFLQRNPKHELTAKYLNYYQGMLDVADESLTDLEAQPYEVGWRVRRRLVEEG

SEQ ID NO: 808233 - protein, 118 aa, Homo sapiens
GRADEWACELRLFGRVLERAACLRRCKRTLPAFQVPYPPRQLLRDFQSRLPYQYLHYALFKRWEPAPTRGPVSGWASWLPTDRSKERYLHPRHEARRALGAASSGLADPLPHPLPPDQ

SEQ ID NO: 808234 - protein, 97 aa, Homo sapiens
RALSEYLAVFARCLAGCEGAHEQVDFKDFYPAIAGICHPDHGGRSSHPQGPVRQMSPSCTWSTANAEEPAGRKALSVEKDAGCRGPSWECPRGWISE

SEQ ID NO: 808235 - protein, 524 aa, Homo sapiens
MNLASFAGTSNSSPLQAGARADGEDLTTLSDPLGKEGRRRDPGPAPPCRLVPGAKTQRARRPPGARPCPLPSAGQPAQLRRAGGAAGMARVAWGLLWLLLGSAGAQYEKYSFRGFPPEDLMPLAAAYGHALEQYEGESWRESARYLEAALRLHRLLRDSEAFCHANCSGPAPAAKPDPDGGRADEWACELRLFGRVLERAACLRRCKRTLPAFQVPYPPRQLLRDFQSRLPYQYLHYALFKANRLEKAVAAAYTFLQRNPKHELTAKYLNYYQGMLDVADESLTDLEAQPYEAVFLRAVKLYNSGDFRSSTEDMERALSEYLAVFARCLAGCEGAHEQVDFKDFYPAIADLFAESLQCKVDCEANLTPNVGGYFVDKFVATMYHYLQFAYYKLNDVRQAARSAASYMLFDPKDSVMQQNLVYYRFHRARWGLEEEDFQPREEAMLYHNQTAELRELLEFTHMYLQSDDEMELEETEPPLEPEDALSDAEFEGEGDYEEGMYADWWQEPDAKGDEAEAEPEPELA

SEQ ID NO: 808236 - protein, 437 aa, Homo sapiens; identical to SEQ ID NO: 808228

SEQ ID NO: 808237 - protein, 504 aa, Homo sapiens
MGRGFLGFPSLAGSAPRRILYLGDTPKAGARADGEDLTTLSDPLGKEGRRRDPGPAPPCRLVPGAKTQRARRPPGARPCPLPSAGQPAQLRRAGGAAGMARVAWGLLWLLLGSAGAQYEKYSFRGFPPEDLMPLAAAYGHALEQYEGESWRESARYLEAALRLHRLLRDSEAFCHANCSGPAPAAKPDPDGGRADEWACELRLFGRVLERAACLRRCKRTLPAFQVPYPPRQLLRDFQSRLPYQYLHYALFKANRLEKAVAAAYTFLQRNPKHELTAKYLNYYQGMLDVADESLTDLEAQPYEAVFLRAVKLYNSGDFRSSTEDMERALSEYLAVFARCLAGCEGAHEQVDFKDFYPAIAGICHPDHGGRSSHPQGPVRQMSPSCTWSTANAEEPAGRKALSVEKDAGCRGPSWECPRAGSEAMLYHNQTAELRELLEFTHMYLQSDDEMELEETEPPLEPEDALSDAEFEGEGDYEEGMYADWWQEPDAKGDEAEAEPEPELA

SEQ ID NO: 808238 - protein, 281 aa, Homo sapiens
MGRGFLGFPSLAGSAPRRILYLGDTPKAGARADGEDLTTLSDPLGKEGRRRDPGPAPPCRLVPGAKTQRARRPPGARPCPLPSAGQPAQLRRAGGAAGMARVAWGLLWLLLGSAGAQYEKYSFRGFPPEDLMPLAAAYGHALEQYEGESWRESARYLEAALRLHRLLRDSEAFCHANCSGPAPAAKPDPDGGRADEWACELRLFGRVLERAACLRRCKRTLPAFQVPYPPRQLLRDFQSRLPYQYLHYALFKANRLEKAVAAAYTFLQRNPKHELTAKYLN

SEQ ID NO: 808239 - protein, 252 aa, Homo sapiens
MGRGFLGFPSLAGSAPRRILYLGDTPKAGARADGEDLTTLSDPLGKEGRRRDPGPAPPCRLVPGAKTQRARRPPGARPCPLPSAGQPAQLRRAGGAAGMARVAWGLLWLLLGSAGAQYEKYSFRGFPPEDLMPLAAAYGHALEQYEGESWRESARYLEAALRLHRLLRDSEAFCHANCSGPAPAAKPDPDGGRADEWACELRLFGRVLERAACLRRCKRTLPAFQVPYPPRQLLRDFQSRLPYQYLHYALFK

SEQ ID NO: 808240 - protein, 62 aa, Homo sapiens
MLYHNQTAELRELLEFTHMYLQSDDEVSASCFPGLGCDGDTLDLFLGPPVCQNSAPAPGGQL

SEQ ID NO: 808241 - protein, 159 aa, Homo sapiens
MRTFRSEPSKFARSILAMWPQSVQKRYLRHNSAIIIKAWEDSTQRLREHRGPTNTIFPPSPSSLDLSSAGHKLYPFLGKTAMARGSSRLLLISTLRQEPSSLDASMVFRPVSVQYRFLATQSTASPSVVFSPRPITVSMLLPFRSARLGESPVLDEQPD

SEQ ID NO: 808242 - protein, 215 aa, Homo sapiens
MDRSNPVKPALDYFSNRLVNYQISVKCSNQFKLEVCLLNAENKVVDNQAGTQGQLKVLGANLWWPYLMHEHPAYLYSGRMVIAHTKALDPSQPVTFGTNSTYAADKGALYVDVIRVNSYYSWYRNYGHLELIRLQLAAQFENWCETSQSHYSERVWSGNACRVSPGLVNYQISVKCSNQFKLEVCLLNAENKVVDNQAGTQGQLKVLVPTSGGRT

SEQ ID NO: 808243 - protein, 98 aa, Homo sapiens
RLRDPLRTVIPSAQTFLIHQQKTVDGTMSLGNTSFQLALLHIQNMDGFVLGDSNELWGKGAQVMVLLTAPFHHIAGCLPQYSLCSSSEKATARQALRW

SEQ ID NO: 808244 - protein, 106 aa, Homo sapiens
MITLNPHSAAMSQILYRQQDGSQEATGLMIGCLVYPDGWDSSEVRRMCGEQTGKYTLGHCTIRWAFMLAILSIGDALILSFLAFVLGYRQDKLLPDDYKADGTEEV

SEQ ID NO: 808245 - protein, 129 aa, Homo sapiens
SAPRGPGTLGCPLCPKAFPLQRMLTRHLKCHSPVRRHLCRCCGKGFHDAFDLKRHMRTHTGIRPFRCSACGKAFTQRCSLEAHLAKVHGQPASYAYRERREKLHVCEDCGFTSSRPDTYAQHRALHRAA

SEQ ID NO: 808246 - protein, 129 aa, Homo sapiens
DLTPEQVRTQNSLASPDSHMQYVQAPDTSVALVLQSLHKAENSSGRKGLPKLGALGPGRRVWSSDPPSLLLPPGNPTVMTLIVSHNNLGIPWDSGAAKLFHPLVASAVLITNSSTNRSPTDRPPDRPPA

SEQ ID NO: 808247 - protein, 172 aa, Homo sapiens
DLTPEQVRTQNSLASPDSHMQYVQAPDTSVALVLQSLHKAENSSGRKGLPKLGALGPGRRVWSSDPPSLLLPPGNPTVMTLIVSHNNLGIPWDSGAAKLFHPLVASAVLITSLTIPQAHPQWACGIHISYSYFKPQYPAKCLLSTQNSIPSAGCGGSCLNPSTLGGQDGRIA

SEQ ID NO: 808248 - protein, 128 aa, Homo sapiens
SYYPSKAMILKITITIPAGWAVQGPTGPTAGADHTGRPGPGPERWRHPPGRRQTLQRQEKVSPEGSGRLPCPVSPLHICLDLTGLPFPWKADLLGTRHILEQGIGKLFLKGPESQYFRLCKPIPPHLG

SEQ ID NO: 808249 - protein, 182 aa, Homo sapiens
MPSGEERRDRQKGRRAGCDTSSTPSNTAPRIPEPGAHPTAARPATAQPPRSLLPPVCSKTIALPASAAAASGSDTAGMRGLGKAPHSGEGHERGRGNSKMKACNNYQYGYLAKPDTSFWIKCRRWLLADAGRHTQRPFWTFRVSHSPLLEAEAGRPSDVSQLQLGSDLKPKMRRPAGELFSP

SEQ ID NO: 808250 - protein, 236 aa, Homo sapiens
GTEAVSVGGQGTLRFYCVILPPSWPDAMGVTCVSQMPVAEGKSVQQTVELLTRKLEMLGAEKQGTFCVDCETYHTAASTLGSQGQTGKLMYVMHNSEYPLSCFALFENGPCLIADTNFDVLMVKLKGFFQSAKASKIETRGTRYQYCDFLVKVGTVTMGPVPGISVEVEYGPCVVASDCWSLLLEFLQSFLGSHTPGAPAVFGNRHDAVYGPADTMVQYMELFNKIRKQQQVAGIR

SEQ ID NO: 808251 - protein, 102 aa, Homo sapiens
MQRYNFHYLKYIVHFYRTCDYSRMIRMVLAYGELLLLTVSAEILFQWTNIVAWQQMPTFCGIAANLQETLVGFSFCFLCFFPLLLNQQGWKEGREVMNYSFQ

SEQ ID NO: 808252 - protein, 101 aa, Homo sapiens
VTPEDYLALPIVHFYRTCDYSRMIRMVLAYGELLLLTVSAEILFQWTNIVAWQQMPTFCGIAANLQETLVGFSFCFLCFFPLLLNQQGWKEGREVMNYSFQ

SEQ ID NO: 808253 - protein, 102 aa, Homo sapiens; identical to SEQ ID NO: 808251

SEQ ID NO: 808254 - protein, 168 aa, Homo sapiens
MQMIIIWALLDTEAESSAKGVHSFYNNISGLTDFGEKVVAEMNRLGMMVDLSHVSDAVARRALEVSQAPVIFSHSAARGVCNSARNVPDDILQLLKKNGGVVMVSLSMGVIQCNPSANVSTVADHFDHIKAVIGSKFIGIGGDYDGAGKYRKKTNGKAPWRTSSRMSS

SEQ ID NO: 808255 - protein, 82 aa, Homo sapiens
CLSVSGIGGFLVSLSSRMKLQTLAVSVTALKFWSAYVPCQTQDRDALRLTLEQIDLIRRMCASYSELELVTSAKGRQVDGKR

SEQ ID NO: 808256 - protein, 486 aa, Homo sapiens
MQPSGLEGPGTFGRWPLLSLLLLLLLLQPVTCAYTTPGPPRALTTLGAPRAHTMPGTYAPSTTLSSPSTQGLQEQARALMRDFPLVDGHNDLPLVLRQVYQKGLQDVNLRNFSYGQTSLDRLRDGLVGAQFWSAYVPCQTQDRDALRLTLEQIDLIRRMCASYSELELVTSAKALNDTQKLACLIGVEGGHSLDNSLSILRTFYMLGVRYLTLTHTCNTPWAESSAKGVHSFYNNISGLTDFGEKVVAEMNRLGMMVDLSHVSDAVARRALEVSQAPVIFSHSAARGVCNSARNVPDDILQLLKKNGGVVMVSLSMGVIQCNPSANVSTVADHFDHIKAVIGSKFIGIGGDYDGAGKFPQGLEDVSTYPVLIEELLSRGWSEEELQGVLRGNLLRVFRQVEKVQEENKWQSPLEDKFPDEQLSSSCHSDLSRLRQRQSLTSGQELTEIPIHWTAKLPAKWSVSESSPHMAPVLAVVATFPVLILWL

SEQ ID NO: 808257 - protein, 486 aa, Homo sapiens; identical to SEQ ID NO: 808256

SEQ ID NO: 808258 - protein, 486 aa, Homo sapiens; identical to SEQ ID NO: 808256

SEQ ID NO: 808259 - protein, 486 aa, Homo sapiens; identical to SEQ ID NO: 808256

SEQ ID NO: 808260 - protein, 398 aa, Homo sapiens
MQPSGLEGPGTFGRWPLLSLLLLLLLLQPVTCAYTTPGPPRAFWSAYVPCQTQDRDALRLTLEQIDLIRRMCASYSELELVTSAKALNDTQKLACLIGVEGGHSLDNSLSILRTFYMLGVRYLTLTHTCNTPWAESSAKGVHSFYNNISGLTDFGEKVVAEMNRLGMMVDLSHVSDAVARRALEVSQAPVIFSHSAARGVCNSARNVPDDILQLLKKNGGVVMVSLSMGVIQCNPSANVSTVADHFDHIKAVIGSKFIGIGGDYDGAGKFPQGLEDVSTYPVLIEELLSRGWSEEELQGVLRGNLLRVFRQVEKVQEENKWQSPLEDKFPDEQLSSSCHSDLSRLRQRQSLTSGQELTEIPIHWTAKLPAKWSVSESSPHMAPVLAVVATFPVLILWL

SEQ ID NO: 808261 - protein, 499 aa, Homo sapiens
MQPSGLEGPGTFGRWPLLSLLLLLLLLQPVTCAYTTPGPPRALTTLGAPRAHTMPGTYAPSTTLSSPSTQGLQEQARALMRDFPLVDGHNDLPLVLRQVYQKGLQDVNLRNFSYGQTSLDRLRDGLVGAQFWSAYVPCQTQDRDALRLTLEQIDLIRRMCASYSELELVTSAKALNDTQKLACLIGVEGGHSLDNSLSILRTFYMLGVRYLTLTHTCNTPWAESSAKGVHSFYNNISGLTDFGEKVVAEMNRLGMMVDLSHVSDAVARRALEVSQAPVIFSHSAARGVCNSARNVPDDILQLLKKNGGVVMVSLSMGVIQCNPSANVSTVADHFDHIKAVIGSKFIGIGGDYDGAGKESGLKPTSWWPHRFPQGLEDVSTYPVLIEELLSRGWSEEELQGVLRGNLLRVFRQVEKVQEENKWQSPLEDKFPDEQLSSSCHSDLSRLRQRQSLTSGQELTEIPIHWTAKLPAKWSVSESSPHMAPVLAVVATFPVLILWL

SEQ ID NO: 808262 - protein, 276 aa, Homo sapiens
MIIIWALLDTEAESSAKGVHSFYNNISGLTDFGEKVVAEMNRLGMMVDLSHVSDAVARRALEVSQAPVIFSHSAARGVCNSARNVPDDILQLLKKNGGVVMVSLSMGVIQCNPSANVSTVADHFDHIKAVIGSKFIGIGGDYDGAGKFPQGLEDVSTYPVLIEELLSRGWSEEELQGVLRGNLLRVFRQVEKVQEENKWQSPLEDKFPDEQLSSSCHSDLSRLRQRQSLTSGQELTEIPIHWTAKLPAKWSVSESSPHMAPVLAVVATFPVLILWL

SEQ ID NO: 808263 - protein, 376 aa, Homo sapiens
MQPSGLEGPGTFGRWPLLSLLLLLLLLQPVTCAYTTPGPPRALTTLGAPRAHTMPGTYAPSTTLSSPSTQGLQEQARALMRDFPLVDGHNDLPLVLRQVYQKGLQDVNLRNFSYGQTSLDRLRDGLVGAQFWSAYVPCQTQDRDALRLTLEQIDLIRRMCASYSELELVTSAKALNDTQKLACLIGVEGGHSLDNSLSILRTFYMLGVRYLTLTHTCNTPWAESSAKGVHSFYNNISGLTDFGEKVVAEMNRLGMMVDLSHVSDAVARRALEVSQAPVIFSHSAARGVCNSARNVPDDILQLLKKNGGVVMVSLSMGVIQCNPSANVSTVADHFDHIKAVIGSKFIGIGGDYDGAGKYRKKTNGKAPWRTSSRMSS

SEQ ID NO: 808264 - protein, 370 aa, Homo sapiens
MQPSGLEGPGTFGRWPLLSLLLLLLLLQPVTCAYTTPGPPRALTTLGAPRAHTMPGTYAPSTTLSSPSTQGLQEQARALMRDFPLVDGHNDLPLVLRQVYQKGLQDVNLRNFSYGQTSLDRLRDGLVGAQFWSAYVPCQTQDRDALRLTLEQIDLIRRMCASYSELELVTSAKALNDTQKLACLIGVEGGHSLDNSLSILRTFYMLGVRYLTLTHTCNTPWAESSAKGVHSFYNNISGLTDFGEKVVAEMNRLGMMVDLSHVSDAVARRALEVSQAPVIFSHSAARGVCNSARNVPDDILQLLKKNGGVVMVSLSMGVIQCNHQPMCPLWQITSTTSRLSLDPSSSGLVEIMMGPANSLRGWKTCPHTRS

SEQ ID NO: 808265 - protein, 1463 aa, Homo sapiens
MHVNAHADSLPVRREGRRDGSPWRSVVCRYCRCSRQTGASVTTVSLPSSSSSPGLDPRGPRQASVRSLRSEPVLLFLPFRTPYRDSEEGKREGLSRLRAVCRRAGPRGRGSFSPRDARASPRLHFLVAAVTTGAASRRQRGARVRQPSPSSSRRAKRLRECERRSLHAPPAMDASYDGTEVTVVMEEIEEAYCYTSPGPPKKKKKYKIHGEKTKKPRSAYLLYYYDIYLKVQQELPHLPQSEINKKISESWRLLSVAERSYYLEKAKLEKEGLDPNSKLSALTAVVPDIPGFRKILPRSDYIIIPKSSLQEDRSCPQLELCVAQNQMSPKGPPLVSNTAPETVPSHAGMAEQCLAVEALAEEVGALTQSGAVQEIATSEILSQDVLLEDASLEVGESHQPYQTSLVIEETLVNGSPDLPTGSLAVPHPQVGESVSVVTVMRDSSESSSSAPATQFIMLPLPAYSVVENPTSIKLTTTYTRRGHGTCTSPGCSFTYVTRHKPPKCPTCGNFLGGKWIPKEKPAKVKVELASGVSSKGSVVKRNQQPVTTEQNSSKENASKLTLENSEAVSQLLNVAPPREVGEESEWEEVIISDAHVLVKEAPGNCGTAVTKTPVVKSGVQPEVTLGTTDNDSPGADVPTPSEGTSTSSPLPAPKKPTGVDLLTPGSRAPELKGRARGKPSLLAAARPMRAILPAPVNVGRGSSMGLPRARQAFSLSDKTPSVRTCGLKPSTLKQLGQPIQQPSGPGEVKLPSGPSNRTSQVKVVEVKPDMFPPYKYSCTVTLDLGLATSRGRGKCKNPSCSYVYTNRHKPRICPSCGVNLAKDRTEKTTKAIEVSSPLPDVLNATEPLSTAQREIQRQSTLQLLRKVLQIPENESELAEVFALIHELNSSRLILSNVSEETVTIEQTSWSNYYESPSTQCLLCSSPLFKGGQNSLAGPQECWLLTASRLQTVTAQVKMCLNPHCLALHSFIDIYTGLFNVGNKLLVSLDLLFAIRNQIKLGEDPRVSINVVLKSVQEQTEKTLTSEELSQLQELLCNGYWAFECLTVRDYNDMICGICGVAPKVEMAQRSEENVLALKSVEFTWPEFLGSNEVNVEDFWATMETEVIEQVAFPASIPITKFDASVIAPFFPPLMRGAVVVNTEKDKNLDVQPVPGSGSALVRLLQEGTCKLDEIGSYSEEKLQHLLRQCGIPFGAEDSKDQLCFSLLALYESVQNGARAIRPPRHFTGGKIYKVCPHQVVCGSKYLVRGESARDHVDLLASSRHWPPVYVVDMATSVALCADLCYPELTNQMWGRNQGCFSSPTEPPVSVSCPELLDQHYTVDMTETEHSIQHPVTKTATRRIVHAGLQPNPGDPSAGHHSLALCPELAPYATILASIVDSKPNGVRQRPIAFDNATHYYLYNRLMDFLTSREIVNRQIHDIVQSCQPGEVVIRDTLYRLGVAQIKTETEEEGEEEEVAAVAE

SEQ ID NO: 808266 - protein, 776 aa, Homo sapiens
MRAILPAPVNVGRGSSMGLPRARQAFSLSDKTPSVRTCGLKPSTLKQLGQPIQQPSGPGEVKLPSGPSNRTSQVKVVEVKPDMFPPYKYSCTVTLDLGLATSRGRGKCKNPSCSYVYTNRHKPRICPSCGVNLAKDRTEKTTKAIEVSSPLPDVLNATEPLSTAQREIQRQSTLQLLRKVLQIPENESELAEVFALIHELNSSRLILSNVSEETVTIEQTSWSNYYESPSTQCLLCSSPLFKGGQNSLAGPQECWLLTASRLQTVTAQVKMCLNPHCLALHSFIDIYTGLFNVGNKLLVSLDLLFAIRNQIKLGEDPRVSINVVLKSVQEQTEKTLTSEELSQLQELLCNGYWAFECLTVRDYNDMICGICGVAPKVEMAQRSEENVLALKSVEFTWPEFLGSNEVNVEDFWATMETEVIEQVAFPASIPITKFDASVIAPFFPPLMRGAVVVNTEKDKNLDVQPVPGSGSALVRLLQEGTCKLDEIGSYSEEKLQHLLRQCGIPFGAEDSKDQLCFSLLALYESVQNGARAIRPPRHFTGGKIYKVCPHQVVCGSKYLVRGESARDHVDLLASSRHWPPVYVVDMATSVALCADLCYPELTNQMWGRNQGCFSSPTEPPVSVSCPELLDQHYTVDMTETEHSIQHPVTKTATRRIVHAGLQPNPGDPSAGHHSLALCPELAPYATILASIVDSKPNGVRQRPIAFDNATHYYLYNRLMDFLTSREIVNRQIHDIVQSCQPGEVVIRDTLYRLGVAQIKTETEEEGEEEEVAAVAE

SEQ ID NO: 808267 - protein, 694 aa, Homo sapiens
MFPPYKYSCTVTLDLGLATSRGRGKCKNPSCSYVYTNRHKPRICPSCGVNLAKDRTEKTTKAIEVSSPLPDVLNATEPLSTAQREIQRQSTLQLLRKVLQIPENESELAEVFALIHELNSSRLILSNVSEETVTIEQTSWSNYYESPSTQCLLCSSPLFKGGQNSLAGPQECWLLTASRLQTVTAQVKMCLNPHCLALHSFIDIYTGLFNVGNKLLVSLDLLFAIRNQIKLGEDPRVSINVVLKSVQEQTEKTLTSEELSQLQELLCNGYWAFECLTVRDYNDMICGICGVAPKVEMAQRSEENVLALKSVEFTWPEFLGSNEVNVEDFWATMETEVIEQVAFPASIPITKFDASVIAPFFPPLMRGAVVVNTEKDKNLDVQPVPGSGSALVRLLQEGTCKLDEIGSYSEEKLQHLLRQCGIPFGAEDSKDQLCFSLLALYESVQNGARAIRPPRHFTGGKIYKVCPHQVVCGSKYLVRGESARDHVDLLASSRHWPPVYVVDMATSVALCADLCYPELTNQMWGRNQGCFSSPTEPPVSVSCPELLDQHYTVDMTETEHSIQHPVTKTATRRIVHAGLQPNPGDPSAGHHSLALCPELAPYATILASIVDSKPNGVRQRPIAFDNATHYYLYNRLMDFLTSREIVNRQIHDIVQSCQPGEVVIRDTLYRLGVAQIKTETEEEGEEEEVAAVAE

SEQ ID NO: 808268 - protein, 1463 aa, Homo sapiens; identical to SEQ ID NO: 808265

SEQ ID NO: 808269 - protein, 325 aa, Homo sapiens
QYGHGSGSQQEWTAVPGSGSALVRLLQEGTCKLDEIGSYSEEKLQHLLRQCGIPFGAEDSKDQLCFSLLALYESVQNGARAIRPPRHFTGGKIYKVCPHQVVCGSKYLVRGESARDHVDLLASSRHWPPVYVVDMATSVALCADLCYPELTNQMWGRNQGCFSSPTEPPVSVSCPELLDQHYTVDMTETEHSIQHPVTKTATRRIVHAGLQPNPGDPSAGHHSLALCPELAPYATILASIVDSKPNGVRQRPIAFDNATHYYLYNRLMDFLTSREIVNRQIHDIVQSCQPGEVVIRDTLYRLGVAQIKTETEEEGEEEEVAAVAE

SEQ ID NO: 808270 - protein, 420 aa, Homo sapiens
MAPWPPKGLVPAVLWGLSLFLNLPGPIWLQPSPPPQSSPPPQPHPCHTCRGLVDSFNKGLERTIRDNFGGGNTAWEEENLSKYKDSETRLVEVLEGVCSKSDFECHRLLELSEELVESWWFHKQQEAPDLFQWLCSDSLKLCCPAGTFGPSCLPCPGGTERPCGGYGQCEGEGTRGGSGHCDCQAGYGGEACGQCGLGYFEAERNASHLVCSACFGPCARCSGPEESNCLQCKKGWALHHLKCVDIDECGTEGANCGADQFCVNTEGSYECRDCAKACLGCMGAGPGRCKKCSPGYQQVGSKCLDVDECETEVCPGENKQCENTEGGYRCICAEGYKQMEGICVKEQIPESAGFFSEMTEDELVVLQQMFFGIIICALATLAAKGDLVFTAIFIGAVAAMTGYWLSERSDRVLEGFIKGR

SEQ ID NO: 808271 - protein, 295 aa, Homo sapiens
MAPWPPKGLVPAVLWGLSLFLNLPGPIWLQPSPPPQSSPPPQPHPCHTCRGLVDSFNKGLERTIRDNFGGGNTAWEEENLSKYKDSETRLVEVLEGVCSKSDFECHRLLELSEELVESWWFHKQQEAPDLFQWLCSDSLKLCCPAGTFGPSCLPCPGGTERPCGGYGQCEGEGTRGGSGHCDCQAGYGGEACGQCGLGYFEAERNASHLVCSVVRPVPDVRTDDQLLHAEGGCSPQCVTGQLLGDGGRPSRKMSLDTGAMSRIWNTGGTTCTRGPLPGTSLGPTSTRGTKSREAP

SEQ ID NO: 808272 - protein, 73 aa, Homo sapiens
LLLGPPGFPLSSRSYVWEIGGGYNFPRNRYAMIQAELPLTKGTKLELPAVAAALELVNPPGCRKSTQLEKGLD

SEQ ID NO: 808273 - protein, 420 aa, Homo sapiens; identical to SEQ ID NO: 808270

SEQ ID NO: 808274 - protein, 489 aa, Homo sapiens
MAPWPPKGLVPAVLWGLSLFLNLPGPIWLQPSPPPQSSPPPQPHPCHTCRGLVDSFNKGLERTIRDNFGGGNTAWEEENLSKYKDSETRLVEVLEGVCSKSDFECHRLLELSEELVESWWFHKQQEAPDLFQWLCSDSLKLCCPAGTFGPSCLPCPGGTERPCGGYGQCEGEGTRGGSGHCDCQAGYGGEACGQCGLGYFEAERNASHLVCSACFGPCARCSGPEESNCLQCKKGWALHHLKCVDIDECGTEGANCGADQFCVNTEGSYECRDCAKACLGCMGAGPGRCKKCSPGYQQVGSKCLGESPADGTQAPGSASPSMNGEEAGIWAGGGRKGGMLPGQGQRGVLEMDKMESGCWVGGPSRTLTPPSPQDVDECETEVCPGENKQCENTEGGYRCICAEGYKQMEGICVKEQIPESAGFFSEMTEDELVVLQQMFFGIIICALATLAAKGDLVFTAIFIGAVAAMTGYWLSERSDRVLEGFIKGR

SEQ ID NO: 808275 - protein, 574 aa, Homo sapiens
MAPWPPKGLVPAVLWGLSLFLNLPGPIWLQPSPPPQSSPPPQPHPCHTCRGLVDSFNKGLERTIRDNFGGGNTAWEEENLSKYKDSETRLVEVLEGVCSKSDFECHRLLELSEELVESWWFHKQQEAPDLFQWLCSDSLKLCCPAGTFGPSCLPCPGGTERPCGGYGQCEGEGTRGGSGHCDCQAGYGGEACGQCGLGYFEAERNASHLVCSACFGPCARCSGPEESNCLQCKKGWALHHLKCVDIDECGTEGANCGADQFCVNTEGSYECRDCAKACLGCMGAGPGRCKKCSPGYQQVGSKCLDVDECETEVCPGENKQCENTEGGYRCICAEGYKQMEGICVKEQIPGAFPILTDLTPETTRRWKLGSHPHSTYVKMKMQRDEATFPGLYGKQVAKLGSQSRQSDRGTRLIHVINALPPTCPPHGLGKSNPFTSLSLTFPFSETGMVTAPCRVVLSSKCSVPGLLGRPGGHDDQVVGVLGRLQELPGTGIRVPGCISCSSAESAGFFSEMTEDELVVLQQMFFGIIICALATLAAKGDLVFTAIFIGAVAAMTGYWLSERSDRVLEGFIKGR

SEQ ID NO: 808276 - protein, 240 aa, Homo sapiens
SSWFPPEETLAFCVNTEGSYECRDCAKACLGCMGAGPGRCKKCSPGYQQVGSKCLGESPADGTQAPGSASPSMNGEEAGIWAGGGRKGGMLPGQGQRGVLEMDKMESGCWVGGPSRTLTPPSPQDVDECETEVCPGENKQCENTEGGYRCICAEGYKQMEGICVKEQIPESAGFFSEMTEDELVVLQQMFFGIIICALATLAAKGDLVFTAIFIGAVAAMTGYWLSERSDRVLEGFIKGR

SEQ ID NO: 808277 - protein, 241 aa, Homo sapiens
MAGTISPAITVSDAVLGAFPILTDLTPETTRRWKLGSHPHSTYVKMKMQRDEATFPGLYGKQVAKLGSQSRQSDRGTRLIHVINALPPTCPPHGLGKSNPFTSLSLTFPFSETGMVTAPCRVVLSSKCSVPGLLGRPGGHDDQVVGVLGRLQELPGTGIRVPGCISCSSAESAGFFSEMTEDELVVLQQMFFGIIICALATLAAKGDLVFTAIFIGAVAAMTGYWLSERSDRVLEGFIKGR

SEQ ID NO: 808278 - protein, 241 aa, Homo sapiens; identical to SEQ ID NO: 808277

SEQ ID NO: 808279 - protein, 71 aa, Homo sapiens
CGVLEDPKRPEDELVVLQQMFFGIIICALATLAAKGDLVFTAIFIGAVAAMTGYWLSERSDRVLEGFIKGR

SEQ ID NO: 808280 - protein, 439 aa, Homo sapiens
MAPWPPKGLVPAVLWGLSLFLNLPGPIWLQPSPPPQSSPPPQPHPCHTCRGLVDSFNKGLERTIRDNFGGGNTAWEEENLSKYKDSETRLVEVLEGVCSKSDFECHRLLELSEELVESWWFHKQQEAPDLFQWLCSDSLKLCCPAGTFGPSCLPCPGGTERPCGGYGQCEGEGTRGGSGHCDCQAGYGGEACGQCGLGYFEAERNASHLVCSACFGPCARCSGPEESNCLQCKKGWALHHLKCVDIDECGTEGANCGADQFCVNTEGSYECRDCAKACLGCMGAGPGRCKKCSPGYQQVGSKCLDVDECETEVCPGENKQCENTEGGYRCICAEGYKQMEGICVKEQIPESAGFFSEMTEDELVVLQQMFFGIIICALATLAAKGDLVFTAIFIGAVAAMTGYWLSERSDRVLEGFQASQCVNFKSFSLMVAARALAPA

SEQ ID NO: 808281 - protein, 85 aa, Homo sapiens
GSDAVRRRPTAPAGWGGRFFLLRGLRGGSGSFSAGSWAVPLPFCEALNLIPSLHIRIRAPPSKPGVPDTSPKTTPLASSPSVLGI

SEQ ID NO: 808282 - protein, 429 aa, Homo sapiens
MAPWPPKGLVPAVLWGLSLFLNLPGPIWLQPSPPPQSSPPPQPHPCHTCRGLVDSFNKGLERTIRDNFGGGNTAWEEENLSKYKDSETRLVEVLEGVCSKSDFECHRLLELSEELVESWWFHKQQEAPDLFQWLCSDSLKLCCPAGTFGPSCLPCPGGTERPCGGYGQCEGEGTRGGSGHCDCQAGYGGEACGQCGLGYFEAERNASHLVCSACFGPCARCSGPEESNCLQCKKGWALHHLKCVDIDECGTEGANCGADQFCVNTEGSYECRDCAKACLGCMGAGPGRCKKCSPGYQQVGSKCLDVDECETEVCPGENKQCENTEGGYRCICAEGYKQMEGICVKEQIPESAGFFSEMTEDELVVLQQMFFGIIICALATLAAKGDLVFTAIFIGAVAAERQSEQSGWGRNHSKAGYELRGTLEGSSTV

SEQ ID NO: 808283 - protein, 455 aa, Homo sapiens
GSDAVRRRPTAPAGWGGRFFLLRGLRGSPAWVKMAPWPPKGLVPAVLWGLSLFLNLPGPIWLQPSPPPQSSPPPQPHPCHTCRGLVDSFNKGLERTIRDNFGGGNTAWEEENLSKYKDSETRLVEVLEGVCSKSDFECHRLLELSEELVESWWFHKQQEAPDLFQWLCSDSLKLCCPAGTFGPSCLPCPGGTERPCGGYGQCEGEGTRGGSGHCDCQAGYGGEACGQCGLGYFEAERNASHLVCSACFGPCARCSGPEESNCLQCKKGWALHHLKCVDIDECGTEGANCGADQFCVNTEGSYECRDCAKACLGCMGAGPGRCKKCSPGYQQVGSKCLDVDECETEVCPGENKQCENTEGGYRCICAEGYKQMEGICVKEQIPGAFPILTDLTPETTRRWKLGSHPHSTYVKMKMQRDEATFPGLYGKQVAKLGSQSRQSDRGTRLIHSQQASSQR

SEQ ID NO: 808284 - protein, 156 aa, Homo sapiens
GSDAVRRRPTAPAGWGGRFFLLRGLRGSPAWVKMAPWPPKGLVPAVLWGLSLFLNLPGPIWLQPSPPPQSSPPPQPHPCHTCRGLVDSFNKGLERTIRDNFGGGNTAWEEENLSKYKDSETRLVEVLEGVCSKSDFECHRLLELSEELVESWWFHK

SEQ ID NO: 808285 - protein, 420 aa, Homo sapiens; identical to SEQ ID NO: 808270

SEQ ID NO: 808286 - protein, 363 aa, Homo sapiens
MGLERTIRDNFGGGNTAWEEENLSKYKDSETRLVEVLEGVCSKSDFECHRLLELSEELVESWWFHKQQEAPDLFQWLCSDSLKLCCPAGTFGPSCLPCPGGTERPCGGYGQCEGEGTRGGSGHCDCQAGYGGEACGQCGLGYFEAERNASHLVCSACFGPCARCSGPEESNCLQCKKGWALHHLKCVDIDECGTEGANCGADQFCVNTEGSYECRDCAKACLGCMGAGPGRCKKCSPGYQQVGSKCLDVDECETEVCPGENKQCENTEGGYRCICAEGYKQMEGICVKEQIPESAGFFSEMTEDELVVLQQMFFGIIICALATLAAKGDLVFTAIFIGAVAAMTGYWLSERSDRVLEGFIKGR

SEQ ID NO: 808287 - protein, 349 aa, Homo sapiens
MAPWPPKGLVPAVLWGLSLFLNLPGPIWLQPSPPPQSSPPPQPHPCHTCRGLVDSFNKGLERTIRDNFGGGNTAWEEENLSKYKDSETRLVEVLEGVCSKSDFECHRLLELSEELVESWWFHKQQEAPDLFQWLCSDSLKLCCPAGTFGPSCLPCPGGTERPCGGYGQCEGEGTRGGSGHCDCQAGYGGEACGQCGLGYFEAERNASHLVCSACFGPCARCSGPEESNCLQCKKGWALHHLKCVDIDECGTEGANCGADQFCVNTEGSYECRDCAKACLGCMGAGPGRCKKCSPGYQQVGSKCLGESPADGTQAPGSASPSMNGEEAGIWADGRHLCEGADPRCIPHLN

SEQ ID NO: 808288 - protein, 420 aa, Homo sapiens; identical to SEQ ID NO: 808270

SEQ ID NO: 808289 - protein, 420 aa, Homo sapiens; identical to SEQ ID NO: 808270

SEQ ID NO: 808290 - protein, 439 aa, Homo sapiens; identical to SEQ ID NO: 808280

SEQ ID NO: 808291 - protein, 404 aa, Homo sapiens
MAPWPPKGLVPAVLWGLSLFLNLPGPIWLQPSPPPQSSPPPQPHPCHTCRGLVDSFNKGLERTIRDNFGGGNTAWEEENLSKYKDSETRLVEVLEGVCSKSDFECHRLLELSEELVESWWFHKQQEAPDLFQWLCSDSLKLCCPAGTFGPSCLPCPGGTERPCGGYGQCEGEGTRGGSGHCDCQAGYGGEACGQCGLGYFEAERNASHLVCSACFGPCARCSGPEESNCLQCKKGWALHHLKCVDIDECGTEGANCGADQFCVNTEGSYECRDCAKACLGCMGAGPGRCKKCSPGYQQVGSKCLDVDECETEVCPGENKQCENTEGGYRCICAEGYKQMEGICVKEQIPESAGFFSEMTEDELVVLQQMFFGIIICALATLAAKGDLVFTAIFIGAVAARLHNV

SEQ ID NO: 808292 - protein, 218 aa, Homo sapiens [sequence omitted]

SEQ ID NO: 808293 - protein, 89 aa, Homo sapiens
LQLFGLSLWLVLRCAASHGALWAQRSDRLRRIGTGPAACGHHGLHGVRGSVKKLTHLTWKQCLNKLKEQLWKEVTKHWATRNTPVAQQS

SEQ ID NO: 808294 - protein, 84 aa, Homo sapiens
PRREVKTSLKRDCISTKYFKTRLHMVVHACSPSYYSWYRNYGHLELIQLQLATQFENWCKTSQSHYSERVWSGNACRVSPGKRC

SEQ ID NO: 808295 - protein, 89 aa, Homo sapiens; identical to SEQ ID NO: 808293

SEQ ID NO: 808296 - protein, 111 aa, Homo sapiens
LQLFGLSLWLVLRCAASHGALWAQRSDRLRRIGTGPAACGHHGLHGVRGSVKKLTHLTWKQCLNKLKEQLWKEVTKHWTRLQRGIDLPCPRPHHHSVSLSSVGAVWHCLCP

SEQ ID NO: 808297 - protein, 82 aa, Homo sapiens
HAYAHASGPAMERFWAQRSDRLRRIGTGPAACGHHGLHGVRGSVKKLTHLTWKQCLNKLKEQLWKEVTKHWATRNTPVAQQS

SEQ ID NO: 808298 - protein, 111 aa, Homo sapiens; identical to SEQ ID NO: 808296

SEQ ID NO: 808299 - protein, 104 aa, Homo sapiens
PRVRPRVRASHGALWAQRSDRLRRIGTGPAACGHHGLHGVRGSVKKLTHLTWKQCLNKLKEQLWKEVTKHWTRLQRGIDLPCPRPHHHSVSLSSVGAVWHCLCP

SEQ ID NO: 808300 - protein, 141 aa, Homo sapiens
MFEQTQRTAVERSHKTLGLVNYQISIKCSNQFKLEVCLLNAENKVVDNQAGTQGQLKVLGANLWWPYLMHEHPAYLYSWEDGDCSHQSLGPLPACDLCDQRHLCSRQGGSVCGCDPCEQLLLLVSQLRAPGVDSAAAGHPV

SEQ ID NO: 808301 - protein, 110 aa, Homo sapiens
GAAATVGGGAGGSGGACPVPSPGSGHTSGPALRCWQRVAGTLLPHLHALHGSKVKIKRITLRARLVGVRRGDSTSPQCCVLIGPPGPSEPSPSDHLVSRSCSKRCEKVSP

SEQ ID NO: 808302 - protein, 151 aa, Homo sapiens
RAARNCFHCKQKKATHDQAGGGEARGGRRAEGGTERRAEGAGERENVGGGAGGSGGACPVPSPGSGHTSGPALRCWQRVAGTLLPHLHALHGSKVKIKRITLRARLVGVRRGDSTSPQCCVLIGPPGPSEPSPSDHLVSRSCSKRCEKVSP

SEQ ID NO: 808303 - protein, 141 aa, Homo sapiens
RAARNCFHCKQKKATHDQAGGGEARGGRRAEGGTERRAEGAGERENVGGGAGGSGGACPVPSPGSGHTSGPALRCWQRVAGTLLPHLHALHGSKVKIKRITLRARLVGVRRGDSTSPQCCVLIGPPGPSEPSPSDHLVSRR

SEQ ID NO: 808304 - protein, 74 aa, Homo sapiens
QVRHCPGARPATGVGARVSAFAFEVPALRWGLHLPLHEQVCRIQEPAHHTVLSFSLLPKPALNFFAVLLSQNFK

SEQ ID NO: 808305 - protein, 497 aa, Homo sapiens
MLRTTVRPSLLPVMGLARQPEEVVLQASVSSYHLFRDVAEVTAFRGSLLSWYDQEKRDLPWRRRAEDEMDLDRRAYAVWVSEVMLQQTQVATVINYYTGWMQKWPTLQDLASASLEEVNQLWAGLGYYSRGRRLQEGARKVVEELGGHMPRTAETLQQLLPGVGRYTAGAIASIAFGQATGVVDGNVARVLCRVRAIGADPSSTLVSQQLWGLAQQLVDPARPGDFNQAAMELGATVCTPQRPLCSQCPVESLCRARQRVEQEQLLASGSLSGSPDVEECAPNTGQCHLCLPPSEPWDQTLGVVNFPRKASRKPPREESSATCVLEQPGALGAQILLVQRPNSGLLAGLWEFPSVTWEPSEQLQRKALLQELQRWAGPLPATHLRHLGEVVHTFSHIKLTYQVYGLALEGQTPVTTVPPGARWLTQEEFHTAAVSTAMKKVFRVYQGQQPGTCMGSKRSQVSSPCSRKKPRMGQQVLDNFFRSHISTDAHSLNSAAQ

SEQ ID NO: 808306 - protein, 546 aa, Homo sapiens
MTPLVSRLSRLWAIMRKPRAAVGSGHRKQAASQEGRQKHAKNNSQAKPSACDGMIAECPGAPAGLARQPEEVVLQASVSSYHLFRDVAEVTAFRGSLLSWYDQEKRDLPWRRRAEDEMDLDRRAYAVWVSEVMLQQTQVATVINYYTGWMQKWPTLQDLASASLEEVNQLWAGLGYYSRGRRLQEGARKVVEELGGHMPRTAETLQQLLPGVGRYTAGAIASIAFGQATGVVDGNVARVLCRVRAIGADPSSTLVSQQLWGLAQQLVDPARPGDFNQAAMELGATVCTPQRPLCSQCPVESLCRARQRVEQEQLLASGSLSGSPDVEECAPNTGQCHLCLPPSEPWDQTLGVVNFPRKASRKPPREESSATCVLEQPGALGAQILLVQRPNSGLLAGLWEFPSVTWEPSEQLQRKALLQELQRWAGPLPATHLRHLGEVVHTFSHIKLTYQVYGLALEGQTPVTTVPPGARWLTQEEFHTAAVSTAMKKVFRVYQGQQPGTCMGSKRSQVSSPCSRKKPRMGQQVLDNFFRSHISTDAHSLNSAAQ

SEQ ID NO: 808307 - protein, 429 aa, Homo sapiens
MDLDRRAYAVWVSEVMLQQTQVATVINYYTGWMQKWPTLQDLASASLEEVNQLWAGLGYYSRGRRLQEGARKVVEELGGHMPRTAETLQQLLPGVGRYTAGAIASIAFGQATGVVDGNVARVLCRVRAIGADPSSTLVSQQLWGLAQQLVDPARPGDFNQAAMELGATVCTPQRPLCSQCPVESLCRARQRVEQEQLLASGSLSGSPDVEECAPNTGQCHLCLPPSEPWDQTLGVVNFPRKASRKPPREESSATCVLEQPGALGAQILLVQRPNSGLLAGLWEFPSVTWEPSEQLQRKALLQELQRWAGPLPATHLRHLGEVVHTFSHIKLTYQVYGLALEGQTPVTTVPPGARWLTQEEFHTAAVSTAMKKVFRVYQGQQPGTCMGSKRSQVSSPCSRKKPRMGQQVLDNFFRSHISTDAHSLNSAAQ

SEQ ID NO: 808308 - protein, 429 aa, Homo sapiens; identical to SEQ ID NO: 808307

SEQ ID NO: 808309 - protein, 103 aa, Homo sapiens
MPPELTPPRVSGPTARDLYVETGFHHVDKAGLELLTSSDLPILASQSAGITGVSHHTHPWELSVLIGRRIRKGCLEEAAGFQKVPGVLSVQSEKAPHGPASPG

SEQ ID NO: 808310 - protein, 285 aa, Homo sapiens
MLRTTVRPSLLPVMGLARQPEEVVLQASVSSYHLFRDVAEVTAFRGSLLSWYDQEKRDLPWRRRAEDEMDLDRRAYAVWVSEVMLQQTQVATVINYYTGWMQKWPTLQDLASASLEEVNQLWAGLGYYSRGRRLQEGARKVVEELGGHMPRTAETLQQLLPGVGRYTAGAIASIAFGQATGVVDGNVARVLCRVRAIGADPSSTLVSQQLWGLAQQLVDPARPGDFNQAAMELGATVCTPQRPLCSQCPVESLCRARQRVEQEQLLASGSLSGSPDVEECGEHQT

SEQ ID NO: 808311 - protein, 362 aa, Homo sapiens
MLRTTVRPSLLPVMGLARQPEEVVLQASVSSYHLFRDVAEVTAFRGSLLSWYDQEKRDLPWRRRAEDEMDLDRRAYAVWVSEVMLQQTQVATVINYYTGWMQKWPTLQDLASASLEEVNQLWAGLGYYSRGRRLQEGARKVVEELGGHMPRTAETLQQLLPGVGRYTAGAIASIAFGQATGVVDGNVARVLCRVRAIGADPSSTLVSQQLWGLAQQLVDPARPGDFNQAAMELGATVCTPQRPLCSQCPVESLCRARQRVEQEQLLASGSLSGSPDVEECGFGDLRSQLPTLDSATCACLPRSPGTRPWEWSTSPERPAASPPGRRALPPVFWNSLGPLGPKFCWCRGPTQVCWQDCGSSRP

SEQ ID NO: 808312 - protein, 349 aa, Homo sapiens
MPRTAETLQQLLPGVGRYTAGAIASIAFGQATGVVDGNVARVLCRVRAIGADPSSTLVSQQLWGLAQQLVDPARPGDFNQAAMELGATVCTPQRPLCSQCPVESLCRARQRVEQEQLLASGSLSGSPDVEECAPNTGQCHLCLPPSEPWDQTLGVVNFPRKASRKPPREESSATCVLEQPGALGAQILLVQRPNSGLLAGLWEFPSVTWEPSEQLQRKALLQELQRWAGPLPATHLRHLGEVVHTFSHIKLTYQVYGLALEGQTPVTTVPPGARWLTQEEFHTAAVSTAMKKVFRVYQGQQPGTCMGSKRSQVSSPCSRKKPRMGQQVLDNFFRSHISTDAHSLNSAAQ

SEQ ID NO: 808313 - protein, 349 aa, Homo sapiens; identical to SEQ ID NO: 808312

SEQ ID NO: 808314 - protein, 247 aa, Homo sapiens
MGQTPDESLYFGVGVEKASSTTFTLDLVSFCLPVAIEVAYTAGPGQCFPGGESHPRVGEIGTIEGLTGDLFDLCSYPQEVNQLWAGLGYYSRGRRLQEGARKVVEELGGHMPRTAETLQQLLPGVGRYTAGAIASIAFGQATGVVDGNVARVLCRVRAIGADPSSTLVSQQLWGLAQQLVDPARPGDFNQAAMELGATVCTPQRPLCSQCPVESLCRARQRVEQEQLLASGSLSGSPDVEECGEHQT

SEQ ID NO: 808315 - protein, 349 aa, Homo sapiens; identical to SEQ ID NO: 808312

SEQ ID NO: 808316 - protein, 393 aa, Homo sapiens
MTPLVSRLSRLWEVNQLWAGLGYYSRGRRLQEGARKVVEELGGHMPRTAETLQQLLPGVGRYTAGAIASIAFGQATGVVDGNVARVLCRVRAIGADPSSTLVSQQLWGLAQQLVDPARPGDFNQAAMELGATVCTPQRPLCSQCPVESLCRARQRVEQEQLLASGSLSGSPDVEECAPNTGQCHLCLPPSEPWDQTLGVVNFPRKASRKPPREESSATCVLEQPGALGAQILLVQRPNSGLLAGLWEFPSVTWEPSEQLQRKALLQELQRWAGPLPATHLRHLGEVVHTFSHIKLTYQVYGLALEGQTPVTTVPPGARWLTQEEFHTAAVSTAMKKVFRVYQGQQPGTCMGSKRSQVSSPCSRKKPRMGQQVLDNFFRSHISTDAHSLNSAAQ

SEQ ID NO: 808317 - protein, 309 aa, Homo sapiens
GNKGASGVSAKELCFTAVFPSFRGLAQQLVDPARPGDFNQAAMELGATVCTPQRPLCSQCPVESLCRARQRVEQEQLLASGSLSGSPDVEECAPNTGQCHLCLPPSEPWDQTLGVVNFPRKASRKPPREESSATCVLEQPGALGAQILLVQRPNSGLLAGLWEFPSVTWEPSEQLQRKALLQELQRWAGPLPATHLRHLGEVVHTFSHIKLTYQVYGLALEGQTPVTTVPPGARWLTQEEFHTAAVSTAMKKVFRVYQGQQPGTCMGSKRSQVSSPCSRKKPRMGQQVLDNFFRSHISTDAHSLNSAAQ

SEQ ID NO: 808318 - protein, 479 aa, Homo sapiens
MLRTTVRPSLLPVMGLARQPEEVVLQASVSSYHLFRDVAEVTAFRGSLLSWYDQEKRDLPWRRRAEDEMDLDRRAYAVWVSEVMLQQTQVATVINYYTGWMQKWPTLQDLASASLEEVNQLWAGLGYYSRGRRLQEGARKVVEELGGHMPRTAETLQQLLPGVGRYTAGAIASIAFGQATGVVDGNVARVLCRVRAIGADPSSTLVSQQLWGLAQQLVDPARPGDFNQAAMELGATVCTPQRPLCSQCPVESLCRARQRVEQEQLLASGSLSGSPDVEECAPNTGQCHLCLPPSEPWDQTLGVVNFPRKASRKPPREESSATCVLEQPGALGAQILLVQRPNSGLLAGLWEFPSVTWEPSEQLQRKALLQELQRWAGPLPATHLRHLGEVVHTFSHIKLTYQVYGLALEGQTPVTTVPPGARWLTQEEFHTAAVSTAMKKVFRVYQGQQPGTCMGSKRSQVSSPCSRTTDAHSLNSAAQ

SEQ ID NO: 808319 - protein, 468 aa, Homo sapiens
MLRTTVRPSLLPVMGLARQPEEVVLQASVSSYHLFRDVAEVTAFRGSLLSWYDQEKRDLPWRRRAEDEMDLDRRAYAVWVSEVMLQQTQVATVINYYTGWMQKWPTLQDLASASLEEVNQLWAGLGYYSRGRRLQEGARKVVEELGGHMPRTAETLQQLLPGVGRYTAGAIASIAFGQATGVVDGNVARVLCRVRAIGADPSSTLVSQQLWGLAQQLVDPARPGDFNQAAMELGATVCTPQRPLCSQCPVESLCRARQRVEQEQLLASGSLSGSPDVEECAPNTGQCHLCLPPSEPWDQTLGVVNFPRKASRKPPREESSATCVLEQPGALGAQILLVQRPNSGLLAGLWEFPSVTWEPSEQLQRKALLQELQRWAGPLPATHLRHLGEVVHTFSHIKLTYQVYGLALEGQTPVTTVPPGARWLTQEEFHTAAVSTAMKKVFRMYQAQQATDSVLEYGFTTVISHRLD

SEQ ID NO: 808320 - protein, 497 aa, Homo sapiens; identical to SEQ ID NO: 808305

SEQ ID NO: 808321 - protein, 497 aa, Homo sapiens; identical to SEQ ID NO: 808305

SEQ ID NO: 808322 - protein, 497 aa, Homo sapiens; identical to SEQ ID NO: 808305

SEQ ID NO: 808323 - protein, 552 aa, Homo sapiens
RRERGASVFCCLHQRGPRAIMRKPRAAVGSGHRKQAASQEGRQKHAKNNSQAKPSACDGMIAECPGAPAGLARQPEEVVLQASVSSYHLFRDVAEVTAFRGSLLSWYDQEKRDLPWRRRAEDEMDLDRRAYAVWVSEVMLQQTQVATVINYYTGWMQKWPTLQDLASASLEEVNQLWAGLGYYSRGRRLQEGARKVVEELGGHMPRTAETLQQLLPGVGRYTAGAIASIAFGQATGVVDGNVARVLCRVRAIGADPSSTLVSQQLWGLAQQLVDPARPGDFNQAAMELGATVCTPQRPLCSQCPVESLCRARQRVEQEQLLASGSLSGSPDVEECAPNTGQCHLCLPPSEPWDQTLGVVNFPRKASRKPPREESSATCVLEQPGALGAQILLVQRPNSGLLAGLWEFPSVTWEPSEQLQRKALLQELQRWAGPLPATHLRHLGEVVHTFSHIKLTYQVYGLALEGQTPVTTVPPGARWLTQEEFHTAAVSTAMKKVFRVYQGQQPGTCMGSKRSQVSSPCSRKKPRMGQQVLDNFFRSHISTDAHSLNSAAQ

SEQ ID NO: 808324 - protein, 79 aa, Homo sapiens
AGPAPLFQPFFFSLSHHSAGVDTTTLCQGPQPGTCMGSKRSQVSSPCSRKKPRMGQQVLDNFFRSHISTDAHSLNSAAQ

SEQ ID NO: 808325 - protein, 522 aa, Homo sapiens
MLRTTVRPSLLPVMGLARQPEEVVLQASVSSYHLFRDVAEVTAFRGSLLSWYDQEKRDLPWRRRAEDEMDLDRRAYAVWVSEVMLQQTQVATVINYYTGWMQKWPTLQDLASASLEEVNQLWAGLGYYSRGRRLQEGARKVRGWQEGRNPGVLGVFNLESCTPMQVVEELGGHMPRTAETLQQLLPGVGRYTAGAIASIAFGQATGVVDGNVARVLCRVRAIGADPSSTLVSQQLWGLAQQLVDPARPGDFNQAAMELGATVCTPQRPLCSQCPVESLCRARQRVEQEQLLASGSLSGSPDVEECAPNTGQCHLCLPPSEPWDQTLGVVNFPRKASRKPPREESSATCVLEQPGALGAQILLVQRPNSGLLAGLWEFPSVTWEPSEQLQRKALLQELQRWAGPLPATHLRHLGEVVHTFSHIKLTYQVYGLALEGQTPVTTVPPGARWLTQEEFHTAAVSTAMKKVFRVYQGQQPGTCMGSKRSQVSSPCSRKKPRMGQQVLDNFFRSHISTDAHSLNSAAQ

SEQ ID NO: 808326 - protein, 349 aa, Homo sapiens; identical to SEQ ID NO: 808312

SEQ ID NO: 808327 - protein, 349 aa, Homo sapiens; identical to SEQ ID NO: 808312

SEQ ID NO: 808328 - protein, 349 aa, Homo sapiens; identical to SEQ ID NO: 808312

SEQ ID NO: 808329 - protein, 392 aa, Homo sapiens
MRWTWTGGHMLEVNQLWAGLGYYSRGRRLQEGARKVVEELGGHMPRTAETLQQLLPGVGRYTAGAIASIAFGQATGVVDGNVARVLCRVRAIGADPSSTLVSQQLWGLAQQLVDPARPGDFNQAAMELGATVCTPQRPLCSQCPVESLCRARQRVEQEQLLASGSLSGSPDVEECAPNTGQCHLCLPPSEPWDQTLGVVNFPRKASRKPPREESSATCVLEQPGALGAQILLVQRPNSGLLAGLWEFPSVTWEPSEQLQRKALLQELQRWAGPLPATHLRHLGEVVHTFSHIKLTYQVYGLALEGQTPVTTVPPGARWLTQEEFHTAAVSTAMKKVFRVYQGQQPGTCMGSKRSQVSSPCSRKKPRMGQQVLDNFFRSHISTDAHSLNSAAQ

SEQ ID NO: 808330 - protein, 195 aa, Homo sapiens
MDAEVAYTAGPGQCFPGGGESTLGWPGLLFSWPAAAGGSSEGLLAGLWEFPSVTWEPSEQLQRKALLQELQRWAGPLPATHLRHLGEVVHTFSHIKLTYQVYGLALEGQTPVTTVPPGARWLTQEEFHTAAVSTAMKKVFRVYQGQQPGTCMGSKRSQVSSPCSRKKPRMGQQVLDNFFRSHISTDAHSLNSAAQ

SEQ ID NO: 808331 - protein, 114 aa, Homo sapiens
LAGLWEFPSVTWEPSEQLQRKALLQELQRWAGPLPATHLRHLGEVSEQRNSQGCWLLRLYPQAYLNPLTLPPGCPHLLSHQADISSIWAGLGRADPSDHRTTRCSLADAGGISH

SEQ ID NO: 808332 - protein, 120 aa, Homo sapiens
GRRWKVILRFHFSFQKNNVEQVVRALPTTPSRESAHVHPHVHLCVQDACPYAYPPMCPGHMSPACLPVCPGCVSPCVSTCVSAHVPGTCVRLCVHPCVRLPMCLGRMSPCVPAVCPWLSH

SEQ ID NO: 808333 - protein, 136 aa, Homo sapiens
MFLHLDSHSSLERTKPTVVGVDTHMELDEVHCCPGRDSGGGFIKGPMLQGLQGEGKLAPIPKPTLPSPSRLTLFVSSSQMEDHGFPARRNGLTQASFIYQMPAGWGSPGGLFLPCQPVPTPVVLKPPLPPCPISWG

SEQ ID NO: 808334 - protein, 532 aa, Homo sapiens
LTASPAPGLKRFSCLRLPRWQHAKGVPVPQGVMASMLLAQRLACSFQHSYRLLVPGSRHISQAAAKVDVEFDYDGPLMKTEVPGPRSQELMKQLNIIQNAEAVHFFCNYEESRGNYLVDVDGNRMLDLYSQISSVPIGYSHPALLKLIQQPQNASMFVNRPALGILPPENFVEKLRQSLLSVAPKGMSQLITMACGSCSNENALKTIFMWYRSKERGQRGFSQEELETCMINQAPGCPDYSILSFMGAFHGRTMGCLATTHSKAIHKIDIPSFDWPIAPFPRLKYPLEEFVKENQQEEARCLEEVEDLIVKYRKKKKTVAGIIVEPIQSEGGDNHASDDFFRKLRDIARKHGCAFLVDEVQTGGGCTGKFWAHEHWGLDDPADVMTFSKKMMTGGFFHKEEFRPNAPYRIFNTWLGDPSKNLLLAEVINIIKREDLLNNAAHAGKALLTGLLDLQARYPQFISRVRGRGTFCSFDTPDDSIRNKLILIARNKGVVLGGCGDKSIRFRPTLVFRDHHAHLFLNIFSDILADFK

SEQ ID NO: 808335 - protein, 561 aa, Homo sapiens
GRSAEPGSPASRWGKSSRHPALPELGARIPQVGTRRIGSRRSETGPGGWQHAKGVPVPQGVMASMLLAQRLACSFQHSYRLLVPGSRHISQAAAKVDVEFDYDGPLMKTEVPGPRSQELMKQLNIIQNAEAVHFFCNYEESRGNYLVDVDGNRMLDLYSQISSVPIGYSHPALLKLIQQPQNASMFVNRPALGILPPENFVEKLRQSLLSVAPKGMSQLITMACGSCSNENALKTIFMWYRSKERGQRGFSQEELETCMINQAPGCPDYSILSFMGAFHGRTMGCLATTHSKAIHKIDIPSFDWPIAPFPRLKYPLEEFVKENQQEEARCLEEVEDLIVKYRKKKKTVAGIIVEPIQSEGGDNHASDDFFRKLRDIARKHGCAFLVDEVQTGGGCTGKFWAHEHWGLDDPADVMTFSKKMMTGGFFHKEEFRPNAPYRIFNTWLGDPSKNLLLAEVINIIKREDLLNNAAHAGKALLTGLLDLQARYPQFISRVRGRGTFCSFDTPDDSIRNKLILIARNKGVVLGGCGDKSIRFRPTLVFRDHHAHLFLNIFSDILADFK

SEQ ID NO: 808336 - protein, 545 aa, Homo sapiens
GRSAEPGSPASRWGKSSRHPALPELGARIPQVGTRRIGSRRSETGPGGWQHAKGVPVPQGVMASMLLAQRLACSFQHSYRLLVPGSRHISQAAAKVDVEFDYDGPLMKTEVPGPRSQELMKQLNIIQNAEAVHFFCNYEESRGNYLVDVDGNRMLDLYSQISSVPIGYSHPALLKLIQQPQNASMFVNRPALGILPPENFVEKLRQSLLSVAPKGMSQLITMACGSCSNENALKTIFMWYRSKERGQRGFSQEELETCMINQAPGCPDYSILSFMGAFHGRTMGCLATTHSKAIHKIDIPSFDWPIAPFPRLKYPLEEFVKENQQEEARCLEEVEDLIVKYRKKKKTVAGIIVEPIQSEGGDNHASDDFFRKLRDIARKHGCAFLVDEVQTGGGCTGKFWAHEHWGLDDPADVMTFSKKMMTGGFFHKEEFRPNAPYRIFNTWLGDPSKNLLLAEVINIIKREDLLNNAAHAGKALLTGLLDLQARYPQFISRVRGRGTFCSFDTPDDSIRNKLILIARNKGKGSGVAAEFHEHPVFPAVAATCC

SEQ ID NO: 808337 - protein, 259 aa, Homo sapiens
LTASPAPGLKRFSCLRLPRWQHAKGVPVPQGVMASMLLAQRLACSFQHSYRLLVPGSRHISQAAAKVDVEFDYDGPLMKTEVPGPRSQELMKQLNIIQNAEAVHFFCNYEESRGNYLVDVDGNRMLDLYSQISSVPIGYSHPALLKLIQQPQNANEAWSRTAGHVQLLQILPDSSPNRSHQLHSHSRGRVPVLPHPRQHGVSLEDFSLTQRVTYLSTHDKELDPRKKSKKGRRNKDPILVRKGVPSPKTYFTLNKQSWS

SEQ ID NO: 808338 - protein, 120 aa, Homo sapiens
MFSLKSIRGECTVKGDLWGGSIFGGLGGGEGREGLVLIFLPAEPMVHIGLSPEILLEPWTHLGKGHGRSWLEFCPTLTNPSNFSKSQSRALHLFLGLAAGPPGCQSISSAIFCDHGCWLP

SEQ ID NO: 808339 - protein, 404 aa, Homo sapiens
GRSAEPGSPASRWGKSSRHPALPELGARIPQVGTRRIGSRRSETGPGGWQHAKGVPVPQGVMASMLLAQRLACSFQHSYRLLVPGSRHISQAAAKVDVEFDYDGPLMKTEVPGPRSQELMKQLNIIQNAEAVHFFCNYEESRGNYLVDVDGNRMLDLYSQISSVPIGYSHPALLKLIQQPQNASMFVNRPALGILPPENFVEKLRQSLLSVAPKGMSQLITMACGSCSNENALKTIFMWYRSKERGQRGFSQEELETCMINQAPGCPDYSILSFMGAFHGRTMGCLATTHSKAIHKIDIPSFDWPIAPFPRLKYPLEEFVKENQQEEARCLEEVEDLIVKYRKKKKTVAGIIVEPIQSEGGDNHASDDFFRKLRDIARKHGCAFLVDEVQTGGASFHRQHPKVQ

SEQ ID NO: 808340 - protein, 107 aa, Homo sapiens
MRHEAWSRTAGHVQLLQILPDSSPNRSHQLHSHSRGRVPVLPHPRQHGVSLEDFSLTQRVTYLSTHDKELDPRKKSKKGRRNKDPILVRKGVPSPKTYFTLNKQSWS

SEQ ID NO: 808341 - protein, 131 aa, Homo sapiens [sequence omitted]

SEQ ID NO: 808342 - protein, 111 aa, Homo sapiens
WPGHCLGEVCCLDAQTHLGRSFLATVMTFRDREAEASNARAFCWVGSQHRDRQMMAHSPMILSPHLRKPTTLQQCKWSSTSCGIPTFCRPKSCSTSSPSWKGGRGPRQPQG

SEQ ID NO: 808343 - protein, 84 aa, Homo sapiens
VCCLDAQTHLGRSFLATVMTFRDREAEASNARAFCWVGSQHRDRQMMAHSPMILSPHLRKPTTLQQCKWSSTSCGIPTFCRPKR

SEQ ID NO: 808344 - protein, 78 aa, Homo sapiens
GRESGARGGGGGREVMLAPGIGAAAAEQQHLRDPGCSVPVARAPAQRPETTRPADPLETLQELLSPGVEGFCEDTDAP

SEQ ID NO: 808345 - protein, 364 aa, Homo sapiens
MPRGRCRQQGPRIPIWAAANYANAHPWQQMDKASPGVAYTPLVDPWIERPCCGDTVCVRTTMEQKSTASGTCGGKPAERGPLAGHMPSSRPHRVDFCWVPGSDPGTFDGSPWLLDRFLAQLGDYMSFHFEHYQDNISRVCEILRRLTGRAQAWAAPYLDGDLPLPDDYELFCQDLKEVVQDPNSFAEYHAVVTCPLPLASSQLPVAPQLPVVRQYLARFLEGLALDMGTAPRSLPAAMATPAVSGSNSVSRSALFEQQLTKESTPGPKEPPVLPSSTCSSKPGPVEPASSQPEEAAPTPVPRLSESANPPAQRPDPAHPGGPKPQKTEEEVLETEGDQEVSLGTPQEVVEAPETPGEPPLSPGF

SEQ ID NO: 808346 - protein, 364 aa, Homo sapiens; identical to SEQ ID NO: 808345

SEQ ID NO: 808347 - protein, 465 aa, Homo sapiens
MTSMASLFSFTSPAVKRLLGWKQGDEEEKWAEKAVDALVKKLKKKKGAMEELEKALSSPGQPSKCVTIPRSLDGRLQVSHRKGLPHVIYCRVWRWPDLQSHHELKPLDICEFPFGSKQKEVCINPYHYKRVESPVLPPVLVPRHNEFNPQHSLLVQFRNLSHNEPHMPQNATFPDSFHQPNNTPFPLSPNSPYPPSPASSTYPNSPASSGPGSPFQLPADTPPPAYMPPDDQMGQDNSQPMDTSNNMIPQIMPSISSRDVQPVAYEEPKHWCSIVYYELNNRVGEAFHASSTSVLVDGFTDPSNNKSRFCLGLLSNVNRNSTIENTRRHIGKGVHLYYVGGEVYAECLSDSSIFVQSRNCNFHHGFHPTTVCKIPSSCSLKIFNNQEFAQLLAQSVNHGFEAVYELTKMCTIRMSFVKGWGAEYHRQDVTSTPCWIEIHLHGPLQWLDKVLTQMGSPLNPISSVS

SEQ ID NO: 808348 - protein, 465 aa, Homo sapiens; identical to SEQ ID NO: 808347

SEQ ID NO: 808349 - protein, 465 aa, Homo sapiens; identical to SEQ ID NO: 808347

SEQ ID NO: 808350 - protein, 465 aa, Homo sapiens; identical to SEQ ID NO: 808347

SEQ ID NO: 808351 - protein, 465 aa, Homo sapiens; identical to SEQ ID NO: 808347

SEQ ID NO: 808352 - protein, 465 aa, Homo sapiens; identical to SEQ ID NO: 808347

SEQ ID NO: 808353 - protein, 239 aa, Homo sapiens
MPPDDQMGQDNSQPMDTSNNMIPQIMPSISSRDVQPVAYEEPKHWCSIVYYELNNRVGEAFHASSTSVLVDGFTDPSNNKSRFCLGLLSNVNRNSTIENTRRHIGKGVHLYYVGGEVYAECLSDSSIFVQSRNCNFHHGFHPTTVCKIPSSCSLKIFNNQEFAQLLAQSVNHGFEAVYELTKMCTIRMSFVKGWGAEYHRQDVTSTPCWIEIHLHGPLQWLDKVLTQMGSPLNPISSVS

SEQ ID NO: 808354 - protein, 423 aa, Homo sapiens
MTSMASLFSFTSPAVKRLLGWKQGDEEEKWAEKAVDALVKKLKKKKGAMEELEKALSSPGQPSKCVTIPRSLDGRLQVSHRKGLPHVIYCRVWRWPDLQSHHELKPLDICEFPFGSKQKEVCINPYHYKRVESPVLPPVLVPRHNEFNPQHSLLVQFRNLSHNEPHMPQNATFPDSFHQPNNTPFPLSPNSPYPPSPASSTYPNSPASSGPGSPFQLPADTPPPAYMPPDDQMGQDNSQPMDTSNNMIPQIMPSISSRDVQPVAYEEPKHWCSIVYYELNNRVGEAFHASSTSVLVDGFTDPSNNKSRFCLGLLSNVNRNSTIENTRRHIGKGVHLYYVGGEVYAECLSDSSIFVQSRNCNFHHGFHPTTVCKIPSSCSLKIFNNQEFAQLLAQSVNHGFEAVYELTKMCTIRMSFVKSLQEI

SEQ ID NO: 808355 - protein, 296 aa, Homo sapiens
MTSMASLFSFTSPAVKRLLGWKQGDEEEKWAEKAVDALVKKLKKKKGAMEELEKALSSPGQPSKCVTIPRSLDGRLQVSHRKGLPHVIYCRVWRWPDLQSHHELKPLDICEFPFGSKQKEVCINPYHYKRVESPVLPPVLVPRHNEFNPQHSLLVQFRNLSHNEPHMPQNATFPDSFHQPNNTPFPLSPNSPYPPSPASSTYPNSPASSGPGSPFQLPADTPPPAYMPPDDQMGQDNSQPMDTSNNMIPQIMPSISSRDVQPVAYEEPKHWCSIVYYELNNRVGLLGDNIDVIPNT

SEQ ID NO: 808356 - protein, 351 aa, Homo sapiens
MTSMASLFSFTSPAVKRLLGWKQGDEEEKWAEKAVDALVKKLKKKKGAMEELEKALSSPGQPSKCVTIPRSLDGRLQVSHRKGLPHVIYCRVWRWPDLQSHHELKPLDICEFPFGSKQKEVCINPYHYKRVESPVLPPVLVPRHNEFNPQHSLLVQFRNLSHNEPHMPQNATFPDSFHQPNNTPFPLSPNSPYPPSPASSTYPNSPASSGPGSPFQLPADTPPPAYMPPDDQMGQDNSQPMDTSNNMIPQIMPSISSRDVQPVAYEEPKHWCSIVYYELNNRVGEAFHASSTSVLVDGFTDPSNNKSRFCLGLLSNVNRNSTIENTRRHIGKGNLVIFLHLIEFNHLLYLP

SEQ ID NO: 808357 - protein, 407 aa, Homo sapiens
GAEGAEVPPPPRASRERARRGEPGTRSESRLPAAAAHGTAATMALLLCFVLLCGVVDFARSLSITTPEEMIEKAKGETAYLPCKFTLSPEDQGPLDIEWLISPADNQKVDQVIILYSGDKIYDDYYPDLKGRVHFTSNDLKSGDASINVTNLQLSDIGTYQCKVKKAPGVANKKIHLVVLVKPSGARCYVDGSEEIGSDFKIKCEPKEGSLPLQYEWQKLSDSQKMPTSWLAEMTSSVISVKNASSEYSGTYSCTVRNRVGSDQCLLRLNVVPPSNKAGLIAGAIIGTLLALALIGLIIFCCRKKRREEKYEKEVHHDIREDVPPPKSRTSTARSYIGSNHSSLGSMSPSNMEGYSKTQYNQVPSEDFERTPQSPTLPPAKVAAPNLSRMGAIPVMIPAQSKDGSIV

SEQ ID NO: 808358 - protein, 294 aa, Homo sapiens
GAEGAEVPPPPRASRERARRGEPGTRSESRLPAAAAHGTAATMALLLCFVLLCGVVDFARSLSITTPEEMIEKAKGETAYLPCKFTLSPEDQGPLDIEWLISPADNQKVDQVIILYSGDKIYDDYYPDLKGRVHFTSNDLKSGDASINVTNLQLSDIGTYQCKVKKAPGVANKKIHLVVLVKPSGARCYVDGSEEIGSDFKIKCEPKEGSLPLQYEWQKLSDSQKMPTSWLAGKMCHLQRAVRPLPEATSAVIIHPWGPCLLPTWKDIPRLSITKYQVKTLNALLRVRLSHLLR

SEQ ID NO: 808359 - protein, 191 aa, Homo sapiens
GAEGAEVPPPPRASRERARRGEPGTRSESRLPAAAAHGTAATMALLLCFVLLCGVVDFARSLSITTPEEMIEKAKGETAYLPCKFTLSPEDQGPLDIEWLISPADNQKVDQVIILYSGDKIYDDYYPDLKGRVHFTSNDLKSGDASINVTNLQLSDIGTYQCKVKKAPGVANKKIHLVVLGKLFLFVLTGY

SEQ ID NO: 808360 - protein, 394 aa, Homo sapiens
GAEGAEVPPPPRASRERARRGEPGTRSESRLPAAAAHGTAATMALLLCFVLLCGVVDFARSLSITTPEEMIEKAKGETAYLPCKFTLSPEDQGPLDIEWLISPADNQKVDQVIILYSGDKIYDDYYPDLKGRVHFTSNDLKSGDASINVTNLQLSDIGTYQCKVKKAPGVANKKIHLVVLVKPSGARCYVDGSEEIGSDFKIKCEPKEGSLPLQYEWQKLSDSQKMPTSWLAEMTSSVISVKNASSEYSGTYSCTVRNRVGSDQCLLRLNVVPPSNKAGLIAGAIIGTLLALALIGLIIFCCRKKRREEKYEKEVHHDIREDVPPPKSRTSTARSYIGSNHSSLGSMSPSNMEGYSKTQYNQVPSEDFERTPQSPTLPPAKFKYPYKTDGITVV

SEQ ID NO: 808361 - protein, 479 aa, Homo sapiens
GAEGAEVPPPPRASRERARRGEPGTRSESRLPAAAAHGTAATMALLLCFVLLCGVVDFARSLSITTPEEMIEKAKGETAYLPCKFTLSPEDQGPLDIEWLISPADNQKVDQVIILYSGDKIYDDYYPDLKGRVHFTSNDLKSGDASINVTNLQLSDIGTYQCKVKKAPGVANKKIHLVVLVKPSGARCYVDGSEEIGSDFKIKCEPKEGSLPLQYEWQKLSDSQKMPTSWLAEMTSSVISVKNASSEYSGTYSCTVRNRVGSDQCLLRLNVVPPSNKAGLIAGAIIGTLLALALIGLIIFCCRKKRREEKYEKEVHHDIREDVPPPKSRTSTARSYIGSNHSSLGSMSPSNMEGYSKTQYNQVPSEDFERTPQSPTLPPAKVAAPPHGVSRYVAPRCGGSSLTPGLKQSSCLYLPKYWDKLIFLKRKEGGNMRPLKKRGRKKVKPRCLERTELQPLPAALLMRGIEFLQAMMFDLRLEQ

SEQ ID NO: 808362 - protein, 314 aa, Homo sapiens
MATQAFVLFQFPFTSCGTTRQITGDRAVYENELVATRDVKNGSRGSVTRDSIFRLHVSCSYSVSSNSLPINVQVFTLPPPFPETQPGPLTLELQIAKDKNYGSYYGVGDYPVVKLLRDPIYVEVSILHRTDPYLGLLLQQCWATPSTDPLSQPQWPILVKGCPYIGDNYQTQLIPVQKALDLPFPSHHQRFSIFTFSFVNPTVEKQALRGPVHLHCSVSVCQPAETPSCVVTCPDLSRRRNFDNSSQNTTASVSSKGPMILLQATKDPPEKLRVPVDSKVLWVAGLSGTLILGALLVSYLAVKKQKSCPDQMCQ

SEQ ID NO: 808363 - protein, 540 aa, Homo sapiens
MWLLRCVLLCVSLSLAVSGQHKPEAPDYSSVLHCGPWSFQFAVNLNQEATSPPVLIAWDNQGLLHELQNDSDCGTWIRKGPGSSVVLEATYSSCYVTEWDSHYIMPVGVEGAGAAEHKVVTERKLLKCPMDLLARDAPDTDWCDSIPARDRLPCAPSPISRGDCEGLGCCYSSEEVNSCYYGNTVTLHCTREGHFSIAVSRNVTSPPLLLDSVRLALRNDSACNPVMATQAFVLFQFPFTSCGTTRQITGDRAVYENELVATRDVKNGSRGSVTRDSIFRLHVSCSYSVSSNSLPINVQVFTLPPPFPETQPGPLTLELQIAKDKNYGSYYGVGDYPVVKLLRDPIYVEVSILHRTDPYLGLLLQQCWATPSTDPLSQPQWPILVKGCPYIGDNYQTQLIPVQKALDLPFPSHHQRFSIFTFSFVNPTVEKQALRGPVHLHCSVSVCQPAETPSCVVTCPDLSRRRNFDNSSQNTTASVSSKGPMILLQATKDPPEKLRVPVDSKVLWVAGLSGTLILGALLVSYLAVKKQKSCPDQMCQ

SEQ ID NO: 808364 - protein, 110 aa, Homo sapiens [sequence omitted]

SEQ ID NO: 808365 - protein, 110 aa, Homo sapiens [sequence omitted]

SEQ ID NO: 808366 - protein, 110 aa, Homo sapiens [sequence omitted]

SEQ ID NO: 808367 - protein, 156 aa, Homo sapiens
MNMVKRIMGRPRQEECSPQDNALGLMHLRRLFTELCHPPRHMTQKEQEEKLYMMLPVFNRVFGNAPPNTMTEKFSDLLQFTTQVSRLMVTEIRRRASNKSTEAASRAIVQFLEINQSEEASRGWMLLTTINLLASSGQKTVDCMTTMSVPSTLVKC

SEQ ID NO: 808368 - protein, 110 aa, Homo sapiens [sequence omitted]

SEQ ID NO: 808369 - protein, 767 aa, Homo sapiens
MEGAMAVRVTAAHTAEAQAEAGREAGEGAVAAVAAALAPSGFLGLPAPFSEEDEDDVHRCGRCQAEFTALEDFVQHKIQKACQRAPPEALPATPATTALLGQEVVPAAPGPEEPITVAHIVVEAASLAADISHASDLVGGGHIKEVIVAAEAELGDGEMAEAPGSPHQQGLGLAGEGEQAQVKLLVNKDGRYVCALCHKTFKTGSILKAHMVTHSSRKDHECKLCGASFRTKGSLIRHHRRHTDERPYKCSKCGKSFRESGALTRHLKSLTPCTEKIRFSVSKDVVVSKEDARAGSGAGAAGLGTATSSVTGEPIETSPVIHLVTDAKGTVIHEVHVQMQELSLGMKALAPEPPVSQELPCSSEGSRENLLHQAMQNSGIVLERAAGEEGALEPAPAAGSSPQPLAVAAPQLPVLEVQPLETQVASEASAVPRTHPCPQCSETFPTAATLEAHKRGHTGPRPFACAQCGKAFPKAYLLKKHQEVHVRERRFRCGDCGKLYKTIAHVRGHRRVHSDERPYPCPKCGKRYKTKNAQQVHFRTHLEEKPHVCQFCSRGFREKGSLVRHVRHHTGEKPFKCYKCGRGFAEHGTLNRHLRTKGGCLLEVEELLVSEDSPAAATTVLTEDPHTVPLLDDAETSEATEIIEGTQTEVDSHIMKVVQQIVHQASAGHQIIVQNVTMDEETALGPEAAAADTITIATPESLTEQVAMTLASAISEGTVLAARAGTSGTEQATVTMVSSEDIEILEHAGELVIASPEGQLEVQTVIV

SEQ ID NO: 808370 - protein, 784 aa, Homo sapiens
MEGAMAVRVTAAHTAEAQAEAGREAGEGAVAAVAAALAPSGFLGLPAPFSEEDEDDVHRCGRCQAEFTALEDFVQHKIQKACQRAPPEALPATPATTALLGQEVVPAAPGPEEPITVAHIVVEAASLAADISHASDLVGGGHIKEVIVAAEAELGDGEMAEAPGSPHQQGLGLAGEGEQAQVKLLVNKDGRYVCALCHKTFKTGSILKAHMVTHSSRKDHECKLCGASFRTKGSLIRHHRRHTDERPYKCSKCGKSFRESGALTRHLKSLTPCTEKIRFSVSKDVVVSKEDARAGSGAGAAGLGTATSSVTGEPIETSPVIHLVTDAKGTVIHEVHVQMQELSLGMKALAPEPPVSQELPCSSEGSRENLLHQAMQNSGIVLERAAGEEGALEPAPAAGSSPQPLAVAAPQLPVLEVQPLETQVASEASAVPRTHPCPQCSETFPTAATLEAHKRGHTGPRPFACAQCGKAFPKAYLLKKHQEVHVRERRFRCGDCGKLYKTIAHVRGHRRVHSDERPYPCPKCGKRYKTKNAQQVHFRTHLEEKPHVCQFCSRGFREKGSLVRHVRHHTGEKPFKCYKCGRGFAEHGTLNRHLRTKGGCLLEVEELLVSEDSPAAATTVLTEDPHTVLVEFSSVVADTQEYIIEATADDAETSEATEIIEGTQTEVDSHIMKVVQQIVHQASAGHQIIVQNVTMDEETALGPEAAAADTITIATPESLTEQVAMTLASAISEGTVLAARAGTSGTEQATVTMVSSEDIEILEHAGELVIASPEGQLEVQTVIV

SEQ ID NO: 808371 - protein, 834 aa, Homo sapiens
MEGAMAVRVTAAHTAEAQAEAGREAGEGAVAAVAAALAPSGFLGLPAPFSEEDEDDVHRCGRCQAEFTALEDFVQHKIQKACQRAPPEALPATPATTALLGQEVVPAAPGPEEPITVAHIVVEAASLAADISHASDLVGGGHIKEVIVAAEAELGDGEMAEAPGSPHQQGLGLAGEGEQAQVKLLVNKDGRYVCALCHKTFKTGSILKAHMVTHSSRKDHECKLCGASFRTKGSLIRHHRRHTDERPYKCSKCGKSFRESGALTRHLKSLTPCTEKIRFSVSKDVVVSKEDARAGSGAGAAGLGTATSSVTGEPIETSPVIHLVTDAKGTVIHEVHVQMQELSLGMKALAPEPPVSQELPCSSEGSRENLLHQAMQNSGIVLERAAGEEGALEPAPAAGSSPQPLAVAAPQLPVLEVQPLETQVASEASAVPRTHPCPQCSETFPTAATLEAHKRGHTGPRPFACAQCGKAFPKAYLLKKHQEVHVRERRFRCGDCGKLYKTIAHVRGHRRVHSDERPYPCPKCGKRYKTKNAQQVHFRTHLEEKPHVCQFCSRGFREKGSLVRHVRHHTGEKPFKCYKCGRGFAEHGTLNRHLRTKGGCLLEVEELLVSEDSPAAATTVLTEDPHTVLVEFSSVVADTQEYIIEVGVGPWGRAGTQGQPRLTSVLLPSAQATADDAETSEATEIIEGTQTEVRGRAGGGGEAPWHSRSCWAVALQVDSHIMKVVQQIVHQASAGHQIIVQNVTMDEETALGPEAAAADTITIATPESLTEQVAMTLASAISEGTVLAARAGTSGTEQATVTMVSSEDIEILEHAGELVIASPEGQLEVQTVIV

SEQ ID NO: 808372 - protein, 736 aa, Homo sapiens
MLVADEDDVHRCGRCQAEFTALEDFVQHKIQKACQRAPPEALPATPATTALLGQEVVPAAPGPEEPITVAHIVVEAASLAADISHASDLVGGGHIKEVIVAAEAELGDGEMAEAPGSPHQQGLGLAGEGEQAQVKLLVNKDGRYVCALCHKTFKTGSILKAHMVTHSSRKDHECKLCGASFRTKGSLIRHHRRHTDERPYKCSKCGKSFRESGALTRHLKSLTPCTEKIRFSVSKDVVVSKEDARAGSGAGAAGLGTATSSVTGEPIETSPVIHLVTDAKGTVIHEVHVQMQELSLGMKALAPEPPVSQELPCSSEGSRENLLHQAMQNSGIVLERAAGEEGALEPAPAAGSSPQPLAVAAPQLPVLEVQPLETQVASEASAVPRTHPCPQCSETFPTAATLEAHKRGHTGPRPFACAQCGKAFPKAYLLKKHQEVHVRERRFRCGDCGKLYKTIAHVRGHRRVHSDERPYPCPKCGKRYKTKNAQQVHFRTHLEEKPHVCQFCSRGFREKGSLVRHVRHHTGEKPFKCYKCGRGFAEHGTLNRHLRTKGGCLLEVEELLVSEDSPAAATTVLTEDPHTVLVEFSSVVADTQEYIIEATADDAETSEATEIIEGTQTEVDSHIMKVVQQIVHQASAGHQIIVQNVTMDEETALGPEAAAADTITIATPESLTEQVAMTLASAISEGTVLAARAGTSGTEQATVTMVSSEDIEILEHAGELVIASPEGQLEVQTVIV

SEQ ID NO: 808373 - protein, 784 aa, Homo sapiens; identical to SEQ ID NO: 808370

SEQ ID NO: 808374 - protein, 468 aa, Homo sapiens
MEGAMAVRVTAAHTAEAQAEAGREAGEGAVAAVAAALAPSGFLGLPAPFSEEDEDDVHRCGRCQAEFTALEDFVQHKIQKACQRAPPEALPATPATTALLGQEVVPAAPGPEEPITVAHIVVEAASLAADISHASDLVGGGHIKEVIVAAEAELGDGEMAEAPGSPHQQGLGLAGEGEQAQVKLLVNKDGRYVCALCHKTFKTGSILKAHMVTHSSRKDHECKLCGASFRTKGSLIRHHRRHTDERPYKCSKCGKSFRESGALTRHLKSLTPCTEKIRFSVSKDVVVSKEDARAGSGAGAAGLGTATSSVTGEPIETSPVIHLVTDAKGTVIHEVHVQMQELSLGMKALAPEQVASEASAVPRTHPCPQCSETFPTAATLEAHKRGHTGPRPFACAQCGKAFPKAYLLKKHQEVHVRERRFRCGDCGKLYKTIAHVRGHRRVHSDERPYPCPKCGKRYKTKMHLWPQD

SEQ ID NO: 808375 - protein, 297 aa, Homo sapiens
MEGAMAVRVTAAHTAEAQAEAGREAGEGAVAAVAAALAPSGFLGLPAPFSEEGNRADPEGAAGVRAVHPGLAEARMARAAGSTDPPRPRHLADLAGPSQPSTKPPDEDDVHRCGRCQAEFTALEDFVQHKIQKACQRAPPEALPATPATTALLGQEVVPAAPGPEEPITVAHIVVEAASLAADISHASDLVGGGHIKEVIVAAEAELGDGEMAEAPGSPHQQGLGLAGEGEQAQVKLLVNKDGRYVCALCHKTFKTGSILKAHMVTHSSRKDHECKLCGASFRTKGPAGGADGHRLA

SEQ ID NO: 808376 - protein, 257 aa, Homo sapiens
MLVADEDDVHRCGRCQAEFTALEDFVQHKIQKACQRAPPEALPATPATTALLGQEVVPAAPGPEEPITVAHIVVEAASLAADISHASDLVGKPTSMNRWPDRPSWLGPEDGAPAACMLVSPETRAWLGGAAASWQPFCGHSLQEEEALGTGPSSGVHSGRGHTQAPGSHWAVLSPVSFPGWSLPCPSQNLPHFPATPWFLLPARRQQHPPGTHQNGPLAQQRLWRVGTGWTGLSRLSSWARTCCWPWPALPSAPSGV

SEQ ID NO: 808377 - protein, 784 aa, Homo sapiens; identical to SEQ ID NO: 808370

SEQ ID NO: 808378 - protein, 837 aa, Homo sapiens
MEGAMAVRVTAAHTAEAQAEAGREAGEGAVAAVAAALAPSGFLGLPAPFSEEGNRADPEGAAGVRAVHPGLAEARMARAAGSTDPPRPRHLADLAGPSQPSTKPPDEDDVHRCGRCQAEFTALEDFVQHKIQKACQRAPPEALPATPATTALLGQEVVPAAPGPEEPITVAHIVVEAASLAADISHASDLVGGGHIKEVIVAAEAELGDGEMAEAPGSPHQQGLGLAGEGEQAQVKLLVNKDGRYVCALCHKTFKTGSILKAHMVTHSSRKDHECKLCGASFRTKGSLIRHHRRHTDERPYKCSKCGKSFRESGALTRHLKSLTPCTEKIRFSVSKDVVVSKEDARAGSGAGAAGLGTATSSVTGEPIETSPVIHLVTDAKGTVIHEVHVQMQELSLGMKALAPEPPVSQELPCSSEGSRENLLHQAMQNSGIVLERAAGEEGALEPAPAAGSSPQPLAVAAPQLPVLEVQPLETQVASEASAVPRTHPCPQCSETFPTAATLEAHKRGHTGPRPFACAQCGKAFPKAYLLKKHQEVHVRERRFRCGDCGKLYKTIAHVRGHRRVHSDERPYPCPKCGKRYKTKNAQQVHFRTHLEEKPHVCQFCSRGFREKGSLVRHVRHHTGEKPFKCYKCGRGFAEHGTLNRHLRTKGGCLLEVEELLVSEDSPAAATTVLTEDPHTVLVEFSSVVADTQEYIIEATADDAETSEATEIIEGTQTEVDSHIMKVVQQIVHQASAGHQIIVQNVTMDEETALGPEAAAADTITIATPESLTEQVAMTLASAISEGTVLAARAGTSGTEQATVTMVSSEDIEILEHAGELVIASPEGQLEVQTVIV

SEQ ID NO: 808379 - protein, 868 aa, Homo sapiens
MEGAMAVRVTAAHTAEAQAEAGREAGEGAVAAVAAALAPSGFLGLPAPFSEEDEDDVHRCGRCQAEFTALEDFVQHKIQKACQRAPPEALPATPATTALLGQEVVPAAPGPEEPITVAHIVVEAASLAADISHASDLVGGGHIKEVIVAAEAELGDGEMAEAPGSPHQQGLGLAGEGEQAQVKLLVNKDGRYVCALCHKTFKTGSILKAHMVTHSSRKDHECKLCGASFRTKGSLIRHHRRHTDERPYKCSKCGKSFRESGALTRHLKSLTPCTEKIRFSVSKDVVVSKEDARAGSGAGAAGLGTATSSVTGEPIETSPVIHLVTDAKGTVIHEVHVQMQELSLGMKALAPEVGATGGPGGLLCLLPARCQSLFWALAPGSEPGRRGLGFPQGEQGQWERHGGLRVCTRLLACVCPMGWVLEPGCLASLLSLPPLQPPVSQELPCSSEGSRENLLHQAMQNSGIVLERAAGEEGALEPAPAAGSSPQPLAVAAPQLPVLEVQPLETQVASEASAVPRTHPCPQCSETFPTAATLEAHKRGHTGPRPFACAQCGKAFPKAYLLKKHQEVHVRERRFRCGDCGKLYKTIAHVRGHRRVHSDERPYPCPKCGKRYKTKNAQQVHFRTHLEEKPHVCQFCSRGFREKGSLVRHVRHHTGEKPFKCYKCGRGFAEHGTLNRHLRTKGGCLLEVEELLVSEDSPAAATTVLTEDPHTVLVEFSSVVADTQEYIIEATADDAETSEATEIIEGTQTEVDSHIMKVVQQIVHQASAGHQIIVQNVTMDEETALGPEAAAADTITIATPESLTEQVAMTLASAISEGTVLAARAGTSGTEQATVTMVSSEDIEILEHAGELVIASPEGQLEVQTVIV

SEQ ID NO: 808380 - protein, 359 aa, Homo sapiens
MEGAMAVRVTAAHTAEAQAEAGREAGEGAVAAVAAALAPSGFLGLPAPFSEEDEDDVHRCGRCQAEFTALEDFVQHKIQKACQRAPPEALPATPATTALLGQEVVPAAPGPEEPITVAHIVVEAASLAADISHASDLVGGGHIKEVIVAAEAELGDGEMAEAPGSPHQQGLGLAGEGEQAQVKLLVNKDGRYVCALCHKTFKTGSILKAHMVTHSSRKDHECKLCGASFRTKGSLIRHHRRHTDERPYKCSKCGKSFRESGALTRHLKSLTPCTEKIRFSVSKDVVVSKEDARAGSGAGAAGLGTATSSVTGEPIETSPVIHLCDHGVIRGHRDPGACRRAGHRLAGGPAGGADGHRLA

SEQ ID NO: 808381 - protein, 103 aa, Homo sapiens
MAQLSTSLAKEENNAHKIAPDGGATFLGQVLQLKSMNRVLPAGYSSCLTSRKLVTCSWRSPSYRRPKKLRKHRGNNQGSPGKATQLHHHSLVPEKINQNKQVY

SEQ ID NO: 808382 - protein, 172 aa, Homo sapiens
MWGAVWGLAVLPPQQPLLPRPQWQLGGCHTELSGASYCSAELGPPVSRRSLGLGRAAPRLSGGDTIGGDAGSEAKATFPGTESLACTRHRGGMEDAVTLIHMTSPSSQQPVGGPPGPTVPPSQLGTEAQGGKGTCPRAPSPQIPRRTPHTMLPPTTQRTWPAGTYQVPCGSQ

SEQ ID NO: 808383 - protein, 1162 aa, Homo sapiens
MAAAPALKHWRTTLERVEKFVSPLYFTDCNLRGRLFGASCPVAVLSSFLTPERLPYQEAVQRDFRPAQVGDSFGPTWWTCWFRVELTIPEAWVGQEVHLCWESDGEGLVWRDGEPVQGLTKEGEKTSYVLTDRLGERDPRSLTLYVEVACNGLLGAGKGSMIAAPDPEKMFQLSRAELAVFHRDVHMLLVDLELLLGIAKGLGKDNQRSFQALYTANQMVNVCDPAQPETFPVAQALASRFFGQHGGESQHTIHATGHCHIDTAWLWPFKETVRKCARSWVTALQLMERNPEFIFACSQAQQLEWVKSRYPGLYSRIQEFACRGQFVPVGGTWVEMDGNLPSGEAMVRQFLQGQNFFLQEFGKMCSEFWLPDTFGYSAQLPQIMHGCGIRRFLTQKLSWNLVNSFPHHTFFWEGLDGSRVLVHFPPGDSYGMQGSVEEVLKTVANNRDKGRANHSAFLFGFGDGGGGPTQTMLDRLKRLSNTDGLPRVQLSSPRQLFSALESDSEQLCTWVGELFLELHNGTYTTHAQIKKGNRECERILHDVELLSSLALARSAQFLYPAAQLQHLWRLLLLNQFHDVVTGSCIQMVAEEAMCHYEDIRSHGNTLLSAAAAALCAGEPGPEGLLIVNTLPWKRIEVMALPKPGGAHSLGRAEGKGCYCSRKDGGQTDQAWDTPRDLGAPDWRVVDIFHQPIPTCASFLKGQEGCTDAQASPPALVTVPSMGYAPVPPPTSLQPLLPQQPVFVVQEVSPACPGGQELCWDTFLQLRVLSSPVWSKWGGGAGVGVGRLLVWEAPTDSASRPPPTKTDGSVTLDNGIIRVKLDPTGRLTSLVLVASGREAIAEGAVGNQFVLFDDVPLYWDAWDVMDYHLETRKPVLGQAGTLAVGTEGGLRGSAWFLLQISPNSRLSQEVVLDVGCPYVRFHTEVHWHEAHKFLKVEFPARVRSSQATYEIQFGHLQRPTHYNTSWDWARFEVWAHRWMDLSEHGFGLALLNDCKYGASVRGSILSLSLLRAPKAPDATADTGRHEFTYALMPHKGSFQDAGVIQAAYSLNFPLLALPAPSPAPATSWSAFSVSSPAVVLETVKQAESSPQRRSLVLRLYEAHGSHVDCWLHLSLPVQEAILCDLLERPDPAGHLTLRDNRLKLTFSPFQVLSLLLVLQPPPH

SEQ ID NO: 808384 - protein, 1068 aa, Homo sapiens
MAAAPALKHWRTTLERVEKFVSPLYFTDCNLRGRLFGASCPVAVLSSFLTPERLPYQEAVQRDFRPAQVGDSFGPTWWTCWFRVELTIPEAWVGQEVHLCWESDGEGLVWRDGEPVQGLTKEGEKTSYVLTDRLGERDPRSLTLYVEVACNGLLGAGKGSMIAAPDPEKMFQLSRAELAVFHRDVHMLLVDLELLLGIAKGLGKDNQRSFQALYTANQMVNVCDPAQPETFPVAQALASRFFGQHGGESQHTIHATGHCHIDTAWLWPFKETVRKCARSWVTALQLMERNPEFIFACSQAQQLEWVKSRYPGLYSRIQEFACRGQFVPVGGTWVEMDGNLPSGEAMVRQFLQGQNFFLQEFGKMCSEFWLPDTFGYSAQLPQIMHGCGIRRFLTQKLSWNLVNSFPHHTFFWEGLDGSRVLVHFPPGDSYGMQGSVEEVLKTVANNRDKGRANHSAFLFGFGDGGGGPTQTMLDRLKRLSNTDGLPRVQLSSPRQLFSALESDSEQLCTWVGELFLELHNGTYTTHAQIKKGNRECERILHDVELLSSLALARSAQFLYPAAQLQHLWRLLLLNQFHDVVTGSCIQMVAEEAMCHYEDIRSHGNTLLSAAAAALCAGEPGPEGLLIVNTLPWKRIEVMALPKPGGAHSLALVTVPSMGYAPVPPPTSLQPLLPQQPVFVVQETDGSVTLDNGIIRVKLDPTGRLTSLVLVASGREAIAEGAVGNQFVLFDDVPLYWDAWDVMDYHLETRYRLGACGDGGGGGNTGCSGSVCPPLSHRKPVLGQAGTLAVGTEGGLRGSAWFLLQISPNSRLSQEVVLDVGCPYVRFHTEVHWHEAHKFLKVEFPARVRSSQATYEIQFGHLQRPTHYNTSWDWARFEVWAHRWMDLSEHGFGLALLNDCKYGASVRGSILSLSLLRAPKAPDATADTGRHEFTYALMPHKGSFQDAGVIQAAYSLNFPLLALPAPSPAPATSWSAFSVSSPAVVLETVKQAESSPQRRSLVLRLYEAHGSHVDCWLHLSLPVQEAILCDLLERPDPAGHLTLRDNRLKLTFSPFQVLSLLLVLQPPPH

SEQ ID NO: 808385 - protein, 1126 aa, Homo sapiens
MAAAPALKHWRTTLERVEKFVSPLYFTDCNLRGRLFGASCPVAVLSSFLTPERLPYQEAVQRDFRPAQVGDSFGPTWWTCWFRVELTIPEAWVGQEVHLCWESDGEGLVWRDGEPVQGLTKEGEKTSYVLTDRLGERDPRSLTLYVEVACNGLLGAGKGSMIAAPDPEKMFQLSRAELAVFHRDVHMLLVDLELLLGIAKGLGKDNQRSFQALYTANQMVNVCDPAQPETFPVAQALASRFFGQHGGESQHTIHATGHCHIDTAWLWPFKETVRKCARSWVTALQLMERNPEFIFACSQAQQLEWVKSRYPGLYSRIQEFACRGQFVPVGGTWVEMDGNLPSGEAMVRQFLQGQNFFLQEFGKMCSEFWLPDTFGYSAQLPQIMHGCGIRRFLTQKLSWNLVNSFPHHTFFWEGLDGSRVLVHFPPGDSYGMQGSVEEVLKTVANNRDKGRANHSAFLFGFGDGGGGPTQTMLDRLKRLSNTDGLPRVQLSSPRQLFSALESDSEQLCTWVGELFLELHNGTYTTHAQIKKGNRECERILHDVELLSSLALARSAQFLYPAAQLQHLWRLLLLNQFHDVVTGSCIQMVAEEAMCHYEDIRSHGNTLLSAAAAALCAGEPGPEGLLIVNTLPWKRIEVMALPKPGGAHSLALVTVPSMGYAPVPPPTSLQPLLPQQPVFVVQEVSPACPGGQELCWDTFLQLRVLSSPVWSKWGGGAGVGVGRLLVWEAPTDSASRPPPTKTDGSVTLDNGIIRVKLDPTGRLTSLVLVASGREAIAEGAVGNQFVLFDDVPLYWDAWDVMDYHLETRYRLGACGDGGGGGNTGCSGSVCPPLSHRKPVLGQAGTLAVGTEGGLRGSAWFLLQISPNSRLSQEVVLDVGCPYVRFHTEVHWHEAHKFLKVEFPARVRSSQATYEIQFGHLQRPTHYNTSWDWARFEVWAHRWMDLSEHGFGLALLNDCKYGASVRGSILSLSLLRAPKAPDATADTGRHEFTYALMPHKGSFQDAGVIQAAYSLNFPLLALPAPSPAPATSWSAFSVSSPAVVLETVKQAESSPQRRSLVLRLYEAHGSHVDCWLHLSLPVQEAILCDLLERPDPAGHLTLRDNRLKLTFSPFQVLSLLLVLQPPPH

SEQ ID NO: 808386 - protein, 1162 aa, Homo sapiens; identical to SEQ ID NO: 808383

SEQ ID NO: 808387 - protein, 1162 aa, Homo sapiens; identical to SEQ ID NO: 808383

SEQ ID NO: 808388 - protein, 1075 aa, Homo sapiens
MAAAPALKHWRTTLERVEKFVSPLYFTDCNLRGRLFGASCPVAVLSSFLTPERLPYQEAVQRDFRPAQVGDSFGPTWWTCWFRVELTIPEAWVGQEVHLCWESDGEGLVWRDGEPVQGLTKEGEKTSYVLTDRLGERDPRSLTLYVEVACNGLLGAGKGSMIAAPDPEKMFQLSRAELAVFHRDVHMLLVDLELLLGIAKGLGKDNQRSFQALYTANQMVNVCDPAQPETFPVAQALASRFFGQHGGESQHTIHATGHCHIDTAWLWPFKETVRKCARSWVTALQLMERNPEFIFACSQAQQLEWVKSRYPGLYSRIQEFACRGQFVPVGGTWVEMDGNLPSGEAMVRQFLQGQNFFLQEFGKMCSEFWLPDTFGYSAQLPQIMHGCGIRRFLTQKLSWNLVNSFPHHTFFWEGLDGSRVLVHFPPGDSYGMQGSVEEVLKTVANNRDKGRANHSAFLFGFGDGGGGPTQTMLDRLKRLSNTDGLPRVQLSSPRQLFSALESDSEQLCTWVGELFLELHNGTYTTHAQIKKGNRECERILHDVELLSSLALARSAQFLYPAAQLQHLWRLLLLNQFHDVVTGSCIQMVAEEAMCHYEDIRSHGNTLLSAAAAALCAGEPGPEGLLIVNTLPWKRIEVMALPKPGGAHSLGRAEGKGCYCSRKDGGQTDQAWDTPRDLGAPDWRVVDIFHQPIPTCASFLKGQEGCTDAQASPPALVTVPSMGYAPVPPPTSLQPLLPQQPVFVVQEVSPACPGGQELCWDTFLQLRVLSSPVWSKWGGGAGVGVGRLLVWEAPTDSASRPPPTKTDGSVTLDNGIIRVKLDPTGRLTSLVLVASGREAIAEGAVGNQFVLFDDVPLYWDAWDVMDYHLETRKPVLGQAGTLAVGTEGGLRGSAWFLLQISPNSRLSQEVVLDVGCPYVRFHTEVHWHEAHKFLKVEFPARVRSSQATYEIQFGHLQRPTHYNTSWDWARFEVWAHRWMDLSEHGFGLALLNDCKYGASVRGSILSLSLLRAPKAPDATADTGRHEFTYALMPHKAQPSARHLLECVFRVFTRGRIGDRQAGGEQPPAPLAGPEAV

SEQ ID NO: 808389 - protein, 1189 aa, Homo sapiens
MAAAPALKHWRTTLERVEKFVSPLYFTDCNLRGRLFGASCPVAVLSSFLTPERLPYQEAVQRDFRPAQVGDSFGPTWWTCWFRVELTIPEAWVGQEVHLCWESDGEGLVWRDGEPVQGLTKEGEKTSYVLTDRLGERDPRSLTLYVEVACNGLLGAGKGSMIAAPDPEKMFQLSRAELAVFHRDVHMLLVDLELLLGIAKGLGKDNQRSFQALYTANQMVNVCDPAQPETFPVAQALASRFFGQHGGESQHTIHATGHCHIDTAWLWPFKETVRKCARSWVTALQLMERNPEFIFACSQAQQLEWVKSRYPGLYSRIQEFACRGQFVPVGGTWVEMDGNLPSGEAMVRQFLQGQNFFLQEFGKMCSEFWLPDTFGYSAQLPQIMHGCGIRRFLTQKLSWNLVNSFPHHTFFWEGLDGSRVLVHFPPGDSYGMQGSVEEVLKTVANNRDKGRANHSAFLFGFGDGGGGPTQTMLDRLKRLSNTDGLPRVQLSSPRQLFSALESDSEQLCTWVGELFLELHNGTYTTHAQIKKGNRECERILHDVELLSSLALARSAQFLYPAAQLQHLWRLLLLNQFHDVVTGSCIQMVAEEAMCHYEDIRSHGNTLLSAAAAALCAGEPGPEGLLIVNTLPWKRIEVMALPKPGGAHSLGRAEGKGCYCSRKDGGQTDQAWDTPRDLGAPDWRVVDIFHQPIPTCASFLKGQEGCTDAQASPPALVTVPSMGYAPVPPPTSLQPLLPQQPVFVVQEVSPACPGGQELCWDTFLQLRVLSSPVWSKWGGGAGVGVGRLLVWEAPTDSASRPPPTKTDGSVTLDNGIIRVKLDPTGRLTSLVLVASGREAIAEGAVGNQFVLFDDVPLYWDAWDVMDYHLETRKPVLGQAGTLAVGTEGGLRGSAWFLLQISPNSRLSQEVVLDVGCPYVRFHTEVHWHEAHKFLKVEFPARVRSSQATYEIQFGHLQRPTHYNTSWDWARFEVWAHRWMDLSEHGFGLALLNDCKYGASVRGSILSLSLLRAPKAPDATADTGRHEFTYALMPHKGSFQDAGVIQAAYSLNFPLLALPAPSPAPATSWSAFSVSSPAVVLETVKQARGGTCWGRGSELGLPSAPPTRRVPLQAESSPQRRSLVLRLYEAHGSHVDCWLHLSLPVQEAILCDLLERPDPAGHLTLRDNRLKLTFSPFQVLSLLLVLQPPPH

SEQ ID NO: 808390 - protein, 805 aa, Homo sapiens
MAAAPALKHWRTTLERVEKFVSPLYFTDCNLRGRLFGASCPVAVLSSFLTPERLPYQEAVQRDFRPAQVGDSFGPTWWTCWFRVELTIPEAWVGQEVHLCWESDGEGLVWRDGEPVQGLTKEGEKTSYVLTDRLGERDPRSLTLYVEVACNGLLGAGKGSMIAAPDPEKMFQLSRAELAVFHRDVHMLLVDLELLLGIAKGLGKDNQRSFQALYTANQMVNVCDPAQPETFPVAQALASRFFGQHGGESQHTIHATGHCHIDTAWLWPFKETVRKCARSWVTALQLMERNPEFIFACSQAQQLEWVKSRYPGLYSRIQEFACRGQFVPVGGTWVEMDGNLPSGEAMVRQFLQGQNFFLQEFGKMCSEFWLPDTFGYSAQLPQIMHGCGIRRFLTQKLSWNLVNSFPHHTFFWEGLDGSRVLVHFPPGDSYGMQGSVEEVLKTVANNRDKGRANHSAFLFGFGDGGGGPTQTMLDRLKRLSNTDGLPRVQLSSPRQLFSALESDSEQLCTWVGELFLELHNGTYTTHAQIKKGNRECERILHDVELLSSLALARSAQFLYPAAQLQHLWRLLLLNQFHDVVTGSCIQMVAEEAMCHYEDIRSHGNTLLSAAAAALCAGEPGPEGLLIVNTLPWKRIEVMALPKPGGAHSLALVTVPSMGYAPVPPPTSLQPLLPQQPVFVVQETDGSVTLDNGIIRVKLDPTGRLTSLVLVASGREAIAEGAVGNQFVLFDDVPLYWDAWDVMDYHLETRKPVLGQAGTLAVGTEGGLRGSAWFLLQISPNSRLSQEVVLDVGCPYVRFHTEVVGG

SEQ ID NO: 808391 - protein, 817 aa, Homo sapiens
MAAAPALKHWRTTLERVEKFVSPLYFTDCNLRGRLFGASCPVAVLSSFLTPERLPYQEAVQRDFRPAQVGDSFGPTWWTCWFRVELTIPEAWVGQEVHLCWESDGEGLVWRDGEPVQGLTKEGEKTSYVLTDRLGERDPRSLTLYVEVACNGLLGAGKGSMIAAPDPEKMFQLSRAELAVFHRDVHMLLVDLELLLGIAKGLGKDNQRSFQALYTANQMVNVCDPAQPETFPVAQALASRFFGQHGGESQHTIHATGHCHIDTAWLWPFKETVRKCARSWVTALQLMERNPEFIFACSQAQQLEWVKSRYPGLYSRIQEFACRGQFVPVGGTWVEMDGNLPSGEAMVRQFLQGQNFFLQEFGKMCSEFWLPDTFGYSAQLPQIMHGCGIRRFLTQKLSWNLVNSFPHHTFFWEGLDGSRVLVHFPPGDSYGMQGSVEEVLKTVANNRDKGRANHSAFLFGFGDGGGGPTQTMLDRLKRLSNTDGLPRVQLSSPRQLFSALESDSEQLCTWVGELFLELHNGTYTTHAQIKKGNRECERILHDVELLSSLALARSAQFLYPAAQLQHLWRLLLLNQFHDVVTGSCIQMVAEEAMCHYEDIRSHGNTLLSAAAAALCAGEPGPEGLLIVNTLPWKRIEVMALPKPGGAHSLALVTVPSMGYAPVPPPTSLQPLLPQQPVFVVQETDGSVTLDNGIIRVKLDPTGRLTSLVLVASGREAIAEGAVGNQFVLFDDVPLYWDAWDVMDYHLETRKPVLGQAGTLAVGTEGGLRGSAWFLLQISPNSRLSQEVVLDVGCPYVRFHTEVHWHEAHKFLISASPA

SEQ ID NO: 808392 - protein, 592 aa, Homo sapiens
MAAAPALKHWRTTLERVEKFVSPLYFTDCNLRGRLFGASCPVAVLSSFLTPERLPYQEAVQRDFRPAQVGDSFGPTWWTCWFRVELTIPEAWVGQEVHLCWESDGEGLVWRDGEPVQGLTKEGEKTSYVLTDRLGERDPRSLTLYVEVACNGLLGAGKGSMIAAPDPEKMFQLSRAELAVFHRDVHMLLVDLELLLGIAKGLGKDNQRSFQALYTANQMVNVCDPAQPETFPVAQALASRFFGQHGGESQHTIHATGHCHIDTAWLWPFKETVRKCARSWVTALQLMERNPEFIFACSQAQQLEWVKSRYPGLYSRIQEFACRGQFVPVGGTWVEMDGNLPSGEAMVRQFLQGQNFFLQEFGKMCSEFWLPDTFGYSAQLPQIMHGCGIRRFLTQKLSWNLVNSFPHHTFFWEGLDGSRVLVHFPPGDSYGMQGSVEEVLKTVANNRDKGRANHSAFLFGFGDGGGGPTQTMLDRLKRLSNTDGLPRVQLSSPRQLFSALESDSEQLCTWVGELFLELHNGTYTTHAQIKKGNRECERISAQLPQIMHGCGIRRFLTQKLSWNLVNSFPHHTFFWEGLDGSRVLVHFPPGDS

SEQ ID NO: 808393 - protein, 66 aa, Homo sapiens
IKKGNRECERILHDVELLSSLALARSAQFLYPAAQLQHLWRSAQFCPCHPPDCSLQLPLCLPLPAF

SEQ ID NO: 808394 - protein, 1040 aa, Homo sapiens
MAAAPALKHWRTTLERVEKFVSPLYFTDCNLRGRLFGASCPVAVLSSFLTPERLPYQEAVQRDFRPAQVGDSFGPTWWTCWFRVELTIPEAWVGQEVHLCWESDGEGLVWRDGEPVQGLTKEGEKTSYVLTDRLGERDPRSLTLYVEVACNGLLGAGKGSMIAAPDPEKMFQLSRAELAVFHRDVHMLLVDLELLLGIAKGLGKDNQRSFQALYTANQMVNVCDPAQPETFPVAQALASRFFGQHGGESQHTIHATGHCHIDTAWLWPFKETVRKCARSWVTALQLMERNPEFIFACSQAQQLEWVKSRYPGLYSRIQEFACRGQFVPVGGTWVEMDGNLPSGEAMVRQFLQGQNFFLQEFGKMCSEFWLPDTFGYSAQLPQIMHGCGIRRFLTQKLSWNLVNSFPHHTFFWEGLDGSRVLVHFPPGDSYGMQGSVEEVLKTVANNRDKGRANHSAFLFGFGDGGGGPTQTMLDRLKRLSNTDGLPRVQLSSPRQLFSALESDSEQLCTWVGELFLELHNGTYTTHAQIKKGNRECERILHDVELLSSLALARSAQFLYPAAQLQHLWRLLLLNQFHDVVTGSCIQMVAEEAMCHYEDIRSHGNTLLSAAAAALCAGEPGPEGLLIVNTLPWKRIEVMALPKPGGAHSLALVTVPSMGYAPVPPPTSLQPLLPQQPVFVVQETDGSVTLDNGIIRVKLDPTGRLTSLVLVASGREAIAEGAVGNQFVLFDDVPLYWDAWDVMDYHLETRKPVLGQAGTLAVGTEGGLRGSAWFLLQISPNSRLSQEVVLDVGCPYVRFHTEVHWHEAHKFLKVEFPARVRSSQATYEIQFGHLQRPTHYNTSWDWARFEVWAHRWMDLSEHGFGLALLNDCKYGASVRGSILSLSLLRAPKAPDATADTGRHEFTYALMPHKGSFQDAGVIQAAYSLNFPLLALPAPSPAPATSWSAFSVSSPAVVLETVKQAESSPQRRSLVLRLYEAHGSHVDCWLHLSLPVQEAILCDLLERPDPAGHLTLRDNRLKLTFSPFQVLSLLLVLQPPPH

SEQ ID NO: 808395 - protein, 217 aa, Homo sapiens
LCRIACVNCIRETEGSNREQGGNRQQRKPQVVGAARQVRVRPFSFALTAPYMTRRFEAEDLLLEQRITDIHVIPDHPIALCAVAWADTHSRRTASSLWTFSLAYSTAGMCCRPSPAPATSWSAFSVSSPAVVLETVKQAESSPQRRSLVLRLYEAHGSHVDCWLHLSLPVQEAILCDLLERPDPLAYSTCLAMSRAMKRMEGSIGPISQLGSAGNQE

SEQ ID NO: 808396 - protein, 1198 aa, Homo sapiens
MAAAPALKHWRTTLERVEKFVSPLYFTDCNLRGRLFGASCPVAVLSSFLTPERLPYQEAVQRDFRPAQVGDSFGPTWWTCWFRVELTIPEAWVGQEVHLCWESDGEGLVWRDGEPVQGLTKEGEKTSYVLTDRLGERDPRSLTLYVEVACNGLLGAGKGSMIAAPDPEKMFQLSRAELAVFHRDVHMLLVDLELLLGIAKGLGKDNQRSFQALYTANQMVNVCDPAQPETFPVAQALASRFFGQHGGESQHTIHATGHCHIDTAWLWPFKETVRKCARSWVTALQLMERNPEFIFACSQAQQLEWVKSRYPGLYSRIQEFACRGQFVPVGGTWVEMDGNLPSGEAMVRQFLQGQNFFLQEFGKMCSEFWLPDTFGYSAQLPQIMHGCGIRRFLTQKLSWNLVNSFPHHTFFWEGLDGSRVLVHFPPGDSYGMQGSVEEVLKTVANNRDKGRANHSAFLFGFGDGGGGPTQTMLDRLKRLSNTDGLPRVQLSSPRQLFSALESDSEQLCTWVGELFLELHNGTYTTHAQIKKGNRECERILHDVELLSSLALARSAQFLYPAAQLQHLWRLLLLNQFHDVVTGSCIQMVAEEAMCHYEDIRSHGNTLLSAAAAALCAGEPGPEGLLIVNTLPWKRIEVMALPKPGGAHSLGRAEGKGCYCSRKDGGQTDQAWDTPRDLGAPDWRVVDIFHQPIPTCASFLKGQEGCTDAQASPPALVTVPSMGYAPVPPPTSLQPLLPQQPVFVVQEVSPACPGGQELCWDTFLQLRVLSSPVWSKWGGGAGVGVGRLLVWEAPTDSASRPPPTKTDGSVTLDNGIIRVKLDPTGRLTSLVLVASGREAIAEGAVGNQFVLFDDVPLYWDAWDVMDYHLETRKPVLGQAGTLAVGTEGGLRGSAWFLLQISPNSRLSQEVVLDVGCPYVRFHTEVHWHEAHKFLKVEFPARVRSSQATYEIQFGHLQRPTHYNTSWDWARFEVWAHRWMDLSEHGFGLALLNDCKYGASVRGSILSLSLYSGVPTRPGSWHGEMGLPDHNSNSFSVAPTRPPHPSLRAPKAPDATADTGRHEFTYALMPHKGSFQDAGVIQAAYSLNFPLLALPAPSPAPATSWSAFSVSSPAVVLETVKQAESSPQRRSLVLRLYEAHGSHVDCWLHLSLPVQEAILCDLLERPDPAGHLTLRDNRLKLTFSPFQVLSLLLVLQPPPH

SEQ ID NO: 808397 - protein, 1081 aa, Homo sapiens
MAAAPALKHWRTTLERVEKFVSPLYFTDCNLRGRLFGASCPVAVLSSFLTPERLPYQEAVQRDFRPAQVGDSFGPTWWTCWFRVELTIPEAWVGQEVHLCWESDGEGLVWRDGEPVQGLTKEGEKTSYVLTDRLGERDPRSLTLYVEVACNGLLGAGKGSMIAAPDPEKMFQLSRAELAVFHRDVHMLLVDLELLLGIAKGLGKDNQRSFQALYTANQMVNVCDPAQPETFPVAQALASRFFGQHGGESQHTIHATGHCHIDTAWLWPFKETVRKCARSWVTALQLMERNPEFIFACSQAQQLEWVKSRYPGLYSRIQEFACRGQFVPVGGTWVEMDGNLPSGEAMVRQFLQGQNFFLQEFGKMCSEFWLPDTFGYSAQLPQIMHGCGIRRFLTQKLSWNLVNSFPHHTFFWEGLDGSRVLVHFPPGDSYGMQGSVEEVLKTVANNRDKGRANHSAFLFGFGDGGGGPTQTMLDRLKRLSNTDGLPRVQLSSPRQLFSALESDSEQLCTWVGELFLELHNGTYTTHAQIKKGNRECERILHDVELLSSLALARSAQFLYPAAQLQHLWRLLLLNQFHDVVTGSCIQMVAEEAMCHYEDIRSHGNTLLSAAAAALCAGEPGPEGLLIVNTLPWKRIEVMALPKPGGAHSLALVTVPSMGYAPVPPPTSLQPLLPQQPVFVVQEPLQTQPQGLLPQKTDGSVTLDNGIIRVKLDPTGRLTSLVLVASGREAIAEGAVGNQFVLFDDVPLYWDAWDVMDYHLETRYRLGACGDGGGGGNTGCSGSVCPPLSHRKPVLGQAGTLAVGTEGGLRGSAWFLLQISPNSRLSQEVVLDVGCPYVRFHTEVHWHEAHKFLKVEFPARVRSSQATYEIQFGHLQRPTHYNTSWDWARFEVWAHRWMDLSEHGFGLALLNDCKYGASVRGSILSLSLLRAPKAPDATADTGRHEFTYALMPHKGSFQDAGVIQAAYSLNFPLLALPAPSPAPATSWSAFSVSSPAVVLETVKQAESSPQRRSLVLRLYEAHGSHVDCWLHLSLPVQEAILCDLLERPDPAGHLTLRDNRLKLTFSPFQVLSLLLVLQPPPH

SEQ ID NO: 808398 - protein, 1075 aa, Homo sapiens; identical to SEQ ID NO: 808388

SEQ ID NO: 808399 - protein, 1151 aa, Homo sapiens
MAAAPALKHWRTTLERVEKFVSPLYFTDCNLRGRLFGASCPVAVLSSFLTPERLPYQEAVQRDFRPAQVGDSFGPTWWTCWFRVELTIPEAWVGQEVHLCWESDGEGLVWRDGEPVQGLTKEGEKTSYVLTDRLGERDPRSLTLYVEVACNGLLGAGKGSMIAAPDPEKMFQLSRAELAVFHRDVHMLLVDLELLLGIAKGLGKDNQRSFQALYTANQMVNVCDPAQPETFPVAQALASRFFGQHGGESQHTIHATGHCHIDTAWLWPFKETVRKCARSWVTALQLMERNPEFIFACSQAQQLEWVKSRYPGLYSRIQEFACRGQFVPVGGTWVEMDGNLPSGEAMVRQFLQGQNFFLQEFGKMCSEFWLPDTFGYSAQLPQIMHGCGIRRFLTQKLSWNLVNSFPHHTFFWEGLDGSRVLVHFPPGDSYGMQGSVEEVLKTVANNRDKGRANHSAFLFGFGDGGGGPTQTMLDRLKRLSNTDGLPRVQLSSPRQLFSALESDSEQLCTWVGELFLELHNGTYTTHAQIKKGNRECERILHDVELLSSLALARSAQFLYPAAQLQHLWRLLLLNQFHDVVTGSCIQMVAEEAMCHYEDIRSHGNTLLSAAAAALCAGEPGPEGLLIVNTLPWKRIEVMALPKPGGAHSLGRAEGKGCYCSRKDGGQTDQAWDTPRDLGAPDWRVVDIFHQPIPTCASFLKGQEGCTDAQASPPALVTVPSMGYAPVPPPTSLQPLLPQQPVFVVQEVSPACPGGQELCWDTFLQLRVLSSPVWSKWGGGAGVGVGRLLVWEAPTDSASRPPPTKTDGSVTLDNGIIRVKLDPTGRLTSLVLVASGREAIAEGAVGNQFVLFDDVPLYWDAWDVMDYHLETRKPVLGQAGTLAVGTEGGLRGSAWFLLQISPNSRLSQEVVLDVGCPYVRFHTEVHWHEAHKFLKVEFPARVRSSQATYEIQFGHLQRPTHYNTSWDWARFEVWAHRWMDLSEHGFGLALLNDCKYGASVRGSILSLSLLRAPKAPDATADTGRHEFTYALMPHKGSFQDAGVIQAAYSLNFPLLALPAPSPAPATSWSAFSVSSPAVVLETVKQAESSPQRRSLVLRLYEAHGSHVDCWLHLSLPVQEAILCDLLERPDPAGHLTLRDNRHTESLGLGFCL

SEQ ID NO: 808400 - protein, 652 aa, Homo sapiens [sequence omitted]

SEQ ID NO: 808401 - protein, 213 aa, Homo sapiens
LWSLGAQRGAQGHQVGLGSALQVWAHRWMDLSEHGFGLALLNDCKYGASVRGSILSLSLLRAPKAPDATADTGRHEFTYALMPHKGSFQDAGVIQAAYSLNFPLLALPAPSPAPATSWSAFSVSSPAVVLETVKQAESSPQRRSLVLRLYEAHGSHVDCWLHLSLPVQEAILCDLLERPDPAGHLTLRDNRLKLTFSPFQVLSLLLVLQPPPH

SEQ ID NO: 808402 - protein, 140 aa, Homo sapiens
SLWSAICNKVLSNFSHQTLEGEYANQKFSGLLITSNFTERQQYQACNDEVSSPAVVLETVKQAESSPQRRSLVLRLYEAHGSHVDCWLHLSLPVQEAILCDLLERPDPAGHLTLRDNRLKLTFSPFQVLSLLLVLQPPPH

SEQ ID NO: 808403 - protein, 121 aa, Homo sapiens
LWAGPAQRLQVWRVSARQHPQPLAVSGVPTRPGSWHGEMGLPDHNSNSFSVAPTRPPHPSLRAPKAPDATADTGRHEFTYALMPHKGECWGRWGLPAALDTSLPFPEPKPQQPGFLPLLGT

SEQ ID NO: 808404 - protein, 102 aa, Homo sapiens
MFACSKFVSIPLVKSTSQLLSRPLSAVVLKRPEILTDESLSSLAVSCPLTSLVSSRSFQTSAISRDIDTAAKFIGAGAATVGVAGSGAGIGTVFGSLIIGYA

SEQ ID NO: 808405 - protein, 476 aa, Homo sapiens
RPPPCSPRATGPRPAMEDLDALLSDLETTTSHMPRSGAPKERPAEPLTPPPSYGHQPQTGSGESSGASGDKDHLYSTVCKPRSPKPAAPAAPPFSSSSGVLGTGLCELDRLLQELNATQFNITDEIMSQFPSSKVASGEQKEDQSEDKKRPSLPSSPSPGLPKASATSATLELDRLMASLSDFRVQNHLPASGPTQPPVVSSTNEGSPSPPEPTGKGSLDTMLGLLQSDLSRRGVPTQAKGLCGSCNKPIAGQVVTALGRAWHPEHFVCGGCSTALGGSSFFEKDGAPFCPECYFERFSPRCGFCNQPIRHKMVTALGTHWHPEHFCCVSCGEPFGDEGFHEREGRPYCRRDFLQLFAPRCQGCQGPILDNYISALSALWHPDCFVCRECFAPFSGGSFFEHEGRPLCENHFHARRGSLCATCGLPVTGRCVSALGRRFHPDHFTCTFCLRPLTKGSFQERAGKPYCQPCFLKLFG

SEQ ID NO: 808406 - protein, 444 aa, Homo sapiens
MPRSGAPKERPAEPLTPPPSYGHQPQTGSGESSGASGDKDHLYSTVCKPRSPKPAAPAAPPFSSSSGVLGTGLCELDRLLQELNATQFNITDEIMSQFPSSKVASGEQKEDQSEDKKRPSLPSSPSPGLPKASATSATLELDRLMASLSDFRVQNHLPASGPTQPPVVSSTNEGSPSPPEPTGKGSLDTMLGLLQSDLSRRGVPTQAKGLCGSCNKPIAGQVVTALGRAWHPEHFVCGGCSTALGGSSFFEKDGAPFCPECYFERFSPRCGFCNQPIRHKMVTALGTHWHPEHFCCVSCGEPFGDEGFHEREGRPYCRRDFLQLFAPRCQGCQGPILDNYISALSALWHPDCFVCRECFAPFSGGSFFEHEGRPLCENHFHARRGSLCATCGLPVTGRCVSALGRRFHPDHFTCTFCLRPLTKGSFQERAGKPYCQPCFLKLFG

SEQ ID NO: 808407 - protein, 250 aa, Homo sapiens
PGGEFGTREDLDALLSDLETTTSHMPRSGAPKERPAEPLTPPPSYGHQPQTGSGESSGASGDKDHLYSTVCKPRSPKPAAPAAPPFSSSSGVLGTGLCELDRLLQELNATQFNITDEIMSQFPSSKVASGEQKEDQSEDKKRPSLPSSPSPGLPKASATSATLELDRLMASLSDFRVQNHLPASGPTQPPVVSSTNEGSPSPPEPTGKGSLDTMLGLLQSDLSRRGVPTQAKGLCGSCNKPIAGQVSGAL

SEQ ID NO: 808408 - protein, 476 aa, Homo sapiens; identical to SEQ ID NO: 808405

SEQ ID NO: 808409 - protein, 468 aa, Homo sapiens
PGGEFGTREDLDALLSDLETTTSHMPRSGAPKERPAEPLTPPPSYGHQPQTGSGESSGASGDKDHLYSTVCKPRSPKPAAPAAPPFSSSSGVLGTGLCELDRLLQELNATQFNITDEIMSQFPSSKVASGEQKEDQSEDKKRPSLPSSPSPGLPKASATSATLELDRLMASLSDFRVQNHLPASGPTQPPVVSSTNEGSPSPPEPTGKGSLDTMLGLLQSDLSRRGVPTQAKGLCGSCNKPIAGQVVTALGRAWHPEHFVCGGCSTALGGSSFFEKDGAPFCPECYFERFSPRCGFCNQPIRHKMVTALGTHWHPEHFCCVSCGEPFGDEGFHEREGRPYCRRDFLQLFAPRCQGCQGPILDNYISALSALWHPDCFVCRECFAPFSGGSFFEHEGRPLCENHFHARRGSLCATCGLPVTGRCVSALGRRFHPDHFTCTFCLRPLTKGSFQERAGKPYCQPCFLKLFG

SEQ ID NO: 808410 - protein, 475 aa, Homo sapiens
MEDLDALLSDLETTTSHMPRSGAPKERPAEPLTPPPSYGHQPQTGSGESSGASGDKDHLYSTVCKPRSPKPAAPAAPPFSSSSGVLGTGLCELDRLLQELNATQFNITDEIMSQFPSSKVASGEQKEDQSEDKKRPSLPSSPSPGLPKASATSATLELDRLMASLSDFRVQNHLPASGPTQPPVVSSTNEGSPSPPEPTGKGSLDTMLGLLQSDLSRRGVPTQAKGLCGSCNKPIAGQVVTALGRAWHPEHFVCGGCSTALGGSSFFEKDGAPFCPECYFERFSPRCGFCNQPIRHKMVTALGTHWHPEHFCCVSCGEPFGDEGFHEREGRPYCRRDFLQLFAPRCQGCQGPILDNYISALSALWHPDCFVCRECFAPFSGGSFFEHEGRPLCENHFHARRGSLCATCGLPVTGRCVSALGRRFHPDHFTCTFCLRPLTKGSFQERRALPEKPGPPDPEALLSEREAPPTGEPRP

SEQ ID NO: 808411 - protein, 107 aa, Homo sapiens
GPRPVRPAPPARAPPWRTWMPCSLTWRLPPRTCQGQGLPKSALRSLSPLPHPMATSHRQGLGSLQEPRGTRTTCTARYASLGPQSLQPRRPLHSPLPAVSWVPGSVS

SEQ ID NO: 808412 - protein, 418 aa, Homo sapiens
PRARSCRGASGDKDHLYSTVCKPRSPKPAAPAAPPFSSSSGVLGTGLCELDRLLQELNATQFNITDEIMSQFPSSKVASGEQKEDQSEDKKRPSLPSSPSPGLPKASATSATLELDRLMASLSDFRVQNHLPASGPTQPPVVSSTNEGSPSPPEPTGKGSLDTMLGLLQSDLSRRGVPTQAKGLCGSCNKPIAGQVVTALGRAWHPEHFVCGGCSTALGGSSFFEKDGAPFCPECYFERFSPRCGFCNQPIRHKMVTALGTHWHPEHFCCVSCGEPFGDEGFHEREGRPYCRRDFLQLFAPRCQGCQGPILDNYISALSALWHPDCFVCRECFAPFSGGSFFEHEGRPLCENHFHARRGSLCATCGLPVTGRCVSALGRRFHPDHFTCTFCLRPLTKGSFQERAGKPYCQPCFLKLFG

SEQ ID NO: 808413 - protein, 290 aa, Homo sapiens
MYRSILERSWKTEHGSYISIAYRLRDLEHWILYSDRSERTRKTPRKSCLTGHVVVRAALTRLTSHSQVVTALGRAWHPEHFVCGGCSTALGGSSFFEKDGAPFCPECYFERFSPRCGFCNQPIRHKMVTALGTHWHPEHFCCVSCGEPFGDEGFHEREGRPYCRRDFLQLFAPRCQGCQGPILDNYISALSALWHPDCFVCRECFAPFSGGSFFEHEGRPLCENHFHARRGSLCATCGLPVTGRCVSALGRRFHPDHFTCTFCLRPLTKGSFQERAGKPYCQPCFLKLFG

SEQ ID NO: 808414 - protein, 175 aa, Homo sapiens
MYRSILERSWKTEHGSYISIAYRLRDLEHWILYSDRSERTRKTPRKSCLTGHVVVRAALTRLTSHSQVVTALGRAWHPEHFVCGGCSTALGGSSFFEKDGAPFCPECYFARAARAPSWITTSRRSARSGTRTVSSAGNASRPSREAAFSSTRAARCARTTSTHDAARCAPRVASL

SEQ ID NO: 808415 - protein, 555 aa, Homo sapiens
MARPDDEEGAAVAPGHPLAKGYLPLPRGAPVGKESVELQNGPKAGTFPVNGAPRDSLAAASGVLGGPQTPLAPEEETQARLLPAGAGAETPGAESSPLPLTALSPRRFVVLLIFSLYSLVNAFQWIQYSIISNVFEGFYGVTLLHIDWLSMVYMLAYVPLIFPATWLLDTRGLRLTALLGSGLNCLGAWIKCGSVQQHLFWVTMLGQCLCSVAQVFILGLPSRIASVWFGPKEVSTACATAVLGNQLGTAVGFLLPPVLVPNTQNDTNLLACNISTMFYGTSAVATLLFILTAIAFKEKPRYPPSQAQAALQDSPPEEYSYKKSIRNLFKNIPFVLLLITYGIMTGAFYSVSTLLNQMILTYYEGEEVNAGRIGLTLVVAGMVGSILCGLWLDYTKTYKQTTLIVYILSFIGMVIFTFTLDLRYIIIVFVTGGVLGFFMTGYLPLGFEFAVEITYPESEGTSSGLLNASAQIFGILFTLAQGKLTSDYGPKAGNIFLCVWMFIGIILTALIKSDLRRHNINIGITNVDVKAIPADSPTDQEPKTVMLSKQSESAI

SEQ ID NO: 808416 - protein, 508 aa, Homo sapiens
MARPDDEEGAAVAPGHPLAKGYLPLPRGAPVGKESVELQNGPKAGTFPVNGAPRDSLAAASGVLGGPQTPLAPEEETQARLLPAGAGAETPGAESSPLPLTALSPRRFVVLLIFSLYSLVNAFQWIQYSIISNVFEGFYGVTLLHIDWLSMVYMLAYVPLIFPATWLLDTRGLRLTALLGSGLNCLGAWIKCGSVQQHLFWVTMLGQCLCSVAQVFILGLPSRIASVWFGPKEVSTACATAVLGNQLGTAVGFLLPPVLVPNTQNDTNLLACNISTMFYGTSAVATLLFILTAIGIMTGAFYSVSTLLNQMILTYYEGEEVNAGRIGLTLVVAGMVGSILCGLWLDYTKTYKQTTLIVYILSFIGMVIFTFTLDLRYIIIVFVTGGVLGFFMTGYLPLGFEFAVEITYPESEGTSSGLLNASAQIFGILFTLAQGKLTSDYGPKAGNIFLCVWMFIGIILTALIKSDLRRHNINIGITNVDVKAIPADSPTDQEPKTVMLSKQSESAI

SEQ ID NO: 808417 - protein, 518 aa, Homo sapiens
MARPDDEEGAAVAPGHPLAKGYLPLPRGAPVGKESVELQNGPKAGTFPVNGAPRDSLAAASGVLGGPQTPLAPEEETQARLLPAGAGAETPGAESSPLPLTALSPRRFVVLLIFSLYSLVNAFQWIQYSIISNVFEGFYGVTLLHIDWLSMVYMLAYVPLIFPATWLLDTRGLRLTALLGSGLNCLGAWIKCGSVQQHLFWVTMLGQCLCSVAQVFILGLPSRIASVWFGPKEVSTACATAVLGNQLGTAVGFLLPPVLVPNTQNDTNLLACNISTMFYGTSAVATLLFILTAIAFKEKPRYPPSQAQAALQDSPPEEYSYKKSIRNLFKNIPFVLLLITYGIMTGAFYSVSTLLNQMILTYYEGEEVNAGRIGLTLVVAGMVGSILCGLWLDYTKTYNFFMTGYLPLGFEFAVEITYPESEGTSSGLLNASAQIFGILFTLAQGKLTSDYGPKAGNIFLCVWMFIGIILTALIKSDLRRHNINIGITNVDVKAIPADSPTDQEPKTVMLSKQSESAI

SEQ ID NO: 808418 - protein, 555 aa, Homo sapiens; identical to SEQ ID NO: 808415

SEQ ID NO: 808419 - protein, 518 aa, Homo sapiens; identical to SEQ ID NO: 808417

SEQ ID NO: 808420 - protein, 111 aa, Homo sapiens
PHSPRAAPGFCTVTALRFPALGILTRFHGSRPGGTAAIMRGGGTYERRSYARARPATGVWNSSSFFLWLWICVPDSLKEDRPFIHEDDPQLGPVHVSSDSSLAFLAERLKK

SEQ ID NO: 808421 - protein, 111 aa, Homo sapiens; identical to SEQ ID NO: 808420

SEQ ID NO: 808422 - protein, 640 aa, Homo sapiens
MDRCKHVGRLRLAQDHSILNPQKWCCLECATTESVWACLKCSHVACGRYIEDHALKHFEETGHPLAMEVRDLYVFCYLCKDYVLNDNPEGDLKLLRSSLLAVRGQKQDTPVRRGRTLRSMASGEDVVLPQRAPQGQPQMLTALWYRRQRLLARTLRLWFEKSSRGQAKLEQRRQEEALERKKEEARRRRREVKRRLLEELASTPPRKSARLLLHTPRDAGPAASRPAALPTSRRVPAATLKLRRQPAMAPGVTGLRNLGNTCYMNSILQVLSHLQKFRECFLNLDPSKTEHLFPKATNGKTQLSGKPTNSSATELSLRNDRAEACEREGFCWNGRASISRSLELIQNKEPSSKHISLCRELHTLFRVMWSGKWALVSPFAMLHSVWSLIPAFRGYDQQDAQEFLCELLHKVQQELESEGTTRRILIPFSQRKLTKQVLKVVNTIFHGQLLSQVTCISCNYKSNTIEPFWDLSLEFPERYHCIEKGFVPLNQTECLLTEMLAKFTETEALEGRIYACDQCNSKRRKSNPKPLVLSEARKQLMIYRLPQVLRLHLKRFRWSGRNHREKIGVHVVFDQVLTMEPYCCRDMLSSLDKETFAYDLSAVVMHHGKGFGSGHYTAYCYNTEGGACALLCGVGDTERG

SEQ ID NO: 808423 - protein, 529 aa, Homo sapiens [sequence omitted]

SEQ ID NO: 808424 - protein, 503 aa, Homo sapiens
MDRCKHVGRLRLAQDHSILNPQKWCCLECATTESVWACLKCSHVACGRYIEDHALKHFEETGHPLAMEVRDLYVFCYLCKDYVLNDNPEGDLKLLRSSLLAVRGQKQDTPVRRGRTLRSMASGEDVVLPQRAPQGQPQMLTALWYRRQRLLARTLRLWFEKSSRGQAKLEQRRQEEALERKSARLLLHTPRDAGPAASRPAALPTSRRVPAATLKLRRQPAMAPGVTGLRNLGNTCYMNSILQVLSHLQKFRECFLNLDPSKTEHLFPKATNGKTQLSGKPTNSSATELSLRNDRAEACEREGFCWNGRASISRSLELIQNKEPSSKHISLCRELHTLFRVMWSGKWALVSPFAMLHSVWSLIPAFRGYDQQDAQEFLCELLHKVQQELESEGTTRRILIPFSQRKLTKQVLKVVNTIFHGQLLSQVTCISCNYKSNTIEPFWDLSLEFPERYHCIEKGFVPLNQTECLLTEMLAKFTETEALEGRIYACDQCNSECCVEEGA

SEQ ID NO: 808425 - protein, 495 aa, Homo sapiens
MEALLEGIQNRGHGGGFLTSCEAELQELMKQIDIMVAHKKSEWEGRTHALETCLKIREQELKSLRSQLDVTHKEVGMLHQQVEEHEKIKQEMTMEYKQELKKLHEELCILKRSYEKLQKKQMREFRGNTKNHREDRSEIERLTAKIEEFRQKSLDWEKQRLIYQQQVSSLEAQRKALAEQSEIIQAQLVNRKQKLESVELSSQSEIQHLSSKLERANDTICANELEIERLTMRVNDLVGTSMTVLQEQQQKEEKLRESEKLLEALQEEKRELKAALQSQENLIHEARIQKEKLQEKVKATNTQHAVEAISLESVSATCKQLSQELMEKYEELKRMEAHNNEYKAEIKKLKEQILQGEQSYSSALEGMKMEISHLTQELHQRDITIASTKGSSSDMEKRLRAEMQKAEDKAVEHKEILDQLESLKLENRHLSEMVMKLELGLHECSLPVSPLGSIATRFLEEEELRSHHILERLDAHIEELKRESEKTVRQFTALK

SEQ ID NO: 808426 - protein, 475 aa, Homo sapiens
MEALLEGIQNRGHGGGFLTSCEAELQELMKQIDIMVAHKKSEWEGRTHALETCLKIREQELKSLRSQLDVTHKEVGMLHQQVEEHEKIKQEMTMEYKQELKKLHEELCILKRSYEKLQKKQMREFRGNTKNHREDRSEIERLTAKIEEFRQKSLDWEKQRLIYQQQVSSLEAQRKALAEQSEIIQAQLVNRKQKLESVELSSQSEIQHLSSKLERANDTICANELEIERLTMRVNDLVGTSMTVLQEQQQKEEKLRESEKLLEALQEEKRELKAALQSQENLIHEARIQKEKLQEKVKATNTQHAVEAISLESVSATCKQLSQELMEKYEELKRMEAHNNEYKAEIKKLKEQILQGEQSYSSALEGMKMEISHLTQELHQRDITIASTKGSSSDMEKRLRAEMQKAEDKAVEHKEILDQLESLKLENRHLSEMVMKLELGLHERWGFTMLSSLVLNFGIQAIRQPQRPKVLELQV

SEQ ID NO: 808427 - protein, 620 aa, Homo sapiens
RREGSGACLRQPCNRRCASWRGKGLPCPGLEAAQAALVILASRPHGLRPVCATACEPPGVSPPAWVRPEAQSLGLARYALHTGGVWRGAARRGVRPRQVVSPSSESRWLGALRRVASCQNKGDLVMEALLEGIQNRGHGGGFLTSCEAELQELMKQIDIMVAHKKSEWEGRTHALETCLKIREQELKSLRSQLDVTHKEVGMLHQQVEEHEKIKQEMTMEYKQELKKLHEELCILKRSYEKLQKKQMREFRGNTKNHREDRSEIERLTAKIEEFRQKSLDWEKQRLIYQQQVSSLEAQRKALAEQSEIIQAQLVNRKQKLESVELSSQSEIQHLSSKLERANDTICANELEIERLTMRVNDLVGTSMTVLQEQQQKEEKLRESEKLLEALQEEKRELKAALQSQENLIHEARIQKEKLQEKVKATNTQHAVEAISLESVSATCKQLSQELMEKYEELKRMEAHNNEYKAEIKKLKEQILQGEQSYSSALEGMKMEISHLTQELHQRDITIASTKGSSSDMEKRLRAEMQKAEDKAVEHKEILDQLESLKLENRHLSEMVMKLELGLHECSLPVSPLGSIATRFLEEEELRSHHILERLDAHIEELKRESEKTVRQFTALK

SEQ ID NO: 808428 - protein, 495 aa, Homo sapiens; identical to SEQ ID NO: 808425

SEQ ID NO: 808429 - protein, 477 aa, Homo sapiens
MEALLEGIQNRGHGGGFLTSCEAELQELMKQIDIMVAHKKSEWEGRTHALETCLKIREQELKSLRSQLDVTHKEVGMLHQQVEEHEKIKQEMTMEYKQELKKLHEELCILKRSYEKLQKKQMREFRGNTKNHREDRSEIERLTAYQQQVSSLEAQRKALAEQSEIIQAQLVNRKQKLESVELSSQSEIQHLSSKLERANDTICANELEIERLTMRVNDLVGTSMTVLQEQQQKEEKLRESEKLLEALQEEKRELKAALQSQENLIHEARIQKEKLQEKVKATNTQHAVEAISLESVSATCKQLSQELMEKYEELKRMEAHNNEYKAEIKKLKEQILQGEQSYSSALEGMKMEISHLTQELHQRDITIASTKGSSSDMEKRLRAEMQKAEDKAVEHKEILDQLESLKLENRHLSEMVMKLELGLHECSLPVSPLGSIATRFLEEEELRSHHILERLDAHIEELKRESEKTVRQFTALK

SEQ ID NO: 808430 - protein, 467 aa, Homo sapiens
MKQIDIMVAHKKSEWEGRTHALETCLKIREQELKSLRSQLDVTHKEVGMLHQQVEEHEKIKQEMTMEYKQELKKLHEELCILKRSYEKLQKKQMREFRGNTKNHREDRSEIERLTAKIEEFRQKSLDWEKQRLIYQQQVSSLEAQRKALAEQSEIIQAQLVNRKQKLESVELSSQSEIQHLSSKLERANDTICANELEIERLTMRVNDLVGTSMTVLQEQQQKEEKLRESEKLLEALQEEKRELKAALQSQENLIHEARIQKEKLQEKVKATNTQHAVEAISLESVSATCKQLSQELMEKYEELKRMEAHNNEYKAEIKKLKEQILQGEQSYSSALEGMKMEISHLTQELHQRDITIASTKGSSSDMEKRLRAEMQKAEDKAVEHKEILDQLESLKLENRHLSEMVMKLELGLHECSLPVSPLGSIATRFLEEEELRSHHILERLDAHIEELKRESEKTVRQFTALK

SEQ ID NO: 808431 - protein, 661 aa, Homo sapiens
MGIGGSPTLSNERIPAPPKPRPGALETLTGTRPPRQTLAPATPPPLPRITCLHSLSSDSRMWGVHLLACRGSLEKALFQLLKVWGQWAEQTRRLQRLDVSLAVARVRSAGPSCQNKGDLVMEALLEGIQNRGHGGGFLTSCEAELQELMKQIDIMVAHKKSEWEGRTHALETCLKIREQELKSLRSQLDVTHKEVGMLHQQVEEHEKIKQEMTMEYKQELKKLHEELCILKRSYEKLQKKQMREFRGNTKNHREDRSEIERLTAKIEEFRQKSLDWEKQRLIYQQQVSSLEAQRKALAEQSEIIQAQLVNRKQKLESVELSSQSEIQHLSSKLERANDTICANELEIERLTMRVNDLVGTSMTVLQEQQQKEEKLRESEKLLEALQEEKRELKAALQSQENLIHEARIQKEKLQEKVKATNTQHAVEAIRPREESLAEKKYTSQGQGDLDSVLSQLNFTHTSEDLLQAEVTCLEGSLESVSATCKQLSQELMEKYEELKRMEAHNNEYKAEIKKLKEQILQGEQSYSSALEGMKMEISHLTQELHQRDITIASTKGSSSDMEKRLRAEMQKAEDKAVEHKEILDQLESLKLENRHLSEMVMKLELGLHECSLPVSPLGSIATRFLEEEELRSHHILERLDAHIEELKRESEKTVRQFTALK

SEQ ID NO: 808432 - protein, 639 aa, Homo sapiens
MGIGGSPTLSNERIPAPPKPRPGALETLTGTRPPRQTLAPATPPPLPRITCLHSLSSDSRMWVSSFARVQGKSGEGIVSIIKSVGAVGGTNAPTTEAGRKLSGGARAQRRPEGPPNPGPQSSTSPWPVGTRLQSRSCQNKGDLVMEALLEGIQNRGHGGGFLTSCEAELQELMKQIDIMVAHKKSEWEGRTHALETCLKIREQELKSLRSQLDVTHKEVGMLHQQVEEHEKIKQEMTMEYKQELKKLHEELCILKRSYEKLQKKQMREFRGNTKNHREDRSEIERLTAKIEEFRQKSLDWEKQRLIYQQQVSSLEAQRKALAEQSEIIQAQLVNRKQKLESVELSSQSEIQHLSSKLERANDTICANELEIERLTMRVNDLVGTSMTVLQEQQQKEEKLRESEKLLEALQEEKRELKAALQSQENLIHEARIQKEKLQEKVKATNTQHAVEAISLESVSATCKQLSQELMEKYEELKRMEAHNNEYKAEIKKLKEQILQGEQSYSSALEGMKMEISHLTQELHQRDITIASTKGSSSDMEKRLRAEMQKAEDKAVEHKEILDQLESLKLENRHLSEMVMKLELGLHECSLPVSPLGSIATRFLEEEELRSHHILERLDAHIEELKRESEKTVRQFTALK

SEQ ID NO: 808433 - protein, 609 aa, Homo sapiens
ASARRVLNRPRQGLPCPGLEAAQAALVILASRPHGLRPVCATACEPPGVSPPAWVRPEAQSLGLARYALHTGGVWRGAARRGVRPRQVVSPSSESRWLGALRRVASCQNKGDLVMEALLEGIQNRGHGGGFLTSCEAELQELMKQIDIMVAHKKSEWEGRTHALETCLKIREQELKSLRSQLDVTHKEVGMLHQQVEEHEKIKQEMTMEYKQELKKLHEELCILKRSYEKLQKKQMREFRGNTKNHREDRSEIERLTAKIEEFRQKSLDWEKQRLIYQQQVSSLEAQRKALAEQSEIIQAQLVNRKQKLESVELSSQSEIQHLSSKLERANDTICANELEIERLTMRVNDLVGTSMTVLQEQQQKEEKLRESEKLLEALQEEKRELKAALQSQENLIHEARIQKEKLQEKVKATNTQHAVEAISLESVSATCKQLSQELMEKYEELKRMEAHNNEYKAEIKKLKEQILQGEQSYSSALEGMKMEISHLTQELHQRDITIASTKGSSSDMEKRLRAEMQKAEDKAVEHKEILDQLESLKLENRHLSEMVMKLELGLHECSLPVSPLGSIATRFLEEEELRSHHILERLDAHIEELKRESEKTVRQFTALK

SEQ ID NO: 808434 - protein, 348 aa, Homo sapiens
MPHIDNDVKLDFKDVLLRPKRSTLKSRSEVDLTRSFSFRNSKQTYSGVPIIAANMDTVGTFEMAKVLCKFSLFTAVHKHYSLVQWQEFAGQNPDCLEHLAASSGTGSSDFEQLEQILEAIPQVKYICLDVANGYSEHFVEFVKDVRKRFPQHTIMAGNVVTGEMVEELILSGADIIKVGIGPGSVCTTRKKTGVGYPQLSAVMECADAAHGLKGHIISDGGCSCPGDVAKAFGAGADFVMLGGMLAGHSESGGELIERDGKKYKLFYGMSSEMAMKKYAGGVAEYRASEGKTVEVPFKGDVEHTIRDILGGIRSTCTYVGAAKLKELSRRTTFIRVTQQVNPIFSEAC

SEQ ID NO: 808435 - protein, 366 aa, Homo sapiens
MTSCLPALRFIATPRLSAMPHIDNDVKLDFKDVLLRPKRSTLKSRSEVDLTRSFSFRNSKQTYSGVPIIAANMDTVGTFEMAKVLCKFSLFTAVHKHYSLVQWQEFAGQNPDCLEHLAASSGTGSSDFEQLEQILEAIPQVKYICLDVANGYSEHFVEFVKDVRKRFPQHTIMAGNVVTGEMVEELILSGADIIKVGIGPGSVCTTRKKTGVGYPQLSAVMECADAAHGLKGHIISDGGCSCPGDVAKAFGAGADFVMLGGMLAGHSESGGELIERDGKKYKLFYGMSSEMAMKKYAGGVAEYRASEGKTVEVPFKGDVEHTIRDILGGIRSTCTYVGAAKLKELSRRTTFIRVTQQVNPIFSEAC

SEQ ID NO: 808436 - protein, 348 aa, Homo sapiens; identical to SEQ ID NO: 808434

SEQ ID NO: 808437 - protein, 138 aa, Homo sapiens
MPHIDNDVKLDFKDVLLRPKRSTLKSRSEVDLTRSFSFRNSKQTYSGVPIIAANMDTVGTFEMAKVLCKFSLFTAVHKHYSLVQWQEFAGQNPDCLEHLAASSGTGSSDFEQLEQILEAIPQVKYICLDVANGYSEHF

SEQ ID NO: 808438 - protein, 348 aa, Homo sapiens; identical to SEQ ID NO: 808434

SEQ ID NO: 808439 - protein, 348 aa, Homo sapiens; identical to SEQ ID NO: 808434

SEQ ID NO: 808440 - protein, 348 aa, Homo sapiens; identical to SEQ ID NO: 808434

SEQ ID NO: 808441 - protein, 241 aa, Homo sapiens
MPHIDNDVKLDFKDVLLRPKRSTLKSRSEVDLTRSFSFRNSKQTYSGVPIIAANMDTVGTFEMAKVLCKFSLFTAVHKHYSLVQWQEFAGQNPDCLEHLAASSGTGSSDFEQLEQILEAIPQVKYICLDVANGYSEHFVEFVKDVRKRFPQHTIMAGNVVTGEMVEELILSGADIIKVGIGPGSVCTTRKKTGVGYPQLSAVMECADAAHGLKGHIISDGGCSCPGDVAKAFGKELEGTEG

SEQ ID NO: 808442 - protein, 241 aa, Homo sapiens; identical to SEQ ID NO: 808441

SEQ ID NO: 808443 - protein, 241 aa, Homo sapiens; identical to SEQ ID NO: 808441

SEQ ID NO: 808444 - protein, 312 aa, Homo sapiens
MGCVFLIYKLFTLKWKMLLLSVLLPASILVAEKFSLFTAVHKHYSLVQWQEFAGQNPDCLEHLAASSGTGSSDFEQLEQILEAIPQVKYICLDVANGYSEHFVEFVKDVRKRFPQHTIMAGNVVTGEMVEELILSGADIIKVGIGPGSVCTTRKKTGVGYPQLSAVMECADAAHGLKGHIISDGGCSCPGDVAKAFGAGADFVMLGGMLAGHSESGGELIERDGKKYKLFYGMSSEMAMKKYAGGVAEYRASEGKTVEVPFKGDVEHTIRDILGGIRSTCTYVGAAKLKELSRRTTFIRVTQQVNPIFSEAC

SEQ ID NO: 808445 - protein, 312 aa, Homo sapiens; identical to SEQ ID NO: 808444

SEQ ID NO: 808446 - protein, 358 aa, Homo sapiens
MPHIDNDVKLDFKDVLLRPKRSTLKSRSEVDLTRSFSFRNSKQTYSGVPIIAANMDTVGTFEMAKVLCKFSLFTAVHKHYSLVQWQEFAGQNPDCLEHLAASSGTGSSDFEQLEQILEAIPQVKYICLDVANGYSEHFVEFVKDVRKRFPQHTIMDAVISIALSQAGNVVTGEMVEELILSGADIIKVGIGPGSVCTTRKKTGVGYPQLSAVMECADAAHGLKGHIISDGGCSCPGDVAKAFGAGADFVMLGGMLAGHSESGGELIERDGKKYKLFYGMSSEMAMKKYAGGVAEYRASEGKTVEVPFKGDVEHTIRDILGGIRSTCTYVGAAKLKELSRRTTFIRVTQQVNPIFSEAC

SEQ ID NO: 808447 - protein, 312 aa, Homo sapiens; identical to SEQ ID NO: 808444

SEQ ID NO: 808448 - protein, 294 aa, Homo sapiens [sequence omitted]

SEQ ID NO: 808449 - protein, 194 aa, Homo sapiens [sequence omitted]

SEQ ID NO: 808450 - protein, 194 aa, Homo sapiens [sequence omitted]

SEQ ID NO: 808451 - protein, 185 aa, Homo sapiens
MVEELILSGADIIKVGIGPGSVCTTRKKTGVGYPQLSAVMECADAAHGLKGHIISDGGCSCPGDVAKAFGAGADFVMLGGMLAGHSESGGELIERDGKKYKLFYGMSSEMAMKKYAGGVAEYRASEGKTVEVPFKGDVEHTIRDILGGIRSTCTYVGAAKLKELSRRTTFIRVTQQVNPIFSEAC

SEQ ID NO: 808452 - protein, 218 aa, Homo sapiens
MVRGRCEFGRGKDVRNRFPQHTIMAAGNVVTGEMVEELILSGADIIKVGIGPGSVCTTRKKTGVGYPQLSAVMECADAAHGLKGHIISDGGCSCPGDVAKAFGAGADFVMLGGMLAGHSESGGELIERDGKKYKLFYGMSSEMAMKKYAGGVAEYRASEGKTVEVPFKGDVEHTIRDILGGIRSTCTYVGAAKLKELSRRTTFIRVTQQVNPIFSEAC

SEQ ID NO: 808453 - protein, 348 aa, Homo sapiens; identical to SEQ ID NO: 808434

SEQ ID NO: 808454 - protein, 348 aa, Homo sapiens; identical to SEQ ID NO: 808434

SEQ ID NO: 808455 - protein, 119 aa, Homo sapiens [sequence omitted]

SEQ ID NO: 808456 - protein, 101 aa, Homo sapiens
CNSSDEGIGGESIIALQLAVRSETMAPDRSYSEASLLGKASEGKTVEVPFKGDVEHTIRDILGGIRSTCTYVGAAKLKELSRRTTFIRVTQQVNPIFSEAC

SEQ ID NO: 808457 - protein, 138 aa, Homo sapiens; identical to SEQ ID NO: 808437

SEQ ID NO: 808458 - protein, 378 aa, Homo sapiens
MPHIDNDVKLDFKDVLLRPKRSTLKSRSEVDLTRSFSFRNSKQTYSGVPIIAANMDTVGTFEMAKVLCKFSLFTAVHKHYSLVQWQEFAGQNPDCLEHLAASSGTGSSDFEQLEQILEAIPQVKYICLDVANGYSEHFVEFVKDVRKRFPQHTIMAGNVVTGEMVEELILSGADIIKVGIGPGSVCTTRKKTGVGYPQLSAVMECADAAHGLKGHIISDGGCSCPGDVAKAFGAGADFVMLGGMLAGHSESGGELIERDGKKYKLFYGMSSEMAMKKYAGGVAEYRASEGKTVEVPFKGDVEHTIRDILGGIRSTCTYVGAAKLKELSRRTTFIRVTQQVNPIFSEGSCSNSVLLYLHTQNAQGTHWGGSKEANSLRK

SEQ ID NO: 808459 - protein, 348 aa, Homo sapiens; identical to SEQ ID NO: 808434

SEQ ID NO: 808460 - protein, 246 aa, Homo sapiens
MTSCLPALRFIATPRLSAMPHIDNDVKLDFKDVLLRPKRSTLKSRSEVDLTRSFSFRNSKQTYSGVPIIAANMDTVGTFEMAKVLCKFSLFTAVHKHYSLVQWQEFAGQNPDCLEHLAASSGTGSSDFEQLEQILEAIPQVKYICLDVANGYSEHFVEFVKDVRKRFPQHTIMAGNVVTGEMVEELILSGADIIKVGIGPALYYFVISCCLTPEGSCSNSVLLYLHTQNAQGTHWGGSKEANSLRK

SEQ ID NO: 808461 - protein, 179 aa, Homo sapiens
MTSCLPALRFIATPRLSAMPHIDNDVKLDFKDVLLRPKRSTLKSRSEVDLTRSFSFRNSKQTYSGVPIIAANMDTVGTFEMAKVLCKFSLFTAVHKHYSLVQWQEFAGQNPDCLEHLAASSGTGSSDFEQLEQILEAIPQVKYICLDVANGYSEHFVEFVKDVRKRFPQHTIMQGMGDP

SEQ ID NO: 808462 - protein, 299 aa, Homo sapiens
MEELEQGLLMQPWAWLQLAENSLLAKVFITKQGYALLVSDLQQVWHEQVDTSVVSQRAKELNKRLTAPPAAFLCHLDNLLRPLLKDAAHPSEATFSCDCVADALILRVRSELSGLPFYWNFHCMLASPSLVSQHLIRPLMGMSLALQCQVRELATLLHMKDLEIQDYQESGATLIRDRLKTEPFEENSFLEQFMIEKLPEACSIGDGKPFVMNLQDLYMAVTTQEVQVGQKHQGAGDPHTSNSASLQGIDSQCVNQPEQLVSSAPTLSAPEKESTGTSGPLQRPQLSKVKRKKPRGLFS

SEQ ID NO: 808463 - protein, 309 aa, Homo sapiens
PGVDGRARVKMEELEQGLLMQPWAWLQLAENSLLAKVFITKQGYALLVSDLQQVWHEQVDTSVVSQRAKELNKRLTAPPAAFLCHLDNLLRPLLKDAAHPSEATFSCDCVADALILRVRSELSGLPFYWNFHCMLASPSLVSQHLIRPLMGMSLALQCQVRELATLLHMKDLEIQDYQESGATLIRDRLKTEPFEENSFLEQFMIEKLPEACSIGDGKPFVMNLQDLYMAVTTQEVQVGQKHQGAGDPHTSNSASLQGIDSQCVNQPEQLVSSAPTLSAPEKESTGTSGPLQRPQLSKVKRKKPRGLFS

SEQ ID NO: 808464 - protein, 299 aa, Homo sapiens; identical to SEQ ID NO: 808462

SEQ ID NO: 808465 - protein, 281 aa, Homo sapiens
MEELEQGLLMQPWAWLQLAENSLLAKVFITKQGYALLVSDLQQVWHEQVDTSVVSQRAKELNKRLTAPPAAFLCHLDNLLRPLLKDAAHPSEATFSCDCVADALILRVRSELSGLPFYWNFHCMLASPSLVSQHLIRPLMGMSLALQCQVRELATLLHMKDLEIQDYQESGATLIRDRLKTEPFEVGDGKPFVMNLQDLYMAVTTQEVQVGQKHQGAGDPHTSNSASLQGIDSQCVNQPEQLVSSAPTLSAPEKESTGTSGPLQRPQLSKVKRKKPRGLFS

SEQ ID NO: 808466 - protein, 299 aa, Homo sapiens; identical to SEQ ID NO: 808462

SEQ ID NO: 808467 - protein, 69 aa, Homo sapiens
GIYHYLLLIFLISGDPHTSNSASLQGIDSQCVNQPEQLVSSAPTLSAPEKESTVSHEQLPGWCSESWHL

SEQ ID NO: 808468 - protein, 310 aa, Homo sapiens
KDERKARCPSSPLRPLGPNPRPGSRSSPLCGLDSLPATTLVGSKRKEVAGPTEEDTQEPGRRAEKTNNVTPEAEPRPPLFPTPASPGDESCGHLQFNGLRGKGEKGGEGNGSLCPRGSSPSSCRLLKTNKLNPPPSGVSGNSWDREKVVPKSGRLRTSDFRGAGARWRLWLGAATRGSSERGPPPLAPSCGFPSAGPVQAEPCVPASLGGGPGRGCPQGRLLLRPAGKGRIPPRSAGRPSASWEARAHVLRLPKGERNRAGRRAHGNQERKAGTGEPKEPDRARPRALLARLRSVTGTQAPTHGECLERS

SEQ ID NO: 808469 - protein, 310 aa, Homo sapiens; identical to SEQ ID NO: 808468

SEQ ID NO: 808470 - protein, 103 aa, Homo sapiens
KLGWYGPGLRSGRLLLRPAGKGRIPPRSAGRPSASWEARAHVLRLPKGERNRAGRRAHGNQERKAGTGEPKEPDRARPRALLARLRSVTGTQAPTHGECLERS

SEQ ID NO: 808471 - protein, 109 aa, Homo sapiens
ASRNWGSGPLTSCPLLAGMISDSFTKEDLMSAKIAFLFGMTDLGEDLFLLRIALVLEGDHLVRGAEFRVPPAAATSSGELGHPGGSVISAPLWEHPRNSRKDRGAPLCD

SEQ ID NO: 808472 - protein, 124 aa, Homo sapiens
MYGRNRDRAGPVQAEPCVPASLGGGPGRGCPQGRLLLRPAGKGRIPPRSAGRPSASWEARAHVLRLPKGERNRAGRRAHGNQERKAGTGEPKEPDRARPRALLARLRSVTGTQAPTHGECLERS

SEQ ID NO: 808473 - protein, 140 aa, Homo sapiens
ESHFRNKRRVSEEKLLVRIPRVIMATYSLANERLRALEDIEREIGAILQNAGTVILELSKEKTNERLLDRQAAAFTASVQHVEAELSAQIRYLTQVATGQPHEGSSYSSRKDCQMALKRVDYARLKLSDVARTCEQMLEN

SEQ ID NO: 808474 - protein, 140 aa, Homo sapiens; identical to SEQ ID NO: 808473

SEQ ID NO: 808475 - protein, 72 aa, Homo sapiens
ESHFRNKRRVSEEKLLVRIPRVIMATYSLANERLRALEDIEREIGAILQNAGSGCDNLDSGERKRDRAALAA

SEQ ID NO: 808476 - protein, 108 aa, Homo sapiens
ESHFRNKRRVSEEKLLVRIPRVIMATYSLANERLRALEDIEREIGAILQNAGTVILELSKEKTNERLLDRQAAAFTASVQHVEAELSAQIRYLTQLPDGLTNSNSGKK

SEQ ID NO: 808477 - protein, 140 aa, Homo sapiens; identical to SEQ ID NO: 808473

SEQ ID NO: 808478 - protein, 116 aa, Homo sapiens
ESHFRNKRRVSEEKLLVRIPRVIMATYSLANERLRALEDIEREIGAILQNAGTVILELSKEKTNERLLDRQAAAFTASVQHVEAELSAQIRYLTQVGVSGGFCERTPALGQSLRLG

SEQ ID NO: 808479 - protein, 140 aa, Homo sapiens; identical to SEQ ID NO: 808473

SEQ ID NO: 808480 - protein, 610 aa, Homo sapiens
MRRVCRGRVRPWMNSHPSGFSFRDNMAPSTPLLTVRGSEGLYMVNGPPHFTESTVFPRESGKNCKVCIFSKDGTLFAWGNGEKVNIISVTNKGLLHSFDLLKAVCLEFSPKNTVLATWQPYTTSKDGTAGIPNLQLYDVKTGTCLKSFIQKKMQNWCPSWSEDETLCARNVNNEVHFFENNNFNTIANKLHLQKINDFVLSPGPQPYKVAVYVPGSKGAPSFVRLYQYPNFAGPHAALANKSFFKADKVTMLWNKKATAVLVIASTDVDKTGASYYGEQTLHYIATNGESAVVQLPKNGPIYDVVWNSSSTEFCAVYGFMPAKATIFNLKCDPVFDFGTGPRNAAYYSPHGHILVLAGFGNLRGQMEVWDVKNYKLISKPVASDSTYFAWCPDGEHILTATCAPRLRVNNGYKIWHYTGSILHKYDVPSNAELWQVSWQPFLDGIFPAKTITYQAVPSEVPNEEPKVATAYRPPALRNKPITNSKLHEEEPPQNMKPQSGNDKPLSKTALKNQRKHEAKKAAKQEARSDKSPDLAPTPAPQSTPRNTVSQSISGDPEIDKKIKNLKKKLKAIEQLKEQAATGKQLEKNQLEKIQKETALLQELEDLELGI

SEQ ID NO: 808481 - protein, 190 aa, Homo sapiens
MRRVCRGRVRPWMNSHPSGFSFRDNMAPSTPLLTVRGSEGLYMVNGPPHFTESTVFPRESGKNCKVCIFSKDGTLFAWGNGEKVNIISVTNKGLLHSFDLLKAVCLEFSPKNTVLATWQPYTTSKDGTAGIPNLQLYDVKTGTCLKSFIQKKMQNWCPSWSEDETLCARNVNNEVHFFENNNFSMERFMT

SEQ ID NO: 808482 - protein, 190 aa, Homo sapiens; identical to SEQ ID NO: 808481

SEQ ID NO: 808483 - protein, 572 aa, Homo sapiens
MRRVCRGRVRPWMNSHPSGFSFRDNMAPSTPLLTVRGSEGLYMVNGPPHFTESTVFPRESGKNCKVCIFSKDGTLFAWGNGEKVNIISVTNKGLLHSFDLLKAVCLEFSPKNTVLATWQPYTTSKDGTAGIPNLQLYDVKTGTCLKSFIQKKMQNWCPSWSEDETLCARNVNNEVHFFENNNFNTIANKLHLQKINDFVLSPGPQPYKVAVYVPGSKGAPSFVRLYQYPNFAGPHAALANKSFFKADKVTMLWNKKATAVLVIASTDVDKTGASYYGEQTLHYIATNGESAVVQLPKNGPIYDVVWNSSSTEFCAVYGFMPAKATIFNLKCDPVFDFGTGPRNAAYYSPHGHILVLAGFGNLRGQMEVWDVKNYKLISKPVASDSTYFAWCPDGEHILTATCAPRLRVNNGYKIWHYTGSILHKYDVPSNAELWQVSWQPFLDGIFPAKTITYQAVPSEVPNEEPKVATAYRPPALRNKPITNSKLEARSDKSPDLAPTPAPQSTPRNTVSQSISGDPEIDKKIKNLKKKLKAIEQLKEQAATGKQLEKNQLEKIQKETALLQELEDLELGI

SEQ ID NO: 808484 - protein, 585 aa, Homo sapiens
MAPSTPLLTVRGSEGLYMVNGPPHFTESTVFPRESGKNCKVCIFSKDGTLFAWGNGEKVNIISVTNKGLLHSFDLLKAVCLEFSPKNTVLATWQPYTTSKDGTAGIPNLQLYDVKTGTCLKSFIQKKMQNWCPSWSEDETLCARNVNNEVHFFENNNFNTIANKLHLQKINDFVLSPGPQPYKVAVYVPGSKGAPSFVRLYQYPNFAGPHAALANKSFFKADKVTMLWNKKATAVLVIASTDVDKTGASYYGEQTLHYIATNGESAVVQLPKNGPIYDVVWNSSSTEFCAVYGFMPAKATIFNLKCDPVFDFGTGPRNAAYYSPHGHILVLAGFGNLRGQMEVWDVKNYKLISKPVASDSTYFAWCPDGEHILTATCAPRLRVNNGYKIWHYTGSILHKYDVPSNAELWQVSWQPFLDGIFPAKTITYQAVPSEVPNEEPKVATAYRPPALRNKPITNSKLHEEEPPQNMKPQSGNDKPLSKTALKNQRKHEAKKAAKQEARSDKSPDLAPTPAPQSTPRNTVSQSISGDPEIDKKIKNLKKKLKAIEQLKEQAATGKQLEKNQLEKIQKETALLQELEDLELGI

SEQ ID NO: 808485 - protein, 599 aa, Homo sapiens
GALTNVSDWQNLDDMAPSTPLLTVRGSEGLYMVNGPPHFTESTVFPRESGKNCKVCIFSKDGTLFAWGNGEKVNIISVTNKGLLHSFDLLKAVCLEFSPKNTVLATWQPYTTSKDGTAGIPNLQLYDVKTGTCLKSFIQKKMQNWCPSWSEDETLCARNVNNEVHFFENNNFNTIANKLHLQKINDFVLSPGPQPYKVAVYVPGSKGAPSFVRLYQYPNFAGPHAALANKSFFKADKVTMLWNKKATAVLVIASTDVDKTGASYYGEQTLHYIATNGESAVVQLPKNGPIYDVVWNSSSTEFCAVYGFMPAKATIFNLKCDPVFDFGTGPRNAAYYSPHGHILVLAGFGNLRGQMEVWDVKNYKLISKPVASDSTYFAWCPDGEHILTATCAPRLRVNNGYKIWHYTGSILHKYDVPSNAELWQVSWQPFLDGIFPAKTITYQAVPSEVPNEEPKVATAYRPPALRNKPITNSKLHEEEPPQNMKPQSGNDKPLSKTALKNQRKHEAKKAAKQEARSDKSPDLAPTPAPQSTPRNTVSQSISGDPEIDKKIKNLKKKLKAIEQLKEQAATGKQLEKNQLEKIQKETALLQELEDLELGI

SEQ ID NO: 808486 - protein, 588 aa, Homo sapiens
FLFPGHLCVSLTVRGSEGLYMVNGPPHFTESTVFPRESGKNCKVCIFSKDGTLFAWGNGEKVNIISVTNKGLLHSFDLLKAVCLEFSPKNTVLATWQPYTTSKDGTAGIPNLQLYDVKTGTCLKSFIQKKMQNWCPSWSEDETLCARNVNNEVHFFENNNFNTIANKLHLQKINDFVLSPGPQPYKVAVYVPGSKGAPSFVRLYQYPNFAGPHAALANKSFFKADKVTMLWNKKATAVLVIASTDVDKTGASYYGEQTLHYIATNGESAVVQLPKNGPIYDVVWNSSSTEFCAVYGFMPAKATIFNLKCDPVFDFGTGPRNAAYYSPHGHILVLAGFGNLRGQMEVWDVKNYKLISKPVASDSTYFAWCPDGEHILTATCAPRLRVNNGYKIWHYTGSILHKYDVPSNAELWQVSWQPFLDGIFPAKTITYQAVPSEVPNEEPKVATAYRPPALRNKPITNSKLHEEEPPQNMKPQSGNDKPLSKTALKNQRKHEAKKAAKQEARSDKSPDLAPTPAPQSTPRNTVSQSISGDPEIDKKIKNLKKKLKAIEQLKEQAATGKQLEKNQLEKIQKETALLQELEDLELGI

SEQ ID NO: 808487 - protein, 585 aa, Homo sapiens
GTRRRGRRVVRGSEGLYMVNGPPHFTESTVFPRESGKNCKVCIFSKDGTLFAWGNGEKVNIISVTNKGLLHSFDLLKAVCLEFSPKNTVLATWQPYTTSKDGTAGIPNLQLYDVKTGTCLKSFIQKKMQNWCPSWSEDETLCARNVNNEVHFFENNNFNTIANKLHLQKINDFVLSPGPQPYKVAVYVPGSKGAPSFVRLYQYPNFAGPHAALANKSFFKADKVTMLWNKKATAVLVIASTDVDKTGASYYGEQTLHYIATNGESAVVQLPKNGPIYDVVWNSSSTEFCAVYGFMPAKATIFNLKCDPVFDFGTGPRNAAYYSPHGHILVLAGFGNLRGQMEVWDVKNYKLISKPVASDSTYFAWCPDGEHILTATCAPRLRVNNGYKIWHYTGSILHKYDVPSNAELWQVSWQPFLDGIFPAKTITYQAVPSEVPNEEPKVATAYRPPALRNKPITNSKLHEEEPPQNMKPQSGNDKPLSKTALKNQRKHEAKKAAKQEARSDKSPDLAPTPAPQSTPRNTVSQSISGDPEIDKKIKNLKKKLKAIEQLKEQAATGKQLEKNQLEKIQKETALLQELEDLELGI

SEQ ID NO: 808488 - protein, 610 aa, Homo sapiens; identical to SEQ ID NO: 808480

SEQ ID NO: 808489 - protein, 610 aa, Homo sapiens; identical to SEQ ID NO: 808480

SEQ ID NO: 808490 - protein, 567 aa, Homo sapiens
MRRVCRGRVRPWMNSHPSGFSFRDNMAPSTPLLTVRGSEGLYMVNGPPHFTESTVFPRESGKNCKVCIFSKDGTLFAWGNGEKVNIISVTNKGLLHSFDLLKAVCLEFSPKNTVLATWQPYTTSKDGTAGIPNLQLYDVKTGTCLKSFIQKKMQNWCPSWSEDETLCARNVNNEVHFFENNNFNTIANKLHLQKINDFVLSPGPQPYKVAVYVPGSKGAPSFVRLYQYPNFAGPHAALANKSFFKADKVTMLWNKKATAVLVIASTDVDKTGASYYGEQTLHYIATNGESAVVQLPKNGPIYDVVWNSSSTEFCAVYGFMPAKATIFNLKCDPVFDFGTGPRNAAYYSPHGHILVLAGFGNLRGQMEVWDVKNYKLISKPVASDSTYFAWCPDGEHILTATCAPRLRVNNGYKIWHYTGSILHKYDVPSNAELWQVSWQPFLDGIFPAKTITYQAVPSEVPNEEPKVATAYRPPALRNKPITNSKLHEEEPPQNMKPQSGNDKPLSKTALKNQRKHEAKKAAKQKLKAIEQLKEQAATGKQLEKNQLEKIQKETALLQELEDLELGI

SEQ ID NO: 808491 - protein, 600 aa, Homo sapiens
FLFPGHLCVSLTVRGSEGLYMVNGPPHFTESTVFPRESGKNCKVCIFSKDGTLFAWGNGEKVNIISVTNKGLLHSFDLLKAVCLEFSPKNTVLATWQPYTTSKDGTAGIPNLQLYDVKTGTCLKSFIQKKMQNWCPSWSEDETLCARNVNNEVHFFENNNFIGSRVSASGSFLDTIANKLHLQKINDFVLSPGPQPYKVAVYVPGSKGAPSFVRLYQYPNFAGPHAALANKSFFKADKVTMLWNKKATAVLVIASTDVDKTGASYYGEQTLHYIATNGESAVVQLPKNGPIYDVVWNSSSTEFCAVYGFMPAKATIFNLKCDPVFDFGTGPRNAAYYSPHGHILVLAGFGNLRGQMEVWDVKNYKLISKPVASDSTYFAWCPDGEHILTATCAPRLRVNNGYKIWHYTGSILHKYDVPSNAELWQVSWQPFLDGIFPAKTITYQAVPSEVPNEEPKVATAYRPPALRNKPITNSKLHEEEPPQNMKPQSGNDKPLSKTALKNQRKHEAKKAAKQEARSDKSPDLAPTPAPQSTPRNTVSQSISGDPEIDKKIKNLKKKLKAIEQLKEQAATGKQLEKNQLEKIQKETALLQELEDLELGI

SEQ ID NO: 808492 - protein, 570 aa, Homo sapiens
GALTNVSDWQNLDDMAPSTPLLTVRGSEGLYMVNGPPHFTESTVFPRESGKNCKVCIFSKDGTLFAWGNGEKVNIISVTNKGLLHSFDLLKAVCLEFSPKNTVLATWQPYTTSKDGTAGIPNLQLYDVKTGTCLKSFIQKKMQNWCPSWSEDETLCARNVNNEVHFFENNNFNTIANKLHLQKINDFVLSPGPQPYKVAVYVPGSKDKVTMLWNKKATAVLVIASTDVDKTGASYYGEQTLHYIATNGESAVVQLPKNGPIYDVVWNSSSTEFCAVYGFMPAKATIFNLKCDPVFDFGTGPRNAAYYSPHGHILVLAGFGNLRGQMEVWDVKNYKLISKPVASDSTYFAWCPDGEHILTATCAPRLRVNNGYKIWHYTGSILHKYDVPSNAELWQVSWQPFLDGIFPAKTITYQAVPSEVPNEEPKVATAYRPPALRNKPITNSKLHEEEPPQNMKPQSGNDKPLSKTALKNQRKHEAKKAAKQEARSDKSPDLAPTPAPQSTPRNTVSQSISGDPEIDKKIKNLKKKLKAIEQLKEQAATGKQLEKNQLEKIQKETALLQELEDLELGI

SEQ ID NO: 808493 - protein, 291 aa, Homo sapiens [sequence omitted]

SEQ ID NO: 808494 - protein, 160 aa, Homo sapiens
IELGTCQSVVPNEEPKVATAYRPPALRNKPITNSKLHEEEPPQNMKPQSGNDKPLSKTALKNQRKHEAKKAAKQEARSDKSPDLAPTPAPQSTPRNTVSQSISGDPEIDKKIKNLKKKLKAIEQLKEQAATGKQLEKNQLEKIQKETALLQELEDLELGI

SEQ ID NO: 808495 - protein, 624 aa, Homo sapiens
MRRVCRGRVRPWMNSHPSGFSFRDNMAPSTPLLTVRGSEGLYMVNGPPHFTESTVFPRESGKNCKVCIFSKDGTLFAWGNGEKVNIISVTNKGLLHSFDLLKAVCLEFSPKNTVLATWQPYTTSKDGTAGIPNLQLYDVKTGTCLKSFIQKKMQNWCPSWSEDETLCARNVNNEVHFFENNNFNTIANKLHLQKINDFVLSPGPQPYKVAVYVPGSKGAPSFVRLYQYPNFAGPHAALANKSFFKADKVTMLWNKKATAVLVIASTDVDKTGASYYGEQTLHYIATNGESAVVQLPKNGPIYDVVWNSSSTEFCAVYGFMPAKATIFNLKCDPVFDFGTGPRNAAYYSPHGHILVLAGFGNLRGQMEVWDVKNYKLISKPVASDSTYFAWCPDGEHILTATCAPRLRVNNGYKIWHYTGSILHKYDVPSNAELWQVSWQPFLDGIFPAKTITYQAVPSEVPNEEPKVATAYRPPALRNKPITNSKLHEEEPPQNMKPQSGNDKPLSKTALKNQRKHEAKKAAKQEARSDKSPDLAPTPAPQSTPRNTVSQSISGDPEIDKNQNQEEMEASNMKTAHGTVENRGESKKLSGGIDGLQSGECVRIWLLYLVDSGLGYLLSVQGVGE

SEQ ID NO: 808496 - protein, 567 aa, Homo sapiens; identical to SEQ ID NO: 808490

SEQ ID NO: 808497 - protein, 436 aa, Homo sapiens
MRRVCRGRVRPWMNSHPSGFSFRDNMAPSTPLLTVRGSEGLYMVNGPPHFTESTVFPRESGKNCKVCIFSKDGTLFAWGNGEKVNIISVTNKGLLHSFDLLKAVCLEFSPKNTVLATWQPYTTSKDGTAGIPNLQLYDVKTGTCLKSFIQKKMQNWCPSWSEDETLCARNVNNEVHFFENNNFNTIANKLHLQKINDFVLSPGPQPYKVAVYVPGSKGAPSFVRLYQYPNFAGPHAALANKSFFKADKVTMLWNKKATAVLVIASTDVDKTGASYYGEQTLHYIATNGESAVVQLPKNGPIYDVVWNSSSTEFCAVYGFMPAKATIFNLKCDPVFDFGTGPRNAAYYSPHGHILVLAGFGNLRGQMEVWDVKNYKLISKPVASDSTYFAWCPDGEHILTALHVLPGYGLIMNNWHIALSAQYGCPSIRLWQFGTIG

SEQ ID NO: 808498 - protein, 190 aa, Homo sapiens; identical to SEQ ID NO: 808481

SEQ ID NO: 808499 - protein, 190 aa, Homo sapiens; identical to SEQ ID NO: 808481

SEQ ID NO: 808500 - protein, 245 aa, Homo sapiens
MAPSTPLLTVRGSEGLYMVNGPPHFTESTVFPRESGKNCKVCIFSKDGTLFAWGNGEKVNIISVTNKGLLHSFDLLKAVCLEFSPKNTVLATWQPYTTSKDGTAGIPNLQLYDVKTGTCLKSFIQKKMQNWCPSWSEDETLCARNVNNEVHFFENNNFNTIANKLHLQKINDFVLSPGPQPYKVAVYVPGSKGAPSFVRLYQYPNFAGPHAALANKSFFKADKVTMLWNKKVWRQTLTHWNNGEG

SEQ ID NO: 808501 - protein, 237 aa, Homo sapiens
MALPPSPLAMEYVNDFDLMKFEVKREPSEGRPGPPTASLGSTPYSSVPPSPTFSEPGMVGATEGTRPGLEELYWLATLQQQLGAGEALGLSPEEAMELLQGQGPVPVDGPHGYYPGSPEETGAQHVQLAERFSDAALVSMSVRELNRQLRGCGRDEALRLKQRRRTLKNRGYAQACRSKRLQQRRGLEAERARLAAQLDALRAEVARLARERDLYKARCDRLTSSGPGSGDPSHLFL

SEQ ID NO: 808502 - protein, 237 aa, Homo sapiens; identical to SEQ ID NO: 808501

SEQ ID NO: 808503 - protein, 235 aa, Homo sapiens
NRTSLGAPGLDGGRSQLYGVSPCWPSWSPTPDLVIRLPWPPKVLEFTGVSHHARLVILSLHNPMRKLICPPNYHHKVLRWFLKLYLHWDISLQPETTGYHPQCYIAPQTQHIYDGCLLSIHSPFLLAERFSDAALVSMSVRELNRQLRGCGRDEALRLKQRRRTLKNRGYAQACRSKRLQQRRGLEAERARLAAQLDALRAEVARLARERDLYKARCDRLTSSGPGSGDPSHLFL

SEQ ID NO: 808504 - protein, 193 aa, Homo sapiens
EGWGLSGCGSTGHTRAWSWMPGIPETSPGFRCATGSPDRGRPCTVGRPPDWSNGQLGGPGSVGAWGGLWTETDCVEGRAFLVKLAERFSDAALVSMSVRELNRQLRGCGRDEALRLKQRRRTLKNRGYAQACRSKRLQQRRGLEAERARLAAQLDALRAEVARLARERDLYKARCDRLTSSGPGSGDPSHLFL

SEQ ID NO: 808505 - protein, 208 aa, Homo sapiens
RRGCVRHEGEEAEKHLPLKPAVTAPRETTHQPGAVAGPAAARGLVYTDCRHCVGQPLLRHALRSSRISRLPGRRAANVTRRPRPLGQPTGQRSTMIDELAERFSDAALVSMSVRELNRQLRGCGRDEALRLKQRRRTLKNRGYAQACRSKRLQQRRGLEAERARLAAQLDALRAEVARLARERDLYKARCDRLTSSGPGSGDPSHLFL

SEQ ID NO: 808506 - protein, 75 aa, Homo sapiens
NRTSLGAPGLDGGRSQLYGVSPCWPSWSPTPDLVIRLPWPPKVLEFTGVSHHARPGHSFSPQSNEETHLPTQLPS

SEQ ID NO: 808507 - protein, 1393 aa, Homo sapiens
QYNLANAIEAADAYTVFAPNNNAIENYIREKKVLSLEEDVLRYHVVLEEKLLKNDLHNGMHRETMLGFSYFLSFFLHNDQLYVNEAPINYTNVATDKGVIHGLGKVLEIQKNRCDNNDTTIIRGRCRTCSSELTCPFGTKSLGNEKRRCIYTSYFMGRRTLFIGCQPKCVRTVITRECCAGFFGPQCQPCPGNAQNVCFGNGICLDGVNGTGVCECGEGFSGTACETCTEGKYGIHCDQACSCVHGRCNQGPLGDGSCDCDVGWRGVHCDNATTEDNCNGTCHTSANCLTNSDGTASCKCAAGFQGNGTICTAINACEISNGGCSAKADCKRTTPGRRVCTCKAGYTGDGIVCLEINPCLENHGGCDKNAECTQTGPNQAACNCLPAYTGDGKVCTLINVCLTKNGGCSEFAICNHTGQVERTCTCKPNYIGDGFTCRGSIYQELPKNPKTSQYFFQLQEHFVKDLVGPGPFTVFAPLSAAFDEEARVKDWDKYGLMPQVLRYHVVACHQLLLENLKLISNATSLQGEPIVISVSQSTVYINNKAKIISSDIISTNGIVHIIDKLLSPKNLLITPKDNSGRILQNLTTLATNNGYIKFSNLIQDSGLLSVITDPIHTPVTLFWPTDQALHALPAEQQDFLFNQDNKDKLKEYLKFHVIRDAKVLAVDLPTSTAWKTLQGSELSVKCGAGRDIGDLFLNGQTCRIVQRELLFDLGVAYGIDCLLIDPTLGGRCDTFTTFDASGECGSCVNTPSCPRWSKPKGVKQKCLYNLPFKRNLEGCRERCSLVIQIPRCCKGYFGRDCQACPGGPDAPCNNRGVCLDQYSATGECKCNTGFNGTACEMCWPGRFGPDCLPCGCSDHGQCDDGITGSGQCLCETGWTGPSCDTQAVLPAVCTPPCSAHATCKENNTCECNLDYEGDGITCTVVDFCKQDNGGCAKVARCSQKGTKVSCSCQKGYKGDGHSCTEIDPCADGLNGGCHEHATCKMTGPGKHKCECKSHYVGDGLNCEPEQLPIDRCLQDNGQCHADAKCVDLHFQDTTVGVFHLRSPLGQYKLTFDKAREACANEAATMATYNQLSYAQKAKYHLCSAGWLETGRVAYPTAFASQNCGSGVVGIVDYGPRPNKSEMWDVFCYRMKDVNCTCKVGYVGDGFSCSGNLLQVLMSFPSLTNFLTEVLAYSNSSARGRAFLEHLTDLSIRGTLFVPQNSGLGENETLSGRDIEHHLANVSMFFYNDLVNGTTLQTRLGSKLLITASQDPLQPTETRFVDGRAILQWDIFASNGIIHVISRPLKAPPAPVTLTHTGLGAGIFFAIILVTGAVALAAYSYFRINRRTIGFQHFESEEDINVAALGKQQPENISNPLYESTTSAPPEPSYDPFTDSEERQLEGNDPLRTL

SEQ ID NO: 808508 - protein, 1115 aa, Homo sapiens
MGHAITSANCLTNSDGTASCKCAAGFQGNGTICTAINACEISNGGCSAKADCKRTTPGRRVCTCKAGYTGDGIVCLEINPCLENHGGCDKNAECTQTGPNQAACNCLPAYTGDGKVCTLINVCLTKNGGCSEFAICNHTGQVERTCTCKPNYIGDGFTCRGSIYQELPKNPKTSQYFFQLQEHFVKDLVGPGPFTVFAPLSAAFDEEARVKDWDKYGLMPQVLRYHVVACHQLLLENLKLISNATSLQGEPIVISVSQSTVYINNKAKIISSDIISTNGIVHIIDKLLSPKNLLITPKDNSGRILQNLTTLATNNGYIKFSNLIQDSGLLSVITDPIHTPVTLFWPTDQALHALPAEQQDFLFNQDNKDKLKEYLKFHVIRDAKVLAVDLPTSTAWKTLQGSELSVKCGAGRDIGDLFLNGQTCRIVQRELLFDLGVAYGIDCLLIDPTLGGRCDTFTTFDASGECGSCVNTPSCPRWSKPKGVKQKCLYNLPFKRNLEGCRERCSLVIQIPRCCKGYFGRDCQACPGGPDAPCNNRGVCLDQYSATGECKCNTGFNGTACEMCWPGRFGPDCLPCGCSDHGQCDDGITGSGQCLCETGWTGPSCDTQAVLPAVCTPPCSAHATCKENNTCECNLDYEGDGITCTVVDFCKQDNGGCAKVARCSQKGTKVSCSCQKGYKGDGHSCTEIDPCADGLNGGCHEHATCKMTGPGKHKCECKSHYVGDGLNCEPEQLPIDRCLQDNGQCHADAKCVDLHFQDTTVGVFHLRSPLGQYKLTFDKAREACANEAATMATYNQLSYAQKAKYHLCSAGWLETGRVAYPTAFASQNCGSGVVGIVDYGPRPNKSEMWDVFCYRMKDVNCTCKVGYVGDGFSCSGNLLQVLMSFPSLTNFLTEVLAYSNSSARGRAFLEHLTDLSIRGTLFVPQNSGLGENETLSGRDIEHHLANVSMFFYNDLVNGTTLQTRLGSKLLITASQDPLQPTETRFVDGRAILQWDIFASNGIIHVISRPLKAPPAPVTLTHTGLGAGIFFAIILVTGAVALAAYSYFRINRRTIGFQHFESEEDINVAALGKQQPENISNPLYESTTSAPPEPSYDPFTDSEERQLEGNDPLRTL

SEQ ID NO: 808509 - protein, 385 aa, Homo sapiens
MALSVSLQAKYHLCSAGWLETGRVAYPTAFASQNCGSGVVGIVDYGPRPNKSEMWDVFCYRMKDVNCTCKVGYVGDGFSCSGNLLQVLMSFPSLTNFLTDSLRKGKVLKLSHGAGRRHSKEQQAELAHTMNIHRWVMPWDLLQPPRSLHTRAGPSDDFLSSPQEVLAYSNSSARGRAFLEHLTDLSIRGTLFVPQNSGLGENETLSGRDIEHHLANVSMFFYNDLVNGTTLQTRLGSKLLITASQDPLQPTETRFVDGRAILQWDIFASNGIIHVISRPLKAPPAPVTLTHTGLGAGIFFAIILVTGAVALAAYSYFRINRRTIGFQHFESEEDINVAALGKQQPENISNPLYESTTSAPPEPSYDPFTDSEERQLEGNDPLRTL

SEQ ID NO: 808510 - protein, 1475 aa, Homo sapiens
QYNLANAIEAADAYTVFAPNNNAIENYIREKKVLSLEEDVLRYHVVLEEKLLKNDLHNGMHRETMLGFSYFLSFFLHNDQLYVNEAPINYTNVATDKGVIHGLGKVLEIQKNRCDNNDTTIIRGRCRTCSSELTCPFGTKSLGNEKRRCIYTSYFMGRRTLFIGCQPKCVRTVITRECCAGFFGPQCQPCPGNAQNVCFGNGICLDGVNGTGVCECGEGFSGTACETCTEGKYGIHCDQACSCVHGRCNQGPLGDGSCDCDVGWRGVHCDNATTEDNCNGTCHTSANCLTNSDGTASCKCAAGFQGNGTICTAINACEISNGGCSAKADCKRTTPGRRVCTCKAGYTGDGIVCLEINPCLENHGGCDKNAECTQTGPNQAACNCLPAYTGDGKVCTLINVCLTKNGGCSEFAICNHTGQVERTCTCKPNYIGDGFTCRGSIYQELPKNPKTSQYFFQLQEHFVKDLVGPGPFTVFAPLSAAFDEEARVKDWDKYGLMPQVLRYHVVACHQLLLENLKLISNATSLQGEPIVISVSQSTVYINNKAKIISSDIISTNGIVHIIDKLLSPKNLLITPKDNSGRILQNLTTLATNNGYIKFSNLIQDSGLLSVITDPIHTPVTLFWPTDQALHALPAEQQDFLFNQDNKDKLKEYLKFHVIRDAKVLAVDLPTSTAWKTLQGSELSVKCGAGRDIGDLFLNGQTCRIVQRELLFDLGVAYGIDCLLIDPTLGGRCDTFTTFDASGECGSCVNTPSCPRWSKPKGVKQKCLYNLPFKRNLEGCRERCSLVIQIPRCCKGYFGRDCQACPGGPDAPCNNRGVCLDQYSATGECKCNTGFNGTACEMCWPGRFGPDCLPCGCSDHGQCDDGITGSGQCLCETGWTGPSCDTQAVLPAVCTPPCSAHATCKENNTCECNLDYEGDGITCTVVDFCKQDNGGCAKVARCSQKGTKVSCSCQKGYKGDGHSCTEIDPCADGLNGGCHEHATCKMTGPGKHKCECKSHYVGDGLNCEPEQLPIDRCLQDNGQCHADAKCVDLHFQDTTVGVFHLRSPLGQYKLTFDKAREACANEAATMATYNQLSYAQKAKYHLCSAGWLETGRVAYPTAFASQNCGSGVVGIVDYGPRPNKSEMWDVFCYRMKDVNCTCKVGYVGDGFSCSGNLLQVLMSFPSLTNFLTEVLAYSNSSARGRAFLEHLTDLSIRGTLFVPQNSGLGENETLSGRDIEHHLANVSMFFYNDLVNGTTLQTRLGSKLLITASQDPLQPTETRFVDGRAILQWDIFASNGIIHVISRPLKAPPAPVTLTHTGLGAGIFFAIILVTGAVALAAYSYFRINRRTIGFQHFESEEDINVAALGKQQPENISNPLYESTTSAPPEPSYDPFTMKKLQPSWDDLSWATQLQAGETKTGGPTPSPSCLPTQGSSTNKHAQHIRVHSAQGESCLRPVATRKIQLGLNTQNALPPYNPLFSRTLKNGSLRAMTP

SEQ ID NO: 808511 - protein, 105 aa, Homo sapiens
ESSLNKVLLKKEKLPEAKGGLLYLPTWLRRSCFGDAPGFHACLSKQSEEDINVAALGKQQPENISNPLYESTTSAPPEPSYDPFTVSLHSYLGIGSLGVQGNDVF

SEQ ID NO: 808512 - protein, 1357 aa, Homo sapiens
QYNLANAIEAADAYTVFAPNNNAIENYIREKKVLSLEEDVLRYHVVLEEKLLKNDLHNGMHRETMLGFSYFLSFFLHNDQLYVNEAPINYTNVATDKGVIHGLGKVLEIQKNRCDNNDTTIIRGRCRTCSSELTCPFGTKSLGNEKRRCIYTSYFMGRRTLFIGCQPKCVRTVITRECCAGFFGPQCQPCPGNAQNVCFGNGICLDGVNGTGVCECGEGFSGTACETCTEGKYGIHCDQACSCVHGRCNQGPLGDGSCDCDVGWRGVHCDNATTEDNCNGTCHTSANCLTNSDGTASCKCAAGFQGNGTICTAINACEISNGGCSAKADCKRTTPGRRVCTCKAGYTGDGIVCLEINPCLENHGGCDKNAECTQTGPNQAACNCLPAYTGDGKVCTLINVCLTKNGGCSEFAICNHTGQVERTCTCKPNYIGDGFTCRGSIYQELPKNPKTSQYFFQLQEHFVKDLVGPGPFTVFAPLSAAFDEEARVKDWDKYGLMPQVLRYHVVACHQLLLENLKLISNATSLQGEPIVISVSQSTVYINNKAKIISSDIISTNGIVHIIDKLLSPKNLLITPKDNSGRILQNLTTLATNNGYIKFSNLIQDSGLLSVITDPIHTPVTLFWPTDQALHALPAEQQDFLFNQDNKDKLKEYLKFHVIRDAKVLAVDLPTSTAWKTLQGSELSVKCGAGRDIGDLFLNGQTCRIVQRELLFDLGVAYGIDCLLIDPTLGGRCDTFTTFDASGECGSCVNTPSCPRWSKPKGVKQKCLYNLPFKRNLEGCRERCSLVIQIPRCCKGYFGRDCQACPGGPDAPCNNRGVCLDQYSATGECKCNTGFNGTACEMCWPGRFGPDCLPCGCSDHGQCDDGITGSGQCLCETGWTGPSCDTQAVLPAVCTPPCSAHATCKENNTCECNLDYEGDGITCTVVDFCKQDNGGCAKVARCSQKGTKVSCSCQKGYKGDGHSCTEIDPCADGLNGGCHEHATCKMTGPGKHKCECKSHYVGDGLNCEPEQLPIDRCLQDNGQCHADAKCVDLHFQDTTVGVFHLRSPLGQYKLTFDKAREACANEAATMATYNQLSYAQKAKYHLCSAGWLETGRVAYPTAFASQNCGSGVVGIVDYGPRPNKSEMWDVFCYRMKGSAGLFQQLSSRPCISRTPDDLSIRGTLFVPQNSGLGENETLSGRDIEHHLANVSMFFYNDLVNGTTLQTRLGSKLLITASQDPLQPTETRFVDGRAILQWDIFASNGIIHVISRPLKAPPAPVTLTHTGLGAGIFFAIILVTGAVALAAYSYFRINRRTIGFQHFESEEDINVAALGKQQPENISNPLYESTTSAPPEPSYDPFTDSEERQLEGNDPLRTL

SEQ ID NO: 808513 - protein, 525 aa, Homo sapiens
MGFNSSHHGYRMKVAPFFAVLPAVCTPPCSAHATCKENNTCECNLDYEGDGITCTVVDFCKQDNGGCAKVARCSQKGTKVSCSCQKGYKGDGHSCTEIDPCADGLNGGCHEHATCKMTGPGKHKCECKSHYVGDGLNCEPEQLPIDRCLQDNGQCHADAKCVDLHFQDTTVGVFHLRSPLGQYKLTFDKAREACANEAATMATYNQLSYAQKAKYHLCSAGWLETGRVAYPTAFASQNCGSGVVGIVDYGPRPNKSEMWDVFCYRMKDVNCTCKVGYVGDGFSCSGNLLQVLMSFPSLTNFLTEVLAYSNSSARGRAFLEHLTDLSIRGTLFVPQNSGLGENETLSGRDIEHHLANVSMFFYNDLVNGTTLQTRLGSKLLITASQDPLQPTETRFVDGRAILQWDIFASNGIIHVISRPLKAPPAPVTLTHTGLGAGIFFAIILVTGAVALAAYSYFRINRRTIGFQHFESEEDINVAALGKQQPENISNPLYESTTSAPPEPSYDPFTDSEERQLEGNDPLRTL

SEQ ID NO: 808514 - protein, 251 aa, Homo sapiens
QYNLANAIEAADAYTVFAPNNNAIENYIREKKVLSLEEDVLRYHVVLEEKLLKNDLHNGMHRETMLGFSYFLSFFLHNDQLYVNEAPINYTNVATDKGVIHGLGKVLEIQKNRCDNNDTTIIRGRCRTCSSELTCPFGTKSLGNEKRRCIYTSYFMGRRTLFIGCQPKCVRTVITRECCAGFFGPQCQPCPGNAQNVCFGNGICLDGVNGTGVCECGEGFSGTACETCTEGKYGIHCDQGEHRPLHRGSWA

SEQ ID NO: 808515 - protein, 265 aa, Homo sapiens
MHFYRLFLGATRRFLNPEWKGEIDNWCVYVLTSLLPFKIQSQDIKALQKELEQFAKLLKQKRITLGYTQADVGLTLGVLFGKVFSQTTICRFEALQLSFKNMCKLRPLLQKWVEEADNNENLQEICKAETLVQARKRKRTSIENRVRGNLENLFLQCPKPTLQQISHIAQQLGLEKDVVRVWFCNRRQKGKRSSSDYAQREDFEAAGSPFSGGPVSFPLAPGPHFGTPGYGSPHFTALYSSVPFPEGEAFPPVSVTTLGSPMHSN

SEQ ID NO: 808516 - protein, 149 aa, Homo sapiens
VTPFPPAQICKAETLVQARKRKRTSIENRVRGNLENLFLQCPKPTLQQISHIAQQLGLEKDVVRVWFCNRRQKGKRSSSDYAQREDFEAAGSPFSGGPVSFPLAPGPHFGTPGYGSPHFTALYSSVPFPEGEAFPPVSVTTLGSPMHSN

SEQ ID NO: 808517 - protein, 338 aa, Homo sapiens
MGAEPGWVDPLTWLSFQGPPGGPGIGPGVGPGSEVWGIPPCPPPYELCGGMAYCGPQVGVGLVPQGGLETSQPEGEAGVGVESNSDGASPEPCTVTPGAVKLEKEKLEQNPEKSQDIKALQKELEQFAKLLKQKRITLGYTQADVGLTLGVLFGKVFSQTTICRFEALQLSFKNMCKLRPLLQKWVEEADNNENLQEICKAETLVQARKRKRTSIENRVRGNLENLFLQCPKPTLQQISHIAQQLGLEKDVVRVWFCNRRQKGKRSSSDYAQREDFEAAGSPFSGGPVSFPLAPGPHFGTPGYGSPHFTALYSSVPFPEGEAFPPVSVTTLGSPMHSN

SEQ ID NO: 808518 - protein, 81 aa, Homo sapiens
ERSFLVVWPQSFAVPRRPSPSHATAPHLSKSADILIFPTLSVRSPPPLDARAPGLVGCAAPRTASHQPAPSLSCSTLICTP

SEQ ID NO: 808519 - protein, 81 aa, Homo sapiens; identical to SEQ ID NO: 808518

SEQ ID NO: 808520 - protein, 81 aa, Homo sapiens; identical to SEQ ID NO: 808518

SEQ ID NO: 808521 - protein, 81 aa, Homo sapiens; identical to SEQ ID NO: 808518

SEQ ID NO: 808522 - protein, 51 aa, Homo sapiens
MTLITKSFIFEFVAVVHFLPTHSINLTELQKKKGGAKNPGPSTYSSDKGHR

SEQ ID NO: 808523 - protein, 71 aa, Homo sapiens
ERSFLVVWPQSFAVPRRPSPSHATAPHLSKSADILIFPTLSVRSPPPLDARAPGESTAGRMVGSTLTIGGN

SEQ ID NO: 808524 - protein, 71 aa, Homo sapiens; identical to SEQ ID NO: 808523

SEQ ID NO: 808525 - protein, 81 aa, Homo sapiens; identical to SEQ ID NO: 808518

SEQ ID NO: 808526 - protein, 71 aa, Homo sapiens; identical to SEQ ID NO: 808523

SEQ ID NO: 808527 - protein, 71 aa, Homo sapiens; identical to SEQ ID NO: 808523

SEQ ID NO: 808528 - protein, 81 aa, Homo sapiens; identical to SEQ ID NO: 808518

SEQ ID NO: 808529 - protein, 81 aa, Homo sapiens; identical to SEQ ID NO: 808518

SEQ ID NO: 808530 - protein, 81 aa, Homo sapiens; identical to SEQ ID NO: 808518

SEQ ID NO: 808531 - protein, 163 aa, Homo sapiens
LVVCLWKRYYYYLTNGIRKDMIAPEEGEVMVRISKLISNTLLTSPFLEPLMVVLVQEKENDYYCSLMKSIVDYILMDPMERKRLFIESIPRLFPQRVIRAPVPWHSVYRSAKKWNEEHLHTVNPMMLRLKELWFAEFRDLRFVRTAEILAGKLPLQPQEFWDV

SEQ ID NO: 808532 - protein, 136 aa, Homo sapiens
LVVCLWKRYYYYLTNGIRKDMIAPEEGEVMVRISKLISNTLLTSPFLEPLMVVLVQEKENDYYCSLMKSIVDYILMDPMERKRLFIESIPRLFPQRVIRAPVPWHSVYRSAKKWNEEHLHTVNPMMLRLKELWFAE

SEQ ID NO: 808533 - protein, 1272 aa, Homo sapiens
MPAERKKPASMEEKDSLPNNKEKDCSERRTVSSKERPKDDIKLTAKKEVSKAPEDKKKRLEDDKRKKEDKERKKKDEEKVKAEEESKKKEEEEKKKHQEEERKKQEEQAKRQQEEEAAAQMKEKEESIQLHQEAWERHHLRKELRSKNQNAPDSRPEENFFSRLDSSLKKNTAFVKKLKTITEQQRDSLSHDFNGLNLSKYIAEAVASIVEAKLKISDVNCAVHLCSLFHQRYADFAPSLLQVWKKHFEARKEEKTPNITKLRTDLRFIAELTIVGIFTDKEGLSLIYEQLKNIINADRESHTHVSVVISFCRHCGDDIAGLVPRKVKSAAEKFNLSFPPSEIISPEKQQPFQNLLKEYFTSLTKHLKRDHRELQNTERQNRRILHSKGELSEDRHKQYEEFAMSYQKLLANSQSLADLLDENMPDLPQDKPTPEEHGPGIDIFTPGKPGEYDLEGGIWEDEDARNFYENLIDLKAFVPAILFKDNEKSCQNKESNKDDTKEAKESKENKEVSSPDDLELELENLEINDDTLELEGGDEAEDLTKKLLDEQEQEDEEASTGSHLKLIVDAFLQQLPNCVNRDLIDKAAMDFCMNMNTKANRKKLVRALFIVPRQRLDLLPFYARLVATLHPCMSDVAEDLCSMLRGDFRFHVRKKDQINIETKNKTVRFIGELTKFKMFTKNDTLHCLKMLLSDFSHHHIEMACTLLETCGRFLFRSPESHLRTSVLLEQMMRKKQAMHLDARYVTMVENAYYYCNPPPAEKTVKKKRPPLQEYVRKLLYKDLSKVTTEKVLRQMRKLPWQDQEVKDYVICCMINIWNVKYNSIHCVANLLAGLVLYQEDVGIHVVDGVLEDIRLGMEVNQPKFNQRRISSAKFLGELYNYRMVESAVIFRTLYSFTSFGVNPDGSPSSLDPPEHLFRIRLVCTILDTCGQYFDRGSSKRKLDCFLVYFQRYVWWKKSLEVWTKDHPFPIDIDYMISDTLELLRPKIKLCNSLEESIRQVQDLEREFLIKLGLVNDKDSKDSMTEGENLEEDEEEEEGGAETEEQSGNESEVNEPEEEEGSDNDDDEGEEEEEENTDYLTDSNKENETDEENTEVMIKGGGLKHVPCVEDEDFIQALDKMMLENLQQRSGESVKVHQLDVAIPLHLKSQLRKGPPLGGGEGEAESADTMPFVMLTRKGNKQQFKILNVPMSSQLAANHWNQQQAEQEERMRMKKLTLDINERQEQEDYQEMLQSLAQRPAPANTNRERRPRYQHPKGAPNADLIFKTGGRRR

SEQ ID NO: 808534 - protein, 1272 aa, Homo sapiens; identical to SEQ ID NO: 808533

SEQ ID NO: 808535 - protein, 1255 aa, Homo sapiens
GRLLLLNSRPRRPVSSKERPKDDIKLTAKKEVSKAPEDKKKRLEDDKRKKEDKERKKKDEEKVKAEEESKKKEEEEKKKHQEEERKKQEEQAKRQQEEEAAAQMKEKEESIQLHQEAWERHHLRKELRSKNQNAPDSRPEENFFSRLDSSLKKNTAFVKKLKTITEQQRDSLSHDFNGLNLSKYIAEAVASIVEAKLKISDVNCAVHLCSLFHQRYADFAPSLLQVWKKHFEARKEEKTPNITKLRTDLRFIAELTIVGIFTDKEGLSLIYEQLKNIINADRESHTHVSVVISFCRHCGDDIAGLVPRKVKSAAEKFNLSFPPSEIISPEKQQPFQNLLKEYFTSLTKHLKRDHRELQNTERQNRRILHSKGELSEDRHKQYEEFAMSYQKLLANSQSLADLLDENMPDLPQDKPTPEEHGPGIDIFTPGKPGEYDLEGGIWEDEDARNFYENLIDLKAFVPAILFKDNEKSCQNKESNKDDTKEAKESKENKEVSSPDDLELELENLEINDDTLELEGGDEAEDLTKKLLDEQEQEDEEASTGSHLKLIVDAFLQQLPNCVNRDLIDKAAMDFCMNMNTKANRKKLVRALFIVPRQRLDLLPFYARLVATLHPCMSDVAEDLCSMLRGDFRFHVRKKDQINIETKNKTVRFIGELTKFKMFTKNDTLHCLKMLLSDFSHHHIEMACTLLETCGRFLFRSPESHLRTSVLLEQMMRKKQAMHLDARYVTMVENAYYYCNPPPAEKTVKKKRPPLQEYVRKLLYKDLSKVTTEKVLRQMRKLPWQDQEVKDYVICCMINIWNVKYNSIHCVANLLAGLVLYQEDVGIHVVDGVLEDIRLGMEVNQPKFNQRRISSAKFLGELYNYRMVESAVIFRTLYSFTSFGVNPDGSPSSLDPPEHLFRIRLVCTILDTCGQYFDRGSSKRKLDCFLVYFQRYVWWKKSLEVWTKDHPFPIDIDYMISDTLELLRPKIKLCNSLEESIRQVQDLEREFLIKLGLVNDKDSKDSMTEGENLEEDEEEEEGGAETEEQSGNESEVNEPEEEEGSDNDDDEGEEEEEENTDYLTDSNKENETDEENTEVMIKGGGLKHVPCVEDEDFIQALDKMMLENLQQRSGESVKVHQLDVAIPLHLKSQLRKGPPLGGGEGEAESADTMPFVMLTRKGNKQQFKILNVPMSSQLAANHWNQQQAEQEERMRMKKLTLDINERQEQEDYQEMLQSLAQRPAPANTNRERRPRYQHPKGAPNADLIFKTGGRRR

SEQ ID NO: 808536 - protein, 1262 aa, Homo sapiens
GGGRGGESPSAGVGAGKPGANVDNRLEIVLGHIMPAERKKPASMEEKDSLPNNKEKDCSERRTVSSKERPKDDIKLTAKKEVSKAPEDKKKRLEDDKRKKEDKERKKKDEEKVKAEEESKKKEEEEKKKHQEEERKKQEEQAKRQQEEEAAAQMKEKEESIQLHQEAWERHHLRKELRSKNQNAPDSRPEENFFSRLDSSLKKNTAFVKKLKTITEQQRDSLSHDFNGLNLSKYIAEAVASIVEAKLKISDVNCAVHLCSLFHQRYADFAPSLLQVWKKHFEARKEEKTPNITKLRTDLRFIAELTIVGIFTDKEGLSLIYEQLKNIINADRESHTHVSVVISFCRHCGDDIAGLVPRKVKSAAEKFNLSFPPSEIISPEKQQPFQNLLKEYFTSLTKHLKRDHRELQNTERQNRRILHSKGELSEDRHKQYEEFAMSYQKLLANSQSLADLLDENMPDLPQDKPTPEEHGPGIDIFTPGKPGEYDLEGGIWEDEDARNFYENLIDLKAFVPAILFKDNEKSCQNKESNKDDTKEAKESKENKEVSSPDDLELELENLEINDDTLELEGGDEAEDLTKKLLDEQEQEDEEASTGSHLKLIVDAFLQQLPNCVNRDLIDKAAMDFCMNMNTKANRKKLVRALFIVPRQRLDLLPFYARLVATLHPCMSDVAEDLCSMLRGDFRFHVRKKDQINIETKNKTVRFIGELTKFKMFTKNDTLHCLKMLLSDFSHHHIEMACTLLETCGRFLFRSPESHLRTSVLLEQMMRKKQAMHLDARYVTMVENAYYYCNPPPAEKTVKKKRPPLQEYVRKLLYKDLSKVTTEKVLRQMRKLPWQDQEVKDYVICCMINIWNVKYNSIHCVANLLAGLVLYQEDVGIHVVDGVLEDIRLGMEVNQPKFNQRRISSAKFLGELYNYRMVESAVIFRTLYSFTSFGVNPDGSPSSLDPPEHLFRIRLVCTILDTCGQYFDRGSSKRKLDCFLVYFQRYVWWKKSLEVWTKDHPFPIDIDYMISDTLELLRPKIKLCNSLEESIRQVQDLEREFLIKLGLVNDKDSKDSMTEGENLEEDEEEEEGGAETEEQSGNESEVNEPEEEEGSDNDDDEGEEEEEENTDYLTDSNKENETDEENTEVMIKGGGLKHVPCVEDEDFIQALDKMMLENLQQRSGESVKVHQLDVAIPLHLKSQLRKGPPLGGGEGEAESADTMPFVMLTRKGNKQQFKILNVPMSSQLAANHWNQQQAEQEERMRMKNVAVSCTAPSSSKHQS

SEQ ID NO: 808537 - protein, 908 aa, Homo sapiens
GGGRGGESPSAGVGAGKPGANVDNRLEIVLGHIMPAERKKPASMEEKDSLPNNKEKDCSERRTVSSKERPKDDIKLTAKKEVSKAPEDKKKRLEDDKRKKEDKERKKKDEEKVKAEEESKKKEEEEKKKHQEEERKKQEEQAKRQQEEEAAAQMKEKEESIQLHQEAWERHHLRKELRSKNQNAPDSRPEENFFSRLDSSLKKNTAFVKKLKTITEQQRDSLSHDFNGLNLSKYIAEAVASIVEAKLKISDVNCAVHLCSLFHQRYADFAPSLLQVWKKHFEARKEEKTPNITKLRTDLRFIAELTIVGIFTDKEGLSLIYEQLKNIINADRESHTHVSVVISFCRHCGDDIAGLVPRKVKSAAEKFNLSFPPSEIISPEKQQPFQNLLKEYFTSLTKHLKRDHRELQNTERQNRRILHSKGELSEDRHKQYEEFAMSYQKLLANSQSLADLLDENMPDLPQDKPTPEEHGPGIDIFTPGKPGEYDLEGGIWEDEDARNFYENLIDLKAFVPAILFKDNEKSCQNKESNKDDTKEAKESKENKEVSSPDDLELELENLEINDDTLELEGGDEAEDLTKKLLDEQEQEDEEASTGSHLKLIVDAFLQQLPNCVNRDLIDKAAMDFCMNMNTKANRKKLVRALFIVPRQRLDLLPFYARLVATLHPCMSDVAEDLCSMLRGDFRFHVRKKDQINIETKNKTVRFIGELTKFKMFTKNDTLHCLKMLLSDFSHHHIEMACTLLETCGRFLFRSPESHLRTSVLLEQMMRKKQAMHLDARYVTMVENAYYYCNPPPAEKTVKKKRPPLQEYVRKLLYKDLSKVTTEKVLRQMRKLPWQDQEVKDYVICCMINIWNVKYNSIHCVANLLAGLVLYQEDVGIHVVDGVLEDIRLGMEYNPKFNQSTDAVGSELD

SEQ ID NO: 808538 - protein, 1305 aa, Homo sapiens
GGGRGGESPSAGVGAGKPGANVDNRLEIVLGHIMPAERKKPASMEEKDSLPNNKEKDCSERRTVSSKERPKDDIKLTAKKEVSKAPEDKKKRLEDDKRKKEDKERKKKDEEKVKAEEESKKKEEEEKKKHQEEERKKQEEQAKRQQEEEAAAQMKEKEESIQLHQEAWERHHLRKELRSKNQNAPDSRPEENFFSRLDSSLKKNTAFVKKLKTITEQQRDSLSHDFNGLNLSKYIAEAVASIVEAKLKISDVNCAVHLCSLFHQRYADFAPSLLQVWKKHFEARKEEKTPNITKLRTDLRFIAELTIVGIFTDKEGLSLIYEQLKNIINADRESHTHVSVVISFCRHCGDDIAGLVPRKVKSAAEKFNLSFPPSEIISPEKQQPFQNLLKEYFTSLTKHLKRDHRELQNTERQNRRILHSKGELSEDRHKQYEEFAMSYQKLLANSQSLADLLDENMPDLPQDKPTPEEHGPGIDIFTPGKPGEYDLEGGIWEDEDARNFYENLIDLKAFVPAILFKDNEKSCQNKESNKDDTKEAKESKENKEVSSPDDLELELENLEINDDTLELEGGDEAEDLTKKLLDEQEQEDEEASTGSHLKLIVDAFLQQLPNCVNRDLIDKAAMDFCMNMNTKANRKKLVRALFIVPRQRLDLLPFYARLVATLHPCMSDVAEDLCSMLRGDFRFHVRKKDQINIETKNKTVRFIGELTKFKMFTKNDTLHCLKMLLSDFSHHHIEMACTLLETCGRFLFRSPESHLRTSVLLEQMMRKKQAMHLDARYVTMVENAYYYCNPPPAEKTVKKKRPPLQEYVRKLLYKDLSKVTTEKVLRQMRKLPWQDQEVKDYVICCMINIWNVKYNSIHCVANLLAGLVLYQEDVGIHVVDGVLEDIRLGMEVNQPKFNQRRISSAKFLGELYNYRMVESAVIFRTLYSFTSFGVNPDGSPSSLDPPEHLFRIRLVCTILDTCGQYFDRGSSKRKLDCFLVYFQRYVWWKKSLEVWTKDHPFPIDIDYMISDTLELLRPKIKLCNSLEESIRQVQDLEREFLIKLGLVNDKDSKDSMTEGENLEEDEEEEEGGAETEEQSGNESEVNEPEEEEGSDNDDDEGEEEEEENTDYLTDSNKENETDEENTEVMIKGGGLKHVPCVEDEDFIQALDKMMLENLQQRSGESVKVHQLDVAIPLHLKSQLRKGPPLGGGEGEAESADTMPFVMLTRKGNKQQFKILNVPMSSQLAANHWNQQQAEQEERMRMKKLTLDINERQEQEDYQEMLQSLAQRPAPANTNRERRPRYQHPKGAPNADLIFKTGGRRR

SEQ ID NO: 808539 - protein, 86 aa, Homo sapiens
MPAERKKPASMEEKDSLPNNKEKDCSERRTVSSKERPKDDIKLTAKKEVSKAPEDKKKRLEDDKRKKGDAAETPTSHKNGLGCQTQ

SEQ ID NO: 808540 - protein, 1272 aa, Homo sapiens; identical to SEQ ID NO: 808533

SEQ ID NO: 808541 - protein, 1248 aa, Homo sapiens
GGGRGGESPSAGVGAGKPGANVDNRLEIVLGHIMPAERKKPASMEEKDSLPNNKEKDCSERRTVSSKERPKDDIKLTAKKEVSKAPEDKKKRLEDDKRKKEDKERKKKDEEKVKAEEESKKKEEEEKKKHQEEERKKQEEQAKRQQEEEAAAQMKEKEESIQLHQEAWERHHLRKELRSKNQNAPDSRPEENFFSRLDSSLKKNTAFVKKLKTITEQQRDSLSHDFNGLNLSKYIAEAVASIVEAKLKISDVNCAVHLCSLFHQRYADFAPSLLQVWKKHFEARKEEKTPNITKLRTDLRFIAELTIVGIFTDKEGLSLIYEQLKNIINADRESHTHVSVVISFCRHCGDDIAGLVPRKVKSAAEKFNLSFPPSEIISPEKQQPFQNLLKEYFTSLTKHLKRDHRELQNTERQNRRILHSKGELSEDRHKQYEEFAMSYQKLLANSQSLADLLDENMPDLPQDKPTPEEHGPGIDIFTPGKPGEYDLEGGIWEDEDARNFYENLIDLKAFVPAILFKDNEKSCQNKESNKDDTKEAKESKENKEVSSPDDLELELENLEINDDTLELEGGDEAEDLTKKLLDEQEQEDEEASTGSHLKLIVDAFLQQLPNCVNRDLIDKAAMDFCMNMNTKANRKKLVRALFIVPRQRLDLLPFYARLVATLHPCMSDVAEDLCSMLRGDFRFHVRKKDQINIETKNKTVRFIGELTKFKMFTKNDTLHCLKMLLSDFSHHHIEMACTLLETCGRFLFRSPESHLRTSVLLEQMMRKKQAMHLDARYVTMVENAYYYCNPPPAEKTVKKKRPPLQEYVRKLLYKDLSKVTTEKVLRQMRKLPWQDQEVKDYVICCMINIWNVKYNSIHCVANLLAGLVLYQEDVGIHVVDGVLEDIRLGMEVNQPKFNQRRISSAKFLGELYNYRMVESAVIFRTLYSFTSFGVNPDGSPSSLDPPEHLFRIRLVCTILDTCGQYFDRGSSKRKLDCFLVYFQRYVWWKKSLEVWTKDHPFPIDIDYMISDTLELLRPKIKLCNSLEESIRQVQDLEREFLIKLGLVNDKDSKDSMTEGENLEEDEEEEEGGAETEEQSGNESEVNEPEEEEGSDNDDDEGEEEEEENTDYLTDSNKENETDEENTEVMIKGGGLKHVPCVEDEDFIQALDKMMLENLQQRSGESVKVHQLDVAIPLHLKSQLRKGPPLGGGEGEAESADTMPFVMLTRKGNKQQFKILNVPMSSQLAANHWNQQQAEQEERMRMKQN

SEQ ID NO: 808542 - protein, 70 aa, Homo sapiens
RILGPAERGGRPLEFDPSGPRSAEDLGYPLTQAGRDPPRIWGPLAPNPELPDVASKSTVLLNLNFRQDRF

SEQ ID NO: 808543 - protein, 70 aa, Homo sapiens; identical to SEQ ID NO: 808542

SEQ ID NO: 808544 - protein, 111 aa, Homo sapiens
RPLARSPAPPPLPLPPGPCPAVYMPVRSPAAPNPSEPRLPEGEARRPANWTGGSLRPGAPDSDLRRLRHHQGGIRLWCFEEGVWCRERNPVPLHLFSPSGLQTQGTRSWLS

SEQ ID NO: 808545 - protein, 306 aa, Homo sapiens [sequence omitted]

SEQ ID NO: 808546 - protein, 316 aa, Homo sapiens
MSANPATGLLDPCVFRVSVRKELKGGKAYSKLGFADLNLAEFAGSGSTVRCCLLEGYDTKNTRQDNSILKVTIGMFLLSGDPCFKTPPSTAKSISIPGQDSSLQLTCKGGGTSSGGSSTNSLTGSRPPKARPTILSSGLPEEPDQNLSSPEEVFHSGHSRNSSYASQQSKISGYSTEHSRSSSLSDLTHRRNTSTSSSASGGLGMTVEGPEGSEREHRPPEKPPRPPRPLHLSDRSFRRKKDSVESHPTWVDDTRIDADAIVEKIVQSQDFTDGSNTEDSNLRLFVSRDGSATLSGIQLATRVSSGVYEPVVIESH

SEQ ID NO: 808547 - protein, 384 aa, Homo sapiens
MAFLMKKKKFKFQTTFTLEELTAVPFVNGVLFCKVRLLDGGDFVSLSSREEVQENCVRWRKRFTFVCKMSANPATGLLDPCVFRVSVRKELKGGKAYSKLGFADLNLAEFAGSGSTVRCCLLEGYDTKNTRQDNSILKVTIGMFLLSGDPCFKTPPSTAKSISIPGQDSSLQLTCKGGGTSSGGSSTNSLTGSRPPKARPTILSSGLPEEPDQNLSSPEEVFHSGHSRNSSYASQQSKISGYSTEHSRSSSLSDLTHRRNTSTSSSASGGLGMTVEGPEGSEREHRPPEKPPRPPRPLHLSDRSFRRKKDSVESHPTWVDDTRIDADAIVEKIVQSQDFTDGSNTEDSNLRLFVSRDGSATLSGIQLATRVSSGVYEPVVIESH

SEQ ID NO: 808548 - protein, 519 aa, Homo sapiens
MSSKSPSLAPPRLNLTFPSRSSRLGLHPQGLLSACPLRTYSHFPPHPSILCPEVPRACSDPELCPAAPHSVLYQGAFPGAPAHPAVPLPSQPLWGCPITFPSTHFPQAFPPPLPADPAAPDSTALFPREQCICVTDNNVLFMSGALAPVHAGTWHKGCFVQLRDVSSWLCHVGAADPGPLSLGPSYATVSRGCGAGPGALSVSLSNFCQVTLLGFRQPGAHTPSALPHAPLTSKLGFADLNLAEFAGSGSTVRCCLLEGYDTKNTRQDNSILKVTIGMFLLSGDPCFKTPPSTAKSISIPGQDSSLQLTCKGGGTSSGGSSTNSLTGSRPPKARPTILSSGLPEEPDQNLSSPEEVFHSGHSRNSSYASQQSKISGYSTEHSRSSSLSDLTHRRNTSTSSSASGGLGMTVEGPEGSEREHRPPEKPPRPPRPLHLSDRSFRRKKDSVESHPTWVDDTRIDADAIVEKIVQSQDFTDGSNTEDSNLRLFVSRDGSATLSGIQLATRVSSGVYEPVVIESH

SEQ ID NO: 808549 - protein, 112 aa, Homo sapiens [sequence omitted]

SEQ ID NO: 808550 - protein, 133 aa, Homo sapiens [sequence omitted]

SEQ ID NO: 808551 - protein, 384 aa, Homo sapiens; identical to SEQ ID NO: 808547

SEQ ID NO: 808552 - protein, 384 aa, Homo sapiens; identical to SEQ ID NO: 808547

SEQ ID NO: 808553 - protein, 335 aa, Homo sapiens
MAFLMKKKKFKFQTTFTLEELTAVPFVNGVLFCKVRLLDGGDFVSLSSREEVQENCVRWRKRFTFVCKMSANPATGLLDPCVFRVSVRKELKGGKAYSKLGFADLNLAEFAGSGSTVRCCLLEGYDTKNTRQDNSILKVTIGMFLLSGDPCFKTPPSTAKSISIPGQDSSLQLTCKGGGTSSGGSSTNSLTGSRPPKARPTILSSGLPEEPDQNLSSPEEVFHSGHSRNSSYASQQSKISGEWLPGPAPVASSFLGIPHCDAPLLSPLTGYSTEHSRSSSLSDLTHRRNTSTSSSASGGLGMTVEGPEGSEREHRPPEKPPRPPRPLHLSDRSFR

SEQ ID NO: 808554 - protein, 344 aa, Homo sapiens
AHLSPLAHREEVQENCVRWRKRFTFVCKMSANPATGLLDPCVFRVSVRKELKGGKAYSKLGFADLNLAEFAGSGSTVRCCLLEGYDTKNTRQDNSILKVTIGMFLLSGDPCFKTPPSTAKSISIPGQDSSLQLTCKGGGTSSGGSSTNSLTGSRPPKARPTILSSGLPEEPDQNLSSPEEVFHSGHSRNSSYASQQSKISGYSTEHSRSSSLSDLTHRRNTSTSSSASGGLGMTVEGPEGSEREHRPPEKPPRPPRPLHLSDRSFRRKKDSVESHPTWVDDTRIDADAIVEKIVQSQDFTDGSNTEDSNLRLFVSRDGSATLSGIQLATRVSSGVYEPVVIESH

SEQ ID NO: 808555 - protein, 548 aa, Homo sapiens
MSSKSPSLAPPRLNLTFPSRSSRLGLHPQGLLSACPLRTYSHFPPHPSILCPEVPRACSDPELCPAAPHSVLYQGAFPGAPAHPAVPLPSQPLWGCPITFPSTHFPQAFPPPLPADPAAPDSTALFPREQCICVTDNNVLFMSGALAPVHAGTWHKGCFVQLRDVSSWLCHVGAADPGPLSLGPSYATVSRGCGAGPGALSVSLSNFCQVTLLGFRQPGAHTPSALPHAPLTSKLGFADLNLAEFAGSGSTVRCCLLEGYDTKNTRQDNSILKVTIGMFLLSGDPCFKTPPSTAKSISIPGQDSSLQLTCKGGGTSSGGSSTNSLTGSRPPKARPTILSSGLPEEPDQNLSSPEEVFHSGHSRNSSYASQQSKISGEWLPGPAPVASSFLGIPHCDAPLRSPLTGYSTEHSRSSSLSDLTHRRNTSTSSSASGGLGMTVEGPEGSEREHRPPEKPPRPPRPLHLSDRSFRRKKDSVESHPTWVDDTRIDADAIVEKIVQSQDFTDGSNTEDSNLRLFVSRDGSATLSGIQLATRVSSGVYEPVVIESH

SEQ ID NO: 808556 - protein, 159 aa, Homo sapiens
LAGSFPTSPTAVKISGYSTEHSRSSSLSDLTHRRNTSTSSSASGGLGMTVEGPEGSEREHRPPEKPPRPPRPLHLSDRSFRRKKDSVESHPTWVDDTRIDADAIVEKIVQSQDFTDGSNTEDSNLRLFVSRDGSATLSGIQLATRVSSGVYEPVVIESH

SEQ ID NO: 808557 - protein, 306 aa, Homo sapiens [sequence omitted]

SEQ ID NO: 808558 - protein, 109 aa, Homo sapiens
LSTVYLGCFFLFYILGCGFVGKFCGSNFKSNFSGIFALKLTFSNSDAAAVDEFLTSVDAIAYLLQVFWTGSSVFFSVLCYCPGTSLCFFSLQGWGLKCMKFLVYSPAYF

SEQ ID NO: 808559 - protein, 436 aa, Homo sapiens
MASPTNGHHGGNCGKCSPGRAPLVGSGALADHDPRQAPRLRRRLTQSAPGRGSDRVGASQRLPRRFEFCAAGVRWFSELCPRLPRAGARERVRGFLTQTRVRSAQSPGGSLPSDDLGEMESSSSDYYNKDNEEESLLANVASLRHELKITEWSLQSLGEELSSVSPSENSDYAPNPSRSEKLILDVQPSHPGLLNYSPYENVCKISGSSTDFQKKPRDKMFSSSAPVDQEIKSLREKLNKLRQQNACLVTQNHSLMTKFESIHFELTQSRAKVSMLESAQQQAASVPILEEQIINLEAEVSAQDKVLREAENKLEQSQKMVIEKEQSLQESKEECIKLKVDLLEQTKQGKRAERQRNEALYNAEELSKAFQQYKKKVAEKLEKVQAEEEILERNLTNCEKENKRLQERCGLYKSELEILKEKLRQLKEENNNEKEK

SEQ ID NO: 808560 - protein, 369 aa, Homo sapiens
MASPTNGHHGGNCGKCSPGRAPLVGSGALADHDPRQAPRLRRRLTQSAPGRGSDRVGASQRLPRRFEFCAAGVRWFSELCPRLPRAGARERVRGFLTQTRVRSAQSPEMESSSSDYYNKDNEEESLLANVASLRHELKITDMEFAEFRGRVIQMFSSSAPVDQEIKSLREKLNKLRQQNACLVTQNHSLMTKFESIHFELTQSRAKVSMLESAQQQAASVPILEEQIINLEAEVSAQDKVLREAENKLEQSQKMVIEKEQSLQESKEECIKLKVDLLEQTKQGKRAERQRNEALYNAEELSKAFQQYKKKVAEKLEKVQAEEEILERNLTNCEKENKRLQERCGLYKSELEILKEKLRQLKEENNNEKE

SEQ ID NO: 808561 - protein, 2003 aa, Homo sapiens
MQPPSLLLLLLLLLLLCVSVVRPRGLLCGSFPEPCANGGTCLSLSLGQGTCQCAPGFLGETCQFPDPCQNAQLCQNGGSCQALLPAPLGLPSSPSPLTPSFLCTCLPGFTGERCQAKLEDPCPPSFCSKRGRCHIQASGRPQCSCMPGWTGEQCQLRDFCSANPCVNGGVCLATYPQIQCHCPPGFEGHACERDVNECFQDPGPCPKGTSCHNTLGSFQCLCPVGQEGPRCELRAGPCPPRGCSNGGTCQLMPEKDSTFHLCLCPPGFIGPDCEVNPDNCVSHQCQNGGTCQDGLDTYTCLCPETWTGWDCSEDVDECETQGPPHCRNGGTCQNSAGSFHCVCVSGWGGTSCEENLDDCIAATCAPGSTCIDRVGSFSCLCPPGRTGLLCHLEDMCLSQPCHGDAQCSTNPLTGSTLCLCQPGYSGPTCHQDLDECLMAQQGPSPCEHGGSCLNTPGSFNCLCPPGYTGSRCEADHNECLSQPCHPGSTCLDLLATFHCLCPPGLEGQLCEVETNECASAPCLNHADCHDLLNGFQCICLPGFSGTRCEEDIDECRSSPCANGGQCQDQPGAFHCKCLPGFEGPRCQTEVDECLSDPCPVGASCLDLPGAFFCLCPSGFTGQLCEVPLCAPNLCQPKQICKDQKDKANCLCPDGSPGCAPPEDNCTCHHGHCQRSSCVCDVGWTGPECEAELGGCISAPCAHGGTCYPQPSGYNCTCPTGYTGPTCSEEMTACHSGPCLNGGSCNPSPGGYYCTCPPSHTGPQCQTSTDYCVSAPCFNGGTCVNRPGTFSCLCAMGFQGPRCEGKLRPSCADSPCRNRATCQDSPQGPRCLCPTGYTGGSCQTLMDLCAQKPCPRNSHCLQTGPSFHCLCLQGWTGPLCNLPLSSCQKAALSQGIDVSSLCHNGGLCVDSGPSYFCHCPPGFQGSLCQDHVNPCESRPCQNGATCMAQPSGYLCQCAPGYDGQNCSKELDACQSQPCHNHGTCTPKPGGFHCACPPGFVGLRCEGDVDECLDQPCHPTGTAACHSLANAFYCQCLPGHTGQWCEVEIDPCHSQPCFHGGTCEATAGSPLGFICHCPKGFEGPTCSHRAPSCGFHHCHHGGLCLPSPKPGFPPRCACLSGYGGPDCLTPPAPKGCGPPSPCLYNGSCSETTGLGGPGFRCSCPHSSPGPRCQKPGAKGCEGRSGDGACDAGCSGPGGNWDGGDCSLGVPDPWKGCPSHSRCWLLFRDGQCHPQCDSEECLFDGYDCETPPACTPAYDQYCHDHFHNGHCEKGCNTAECGWDGGDCRPEDGDPEWGPSLALLVVLSPPALDQQLFALARVLSLTLRVGLWVRKDRDGRDMVYPYPGARAEEKLGGTRDPTYQERAAPQTQPLGKETDSLSAGFVVVMGVDLSRCGPDHPASRCPWDPGLLLRFLAAMAAVGALEPLLPGPLLAVHPHAGTAPPANQLPWPVLCSPVAGVILLALGALLVLQLIRRRRREHGALWLPPGFTRRPRTQSAPHRRRPPLGEDSIGLKALKPKAEVDEDGVVMCSGPEEGEEVGQAEETGPPSTCQLWSLSGGCGALPQAAMLTPPQESEMEAPDLDTRGPDGVTPLMSAVCCGEVQSGTFQGAWLGCPEPWEPLLDGGACPQAHTVGTGETPLHLAARFSRPTAARRLLEAGANPNQPDRAGRTPLHAAVAADAREVCQLLLRSRQTAVDARTEDGTTPLMLAARLAVEDLVEELIAAQADVGARDKWGKTALHWAAAVNNARAARSLLQAGADKDAQDNREQTPLFLAAREGAVEVAQLLLGLGAARELRDQAGLAPADVAHQRNHWDLLTLLEGAGPPEARHKATPGREAGPFPRARTVSVSVPPHGGGALPRCRTLSAGAGPRGGGACLQARTWSVDLAARGGGAYSHCRSLSGVGAGGGPTPRGRRFSAGMRGPRPNPAIMRGRYGVAAGRGGRVSTDDWPCDWVALGACGSASNIPIPPPCLTPSPERGSPQLDCGPPALQEMPINQGGEGKK

SEQ ID NO: 808562 - protein, 1762 aa, Homo sapiens
MQPPSLLLLLLLLLLLCVSVVRPRGLLCGSFPEPCANGGTCLSLSLGQGTCQCAPGFLGETCQFPDPCQNAQLCQNGGSCQALLPAPLGLPSSPSPLTPSFLCTCLPGFTGERCQAKLEDPCPPSFCSKRGRCHIQASGRPQCSCMPGWTGEQCQLRDFCSANPCVNGGVCLATYPQIQCHCPPGFEGHACERDVNECFQDPGPCPKGTSCHNTLGSFQCLCPVGQEGPRCELRAGPCPPRGCSNGGTCQLMPEKDSTFHLCLCPPGFIGPDCEVNPDNCVSHQCQNGGTCQDGLDTYTCLCPETWTGWDCSEDVDECETQGPPHCRNGGTCQNSAGSFHCVCVSGWGGTSCEENLDDCIAATCAPGSTCIDRVGSFSCLCPPGRTGLLCHLEDMCLSQPCHGDAQCSTNPLTGSTLCLCQPGYSGPTCHQDLDECLMAQQGPSPCEHGGSCLNTPGSFNCLCPPGYTGSRCEADHNECLSQPCHPGSTCLDLLATFHCLCPPGLEGQLCEVETNECASAPCLNHADCHDLLNGFQCICLPGFSGTRCEEDIDECRSSPCANGGQCQDQPGAFHCKCLPGFEGPRCQTEVDECLSDPCPVGASCLDLPGAFFCLCPSGFTGQLCEVPLCAPNLCQPKQICKDQKDKANCLCPDGSPGCAPPEDNCTCHHGHCQRSSCVCDVGWTGPECEAELGGCISAPCAHGGTCYPQPSGYNCTCPTGYTGPTCSEEMTACHSGPCLNGGSCNPSPGGYYCTCPPSHTGPQCQTSTDYCVSAPCFNGGTCVNRPGTFSCLCAMGFQGPRCEGKLRPSCAEQTLMDLCAQKPCPRNSHCLQTGPSFHCLCLQGWTGPLCNLPLSSCQKAALSQGIDVSSLCHNGGLCVDSGPSYFCHCPPGFQGSLCQDHVNPCESRPCQNGATCMAQPSGYLCQCAPGYDGQNCSKELDACQSQPCHNHGTCTPKPGGFHCACPPGFVGLRCEGDVDECLDQPCHPTGTAACHSLANAFYCQCLPGHTGQWCEVEIDPCHSQPCFHGGTCEATAGSPLGFICHCPKGFEGPTCSHRAPSCGFHHCHHGGLCLPSPKPGFPPRCACLSGYGGPDCLTPPAPKGCGPPSPCLYNGSCSETTGLGGPGFRCSCPHSSPGPRCQKPGAKGCEGRSGDGACDAGCSGPGGNWDGGDCSLGVPDPWKGCPSHSRCWLLFRDGQCHPQCDSEECLFDGYDCETPPACTPAYDQYCHDHFHNGHCEKGCNTAECGWDGGDCRPEDGDPEWGPSLALLVVLSPPALDQQLFALARVLSLTLRVGLWVRKDRDGRDMVYPYPGARAEEKLGGTRDPTYQERAAPQTQPLGKETDSLSAGFVVVMGVDLSRCGPDHPASRCPWDPGLLLRFLAAMAAVGALEPLLPGPLLAVHPHAGTAPPANQLPWPVLCSPVAGVILLALGALLVLQLIRRRRREHGALWLPPGFTRRPRTQSAPHRRRPPLGEDSIGLKALKPKAEVDEDGVVMCSGPEEGEEVGQAEETGPPSTCQLWSLSGGCGALPQAAMLTPPQESEMEAPDLDTRGPDGVTPLMSAVCCGEVQSGTFQGAWLGCPEPWEPLLDGGACPQAHTVGTGETPLHLAARFSRPTAARRLLEAGANPNQPDRAGRTPLHAAVAADAREVCQLLLRSRQTAVDARTEDGTTPLMLAARLAVEDLVEELIAAQADVGARDKWGKTALHWAAAVNNARAARSLLQAGADKDAQDNRVRWDRGLPTKQSGAREMESAVTRKA

SEQ ID NO: 808563 - protein, 1111 aa, Homo sapiens
MQPPSLLLLLLLLLLLCVSVVRPRGLLCGSFPEPCANGGTCLSLSLGQGTCQCAPGFLGETCQFPDPCQNAQLCQNGGSCQALLPAPLGLPSSPSPLTPSFLCTCLPGFTGERCQAKLEDPCPPSFCSKRGRCHIQASGRPQCSCMPGWTGEQCQLRDFCSANPCVNGGVCLATYPQIQCHCPPGFEGHACERDVNECFQDPGPCPKGTSCHNTLGSFQCLCPVGQEGPRCELRAGPCPPRGCSNGGTCQLMPEKDSTFHLCLCPPGFIGPDCEVNPDNCVSHQCQNGGTCQDGLDTYTCLCPETWTGWDCSEDVDECETQGPPHCRNGGTCQNSAGSFHCVCVSGWGGTSCEENLDDCIAATCAPGSTCIDRVGSFSCLCPPGRTGLLCHLEDMCLSQPCHGDAQCSTNPLTGSTLCLCQPGYSGPTCHQDLDECLMAQQGPSPCEHGGSCLNTPGSFNCLCPPGYTGSRCEADHNECLSQPCHPGSTCLDLLATFHCLCPPGLEGQLCEVETNECASAPCLNHADCHDLLNGFQCICLPGFSGTRCEEDIDECRSSPCANGGQCQDQPGAFHCKCLPGFEGPRCQTEVDECLSDPCPVGASCLDLPGAFFCLCPSGFTGQLCEVPLCAPNLCQPKQICKDQKDKANCLCPDGSPGCAPPEDNCTCHHGHCQRSSCVCDVGWTGPECEAELGGCISAPCAHGGTCYPQPSGYNCTCPTGYTGPTCSEEMTACHSGPCLNGGSCNPSPGGYYCTCPPSHTGPQCQTSTDYCVSAPCFNGGTCVNRPGTFSCLCAMGFQGPRCEGKLRPSCAEQTLMDLCAQKPCPRNSHCLQTGPSFHCLCLQGWTGPLCNLPLSSCQKAALSQGIDVSSLCHNGGLCVDSGPSYFCHCPPGFQGSLCQDHVNPCESRPCQNGATCMAQPSGYLCQCAPGYDGQNCSKELDACQSQPCHNHGTCTPKPGGFHCACPPGFVGLRCEGDVDECLDQPCHPTGTAACHSLANAFYCQCLPGHTGQWCEVEIDPCHSQPCFHGGTCEATAGSPLGFICHCPKASDHKSAFSVAPYADKARIPQLESQKGLWVSTDVEIIGKSHAKLTVGSVSQKQSKARQDQLIA

SEQ ID NO: 808564 - protein, 544 aa, Homo sapiens
MQPPSLLLLLLLLLLLCVSVVRPRGLLCGSFPEPCANGGTCLSLSLGQGTCQCAPGFLGETCQFPDPCQNAQLCQNGGSCQALLPAPLGLPSSPSPLTPSFLCTCLPGFTGERCQAKLEDPCPPSFCSKRGRCHIQASGRPQCSCMPGWTGEQCQLRDFCSANPCVNGGVCLATYPQIQCHCPPGFEGHACERDVNECFQDPGPCPKGTSCHNTLGSFQCLCPVGQEGPRCELRAGPCPPRGCSNGGTCQLMPEKDSTFHLCLCPPGFIGPDCEVNPDNCVSHQCQNGGTCQDGLDTYTCLCPETWTGWDCSEDVDECETQGPPHCRNGGTCQNSAGSFHCVCVSGWGGTSCEENLDDCIAATCAPGSTCIDRVGSFSCLCPPGRTGLLCHLEDMCLSQPCHGDAQCSTNPLTGSTLCLCQPGYSGPTCHQDLDECLMAQQGPSPCEHGGSCLNTPGSFNCLCPPGYTGSRCEADHNECLSQPCHPGSTCLDLLATFHCLCPPVLPSHRLCEIDGPVTSFKPHVEPTRDPRMSAHLHGVPGQIS

SEQ ID NO: 808565 - protein, 105 aa, Homo sapiens [sequence omitted]

SEQ ID NO: 808566 - protein, 1974 aa, Homo sapiens
MQPPSLLLLLLLLLLLCVSVVRPRGLLCGSFPEPCANGGTCLSLSLGQGTCQCAPGFLGETCQFPDPCQNAQLCQNGGSCQALLPAPLGLPSSPSPLTPSFLCTCLPGFTGERCQAKLEDPCPPSFCSKRGRCHIQASGRPQCSCMPGWTGEQCQLRDFCSANPCVNGGVCLATYPQIQCHCPPGFEGHACERDVNECFQDPGPCPKGTSCHNTLGSFQCLCPVGQEGPRCELRAGPCPPRGCSNGGTCQLMPEKDSTFHLCLCPPGFIGPDCEVNPDNCVSHQCQNGGTCQDGLDTYTCLCPETWTGWDCSEDVDECETQGPPHCRNGGTCQNSAGSFHCVCVSGWGGTSCEENLDDCIAATCAPGSTCIDRVGSFSCLCPPGRTGLLCHLEDMCLSQPCHGDAQCSTNPLTGSTLCLCQPGYSGPTCHQDLDECLMAQQGPSPCEHGGSCLNTPGSFNCLCPPGYTGSRCEADHNECLSQPCHPGSTCLDLLATFHCLCPPGLEGQLCEVETNECASAPCLNHADCHDLLNGFQCICLPGFSGTRCEEDIDECRSSPCANGGQCQDQPGAFHCKCLPGFEGPRCQTEVDECLSDPCPVGASCLDLPGAFFCLCPSGFTGQLCEVPLCAPNLCQPKQICKDQKDKANCLCPDGSPGCAPPEDNCTCHHGHCQRSSCVCDVGWTGPECEAELGGCISAPCAHGGTCYPQPSGYNCTCPTGYTGPTCSEEMTACHSGPCLNGGSCNPSPGGYYCTCPPSHTGPQCQTSTDYCVSAPCFNGGTCVNRPGTFSCLCAMGFQGPRCEGKLRPSCAEQTLMDLCAQKPCPRNSHCLQTGPSFHCLCLQGWTGPLCNLPLSSCQKAALSQGIDVSSLCHNGGLCVDSGPSYFCHCPPGFQGSLCQDHVNPCESRPCQNGATCMAQPSGYLCQCAPGYDGQNCSKELDACQSQPCHNHGTCTPKPGGFHCACPPGFVGLRCEGDVDECLDQPCHPTGTAACHSLANAFYCQCLPGHTGQWCEVEIDPCHSQPCFHGGTCEATAGSPLGFICHCPKGFEGPTCSHRAPSCGFHHCHHGGLCLPSPKPGFPPRCACLSGYGGPDCLTPPAPKGCGPPSPCLYNGSCSETTGLGGPGFRCSCPHSSPGPRCQKPGAKGCEGRSGDGACDAGCSGPGGNWDGGDCSLGVPDPWKGCPSHSRCWLLFRDGQCHPQCDSEECLFDGYDCETPPACTPAYDQYCHDHFHNGHCEKGCNTAECGWDGGDCRPEDGDPEWGPSLALLVVLSPPALDQQLFALARVLSLTLRVGLWVRKDRDGRDMVYPYPGARAEEKLGGTRDPTYQERAAPQTQPLGKETDSLSAGFVVVMGVDLSRCGPDHPASRCPWDPGLLLRFLAAMAAVGALEPLLPGPLLAVHPHAGTAPPANQLPWPVLCSPVAGVILLALGALLVLQLIRRRRREHGALWLPPGFTRRPRTQSAPHRRRPPLGEDSIGLKALKPKAEVDEDGVVMCSGPEEGEEVGQAEETGPPSTCQLWSLSGGCGALPQAAMLTPPQESEMEAPDLDTRGPDGVTPLMSAVCCGEVQSGTFQGAWLGCPEPWEPLLDGGACPQAHTVGTGETPLHLAARFSRPTAARRLLEAGANPNQPDRAGRTPLHAAVAADAREVCQLLLRSRQTAVDARTEDGTTPLMLAARLAVEDLVEELIAAQADVGARDKWGKTALHWAAAVNNARAARSLLQAGADKDAQDNREQTPLFLAAREGAVEVAQLLLGLGAARELRDQAGLAPADVAHQRNHWDLLTLLEGAGPPEARHKATPGREAGPFPRARTVSVSVPPHGGGALPRCRTLSAGAGPRGGGACLQARTWSVDLAARGGGAYSHCRSLSGVGAGGGPTPRGRRFSAGMRGPRPNPAIMRGRYGVAAGRGGRVSTDDWPCDWVALGACGSASNIPIPPPCLTPSPERGSPQLDCGPPALQEMPINQGGEGKK

SEQ ID NO: 808567 - protein, 317 aa, Homo sapiens
VVSWATLPAFEGPAGPNSPSPKARTRGKPEPRRLAPNWGNNLPRRPLGKTALHWAAAVNNARAARSLLQAGADKDAQDNREQTPLFLAAREGAVEVAQLLLGLGAARELRDQAGLAPADVAHQRNHWDLLTLLEGAGPPEARHKATPGREAGPFPRARTVSVSVPPHGGGALPRCRTLSAGAGPRGGGACLQARTWSVDLAARGGGAYSHCRSLSGVGAGGGPTPRGRRFSAGMRGPRPNPAIMRGRYGVAAGRGGRVSTDDWPCDWVALGACGSASNIPIPPPCLTPSPERGSPQLDCGPPALQEMPINQGGEGKK

SEQ ID NO: 808568 - protein, 103 aa, Homo sapiens
PHSLWVVAAGLKTADRTSRPAACGHPPAQALSWKTQHLEFRLALREGRAFATSWGAPSVTSQGRAFCHVTRAVQCLELGSLLRVEPGNRDLPASSCVLLAGKG

SEQ ID NO: 808569 - protein, 918 aa, Homo sapiens
MASLSRALRVAAAHPRQSPTRGMGPCNLSSAAGPTAEKSVPYQRTLKEGQGTSVVAQGPSRPLPSTANVVVIGGGSLGCQTLYHLAKLGMSGAVLLERERLTSGTTWHTAGLLWQLRPSDVEVELLAHTRRVVSRELEEETGLHTGWIQNGGLFIASNRQRLDEYKRLMSLGKAYGVESHVLSPAETKTLYPLMNVDDLYGTLYVPHDGTMDPAGTCTTLARAASARGAQVIENCPVTGIRVWTDDFGVRRVAGVETQHGSIQTPCVVNCAGVWASAVGRMAGVKVPLVAMHHAYVVTERIEGIQNMPNVRDHDASVYLRLQGDALSVGGYEANPIFWEEVSDKFAFGLFDLDWEVFTQHIEGAINRVPVLEKTGIKSTVCGPESFTPDHKPLMGEAPELRGFFLGCGFNSAGMMLGGGCGQELAHWIIHGRPEKDMHGYDIRRFHHSLTDHPRWIRERSHESYAKNYSVVFPHDEPLAGRNMRRDPLHEELLGQGCVFQERHGWERPGWFHPRGPAPVLEYDYYGAYGSRAHEDYAYRRLLADEYTFAFPPHHDTIKKECLACRGAAAVFDMSYFGKFYLVGLDARKAADWLFSADVSRPPGSTVYTCMLNHHGGTESDLTVSRLAPSHQASPLAPAFEGDGYYLAVGGAVAQHNWSHITTVLQDQKSQCQLIDSSEDLGMISIQGPASRAILQEVLDADLSNEAFPFSTHKLLRAAGHLVRAMRLSFVGELGWELHIPKASCVPVYRAVMAAGAKHGLINAGYRAIDSLSIEKGYRHWHADLRPDDSPLEAGLAFTCKLKSPVPFLGREALEQQRAAGLRRRLVCFTMEDKVPMFGLEAIWRNGQVVGHVRRADFGFAIDKTIAYGYIHDPSGGPVSLDFVKSGDYALERMGVTYGAQAHLKSPFDPNNKRVKGIY

SEQ ID NO: 808570 - protein, 431 aa, Homo sapiens [sequence omitted]

SEQ ID NO: 808571 - protein, 690 aa, Homo sapiens
MASLSRALRVAAAHPRQSPTRGMGPCNLSSAAGPTAEKSVPYQRTLKEGQGTSVVAQGPSRPLPSTANVVVIGGGSLGCQTLYHLAKLGMSGAVLLERERLTSGTTWHTAGLLWQLRPSDVEVELLAHTRRVVSRELEEETGLHTGWIQNGGLFIASNRQRLDEYKRLMSLGKAYGVESHVLSPAETKTLYPLMNVDDLYGTLYVPHDGTMDPAGTCTTLARAASARGAQVIENCPVTGIRVWTDDFGVRRVAGVETQHGSIQTPCVVNCAGVWASAVGRMAGVKVPLVAMHHAYVVTERIEGIQNMPNVRDHDASVYLRLQGDALSVGGYEANPIFWEEVSDKFAFGLFDLDWEVFTQHIEGAINRVPVLEKTGIKSTVCGPESFTPDHKPLMGEAPELRGFFLGCGFNSAGMMLGGGCGQELAHWIIHGRPEKDMHGYDIRRFHHSLTDHPRWIRERSHESYAKNYSVVFPHDEPLAGRNMRRDPLHEELLGQGCVFQERHGWERPGWFHPRGPAPVLEYDYYGAYGSRAHEDYAYRRLLADEYTFAFPPHHDTIKKECLACRGAAAVFDMSYFGKFYLVGLDARKAADWLFSADVSRPPGSTVYTCMLNHHGGTESDLTVSRLAPSHQASPLAPAFEGDGYYLAVGGAVAQHNWSHITTVLQDQKSQCQLIDSSEDLGMISIQGPAR

SEQ ID NO: 808572 - protein, 372 aa, Homo sapiens
MASLSRALRVAAAHPRQSPTRGMGPCNLSSAAGPTAEKSVPYQRTLKEGQGTSVVAQGPSRPLPSTANVVVIGGGSLGCQTLYHLAKLGMSGAVLLERERLTSGTTWHTAGLLWQLRPSDVEVELLAHTRRVVSRELEEETGLHTGWIQNGGLFIASNRQRLDEYKRLMSLGKAYGVESHVLSPAETKTLYPLMNVDDLYGTLYVPHDGTMDPAGTCTTLARAASARGAQVIENCPVTGIRVWTDDFGVRRVAGVETQHGSIQTPCVVNCAGVWASAVGRMAGVKVPLVAMHHAYVVTERIEGIQNMPNVRDHDASVYLRLQGDALSVGGYEANPIFWEEAVKYRPRAAGGLCLKTSTEKVCAVWSDDLRRA

SEQ ID NO: 808573 - protein, 170 aa, Homo sapiens
QQSPLLVLMFSIHPFYSLEARALLSRPGAGLALGTSVVLVGQPYLPGATVGCASCSPPFSSRPLWTRPHPAVSGAPAFSTASSSKVPMFGLEAIWRNGQVVGHVRRADFGFAIDKTIAYGYIHDPSGGPVSLDFVKSGDYALERMGVTYGAQAHLKSPFDPNNKRVKGIY

SEQ ID NO: 808574 - protein, 396 aa, Homo sapiens
MASLSRALRVAAAHPRQSPTRGMGPCNLSSAAGPTAEKSVPYQRTLKEGQGTSVVAQGPSRPLPSTANVVVIGGGSLGCQTLYHLAKLGMSGAVLLERERLTSGTTWHTAGLLWQLRPSDVEVELLAHTRRVVSRELEEETGLHTGWIQNGGLFIASNRQRLDEYKRLMSLGKAYGVESHVLSPAETKTLYPLMNVDDLYGTLYVPHDGTMDPAGTCTTLARAASARGAQVIENCPVTGIRVWTDDFGVRRVAGVETQHGSIQTPCVVNCAGVWASAVGRMAGVKVPLVAMHHAYVVTERIEGIQSFTLLPTLEYSGTVSAHCNLRLPGSSNSRASASHVAGIKCARHHTRLIFFCILVETEFHHVAKAGLELLSSGNPPISDFQSARITGVSHHA

SEQ ID NO: 808575 - protein, 918 aa, Homo sapiens; identical to SEQ ID NO: 808569

SEQ ID NO: 808576 - protein, 560 aa, Homo sapiens
GEAPELPHQGLWSGVKDSGPQTVDLIPVFSSRGPLMGEAPELRGFFLGCGFNSAGMMLGGGCGQELAHWIIHGRPEKDMHGYDIRRFHHSLTDHPRWIRERSHESYAKNYSVVFPHDEPLAGRNMRRDPLHEELLGQGCVFQERHGWERPGWFHPRGPAPVLEYDYYGAYGSRAHEDYAYRRLLADEYTFAFPPHHDTIKKECLACRGAAAVFDMSYFGKFYLVGLDARKAADWLFSADVSRPPGSTVYTCMLNHHGGTESDLTVSRLAPSHQASPLAPAFEGDGYYLAVGGAVAQHNWSHITTVLQDQKSQCQLIDSSEDLGMISIQGPASRAILQEVLDADLSNEAFPFSTHKLLRAAGHLVRAMRLSFVGELGWELHIPKASCVPVYRAVMAAGAKHGLINAGYRAIDSLSIEKGYRHWHADLRPDDSPLEAGLAFTCKLKSPVPFLGREALEQQRAAGLRRRLVCFTMEDKVPMFGLEAIWRNGQVVGHVRRADFGFAIDKTIAYGYIHDPSGGPVSLDFVKSGDYALERMGVTYGAQAHLKSPFDPNNKRVKGIY

SEQ ID NO: 808577 - protein, 283 aa, Homo sapiens
GLPWPHTVSPASKEQTQNYRSHIISGPRRWIGQPLPRHSWDFPPETLYLLGPWSDPQTRPSFGITDLGRPDGTGGHPCPHSPAGGWKGGFLDEEGDTGVLTHHQAKLQRPFTWTLPRAFWGSEPIPPRGRSLPSHVGAPQDSPALEPRQQTAMCGERGRSPMSLWGMRASAGPSVHNAHSLRATGVGWLWGRKLSSPKGGANGESGARSMLSHKGDSGAGDRGPGLPWVLGSPSLTGHPQSSDPSPVCGRRFHHSLTDHPRWIRERSHESYAKNYSVVFPHDE

SEQ ID NO: 808578 - protein, 564 aa, Homo sapiens
RSSWGHPREGRVCRERELLSSTGRAGSWLVLTPWPQRQVLPRAFGGDMELEELGIREECGVFGCIASGEWPTQLDVPHVITLGLVGLQHRGQESAGIVTSDGSSVPTFKSHKGMGLVNHVFTEDNLKKLYVSNLGIGHTRYATTGKCELENCQPFVVETLHGKIAVAHNGELVNAARLRKKLLRHGIGLSTSSDSEMITQLLAYTPPQEQDDTPDWVARIKNLMKEAPTAYSLLIMHRDVIYAVRDPYGNRPLCIGRLIPVSDINDKEKKTSETEGWVVSSESCSFLSIGARYYREVLPGEIVEISRHNVQTLDIISRSEGNPVAFCIFEYVYFARPDSMFEDQMVYTVRYRCGQQLAIEAPVDADLVSTVPESATPAALAYAGKCGLPYVEVLCKNRYVGRTFIQPNMRLRQLGVAKKFGVLSDNFKGKRIVLVDDSIVRGNTISPIIKLLKESGAKEVHIRVASPPIKYPCFMGINIPTKEELIANKPEFDHLAEYLGANSVVYLSVEGLVSSVQEGIKFKKQKEKKHDIMIQENGNGLECFEKSGHCTACLTGKYPVELEW

SEQ ID NO: 808579 - protein, 564 aa, Homo sapiens; identical to SEQ ID NO: 808578

SEQ ID NO: 808580 - protein, 368 aa, Homo sapiens
MITQLLAYTPPQEQDDTPDWVARIKNLMKEAPTAYSLLIMHRDVIYAVRDPYGNRPLCIGRLIPVSDINDKEKKTSETEGWVVSSESCSFLSIGARYYREVLPGEIVEISRHNVQTLDIISRSEGNPVAFCIFEYVYFARPDSMFEDQMVYTVRYRCGQQLAIEAPVDADLVSTVPESATPAALAYAGKCGLPYVEVLCKNRYVGRTFIQPNMRLRQLGVAKKFGVLSDNFKGKRIVLVDDSIVRGNTISPIIKLLKESGAKEVHIRVASPPIKYPCFMGINIPTKEELIANKPEFDHLAEYLGANSVVYLSVEGLVSSVQEGIKFKKQKEKKHDIMIQENGNGLECFEKSGHCTACLTGKYPVELEW

SEQ ID NO: 808581 - protein, 451 aa, Homo sapiens [sequence omitted]

SEQ ID NO: 808582 - protein, 106 aa, Homo sapiens
RKAKGEIYPSLNYSVCNYSLLTRFFLSKGILITFLFFPLSLGANSVVYLSVEGLVSSVQEGIKFKKQKEKKHDIMIQENGNGLECFEKSGHCTACLTGKYPVELEW

SEQ ID NO: 808583 - protein, 564 aa, Homo sapiens; identical to SEQ ID NO: 808578

SEQ ID NO: 808584 - protein, 469 aa, Homo sapiens
RSSWGHPREGRVCRERELLSSTGRAGSWLVLTPWPQRQVLPRAFGGDMELEELGIREECGVFGCIASGEWPTQLDVPHVITLGLVGLQHRGQESAGIVTSDGSSVPTFKSHKGMGLVNHVFTEDNLKKLYVSNLGIGHTRYATTGKCELENCQPFVVETLHGKIAVAHNGELVNAARLRKKLLRHGIGLSTSSDSEMITQLLAYTPPQEQDDTPDWVARIKNLMKEAPTAYSLLIMHRDVIYAVRDPYGNRPLCIGRLIPVSDINDKEKKTSETEGWVVSSESCSFLSIGARYYREVLPGEIVEISRHNVQTLDIISRSEGNPVAFCIFEYVYFARPDSMFEDQMVYTVRYRCGQQLAIEAPVDADLVSTVPESATPAALAYAGKCGLPYVEVLCKNRYVGRTFIQPNMRLRQLGVAKKFGVLSDNFKGKRIVLVDDSIVRGNTISPIIKLLKESGAKEVSNIKTYPKA

SEQ ID NO: 808585 - protein, 184 aa, Homo sapiens
RSSWGHPREGRVCRERELLSSTGRAGSWLVLTPWPQRQVLPRAFGGDMELEELGIREECGVFGCIASGEWPTQLDVPHVITLGLVGLQHRGQESAGIVTSDGSSVPTFKSHKGMGLVNHVFTEDNLKKLYVSNLGIGHTRYATTGKCELENCQPFVVETLHGKIPRSKLSIRPNASVRFLKQEH

SEQ ID NO: 808586 - protein, 756 aa, Homo sapiens
MASAPPASPPGSEPPGPDPEPGGPDGPGAAQLAPGPAELRLGAPVGGPDPQSPGLDEPAPGAAADGGARWSAGPAPGLEGGPRDPGPSAPPPRSGPRGQLASPDAPGPGPRSEAPLPELDPLFSWTEEPEECGPASCPESAPFRLQGSSSSHRARGEVDVFSPFPAPTAGELALEQGPGSPPQPSDLSQTHPLPSEPVGSQEDGPRLRAVFDALDGDGDGFVRIEDFIQFATVYGAEQVKDLTKYLDPSGLGVISFEDFYQGITAIRNGDPDGQCYGGVASAQDEEPLACPDEFDDFVTYEANEVTDSAYMGSESTYSECETFTDEDTSTLVHPELQPEGDADSAGGSAVPSECLDAMEEPDHGALLLLPGRPHPHGQSVITVIGGEEHFEDYGEGSEAELSPETLCNGQLGCSDPAFLTPSPTKRLSSKKVARYLHQSGALTMEALEDPSPELMEGPEEDIADKVVFLERRVLELEKDTAATGEQHSRLRQENLQLVHRANALEEQLKEQELRACEMVLEETRRQKELLCKMEREKSIEIENLQTRLQQLDEENSELRSCTPCLKANIERLEEEKQKLLDEIESLTLRLSEEQENKRRMGDRLSHERHQFQRDKEATQELIEDLRKQLEHLQLLKLEAEQRRGRSSSMGLQEYHSRARESELEQEVRRLKQDNRNLKEQNEELNGQIITLSIQGAKSLFSTAFSESLAAEISSVSRDELMEAIQKQEEINFRLQDYIDRIIVAIMETNPSILEVK

SEQ ID NO: 808587 - protein, 801 aa, Homo sapiens
MASAPPASPPGSEPPGPDPEPGGPDGPGAAQLAPGPAELRLGAPVGGPDPQSPGLDEPAPGAAADGGARWSAGPAPGLEGGPRDPGPSAPPPRSGPRGQLASPDAPGPGPRSEAPLPELDPLFSWTEEPEECGPASCPESAPFRLQGSSSSHRARGEVDVFSPFPAPTAGELALEQGPGSPPQPSDLSQTHPLPSEPVGSQEDGPRLRAVFDALDGDGDGFVRIEDFIQFATVYGAEQVKDLTKYLDPSGLGVISFEDFYQGITAIRNGDPDGQCYGGVASAQDEEPLACPDEFDDFVTYEANEVTDSAYMGSESTYSECETFTDEDTSTLVHPELQPEGDADSAGGSAVPSECLDAMEEPDHGALLLLPGRPHPHGQSVITVIGGEEHFEDYGEGSEAELSPETLCNGQLGCSDPAFLTPSTDPLAAKLHSILTDEAFEFYCSQCHKQINRLEDLSARLSDLEMNSPTKRLSSKKVARYLHQSGALTMEALEDPSPELMEGPEEDIADKVVFLERRVLELEKDTAATGEQHSRLRQENLQLVHRANALEEQLKEQELRACEMVLEETRRQKELLCKMEREKSIEIENLQTRLQQLDEENSELRSCTPCLKANIERLEEEKQKLLDEIESLTLRLSEEQENKRRMGDRLSHERHQFQRDKEATQELIEDLRKQLEHLQLLKLEAEQRRGRSSSMGLQEYHSRARESELEQEVRRLKQDNRNLKEQNEELNGQIITLSIQGAKSLFSTAFSESLAAEISSVSRDELMEAIQKQEEINFRLQDYIDRIIVAIMETNPSILEVK

SEQ ID NO: 808588 - protein, 289 aa, Homo sapiens
AGSLEVLRQLLGMGGATAHPAWRQLSSSLCLSRANALEEQLKEQELRACEMVLEETRRQKELLCKMEREKSIEIENLQTRLQQLDEENSELRSCTPCLKANIERLEEEKQKLLDEIESLTLRLSEEQENKRRMGDRLSHERHQFQRDKEATQELIEDLRKQLEHLQLLKLEAEQRRGRSSSMGLQEYHSRARESELEQEVRRLKQDNRNLKEQNEELNGQIITLSIQGAKSLFSTAFSESLAAEISSVSRDELMEAIQKQEEINFRLQDYIDRIIVAIMETNPSILEVK

SEQ ID NO: 808589 - protein, 801 aa, Homo sapiens; identical to SEQ ID NO: 808587

SEQ ID NO: 808590 - protein, 479 aa, Homo sapiens
MASAPPASPPGSEPPGPDPEPGGPDGPGAAQLAPGPAELRLGAPVGGPDPQSPGLDEPAPGAAADGGARWSAGPAPGLEGGPRDPGPSAPPPRSGPRGQLASPDAPGPGPRSEAPLPELDPLFSWTEEPEECGPASCPESAPFRLQGSSSSHRARGEVDVFSPFPAPTAGELALEQGPGSPPQPSDLSQTHPLPSEPVGSQEDGPRLRAVFDALDGDGDGFVRIEDFIQFATVYGAEQVKDLTKYLDPSGLGVISFEDFYQGITAIRNGDPDGQCYGGVASAQDEEPLACPDEFDDFVTYEANEVTDSAYMGSESTYSECETFTDEDTSTLVHPELQPEGDADSAGGSAVPSECLDAMEEPDHGALLLLPGRPHPHGQSVITVIGGEEHFEDYGEGSEAELSPETLCNGQLGCSDPAFLTPSTDPLAAKLHSILTDEAFEFYCSQCHKQINRLEDLSARLSDLEMNSPTKRLSSKKVAR

SEQ ID NO: 808591 - protein, 481 aa, Homo sapiens
MASAPPASPPGSEPPGPDPEPGGPDGPGAAQLAPGPAELRLGAPVGGPDPQSPGLDEPAPGAAADGGARWSAGPAPGLEGGPRDPGPSAPPPRSGPRGQLASPDAPGPGPRSEAPLPELDPLFSWTEEPEECGPASCPESAPFRLQGSSSSHRARGEVDVFSPFPAPTAGELALEQGPGSPPQPSDLSQTHPLPSEPVGSQEDGPRLRAVFDALDGDGDGFVRIEDFIQFATVYGAEQVKDLTKYLDPSGLGVISFEDFYQGITAIRNGDPDGQCYGGVASAQDEEPLACPDEFDDFVTYEANEVTDSAYMGSESTYSECETFTDEDTSTLVHPELQPEGDADSAGGSAVPSECLDAMEEPDHGALLLLPGRPHPHGQSVITVIGGEEHFEDYGEGSEAELSPETLCNGQLGCSDPAFLTPSTDPLAAKLHSILTDEAFEFYCSQCHKQINRLEDLSARLSDLEMNSPTKRLSSKKVASFV

SEQ ID NO: 808592 - protein, 436 aa, Homo sapiens
MASAPPASPPGSEPPGPDPEPGGPDGPGAAQLAPGPAELRLGAPVGGPDPQSPGLDEPAPGAAADGGARWSAGPAPGLEGGPRDPGPSAPPPRSGPRGQLASPDAPGPGPRSEAPLPELDPLFSWTEEPEECGPASCPESAPFRLQGSSSSHRARGEVDVFSPFPAPTAGELALEQGPGSPPQPSDLSQTHPLPSEPVGSQEDGPRLRAVFDALDGDGDGFVRIEDFIQFATVYGAEQVKDLTKYLDPSGLGVISFEDFYQGITAIRNGDPDGQCYGGVASAQDEEPLACPDEFDDFVTYEANEVTDSAYMGSESTYSECETFTDEDTSTLVHPELQPEGDADSAGGSAVPSECLDAMEEPDHGALLLLPGRPHPHGQSVITVIGGEEHFEDYGEGSEAELSPETLCNGQLGCSDPAFLTPSPTKRLSSKKVASFV

SEQ ID NO: 808593 - protein, 481 aa, Homo sapiens; identical to SEQ ID NO: 808591

SEQ ID NO: 808594 - protein, 596 aa, Homo sapiens
MASAPPASPPGSEPPGPDPEPGGPDGPGAAQLAPGPAELRLGAPVGGPDPQSPGLDEPAPGAAADGGARWSAGPAPGLEGGPRDPGPSAPPPRSGPRGQLASPDAPGPGPRSEAPLPELDPLFSWTEEPEECGPASCPESAPFRLQGSSSSHRARGEVDVFSPFPAPTAGELALEQGPGSPPQPSDLSQTHPLPSEPVGSQEDGPRLRAVFDALDGDGDGFVRIEDFIQFATVYGAEQVKDLTKYLDPSGLGVISFEDFYQGITAIRNGDPDGQCYGGVASAQDEEPLACPDEFDDFVTYEANEVTDSAYMGSESTYSECETFTDEDTSTLVHPELQPEGDADSAGGSAVPSECLDAMEEPDHGALLLLPGRPHPHGQSVITVIGGEEHFEDYGEGSEAELSPETLCNGQLGCSDPAFLTPSTDPLAAKLHSILTDEAFEFYCSQCHKQINRLEDLSARLSDLEMNSPTKRLSSKKVARYLHQSGALTMEALEDPSPELMEGPEEDIADKVVFLERRVLELEKDTAATGEQHSRLRQENLQLVHSRDALQEQMNRTQRAGGRPAKNAIQETDERRAMRKRSVTVQRLETGEQALRE

SEQ ID NO: 808595 - protein, 92 aa, Homo sapiens
KRGSQDSRVACSTPYGKHLPHPQLGGALAFSQKTIISVLLCRPHPHGQSVITVIGGEEHFEDYGEGSEAELSPETLCNGQLGCSDPAFLTPR

SEQ ID NO: 808596 - protein, 72 aa, Homo sapiens
PRLRAVFDALDGDGDGFVRIEDFIQFATVYGAEQVRSGPGRGVGTGQVALAGGVDVGPVDAAPGVGKGTVKT

SEQ ID NO: 808597 - protein, 756 aa, Homo sapiens; identical to SEQ ID NO: 808586

SEQ ID NO: 808598 - protein, 130 aa, Homo sapiens
MARGLPTIASLARLCQKLNRLKPLEDSTMETSLRRCLSTLDLTLLGVGGMVGSGLYVLTGAVAKEVAGPAVLLSFGVAAVASLLAALCYAEFGARVPRTGSAYLFTYVSTAQGIHNNNCLASHVACWRKK

SEQ ID NO: 808599 - protein, 635 aa, Homo sapiens
MARGLPTIASLARLCQKLNRLKPLEDSTMETSLRRCLSTLDLTLLGVGGMVGSGLYVLTGAVAKEVAGPAVLLSFGVAAVASLLAALCYAEFGARVPRTGSAYLFTYVSMGELWAFLIGWNVLLEYIIGGAAVARAWSGYLDSMFSHSIRNFTETHVGSWQVPLLGHYPDFLAAGIILLASAFVSCGARVSSWLNHTFSAISLLVILFIVILGFILAQPHNWSADEGGFAPFGFSGVMAGTASCFYAFVGFDVIAASSEEAQNPRRSVPLAIAISLAIAAGAYILVSTVLTLMVPWHSLDPDSALADAFYQRGYRWAGFIVAAGSICAMNTVLLSLLFSLPRIVYAMAADGLFFQVFAHVHPRTQVPVAGTLAFGLLTAFLALLLDLESLVQFLSLGTLLAYTFVATSIIVLRFQKSSPPSSPGPASPGPLTKQQSSFSDHLQLVGTVHASVPEPGELKPALRPYLGFLDGYSPGAVVTWALGVMLASAITIGCVLVFGNSTLHLPHWGYILLLLLTSVMFLLSLLVLGAHQQQYREDLFQIPMVPLIPALSIVLNICLMLKLSYLTWVRFSIWLLMGLAVYFGYGIRHSKENQRELPGLNSTHYVVFPRGSLEETVQAMQPPSQAPAQDPGHME

SEQ ID NO: 808600 - protein, 130 aa, Homo sapiens; identical to SEQ ID NO: 808598

SEQ ID NO: 808601 - protein, 578 aa, Homo sapiens
MARGLPTIASLARLCQKLNRLKPLEDSTMETSLRRCLSTLDLTLLGVGGMVGSGLYVLTGAVAKEVAGPAVLLSFGVAAVASLLDSMFSHSIRNFTETHVGSWQVPLLGHYPDFLAAGIILLASAFVSCGARVSSWLNHTFSAISLLVILFIVILGFILAQPHNWSADEGGFAPFGFSGVMAGTASCFYAFVGFDVIAASSEEAQNPRRSVPLAIAISLAIAAGAYILVSTVLTLMVPWHSLDPDSALADAFYQRGYRWAGFIVAAGSICAMNTVLLSLLFSLPRIVYAMAADGLFFQVFAHVHPRTQVPVAGTLAFGLLTAFLALLLDLESLVQFLSLGTLLAYTFVATSIIVLRFQKSSPPSSPGPASPGPLTKQQSSFSDHLQLVGTVHASVPEPGELKPALRPYLGFLDGYSPGAVVTWALGVMLASAITIGCVLVFGNSTLHLPHWGYILLLLLTSVMFLLSLLVLGAHQQQYREDLFQIPMVPLIPALSIVLNICLMLKLSYLTWVRFSIWLLMGLAVYFGYGIRHSKENQRELPGLNSTHYVVFPRGSLEETVQAMQPPSQAPAQDPGHME

SEQ ID NO: 808602 - protein, 614 aa, Homo sapiens
MTSFIGVLRVSNSEESSAIFLSDASIKTYAVATQEGMGLDHVLVSYLIHAVCDQLVSPPVRVLAALCYAEFGARVPRTGSAYLFTYVSMGELWAFLIGWNVLLEYIIGGAAVARAWSGYLDSMFSHSIRNFTETHVGSWQVPLLGHYPDFLAAGIILLASAFVSCGARVSSWLNHTFSAISLLVILFIVILGFILAQPHNWSADEGGFAPFGFSGVMAGTASCFYAFVGFDVIAASSEEAQNPRRSVPLAIAISLAIAAGAYILVSTVLTLMVPWHSLDPDSALADAFYQRGYRWAGFIVAAGSICAMNTVLLSLLFSLPRIVYAMAADGLFFQVFAHVHPRTQVPVAGTLAFGLLTAFLALLLDLESLVQFLSLGTLLAYTFVATSIIVLRFQKSSPPSSPGPASPGPLTKQQSSFSDHLQLVGTVHASVPEPGELKPALRPYLGFLDGYSPGAVVTWALGVMLASAITIGCVLVFGNSTLHLPHWGYILLLLLTSVMFLLSLLVLGAHQQQYREDLFQIPMVPLIPALSIVLNICLMLKLSYLTWVRFSIWLLMGLAVYFGYGIRHSKENQRELPGLNSTHYVVFPRGSLEETVQAMQPPSQAPAQDPGHME

SEQ ID NO: 808603 - protein, 635 aa, Homo sapiens; identical to SEQ ID NO: 808599

SEQ ID NO: 808604 - protein, 192 aa, Homo sapiens
LLGHYPDFLAAGIILLASAFVSCGARVSSWLNHTFSAISLLVILFIVILGFILAQPHNWSADEGGFAPFGFSGVMAGTASCFYAFVGFDVIAASSEEAQNPRRSVPLAIAISLAIAAGAYILVSTVLTLMVPWHSLDPDSALADAFYQRGYRWAGFIVAAGSICGERLFLGRVAGKRARGTLSSDSWGMHLQ

SEQ ID NO: 808605 - protein, 187 aa, Homo sapiens
MWCASPVAVVAFCAGLLVSHPVLTQGQEAGGRPGADCEVCKEFLNRFYKSLIDRGVNFSLDTIEKELISFCLDTKGKENRLCYYLGATKDAATKILSEVTRPMSVHMPAMKICEKLKKLDSQICELKYEKTLDLASVDLRKMRVAELKQILHSWGEECRACAEKTDYVNLIQELAPKYAATHPKTEL

SEQ ID NO: 808606 - protein, 78 aa, Homo sapiens
SPVAVVAFCAGLLVSHPVLTQGQEAGGRPGADCEGERCDNCLHGGGPALRRSSCRLWLLLALAINNIPPRKCRPCPSF

SEQ ID NO: 808607 - protein, 287 aa, Homo sapiens
RVTCAMEPKVAELKQKIEDTLCPFGFEVYPFQVAWYNELLPPAFHLPLPGPTLAFLVLSTPAMFDRALKPFLQSCHLRMLTDPVDQCVAYHLGRVRESLPELQIEIIADYEVHPNRRPKILAQTAAHVAGAAYYYQRQDVEADPWGNQRISGVCIHPRFGGWFAIRGVVLLPGIEVPDLPPRKPHDCVPTRADRIALLEGFNFHWRDWTYRDAVTPQERYSEEQKAYFSTPPAQRLALLGLAQPSEKPSSPSPDLPFTTPAPKKPGNPSRARSWLSPRVSPPASPGP

SEQ ID NO: 808608 - protein, 287 aa, Homo sapiens; identical to SEQ ID NO: 808607

SEQ ID NO: 808609 - protein, 287 aa, Homo sapiens; identical to SEQ ID NO: 808607

SEQ ID NO: 808610 - protein, 104 aa, Homo sapiens
DLHDLAFLHPPPQRISGVCIHPRFGGWFAIRGVVLLPGIEVPDLPPRKPHDCVPTRADRIALLEGFNFHWRDWTYRDAVTPQERYSEEQKAYFSTPPAQRLALL

SEQ ID NO: 808611 - protein, 593 aa, Homo sapiens
MAGERTRRLTRSLLRPGRRRAPAQPAASAAAVAVSSRQQQRQEKPRLLEPLDYETVIEELEKTYRNDPLQDLLFFPSDDFSAATVSWDIRTLYSTVPEDAEHKAENLLVKEACKFYSSQWHVVNYKYEQYSGDIRQLPRAEYKPEKLPSHSFEIDHEDADKDEDTTSHSSSKGGGGAGGTGVFKSGWLYKGNFNSTVNNTVTVRSFKKRYFQLTQLPDNSYIMNFYKDEKISKEPKGCIFLDSCTGVVQNNRLRKYAFELKMNDLTYFVLAAETESDMDEWIHTLNRILQISPEGPLQGRRSTELTDLGLDSLDNSVTCECTPEETDSSENNLHADFAKYLTETEDTVKTTRNMERLNLFSLDPDIDTLKLQKKDLLEPESVIKPFEEKAAKRIMIICKALNSNLQGCVTENENDPITNIEPFFVSVALYDLRDSRKISADFHVDLNHAAVRQMLLGASVALENGNIDTITPRQSEEPHIKGLPEEWLKFPKQAVFSVSNPHSEIVLVAKIEKVLMGNIASGAEPYIKNPDSNKYAQKILKSNRQFCSKLGKYRMPFAWAVRYVDSCSQQTRNTFNGGIGSFSFERFCVAYYF

SEQ ID NO: 808612 - protein, 123 aa, Homo sapiens
MAGERTRRLTRSLLRPGQAAELRHSLPRPPPRWQSAAGSSSGKKSLGFSSLWIMRLSLKNLKRPTGMILFKISCSSPVMTFQQPQFPGISARCTQQYLKMQSTRQKIYWLRRLVNFIVPSGMW

SEQ ID NO: 808613 - protein, 420 aa, Homo sapiens
MLKAVILIGGPQKGTRFRPLSFEVPKPLFPVAGVPMIQHHIEACAQVPGMQEILLIGFYQPDEPLTQFLEAAQQEFNLPVRYLQEFAPLGTGGGLYHFRDQILAGSPEAFFVLNADVCSDFPLSAMLEAHRRQRHPFLLLGTTANRTQSLNYGCIVENPQTHEVLHYVEKPSTFISDIINCGIYLFSPEALKPLRDVFQRNQQDGQLEDSPGLWPGAGTIRLEQDVFSALAGQGQIYVHLTDGIWSQIKSAGSALYASRLYLSRYQDTHPERLAKHTPGGPWIRGNVYIHPTAKVAPSAVLGPNVSIGKGVTVGEGVRLRESIVLHGATLQEHTCVLHSIVGWGSTVGRWARVEGTPSDPNPNDPRARMDSESLFKDGKLLPAITILGCRVRIPAEVLILNSIVLPHKELSRSFTNQIIL

SEQ ID NO: 808614 - protein, 420 aa, Homo sapiens; identical to SEQ ID NO: 808613

SEQ ID NO: 808615 - protein, 420 aa, Homo sapiens; identical to SEQ ID NO: 808613

SEQ ID NO: 808616 - protein, 207 aa, Homo sapiens
IELVPMQRTREDGQLEDSPGLWPGAGTIRLEQDVFSALAGQGQIYVHLTDGIWSQIKSAGSALYASRLYLSRYQDTHPERLAKHTPGGPWIRGNVYIHPTAKVAPSAVLGPNVSIGKGVTVGEGVRLRESIVLHGATLQEHTCVLHSIVGWGSTVGRWARVEGTPSDPNPNDPRARMDSESLFKDGKLLPAITILGSRVPCIGTEHR

SEQ ID NO: 808617 - protein, 182 aa, Homo sapiens
MLKAVILIGGPQKGTRFRPLSFEVPKPLFPVAGVPMIQHHIEACAQVLHYVEKPSTFISDIINCGIYLFSPEALKPLRDVFQRNQQDGQLEDSPGLWPGAGTIRLEQDVFSALAGQGQIYVHLTDGIWSQIKSAGSSLYGSGSTERYRKSPEGGKHTQGAWSRVFHSRTQCLVVGQSEGDGR

SEQ ID NO: 808618 - protein, 117 aa, Homo sapiens
MGQGGKQASAWGSLVIAPTQVGAGWERFLGCEQPHPREGRTRPGERGLERWWESSYSCPWETVLAPQSGLSWGTNVSILPLCQGGLTRLVARGRYHPPRAGCVFSPGRAGPDIRASH

SEQ ID NO: 808619 - protein, 146 aa, Homo sapiens
MLKAVILIGGPQKGTRFRPLSFEVPKPLFPVAGVPMIQHHIEACAQLEAGDQGAATNLSELRIGPSNAAHEWNRPGSDRQGAPWGGLCYIILFGPRGRRSQVGRRRWPEGEGWNPYRCRHPGGRRGTANIYLKPAMASVGDKATYT

SEQ ID NO: 808620 - protein, 107 aa, Homo sapiens
SPSRAYGVCFSPQLGPNVSIGKGVTVGEGVRLRESIVLHGATLQEHTCVLHSIVGWGSTVGRWARVEGTPSDPNPNDPRARMDSESLFKDGKLLPAITILGMASWGP

SEQ ID NO: 808621 - protein, 420 aa, Homo sapiens; identical to SEQ ID NO: 808613

SEQ ID NO: 808622 - protein, 420 aa, Homo sapiens; identical to SEQ ID NO: 808613

SEQ ID NO: 808623 - protein, 385 aa, Homo sapiens [sequence omitted]

SEQ ID NO: 808624 - protein, 295 aa, Homo sapiens
MLEAHRRQRHPFLLLGTTANRTQSLNYGCIVENPQTHEVLHYVEKPSTFISDIINCGIYLFSPEALKPLRDVFQRNQQDGQLEDSPGLWPGAGTIRLEQDVFSALAGQGQIYVHLTDGIWSQIKSAGSALYASRLYLSRYQDTHPERLAKHTPGGPWIRGNVYIHPTAKVAPSAVLGPNVSIGKGVTVGEGVRLRESIVLHGATLQEHTCVLHSIVGWGSTVGRWARVEGTPSDPNPNDPRARMDSESLFKDGKLLPAITILGCRVRIPAEVLILNSIVLPHKELSRSFTNQIIL

SEQ ID NO: 808625 - protein, 295 aa, Homo sapiens; identical to SEQ ID NO: 808624

SEQ ID NO: 808626 - protein, 295 aa, Homo sapiens; identical to SEQ ID NO: 808624

SEQ ID NO: 808627 - protein, 473 aa, Homo sapiens
MLKAVILIGGPQKGTRFRPLSFEVPKPLFPVAGVPMIQHHIEACAQVPGMQEILLIGFYQPDEPLTQFLEAAQQEFNLPVRYLQEFAPLGTGGGLYHFRDQILAGSPEAFFVLNADVCSDFPLSAMLEAHRRQRHPFLLLGTTANRTQSLNYGCIVENPQTHEVLHYVEKPSTFISDIINCGIYLFSPEALKPLRDVFQRNQQDGQLEDSPGLWPGAGTIRLEQDVFSALAGQGQIYVHLTDGIWSQIKSAGSALYASRLYLSRYQDTHPERLAKHTPGGPWIRGTQPAPIPNLWLPPQPSEPGFLTSSPELKPQSLPLPDQIRFGIFAPRASLLLLGNVYIHPTAKVAPSAVLGPNVSIGKGVTVGEGVRLRESIVLHGATLQEHTCVLHSIVGWGSTVGRWARVEGTPSDPNPNDPRARMDSESLFKDGKLLPAITILGCRVRIPAEVLILNSIVLPHKELSRSFTNQIIL

SEQ ID NO: 808628 - protein, 427 aa, Homo sapiens
MLKAVILIGGPQKGTRFRPLSFEVPKPLFPVAGVPMIQHHIEACAQVPGMQEILLIGFYQPDEPLTQFLEAAQQEFNLPVRYLQEFAPLGTGGGLYHFRDQILAGSPEAFFVLNADVCSDFPLSAMLEAHRRQRHPFLLLGTTANRTQSLNYGCIVENPQTHEVLHYVEKPSTFISDIINCGIYLFSPEALKPLRDVFQRNQQDGQLEDSPGLWPGAGTIRLEQDVFSALAGQGQIYVHLTDGIWSQIKSAGSALYASRLYLSRYQDTHPERLAKHTPGGPWIRGPLFCFYGNVYIHPTAKVAPSAVLGPNVSIGKGVTVGEGVRLRESIVLHGATLQEHTCVLHSIVGWGSTVGRWARVEGTPSDPNPNDPRARMDSESLFKDGKLLPAITILGCRVRIPAEVLILNSIVLPHKELSRSFTNQIIL

SEQ ID NO: 808629 - protein, 228 aa, Homo sapiens
IELVPMQRTREDGQLEDSPGLWPGAGTIRLEQDVFSALAGQGQIYVHLTDGIWSQIKSAGSALYASRLYLSRYQDTHPERLAKHTPGGPWIRGNVYIHPTAKVAPSAVLGPNVSIGKGVTVGEGVRLRESIVLHGATLQEHTCVLHSIVGWGSTVGRWARVEGTPSDPNPNDPRARMDSESLFKDGKLLPAITILGCRVRIPAEVLILNSIVLPHKELSRSFTNQIIL

SEQ ID NO: 808630 - protein, 222 aa, Homo sapiens [sequence omitted]

SEQ ID NO: 808631 - protein, 399 aa, Homo sapiens
MLKAVILIGGPQKGTRFRPLSFEVPKPLFPVAGVPMIQHHIEACAQVPGMQEILLIGFYQPDEPLTQFLEAAQQEFNLPVRYLQEFAPLGTGGGLYHFRDQILAGSPEAFFVLNADVCSDFPLSAMLEAHRRQRHPFLLLGTTANRTQSLNYGCIVENPQTHEVLHYVEKPSTFISDIINCGIYLFSPEALKPLRDVFQRNQQDGQLEDSPGLWPGAGTIRLEQDVFSALAGQGQIYVHLTDGIWSQIKSAGSALYASRLYLSRYQDTHPERLAKHTPGGPWIRGNVYIHPTAKVAPSAVLGPNVSIGKGVTVGEGVRLRESIVLHGATLQEHTCVLHSIVGWGSTVGRWARVEGTPSDPNPNDPRARMDSESLFKDGKLLPAITILGSRVPCIGTEHR

SEQ ID NO: 808632 - protein, 268 aa, Homo sapiens
MLKAVILIGGPQKGTRFRPLSFEVPKPLFPVAGVPMIQHHIEACAQVPGMQEILLIGFYQPDEPLTQFLEAAQQEFNLPVRYLQEFAPLGTGGGLYHFRDQILAGSPEAFFVLNADVCSDFPLSAMLEAHRRQRHPFLLLGTTANRTQSLNYGCIVENPQTHEVLHYVEKPSTFISDIINCGIYLFSPEALKPLRDVFQRNQQDGQLEDSPGLWPGAGTIRLEQDVFSALAGQGQIYVHLTDGIWSQIKSAGSALYSCAVVSAHFRCI

SEQ ID NO: 808633 - protein, 95 aa, Homo sapiens
CEKTRARKELAVAGGRAGVKGASGKGSWWRGGGRGKGQGTPSRRRAGSEVLAGPRCARPCVGPTIPGNERPGFIGQSQLWGSEGQQSINPPNPEI

SEQ ID NO: 808634 - protein, 147 aa, Homo sapiens
MAAQRLGKRVLSKLQSPSRARGPGGSPGGLQKRHARVTVKYDRRELQRRLDVEKWIDGRLEELYRGMEADMPDEINIDELLELESEEERSRKIQGLLKSCGKPVEDFIQELLAKLQGLHRQPGLRQPSPSHDGSLSPLQDRARTAHP

SEQ ID NO: 808635 - protein, 120 aa, Homo sapiens
MAAQRLGKRVLSKLQSPSRARGPGGSPGGLQKRHARVTVKYDRRELQRRLDVEKWIDGRLEELYRGMGLLKSCGKPVEDFIQELLAKLQGLHRQPGLRQPSPSHDGSLSPLQDRARTAHP

SEQ ID NO: 808636 - protein, 153 aa, Homo sapiens
MAAQRLGKRVLSKLQSPSRARGPGGSPGGLQKRHARVTVKYDRRELQRRLDVEKWIDGRLEELYRGMEADMPDEINIDELLELESEEERSRKIQGLLKSCGKPVEDFIQELLAKLQGLHRQPGLRQPSPSHDCSPLTLLHSPCPPDAAQLACV

SEQ ID NO: 808637 - protein, 121 aa, Homo sapiens
MAAQRLGKRVLSKLQSPSRARGPGGSPGGLQKRHARVTVKYDRRELQRRLDVEKWIDGRLEELYRGMEADMPDEINIDELLELESEEERSRKIQGLLKSCGKPVEVSFLSLILSLFWPQVL

SEQ ID NO: 808638 - protein, 585 aa, Homo sapiens
MARPDPSAPPSLLLLLLAQLVGRAAAASKAPVCQEITVPMCRGIGYNLTHMPNQFNHDTQDEAGLEVHQFWPLVEIQCSPDLRFFLCSMYTPICLPDYHKPLPPCRSVCERAKAGCSPLMRQYGFAWPERMSCDRLPVLGRDAEVLCMDYNRSEATTAPPRPFPAKPTLPGPPGAPASGGECPAGGPFVCKCREPFVPILKESHPLYNKVRTGQVPNCAVPCYQPSFSADERTFATFWIGLWSVLCFISTSTTVATFLIDMERFRYPERPIIFLSACYLCVSLGFLVRLVVGHASVACSREHNHIHYETTGPALCTIVFLLVYFFGMASSIWWVILSLTWFLAAGMKWGNEAIAGYAQYFHLAAWLIPSVKSITALALSSVDGDPVAGICYVGNQNLNSLRGFVLGPLVLYLLVGTLFLLAGFVSLFRIRSVIKQGGTKTDKLEKLMIRIGIFTLLYTVPASIVVACYLYEQHYRESWEAALTCACPGHDTGQPRAKPEYWVLMLKYFMCLVVGITSGVWIWSGKTVESWRRFTSRCCCRPRRGHKSGGAMAAGDYPEASAALTGRTGPPGPAATYHKQVSLSHV

SEQ ID NO: 808639 - protein, 142 aa, Homo sapiens
MAAVVAATALKGRGARNARVLRGILAGATANKASHNRTRALQSHSSPEGKEEPEPLSPELEYIPRKRGKNPMKAVGLAWAIGFPCGILLFILTKREVDKDRVKQMKARQNMRLSNTGEYESQRFRASSQSAPSPDVGSGVQT

SEQ ID NO: 808640 - protein, 175 aa, Homo sapiens
VVLLGPLCGLLGDVVSGLQAGRKERGRPLTQTTIPGGERGEAGVGSEHGGGGSCYGAEGPGGEKCPRPPGTRALQSHSSPEGKEEPEPLSPELEYIPRKRGKNPMKAVGLAWAIGFPCGILLFILTKREVDKDRVKQMKARQNMRLSNTGEYESQRFRASSQSAPSPDVGSGVQT

SEQ ID NO: 808641 - protein, 142 aa, Homo sapiens; identical to SEQ ID NO: 808639

SEQ ID NO: 808642 - protein, 99 aa, Homo sapiens
IWTALGPGSQLHDRPVGQVAHARARPRGTMTTSSSLGVSLIPTASPSCRIRHEVDKDRVKQMKARQNMRLSNTGEYESQRFRASSQSAPSPDVGSGVQT

SEQ ID NO: 808643 - protein, 117 aa, Homo sapiens
VIYSDLIPVLGSHSSPEGKEEPEPLSPELEYIPRKRGKNPMKAVGLAWAIGFPCGILLFILTKREVDKDRVKQMKARQNMRLSNTGEYESQLTRLLITGPGPCKATAPQRARRNLNP

SEQ ID NO: 808644 - protein, 130 aa, Homo sapiens
MAAVVAATALKGRGARNARVLRGKERDPGEGRTAEDPFSFTSSPTIAGGQGSWFLPTLFCKILESGGAEMLFRGHPVHPPAFGLLDTSGVLLQEGAPRKPVGLPRSRCFTLTAVQRKEPRASGGLSSSPG

SEQ ID NO: 808645 - protein, 92 aa, Homo sapiens
LMKLEGLPPAPLAQAWPLPKPRAHLPTRRAIGFPCGILLFILTKREVDKDRVKQMKARQNMRLSNTGEYESQRFRASSQSAPSPDVGSGVQT

SEQ ID NO: 808646 - protein, 255 aa, Homo sapiens [sequence omitted]

SEQ ID NO: 808647 - protein, 278 aa, Homo sapiens
MASPGAGRAAFPGGKGLFLNPRGGQKAPGGNILGREGLTPGRKVEVPWGIKRYQGAADSAPYDWFGDFSSFRALLEPELRPEDRILVLGCGNSALSYELFLGGFPNVTSVDYSSVVVAAMQARYAHVPQLRWETMDVRKLDFPSASFDVVLEKGTLDALLAGERDPWTVSSEGVHTVDQVLSEVSRVLVPGGRFISMTSAAPHFRTRHYAQAYYGWSLRHATYGSGFHFHLYLMHKGGKLSVAQLALGAQILSPPRPPTSPCFLQDSDHEDFLSAIQL

SEQ ID NO: 808648 - protein, 255 aa, Homo sapiens [sequence omitted]

SEQ ID NO: 808649 - protein, 255 aa, Homo sapiens [sequence omitted]

SEQ ID NO: 808650 - protein, 128 aa, Homo sapiens
GWQRREKLLGNLVTRSYSTSSVSSESLSSRRPLTGHRRSPHMDQYVSTAPPRFPIAQLGTFKQDSAGMGRIFKGNLLQKKALTTFENEHHIRFFTLLVLFHVMVLLRNHSRIQGVSEDWKRANSIFRK

SEQ ID NO: 808651 - protein, 1056 aa, Homo sapiens
MLSVVENGLDPQAAIPVIKKKLVGSVKALQKQYVSLDTVVTSEDGDANTMCSALEAVFIHGLHAKHIRAEAGGKRKKSAHQKPLPQPVFWPLLKAVTHKHIISELEHLTFVNTDVGRCRAWLRLALNDGLMECYLKLLLQEQARLHEYYQPTALLRDAEEGEFLLSFLQGLTSLSFELSYKSAILNEWTLTPLALSGLCPLSELDPLSTSGAELQRKESLDSISHSSGSEDIEVHHSGHKIRRNQKLTASSLSLDTASSSQLSCSLNSDSCLLQENGSKSPDHCEEPMSCDSDLGTANAEDSDRSLQEVLLEFSKAQVNSVPTNGLSQETEIPTPQASLSLHGLNTSTYLHCEAPAEPLPAQAASGTQDGVHVQEPRPQAPSPLDLQQPVESTSGQQPSSTVSETAREVGQGNGLQKAQAHDGAGLKLVVSSPTSPKNKSWISEDDFYRPSREQPLESASDHPIASYRGTPGSRPGLHRHFSQEPRKNCSLGALDQACVPSPGRRQAQAAPSQGHKSFRVVHRRQMGLSNPFRGLMKLGTVERRGAMGIWKELFCELSPLEFRLYLSNEEHTCVENCSLLRCESVGPAHSDGRFELVFSGKKLALRASSQDEAEDWLDRVREALQKVRPQQEDEWVNVQYPDQPEEPPEAPQGCLSPSDLLSEPAALQGTQFDWSSAQVPEPDAIKESLLYLYMDRTWMPYIFSLSLEALKCFRIRNNEKMLSDSHGVETIRDILPDTSLGGPSFFKIITAKAVLKLQAGNAEEAALWRDLVRKVLASYLETAEEAVTLGGSLDENCQEVLKFATRENGFLLQYLVAIPMEKGLDSQGCFCAGCSRQIGFSFVRPKLCAFSGLYYCDICHQDDASVIPARIIHNWDLTKRPICRQALKFLTQIRAQPLINLQMVNASLYEHVERMHLIGRRREQLKLLGDYLGLCRSGALKELSKRLNHRNYLLESPHRFSVADLQQIADGVYEGFLKALIEFASQHVYHCDLCTQRGFICQICQHHDIIFPFEFDTTVRCAECKTVFHQSCQAVVKKGCPRCARRRKYQEQNIFA

SEQ ID NO: 808652 - protein, 318 aa, Homo sapiens [sequence omitted]

SEQ ID NO: 808653 - protein, 336 aa, Homo sapiens [sequence omitted]

SEQ ID NO: 808654 - protein, 1039 aa, Homo sapiens
SLQRQGSLQRQGSLQQSGLDTVVTSEDGDANTMCSALEAVFIHGLHAKHIRAEAGGKRKKSAHQKPLPQPVFWPLLKAVTHKHIISELEHLTFVNTDVGRCRAWLRLALNDGLMECYLKLLLQEQARLHEYYQPTALLRDAEEGEFLLSFLQGLTSLSFELSYKSAILNEWTLTPLALSGLCPLSELDPLSTSGAELQRKESLDSISHSSGSEDIEVHHSGHKIRRNQKLTASSLSLDTASSSQLSCSLNSDSCLLQENGSKSPDHCEEPMSCDSDLGTANAEDSDRSLQEVLLEFSKAQVNSVPTNGLSQETEIPTPQASLSLHGLNTSTYLHCEAPAEPLPAQAASGTQDGVHVQEPRPQAPSPLDLQQPVESTSGQQPSSTVSETAREVGQGNGLQKAQAHDGAGLKLVVSSPTSPKNKSWISEDDFYRPSREQPLESASDHPIASYRGTPGSRPGLHRHFSQEPRKNCSLGALDQACVPSPGRRQAQAAPSQGHKSFRVVHRRQMGLSNPFRGLMKLGTVERRGAMGIWKELFCELSPLEFRLYLSNEEHTCVENCSLLRCESVGPAHSDGRFELVFSGKKLALRASSQDEAEDWLDRVREALQKVRPQQEDEWVNVQYPDQPEEPPEAPQGCLSPSDLLSEPAALQGTQFDWSSAQVPEPDAIKESLLYLYMDRTWMPYIFSLSLEALKCFRIRNNEKMLSDSHGVETIRDILPDTSLGGPSFFKIITAKAVLKLQAGNAEEAALWRDLVRKVLASYLETAEEAVTLGGSLDENCQEVLKFATRENGFLLQYLVAIPMEKGLDSQGCFCAGCSRQIGFSFVRPKLCAFSGLYYCDICHQDDASVIPARIIHNWDLTKRPICRQALKFLTQIRAQPLINLQMVNASLYEHVERMHLIGRRREQLKLLGDYLGLCRSGALKELSKRLNHRNYLLESPHRFSVADLQQIADGVYEGFLKALIEFASQHVYHCDLCTQRGFICQICQHHDIIFPFEFDTTVRCAECKTVFHQSCQAVVKKGCPRCARRRKYQEQNIFA

SEQ ID NO: 808655 - protein, 1056 aa, Homo sapiens; identical to SEQ ID NO: 808651

SEQ ID NO: 808656 - protein, 1056 aa, Homo sapiens; identical to SEQ ID NO: 808651

SEQ ID NO: 808657 - protein, 1056 aa, Homo sapiens; identical to SEQ ID NO: 808651

SEQ ID NO: 808658 - protein, 1015 aa, Homo sapiens
GRETASSARRLRGCRGRERPSPRSSLRLVSCDSLREQLREWRCFQWWRMDWTPRLPSRHIISELEHLTFVNTDVGRCRAWLRLALNDGLMECYLKLLLQEQARLHEYYQPTALLRDAEEGEFLLSFLQGLTSLSFELSYKSAILNEWTLTPLALSGLCPLSELDPLSTSGAELQRKESLDSISHSSGSEDIEVHHSGHKIRRNQKLTASSLSLDTASSSQLSCSLNSDSCLLQENGSKSPDHCEEPMSCDSDLGTANAEDSDRSLQEVLLEFSKAQVNSVPTNGLSQETEIPTPQASLSLHGLNTSTYLHCEAPAEPLPAQAASGTQDGVHVQEPRPQAPSPLDLQQPVESTSGQQPSSTVSETAREVGQGNGLQKAQAHDGAGLKLVVSSPTSPKNKSWISEDDFYRPSREQPLESASDHPIASYRGTPGSRPGLHRHFSQEPRKNCSLGALDQACVPSPGRRQAQAAPSQGHKSFRVVHRRQMGLSNPFRGLMKLGTVERRGAMGIWKELFCELSPLEFRLYLSNEEHTCVENCSLLRCESVGPAHSDGRFELVFSGKKLALRASSQDEAEDWLDRVREALQKVRPQQEDEWVNVQYPDQPEEPPEAPQGCLSPSDLLSEPAALQGTQFDWSSAQVPEPDAIKESLLYLYMDRTWMPYIFSLSLEALKCFRIRNNEKMLSDSHGVETIRDILPDTSLGGPSFFKIITAKAVLKLQAGNAEEAALWRDLVRKVLASYLETAEEAVTLGGSLDENCQEVLKFATRENGFLLQYLVAIPMEKGLDSQGCFCAGCSRQIGFSFVRPKLCAFSGLYYCDICHQDDASVIPARIIHNWDLTKRPICRQALKFLTQIRAQPLINLQMVNASLYEHVERMHLIGRRREQLKLLGDYLGLCRSGALKELSKRLNHRNYLLESPHRFSVADLQQIADGVYEGFLKALIEFASQHVYHCDLCTQRGFICQICQHHDIIFPFEFDTTVRCAECKTVFHQSCQAVVKKGCPRCARRRKYQEQNIFA

SEQ ID NO: 808659 - protein, 928 aa, Homo sapiens
MLSVVENGLDPQAAIPVIKKKLVGSVKALQKQYVSLDTVVTSEDGDANTMCSALEAVFIHGLHAKHIRAEAGGKRKKSAHQKPLPQPVFWPLLKAVTHKHIISELEHLTFVNTDVGRCRAWLRLALNDGLMECYLKLLLQEQARLHEYYQPTALLRDAEEGEFLLSFLQGLTSLSFELSYKSAILNEWTLTPLALSGLCPLSELDPLSTSGAELQRKESLDSISHSSGSEDIEVHHSGHKIRRNQKLTASSLSLDTASSSQLSCSLNSDSCLLQENGSKSPDHCEEPMSCDSDLGTANAEDSDRSLQEKTRAGSQRMTSTGLPGSNPWRVLQTTQVASYRGTPGSRPGLHRHFSQEPRKNCSLGALDQACVPSPGRRQAQAAPSQGHKSFRVVHRRQMGLSNPFRGLMKLGTVERRGAMGIWKELFCELSPLEFRLYLSNEEHTCVENCSLLRCESVGPAHSDGRFELVFSGKKLALRASSQDEAEDWLDRVREALQKVRPQQEDEWVNVQYPDQPEEPPEAPQGCLSPSDLLSEPAALQGTQFDWSSAQVPEPDAIKESLLYLYMDRTWMPYIFSLSLEALKCFRIRNNEKMLSDSHGVETIRDILPDTSLGGPSFFKIITAKAVLKLQAGNAEEAALWRDLVRKVLASYLETAEEAVTLGGSLDENCQEVLKFATRENGFLLQYLVAIPMEKGLDSQGCFCAGCSRQIGFSFVRPKLCAFSGLYYCDICHQDDASVIPARIIHNWDLTKRPICRQALKFLTQIRAQPLINLQMVNASLYEHVERMHLIGRRREQLKLLGDYLGLCRSGALKELSKRLNHRNYLLESPHRFSVADLQQIADGVYEGFLKALIEFASQHVYHCDLCTQRGFICQICQHHDIIFPFEFDTTVRCAECKTVFHQSCQAVVKKGCPRCARRRKYQEQNIFA

SEQ ID NO: 808660 - protein, 1056 aa, Homo sapiens; identical to SEQ ID NO: 808651

SEQ ID NO: 808661 - protein, 1037 aa, Homo sapiens
MLSVVENGLDPQAAIPVIKKKLVGSVKALQKQYVSLDTVVTSEDGDANTMCSALEAVFIHGLHAKHIRAEAGGKRKKSAHQKPLPQPVFWPLLKAVTHKHIISELEHLTFVNTDVGRCRAWLRLALNDGLMECYLKLLLQEQARLHEYYQPTALLRDAEEGEFLLSFLQGLTSLSFELSYKSAILNEWTLTPLALSGLCPLSELDPLSTSGAELQRKESLDSISHSSGSEDIEVHHSGHKIRRNQKLTASSLSLDTASSSQLSCSLNSDSCLLQENGSKSPDHCEEPMSCDSDLGTANAEDSDRSLQEVLLEFSKAQVNSVPTNGLSQETEIPTPQASLSLHGLNTSTYLHCEAPAEPLPAQAASGTQDGVHVQEPRPQAPSPLDLQQPVESTSGQQPSSTVSETAREVGQGNGLQKAQAHDGAGLKLVVSSPTSPKNKSWISEDDFYRPSREQPLESASDHPIASYRGTPGSRPGLHRHFSQEPRKNCSLGALDQACVPSPGRRQAQAAPSQGHKSFRVVHRRQMGLSNPFRGLMKLGTVERRGAMGIWKELFCELSPLEFRLYLSNEEHTCVENCSLLRCESVGPAHSDGRFELVFSGKKLALRASSQDEAEDWLDRVREALQKVRPQQEDEWVNVQYPDQPEEPPEAPQGCLSPSDLLSEPAALQGTQFDWSSAQVPEPDAIKESLLYLYMDRTWMPYIFSLSLEALKCFRIRNNEKMLSDSHGVETIRDILPDTSLGGPSFFKIITAKAVLKLQAGNAEEAALWRDLVRKVLASYLETAEEAVTLGGSLDENCQEVLKFATRENGFLLQYLVAIPMEKGLDSQGCFCAGCSRQIGFSFVRPKLCAFSGLYYCDICHQDDASVIPARIIHNWDLTKRPICRQALKFLTQIRAQPLINLQMVNASLYEHVERMHLIGRRREQLKLLGDYLGLCRSGALKELSKRLNHRNYLLESPHRFSVADLQQHVYHCDLCTQRGFICQICQHHDIIFPFEFDTTVRCAECKTVFHQSCQAVVKKGCPRCARRRKYQEQNIFA

SEQ ID NO: 808662 - protein, 539 aa, Homo sapiens
MCPFLPLPPGLSNPFRGLMKLGTVERRGAMGIWKELFCELSPLEFRLYLSNEEHTCVENCSLLRCESVGPAHSDGRFELVFSGKKLALRASSQDEAEDWLDRVREALQKVRPQQEDEWVNVQYPDQPEEPPEAPQGCLSPSDLLSEPAALQGTQFDWSSAQVPEPDAIKESLLYLYMDRTWMPYIFSLSLEALKCFRIRNNEKMLSDSHGVETIRDILPDTSLGGPSFFKIITAKAVLKLQAGNAEEAALWRDLVRKVLASYLETAEEAVTLGGSLDENCQEVLKFATRENGFLLQYLVAIPMEKGLDSQGCFCAGCSRQIGFSFVRPKLCAFSGLYYCDICHQDDASVIPARIIHNWDLTKRPICRQALKFLTQIRAQPLINLQMVNASLYEHVERMHLIGRRREQLKLLGDYLGLCRSGALKELSKRLNHRNYLLESPHRFSVADLQQIADGVYEGFLKALIEFASQHVYHCDLCTQRGFICQICQHHDIIFPFEFDTTVRCAECKTVFHQSCQAVVKKGCPRCARRRKYQEQNIFA

SEQ ID NO: 808663 - protein, 199 aa, Homo sapiens
MAPGQAVLTEQPFLPIPNAWWYPQICRQALKFLTQIRAQPLINLQMVNASLYEHVERMHLIGRRREQLKLLGDYLGLCRSGALKELSKRLNHRNYLLESPHRFSVADLQQIADGVYEGFLKALIEFASQHVYHCDLCTQRGFICQICQHHDIIFPFEFDTTVRCAECKTVFHQSCQAVVKKGCPRCARRRKYQEQNIFA

SEQ ID NO: 808664 - protein, 164 aa, Homo sapiens
PKSLIAEQVNIPARRMMRWGDGSRKVVRVLECPVSLHWRWHLGKSGCVIQGCGASDFRSRSNWKWFQEKPLSFSHTRPYRKPTQVGEMSILRRNERFKSLMWKGDLGSIFNSTFLIKRSSFLRWVFPIHISTESIFLFLTLRESPMKSRHSHPQRMHRSHSGLA

SEQ ID NO: 808665 - protein, 1056 aa, Homo sapiens; identical to SEQ ID NO: 808651

SEQ ID NO: 808666 - protein, 558 aa, Homo sapiens
MLSVVENGLDPQAAIPVIKKKLVGSVKALQKQYVSLDTVVTSEDGDANTMCSALEAVFIHGLHAKHIRAEAGGKRKKSAHQKPLPQPVFWPLLKAVTHKHIISELEHLTFVNTDVGRCRAWLRLALNDGLMECYLKLLLQEQARLHEYYQPTALLRDAEEGEFLLSFLQGLTSLSFELSYKSAILNEWTLTPLALSGLCPLSELDPLSTSGAELQRKESLDSISHSSGSEDIEVHHSGHKIRRNQKLTASSLSLDTASSSQLSCSLNSDSCLLQENGSKSPDHCEEPMSCDSDLGTANAEDSDRSLQEVLLEFSKAQVNSVPTNGLSQETEIPTPQASLSLHGLNTSTYLHCEAPAEPLPAQAASGTQDGVHVQEPRPQAPSPLDLQQPVESTSGQQPSSTVSETAREVGQGNGLQKAQAHDGAGLKLVVSSPTSPKNKSWISEDDFYRPSREQPLESASDHPIASYRGTPGSRPGLHRHFSQEPRKNCSLGALDQACVPSPGRRQAQAAPSQGHKSFRVVHRRQMGRLPGGSRVGPICRDQAFQKAAVKFCFPLLKG

SEQ ID NO: 808667 - protein, 458 aa, Homo sapiens
MLSVVENGLDPQAAIPVIKKKLVGSVKALQKQYVSLDTVVTSEDGDANTMCSALEAVFIHGLHAKHIRAEAGGKRKKSAHQKPLPQPVFWPLLKAVTHKHIISELEHLTFVNTDVGRCRAWLRLALNDGLMECYLKLLLQEQARLHEYYQPTALLRDAEEGEFLLSFLQGLTSLSFELSYKSAILNEWTLTPLALSGLCPLSELDPLSTSGAELQRKESLDSISHSSGSEDIEVHHSGHKIRRNQKLTASSLSLDTASSSQLSCSLNSDSCLLQENGSKSPDHCEEPMSCDSDLGTANAEDSDRSLQEVLLEFSKAQVNSVPTNGLSQETEIPTPQASLSLHGLNTSTYLHCEAPAEPLPAQAASGTQDGVHVQEPRPQAPSPLDLQQPVESTSGQQPSSTVSETAREVGQGNGLQKAQAHDGAGLKLVVSSPTSPVSGASRSGGSLGKCQLTQGFPS

SEQ ID NO: 808668 - protein, 141 aa, Homo sapiens
GRETASSARRLRGCRGRERPSPRSSLRLVSCDSLREQLRELEMLSVVENGLDPQAAIPVIKKKLVGSVKALQKQYVSLDTVVTSEDGDANTMCSALEAVFIHGLHAKHIRAEAGGKRKKSAHQKPLPQPVFWPLLKAVTHK

SEQ ID NO: 808669 - protein, 80 aa, Homo sapiens
LCAFSGLYYCDICHQDDASVIPARIIHNWDLTKRPVSLKPSSPAAEGQRGVHSSLLLLFICLEEFGSSKQGKPGSLVQAL

SEQ ID NO: 808670 - protein, 470 aa, Homo sapiens
MHFSIPETESRSGDSGGSAYVAYNIHVNGVLHCRVRYSQLLGLHEQLRKEYGANVLPAFPPKKLFSLTPAEVEQRREQLEKYMQAVRQDPLLGSSETFNSFLRRAQQETQQVPTEEVSLEVLLSNGQKVLVNVLTSDQTEDVLEAVAAKLDLPDDLIGYFSLFLVREKEDGAFSFVRKLQEFELPYVSVTSLRSQEYKIVLRKSYWDSAYDDDVMENRVGLNLLYAQTVSDIERGWILVTKEQHRQLKSLQEKVSKKEFLRLAQTLRHYGYLRFDACVADFPEKDCPVVVSAGNSELSLQLRLPGQQLREGSFRVTRMRCWRVTSSVPLPSGSTSSPGRGRGEVRLELAFEYLMSKDRLQWVTITSPQAIMMSICLQSMVDELMVKKSGGSIRKMLRRRVGGTLRRSDSQQAVKSPPLLESPDATRESMVKLSSKLSAVSLRGIGSPSTDASASDVHGNFAFEGIGDEDL

SEQ ID NO: 808671 - protein, 117 aa, Homo sapiens [sequence omitted]

SEQ ID NO: 808672 - protein, 117 aa, Homo sapiens [sequence omitted]

SEQ ID NO: 808673 - protein, 265 aa, Homo sapiens
MHFSIPETESRSGDSGGSAYVAYNIHVNGVLHCRVRYSQLLGLHEQLRKEYGANVLPAFPPKKLFSLTPAEVEQRREQLEKYMQAVRQDPLLGSSETFNSFLRRAQQETQQVPTEEVSLEVLLSNGQKVLVNVLTSDQTEDVLEAVAAKLDLPDDLIGYFSLFLVREKEDGAFSFVRKLQEFELPYVSVTSLRSQEYKIVLRKRTSYGDSGYDDDVWGTGGLEPVYAPTVRFERGGLGARTAGTNSGKIQRSKGHWAMMLSGGPK

SEQ ID NO: 808674 - protein, 212 aa, Homo sapiens
MHFSIPETESRSGDSGGSAYVAYNIHVNGVLHCRVRYSQLLGLHEQLRKEYGANVLPAFPPKKLFSLTPAEVEQRREQLEKYMQAVRQDPLLGSSETFNSFLRRAQQETQQVPTEEVSLEVLLSNGQKVLVNVLTSDQTEDVLEAVAAKLDLPDDLIGYFSLFLVREKEDGAFSFVRSAELSCYVSVTTFGSELEGAGSWARLKQSGTGGRP

SEQ ID NO: 808675 - protein, 470 aa, Homo sapiens; identical to SEQ ID NO: 808670

SEQ ID NO: 808676 - protein, 470 aa, Homo sapiens; identical to SEQ ID NO: 808670

SEQ ID NO: 808677 - protein, 470 aa, Homo sapiens; identical to SEQ ID NO: 808670

SEQ ID NO: 808678 - protein, 470 aa, Homo sapiens; identical to SEQ ID NO: 808670

SEQ ID NO: 808679 - protein, 452 aa, Homo sapiens
MHFSIPETESRSGDSGGSAYVAYNIHVNGVLHCRVRYSQLLGLHEQLRKEYGANVLPAFPPKKLFSLTPAEVEQRREQLEKYMQAVRQDPLLGSSETFNSFLRRAQQETQQVPTEEVSLEVLLSNGQKVLVNVLTSDQTEDVLEAVAAKLDLPDDLIGYFSLFLVREKEDGAFSFVRKLQEFELPYVSVTSLRSQEYKIVLRKSYWDSAYDDDVMENRVGLNLLYAQTVSDIERGWILVTKEQHRQLKSLQEKVSKKEFLRLAQTLRHYGYLRFDACVADFPVRLPGQQLREGSFRVTRMRCWRVTSSVPLPSGSTSSPGRGRGEVRLELAFEYLMSKDRLQWVTITSPQAIMMSICLQSMVDELMVKKSGGSIRKMLRRRVGGTLRRSDSQQAVKSPPLLESPDATRESMVKLSSKLSAVSLRGIGSPSTDASASDVHGNFAFEGIGDEDL

SEQ ID NO: 808680 - protein, 470 aa, Homo sapiens; identical to SEQ ID NO: 808670

SEQ ID NO: 808681 - protein, 422 aa, Homo sapiens
MHFSIPETESRSGDSGGSAYVAYNIHVNGVLHCRVRYSQLLGLHEQLRKEYGANVLPAFPPKKLFSLTPAEVEQRREQLEKYMQAVRQDPLLGSSETFNSFLRRAQQETQQVPTEEVSLEVLLSNGQKVLVNVLTSDQTEDVLEAVAAKLDLPDDLIGYFSLFLVREKEDGAFSFVRKLQEFELPYVSVTSLRSQEYKIVLRKSYWDSAYDDDVMENRVGLNLLYAQTVSDIERGWILVTKEQHRQLKSLQEKVSKKEFLRLAQTLRHYGYLRFDACVADFPEKDCPVVVSAGNSELSLQLRLPGQQLREGSFRVTRMRCWRVTSSVPLPSGSTSSPGRGRGEVRLELAFEYLMSKDRLQWVTITSPQAIMMSICLQSMVDELMVKKSGGSIRKMLRRRVGGTLRRSDSQQAVKSPPLLEST

SEQ ID NO: 808682 - protein, 455 aa, Homo sapiens
MHFSIPETESRSGDSGGSAYVAYNIHVNGVLHCRVRYSQLLGLHEQLRKEYGANVLPAFPPKKLFSLTPAEVEQRREQLEKYMQAVRQDPLLGSSETFNSFLRRAQQETQQVPTEEVSLEVLLSNGQKVLVNVLTSDQTEDVLEAVAAKLDLPDDLIGYFSLFLVREKEDGAFSFVRKLQEFELPYVSVTSLRSQEYKIVLRKSYWDSAYDDDVMENRVGLNLLYAQTVSDIERGWILVTKEQHRQLKSLQEKVSKKEFLRLAQTLRHYGYLRFDACVADFPEKDCPVVVSAGNSELSLQLRLPGQQLREGSFRVTRMRCWRVTSSVPLPSGSTSSPGRGRGEVRLELAFEYLMSKDRLQWVTITSPQAIMMSICLQSMVDELMVKKSGGSIRKVGSKCGLSSEQMLRRRVGGTLRRSDSQQAVKSPPLLESPDATRESMVKLSSKLSAGGWGNG

SEQ ID NO: 808683 - protein, 470 aa, Homo sapiens; identical to SEQ ID NO: 808670

SEQ ID NO: 808684 - protein, 473 aa, Homo sapiens
MPRRLRPRTDVPPPSHIGSQGSQNAYNIHVNGVLHCRVRYSQLLGLHEQLRKEYGANVLPAFPPKKLFSLTPAEVEQRREQLEKYMQAVRQDPLLGSSETFNSFLRRAQQETQQVPTEEVSLEVLLSNGQKVLVNVLTSDQTEDVLEAVAAKLDLPDDLIGYFSLFLVREKEDGAFSFVRKLQEFELPYVSVTSLRSQEYKIVLRKSYWDSAYDDDVMENRVGLNLLYAQTVSDIERGWILVTKEQHRQLKSLQEKVSKKEFLRLAQTLRHYGYLRFDACVADFPEKDCPVVVSAGNSELSLQLRLPGQQLREGSFRVTRMRCWRVTSSVPLPSGSTSSPGRGRGEVRLELAFEYLMSKDRLQWVTITSPQAIMMSICLQSMVDELMVKKSGGSIRKMLRRRVGGTLRRSDSQQAVKSPPLLESPDATRESMVKLSSKLSAVSLRGIGSPSTDASASDVHGNFAFEGIGDEDL

SEQ ID NO: 808685 - protein, 256 aa, Homo sapiens
MENRVGLNLLYAQTVSDIERGWILVTKEQHRQLKSLQEKVSKKEFLRLAQTLRHYGYLRFDACVADFPEKDCPVVVSAGNSELSLQLRLPGQQLREGSFRVTRMRCWRVTSSVPLPSGSTSSPGRGRGEVRLELAFEYLMSKDRLQWVTITSPQAIMMSICLQSMVDELMVKKSGGSIRKMLRRRVGGTLRRSDSQQAVKSPPLLESPDATRESMVKLSSKLSAVSLRGIGSPSTDASASDVHGNFAFEGIGDEDL

SEQ ID NO: 808686 - protein, 388 aa, Homo sapiens
MQAVRQDPLLGSSETFNSFLRRAQQETQQVPTEEVSLEVLLSNGQKVLVNVLTSDQTEDVLEAVAAKLDLPDDLIGYFSLFLVREKEDGAFSFVRKLQEFELPYVSVTSLRSQEYKIVLRKSYWDSAYDDDVMENRVGLNLLYAQTVSDIERGWILVTKEQHRQLKSLQEKVSKKEFLRLAQTLRHYGYLRFDACVADFPEKDCPVVVSAGNSELSLQLRLPGQQLREGSFRVTRMRCWRVTSSVPLPSGSTSSPGRGRGEVRLELAFEYLMSKDRLQWVTITSPQAIMMSICLQSMVDELMVKKSGGSIRKMLRRRVGGTLRRSDSQQAVKSPPLLESPDATRESMVKLSSKLSAVSLRGIGSPSTDASASDVHGNFAFEGIGDEDL

SEQ ID NO: 808687 - protein, 388 aa, Homo sapiens
MPQVRQDPLLGSSETFNSFLRRAQQETQQVPTEEVSLEVLLSNGQKVLVNVLTSDQTEDVLEAVAAKLDLPDDLIGYFSLFLVREKEDGAFSFVRKLQEFELPYVSVTSLRSQEYKIVLRKSYWDSAYDDDVMENRVGLNLLYAQTVSDIERGWILVTKEQHRQLKSLQEKVSKKEFLRLAQTLRHYGYLRFDACVADFPEKDCPVVVSAGNSELSLQLRLPGQQLREGSFRVTRMRCWRVTSSVPLPSGSTSSPGRGRGEVRLELAFEYLMSKDRLQWVTITSPQAIMMSICLQSMVDELMVKKSGGSIRKMLRRRVGGTLRRSDSQQAVKSPPLLESPDATRESMVKLSSKLSAVSLRGIGSPSTDASASDVHGNFAFEGIGDEDL

SEQ ID NO: 808688 - protein, 329 aa, Homo sapiens
MHFSIPETESRSGDSGGSAYVAYNIHVNGVLHCRVRYSQLLGLHEQLRKEYGANVLPAFPPKKLFSLTPAEVEQRREQLEKYMQAVRQDPLLGSSETFNSFLRRAQQETQQVPTEEVSLEVLLSNGQKVLVNVLTSDQTEDVLEAVAAKLDLPDDLIGYFSLFLVREKEDGAFSFVRKLQEFELPYVSVTSLRSQEYKIVLRKSYWDSAYDDDVMENRVGLNLLYAQTVSDIERGWILVTKEQHRQLKSLQEKVSKKEFLRLAQTLRHYGYLRFDACVADFPEKDCPVVVSAGNSELSLQLRLPGQQLREGSFRVTRMRSQTVGSVDRR

SEQ ID NO: 808689 - protein, 408 aa, Homo sapiens
MKSKKSQPIFKQLRIKTHRDLEIELGIGQGKGQGSASHPHVCSQQETQQVPTEEVSLEVLLSNGQKVLVNVLTSDQTEDVLEAVAAKLDLPDDLIGYFSLFLVREKEDGAFSFVRKLQEFELPYVSVTSLRSQEYKIVLRKSYWDSAYDDDVMENRVGLNLLYAQTVSDIERGWILVTKEQHRQLKSLQEKVSKKEFLRLAQTLRHYGYLRFDACVADFPEKDCPVVVSAGNSELSLQLRLPGQQLREGSFRVTRMRCWRVTSSVPLPSGSTSSPGRGRGEVRLELAFEYLMSKDRLQWVTITSPQAIMMSICLQSMVDELMVKKSGGSIRKMLRRRVGGTLRRSDSQQAVKSPPLLESPDATRESMVKLSSKLSAVSLRGIGSPSTDASASDVHGNFAFEGIGDEDL

SEQ ID NO: 808690 - protein, 153 aa, Homo sapiens
MRCWRVTSSVPLPSGSTSSPGRGRGEVRLELAFEYLMSKDRLQWVTITSPQAIMMSICLQSMVDELMVKKSGGSIRKMLRRRVGGTLRRSDSQQAVKSPPLLESPDATRESMVKLSSKLSAVSLRGIGSPSTDASASDVHGNFAFEGIGDEDL

SEQ ID NO: 808691 - protein, 236 aa, Homo sapiens
MHFSIPETESRSGDSGGSAYVAYNIHVNGVLHCRVRYSQLLGLHEQLRKEYGANVLPAFPPKKLFSLTPAEVEQRREQLEKYMQAVRQDPLLGSSETFNSFLRRAQQETQQVPTEEVSLEVLLSNGQKVLVNVLTSDQTEDVLEAVAAKLDLPDDLIGYFSLFLVREKEDGAFSFVRKLQEFELPYVSVTSLRSQEYKIVLRKRRYQILSVGGSWSPRNSTGNSNLCKRKSPRRSS

SEQ ID NO: 808692 - protein, 265 aa, Homo sapiens; identical to SEQ ID NO: 808673

SEQ ID NO: 808693 - protein, 212 aa, Homo sapiens; identical to SEQ ID NO: 808674

SEQ ID NO: 808694 - protein, 69 aa, Homo sapiens
MQAVRQDPLLGSSETFNSFLRRAQQETQQVPTEEVSLEVLLSNGQKVLVNVLTSDQTEDVLELSIVLQG

SEQ ID NO: 808695 - protein, 511 aa, Homo sapiens
ISFRAGALDCITVPVVFTINERAEPLRPSQSGARPCRAVGNMHFSIPETESRSGDSGGSAYVAYNIHVNGVLHCRVRYSQLLGLHEQLRKEYGANVLPAFPPKKLFSLTPAEVEQRREQLEKYMQAVRQDPLLGSSETFNSFLRRAQQETQQVPTEEVSLEVLLSNGQKVLVNVLTSDQTEDVLEAVAAKLDLPDDLIGYFSLFLVREKEDGAFSFVRKLQEFELPYVSVTSLRSQEYKIVLRKSYWDSAYDDDVMENRVGLNLLYAQTVSDIERGWILVTKEQHRQLKSLQEKVSKKEFLRLAQTLRHYGYLRFDACVADFPEKDCPVVVSAGNSELSLQLRLPGQQLREGSFRVTRMRCWRVTSSVPLPSGSTSSPGRGRGEVRLELAFEYLMSKDRLQWVTITSPQAIMMSICLQSMVDELMVKKSGGSIRKMLRRRVGGTLRRSDSQQAVKSPPLLESPDATRESMVKLSSKLSAVSLRGIGSPSTDASASDVHGNFAFEGIGDEDL

SEQ ID NO: 808696 - protein, 397 aa, Homo sapiens
MHFSIPETESRSGDSGGSAYVAYNIHVNGVLHCRVRYSQLLGLHEQLRKEYGANVLPAFPPKKLFSLTPAEVEQRREQLEKYMQAVRQDPLLGSSETFNSFLRRAQQETQQVPTEEVSLEVLLSNGQKVLVNVLTSDQTEDVLEAVAAKLDLPDDLIGYFSLFLVREKEDGAFSFVRKLQEFELPYVSVTSLRSQEYKIVLRKSYWDSAYDDDVMENRVGLNLLYAQTVSDIERGWILVTKEQHRQLKSLQEKVSKKEFLRLAQTLRHYGYLRFDACVADFPEKDCPVVVSAGNSELSLQLRLPGQQLREGSFRVTRMRCWRVTSSVPLPSGSTSSPGRGRGEVRLELAFEYLWFPLTAPASPITAWTTMLRVRPNCLPLPIQHRHGFVSVSFIIKH

SEQ ID NO: 808697 - protein, 256 aa, Homo sapiens; identical to SEQ ID NO: 808685

SEQ ID NO: 808698 - protein, 388 aa, Homo sapiens; identical to SEQ ID NO: 808686

SEQ ID NO: 808699 - protein, 256 aa, Homo sapiens; identical to SEQ ID NO: 808685

SEQ ID NO: 808700 - protein, 256 aa, Homo sapiens; identical to SEQ ID NO: 808685

SEQ ID NO: 808701 - protein, 277 aa, Homo sapiens
MHFSIPETESRSGDSGGSAYVAYNIHVNGVLHCRVRYSQLLGLHEQLRKEYGANVLPAFPPKKLFSLTPAEVEQRREQLEKYMQAVRQDPLLGSSETFNSFLRRAQQETQQVPTEEVSLEVLLSNGQKVLVNVLTSDQTEDVLEAVAAKLDLPDDLIGYFSLFLVREKEDGAFSFVRKLQEFELPYVSVTSLRSQEYKIVLRKSYWDSAYDDDVMENRVGLNLLYAQTVSDIERGWILVTKEQHRQLKSLQEKVSKKEFLSLALALLEMLTGFLQRH

SEQ ID NO: 808702 - protein, 117 aa, Homo sapiens
HLNYRFPSSVPLVRHAIMMSICLQSMVDELMVKKSGGSIRKMLRRRVGGTLRRSDSQQAVKSPPLLESPDATRESMVKLSSKLSAVSLRGIGSPSTDASASDVHGNFAFEGIGDEDL

SEQ ID NO: 808703 - protein, 320 aa, Homo sapiens
MHFSIPETESRSGDSGGSAYVAYNIHVNGVLHCRVRYSQLLGLHEQLRKEYGANVLPAFPPKKLFSLTPAEVEQRREQLEKYMQAVRQDPLLGSSETFNSFLRRAQQETQQVPTEEVSLEVLLSNGQKVLVNVLTSDQTEDVLEAVAAKLDLPDDLIGYFSLFLVREKEDGAFSFVRKLQEFELPYVSVTSLRSQEYKIVLRKRLGPDYMRSHEHGVAAKEKEKDNTLTPLRYTPQPTPQDHLQQPPEESRKGQQEAKGDEREQRYTDKQRRVPTPERKTDQESEQKNQDTTLSNATRKPQGEDTQPDDTRQTRQHHTGT

SEQ ID NO: 808704 - protein, 122 aa, Homo sapiens
MRWGPALRGRETRPSCPTVAMHLLVALVVVPVARGIGAGGTAEGLLACVPQHVTFEVHALVAAVVAKATPKRFVTRVDATMTLEVGQIATGIRAEGALVGLLSCMDAPWCRFQVIQMSRGIR

SEQ ID NO: 808705 - protein, 235 aa, Homo sapiens
MATWDEKAVTRRAKVAPAERMSKFLRHFTVVGDDYHAWNINYKKWENEEEEEEEEQPPPTPVSGVIIICLVVLDALLVLAELILDLKIIQPDKNNYAAMVFHYMSITILVFFMMEIIFKLFVFRLEFFHHKFEILDAVVVVVSFILDIVLLFQEHQFEALGLLILLRLWRVARIINGIIISVKTRSERQLLRLKQMNVQLAAKIQHLEFSCSEKEQEIERLNKLLRQHGLLGEVN

SEQ ID NO: 808706 - protein, 273 aa, Homo sapiens
MATWDEKAVTRRAKVAPAERMSKFLRHFTVVGDDYHAWNINYKKWENEEEEEEEEQPPPTPVSGEEGRAAAPDVAPAPGPAPRAPLDFRGMLRKLFSSHRFQVIIICLVVLDALLVLAELILDLKIIQPDKNNYAAMVFHYMSITILVFFMMEIIFKLFVFRLEFFHHKFEILDAVVVVVSFILDIVLLFQEHQFEALGLLILLRLWRVARIINGIIISVKTRSERQLLRLKQMNVQLAAKIQHLEFSCSEKEQEIERLNKLLRQHGLLGEVN

SEQ ID NO: 808707 - protein, 273 aa, Homo sapiens; identical to SEQ ID NO: 808706

SEQ ID NO: 808708 - protein, 273 aa, Homo sapiens; identical to SEQ ID NO: 808706

SEQ ID NO: 808709 - protein, 364 aa, Homo sapiens
PREVLRAERLLIRQSVLPTLHPCMAETVQGTRPRNQETQRQGWPGDGGMEQKLPERGWRGGFAPLQPAEEVKKPRRREAKPLALGHTAKGGRARTHNQAVTRRAKVAPAERMSKFLRHFTVVGDDYHAWNINYKKWENEEEEEEEEQPPPTPVSGEEGRAAAPDVAPAPGPAPRAPLDFRGMLRKLFSSHRFQVIIICLVVLDALLVLAELILDLKIIQPDKNNYAAMVFHYMSITILVFFMMEIIFKLFVFRLEFFHHKFEILDAVVVVVSFILDIVLLFQEHQFEALGLLILLRLWRVARIINGIIISVKTRSERQLLRLKQMNVQLAAKIQHLEFSCSEKEQEIERLNKLLRQHGLLGEVN

SEQ ID NO: 808710 - protein, 310 aa, Homo sapiens
SEAPSRSGDRGRVGRRVKKPRRREAKPLALGHTAKGGRARTHNQAVTRRAKVAPAERMSKFLRHFTVVGDDYHAWNINYKKWENEEEEEEEEQPPPTPVSGEEGRAAAPDVAPAPGPAPRAPLDFRGMLRKLFSSHRFQVIIICLVVLDALLVLAELILDLKIIQPDKNNYAAMVFHYMSITILVFFMMEIIFKLFVFRLEFFHHKFEILDAVVVVVSFILDIVLLFQEHQFEALGLLILLRLWRVARIINGIIISVKTRSERQLLRLKQMNVQLAAKIQHLEFSCSEKEQEIERLNKLLRQHGLLGEVN

SEQ ID NO: 808711 - protein, 253 aa, Homo sapiens
MSKFLRHFTVVGDDYHAWNINYKKWENEEEEEEEEQPPPTPVSGEEGRAAAPDVAPAPGPAPRAPLDFRGMLRKLFSSHRFQVIIICLVVLDALLVLAELILDLKIIQPDKNNYAAMVFHYMSITILVFFMMEIIFKLFVFRLEFFHHKFEILDAVVVVVSFILDIVLLFQEHQFEALGLLILLRLWRVARIINGIIISVKTRSERQLLRLKQMNVQLAAKIQHLEFSCSEKEQEIERLNKLLRQHGLLGEVN

SEQ ID NO: 808712 - protein, 273 aa, Homo sapiens; identical to SEQ ID NO: 808706

SEQ ID NO: 808713 - protein, 235 aa, Homo sapiens; identical to SEQ ID NO: 808705

SEQ ID NO: 808714 - protein, 151 aa, Homo sapiens
MATWDEKAVTRRAKVAPAERMSKFLRHFTVVGDDYHAWNINYKKWENEEEEEEEEQPPPTPVSGEEGRAAAPDVAPAPGPAPRAPLDFRGMLRKLFSSHRFQVIIICLVVLDALLVLAELILDLKIIQPDKNNYAAMGLSSQLRHVQNGNS

SEQ ID NO: 808715 - protein, 267 aa, Homo sapiens
AGPAAPDAGCALPGAERPRARARATGPAGAVLIPSPVKSYRGWLVMGEPSREEYKIQSFDAETQQLLKTALKDPGAVDLEKVANVIVDHSLQDCVFSKEAGRMCYAIIQAESKQAGQSVFRRGLLNRLQQEYQAREQLRARSLQGWVCYVTFICNIFDYLRVNNMPMMALVNPVYDCLFRLAQPDSLSKEEEVDCLVLQLHRVGEQLEKMNGQRMDELFVLIRDGFLLPTGLSSLAQLLLLEIIEFRAAGWKTTPAAHKYYYSEVSD

SEQ ID NO: 808716 - protein, 222 aa, Homo sapiens
MGEPSREEYKIQSFDAETQQLLKTALKDPGAVDLEKVANVIVDHSLQDCVFSKEAGRMCYAIIQAESKQAGQSVFRRGLLNRLQQEYQAREQLRARSLQGWVCYVTFICNIFDYLRVNNMPMMALVNPVYDCLFRLAQPDSLSKEEEVDCLVLQLHRVGEQLEKMNGQRMDELFVLIRDGFLLPTGLSSLAQLLLLEIIEFRAAGWKTTPAAHKYYYSEVSD

SEQ ID NO: 808717 - protein, 299 aa, Homo sapiens
RLSRPRDPGPWAPQPALCLREGRSGRGGNGRGLETLKAPPTARGEPPAGATSPGRIILPPSAVLIPSPVKSYRGWLVMGEPSREEYKIQSFDAETQQLLKTALKDPGAVDLEKVANVIVDHSLQDCVFSKEAGRMCYAIIQAESKQAGQSVFRRGLLNRLQQEYQAREQLRARSLQGWVCYVTFICNIFDYLRVNNMPMMALVNPVYDCLFRLAQPDSLSKEEEVDCLVLQLHRVGEQLEKMNGQRMDELFVLIRDGFLLPTGLSSLAQLLLLEIIEFRAAGWKTTPAAHKYYYSEVSD

SEQ ID NO: 808718 - protein, 282 aa, Homo sapiens
MGEPSREEYKIQSFDAETQQLLKTALKDPGAVDLEKVANVIVDHSLQDCVFSKEAGRMCYAIIQVGGWERKGSCFEEGASGVGRRPGLQDRDAQGLAQREKRHRMGGVTGAPPPTLHLPLPGSQAESKQAGQSVFRRGLLNRLQQEYQAREQLRARSLQGWVCYVTFICNIFDYLRVNNMPMMALVNPVYDCLFRLAQPDSLSKEEEVDCLVLQLHRVGEQLEKMNGQRMDELFVLIRDGFLLPTGLSSLAQLLLLEIIEFRAAGWKTTPAAHKYYYSEVSD

SEQ ID NO: 808719 - protein, 290 aa, Homo sapiens
AGPAAPDAGCALPGAERPRARARATGPAGAVLIPSPVKSYRGWLVMGEPSREEYTPSLECTVACFETEDGEYSVCQRSYSNCSRLMPSRCNTQYRDPGAVDLEKVANVIVDHSLQDCVFSKEAGRMCYAIIQAESKQAGQSVFRRGLLNRLQQEYQAREQLRARSLQGWVCYVTFICNIFDYLRVNNMPMMALVNPVYDCLFRLAQPDSLSKEEEVDCLVLQLHRVGEQLEKMNGQRMDELFVLIRDGFLLPTGLSSLAQLLLLEIIEFRAAGWKTTPAAHKYYYSEVSD

SEQ ID NO: 808720 - protein, 267 aa, Homo sapiens; identical to SEQ ID NO: 808715

SEQ ID NO: 808721 - protein, 170 aa, Homo sapiens
MGEPSREEYKIQSFDAETQQLLKTALKDPGAVDLEKVANVIVDHSLQDCVFSKEAGRMCYAIIQVNNMPMMALVNPVYDCLFRLAQPDSLSKEEEVDCLVLQLHRVGEQLEKMNGQRMDELFVLIRDGFLLPTGLSSLAQLLLLEIIEFRAAGWKTTPAAHKYYYSEVSD

SEQ ID NO: 808722 - protein, 249 aa, Homo sapiens
AGPAAPDAGCALPGAERPRARARATGPAGAVLIPSPVKSYRGWLVMGEPSREEYKIQSFDAETQQLLKTALKDPGAVDLEKVANVIVDHSLQDCVFSKEAGRMCYAIIQAESKQAGQSVFRRGLLNRLQQEYQAREQLRARSLQGWVCYVTFICNIFDYLRVNNMPMMALVNPVYDCLFRLAQPDSLSKEEEVDCLVLQLHRVGEQLELLPTGLSSLAQLLLLEIIEFRAAGWKTTPAAHKYYYSEVSD

SEQ ID NO: 808723 - protein, 267 aa, Homo sapiens; identical to SEQ ID NO: 808715

SEQ ID NO: 808724 - protein, 267 aa, Homo sapiens; identical to SEQ ID NO: 808715

SEQ ID NO: 808725 - protein, 37 aa, Homo sapiens
MNGQRMDELFVLIRDGFLLPTGLSSLAQLLLLEIIEF

SEQ ID NO: 808726 - protein, 308 aa, Homo sapiens
AGPAAPDAGCALPGAERPRARARATGPAGAVLIPSPVKSYRGWLVMGEPSREEYKIQSFDAETQQLLKTALKAPSLECTVACFETEDGEYSVCQRSYSNCSRLMPSRCNTQYRDPGAVDLEKVANVIVDHSLQDCVFSKEAGRMCYAIIQAESKQAGQSVFRRGLLNRLQQEYQAREQLRARSLQGWVCYVTFICNIFDYLRVNNMPMMALVNPVYDCLFRLAQPDSLSKEEEVDCLVLQLHRVGEQLEKMNGQRMDELFVLIRDGFLLPTGLSSLAQLLLLEIIEFRAAGWKTTPAAHKYYYSEVSD

SEQ ID NO: 808727 - protein, 256 aa, Homo sapiens
MGEPSREEYKIQSFDAETQQLLKTALKVACFETEDGEYSVCQRSYSNCSRLMPSRCNTQYRDPGAVDLEKVANVIVDHSLQDCVFSKEAGRMCYAIIQAESKQAGQSVFRRGLLNRLQQEYQAREQLRARSLQGWVCYVTFICNIFDYLRVNNMPMMALVNPVYDCLFRLAQPDSLSKEEEVDCLVLQLHRVGEQLEKMNGQRMDELFVLIRDGFLLPTGLSSLAQLLLLEIIEFRAAGWKTTPAAHKYYYSEVSD

SEQ ID NO: 808728 - protein, 323 aa, Homo sapiens
MGEPSREEYKIQSFDAETQQLLKTALKAPSLECTVACFETEDGEYSVCQRSYSNCSRLMPSRCNTQYRDPGAVDLEKVANVIVDHSLQDCVFSKEAGRMCYAIIQVGGWERKGSCFEEGASGVGRRPGLQDRDAQGLAQREREARMGGVTGAPPPTLHLPLPGSQAESKQAGQSVFRRGLLNRLQQEYQAREQLRARSLQGWVCYVTFICNIFDYLRVNNMPMMALVNPVYDCLFRLAQPDSLSKEEEVDCLVLQLHRVGEQLEKMNGQRMDELFVLIRDGFLLPTGLSSLAQLLLLEIIEFRAAGWKTTPAAHKYYYSEVSD

SEQ ID NO: 808729 - protein, 178 aa, Homo sapiens [sequence omitted]

SEQ ID NO: 808730 - protein, 204 aa, Homo sapiens
MGEPSREEYKIQSFDAETQQLLKTALKDPGAVDLEKVANVIVDHSLQDCVFSKEAGRMCYAIIQAESKQAGQSVFRRGLLNRLQQEYQAREQLRARSLQGWVCYVTFICNIFDYLRVNNMPMMALVNPVYDCLFRLAQPDSLSKEEEVDCLVLQLHRVGEQLELLPTGLSSLAQLLLLEIIEFRAAGWKTTPAAHKYYYSEVSD

SEQ ID NO: 808731 - protein, 267 aa, Homo sapiens; identical to SEQ ID NO: 808715

SEQ ID NO: 808732 - protein, 621 aa, Homo sapiens
MTKAMKVKTPLRALKSLWDYDFLIYDGVIDNTAPDFLAFKEHFSLAWGGIFSLLEHVEKFLRNYAIPEVKIKGNNLVALLPEFELTNKLTRYDLLSVLEDPAHVQMLINLPGQRYKGQDGNSEAAMKIQATWKCYKARKFFLFYRQQKWASGVIAIAWLLYCHKTRLKKILKESRQRHLENFRIRAKHLAANWNRIRTSRRTIIHIPSLGYSQPVREHIADFNTQQNMQLGRLCDILDANVNVIYICSHHMNDELVLYYKKILSLHAAVKSGNLEDRSDLQDRFKIITPEAVNIFPMIEQLSQLITDHLQIQRWLFKMDSEFRGNGTAFCDIPSYLKCYKWVLKESSRYGLEDWRKKWAQEPALVKISEELAGILAQHAQPVNEKRFPTWRKFLQTFLSQGGVIEAFPPADNVTNLTVDMLIEPNGKISVLSTGDQLHAESPFISSGTTVPQTSVDPQVLTYLCLQIGKACRMRDVVGYFSIDLVTFIDPSTLEQQVWATGLNLAYSDQLALTQLTLYLTNGHLDCSLSTLEVPRFVPKERKKTKCMSALSMPMLATSRYAVMTTQLRHSNLSLVFHYVFLQICRAHGIGYDLENNRRGSPGGPHDLCSPSLHHPSRNIST

SEQ ID NO: 808733 - protein, 168 aa, Homo sapiens
MAQNTENHDPVGSILIQIHEDLYQLKEKLTKFSPEEKGETLDIQSLETAIKRTEVGLRIHIEKYLNVVNQNVLTTSVNDESLYTPQASKWLLPTVIDQKSFIFPQESEGTFWQPQRQHSSSLPVFPRAKRKIGLNVKILQDPENIHHRAAVNANYGISLPYINQRKAC

SEQ ID NO: 808734 - protein, 1027 aa, Homo sapiens
MAQNTENHDPVGSILIQIHEDLYQLKEKLTKFSPEEKGETLDIQSLETAIKRTEVGLRIHIEKYLNVVNQNVLTTSVNDESLYTPQASKWLLPTVIDQKSFIFPQESEGTFWQPQRQHSSSLPVFPRAKIKVSKLIKGSNISSLTVLPSSHCTDPYFTPIPVLQADAHKGILSMIERGLIPPTARITFQNPPITPRAAPLHSFDEARKIPTVATFTIPREPPPSPAEVKFFPKKQRSKGKSRRSRGHHDRKAMKVKTPLRALKSLWDYDFLIYDGVIDNTAPDFLAFKEHFSLAWGGIFSLLEHVEKFLRNYAIPEVKIKGNNLVALLPEFELTNKLTRYDLLSVLEDPAHVQMLINLPGQRYKGQDGNSEAAMKIQATWKCYKARKFFLFYRQQKWASGVIAIAWLLYCHKTRLKKILKESRQRHLENFRIRAKHLAANWNRIRTSRRTIIHIPSLGYSQPVREHIADFNTQQNMQLGRLCDILDANVNVIYICSHHMNDELVLYYKKILSLHAAVKSGNLEDRSDLQDRFKIITPEAVNIFPKHHMCLATHLMYSPKAIKRIKNLIRGTEAYIVSGLLHRDDLAVADMLDIPILGSEPELAHLYSTKSGGKRVFDSANVAVPPGIYDIYSQQQMIEQLSQLITDHLQIQRWLFKMDSEFRGNGTAFCDIPSYLKCYKWVLKESSRYGLEDWRKKWAQEPALVKISEELAGILAQHAQPVNEKRFPTWRKFLQTFLSQGGVIEAFPPADNVTNLTVDMLIEPNGKISVLSTGDQLHAESPFISSGTTVPQTSVDPQVLTYLCLQIGKACRMRDVVGYFSIDLVTFIDPSTLEQQVWATGLNLAYSDQLALTQLTLYLTNGHLDCSLSTLEVPRFVPKERKKTKCMSALSMPMLATSRYAVMTTQLRHSNLSLVFHYVFLQICRAHGIGYDLEERQGTVFILYEHLKRHKLGMLTIGEDLQGVLMTFARHLFIIHQEISAPNMQGETNFKTTIADIETILRVTKENKMRFEEEQQSKDDKNLSKPKK

SEQ ID NO: 808735 - protein, 854 aa, Homo sapiens [sequence omitted]

SEQ ID NO: 808736 - protein, 775 aa, Homo sapiens
MKVKTPLRALKSLWDYDFLIYDGVIDNTAPDFLAFKEHFSLAWGGIFSLLEHVEKFLRNYAIPEVKIKGNNLVALLPEFELTNKLTRYDLLSVLEDPAHVQMLINLPGQRYKGQDGNSEAAMKIQATWKCYKARKFFLFYRQQKWASGVIAIAWLLYCHKTRLKKILKESRQRHLENFRIRAKHLAANWNRIRTSRRTIIHIPSLGYSQPVREHIADFNTQQNMQLGRLCDILDANVNVIYICSHHMNDELVLYYKKILSLHAAVKSGNLEDRSDLQDRFKIITPEAVNIFPKHHMCLATHLMYSPKAIKRIKNLIRGTEAYIVSGLLHRDDLAVADMLDIPILGSEPELAHLYSTKSGGKRVFDSANVAVPPGIYDIYSQQQMIEQLSQLITDHLQIQRWLFKMDSEFRGNGTAFCDIPSYLKCYKWVLKESSRYGLEDWRKKWAQEPALVKISEELAGILAQHAQPVNEKRFPTWRKFLQTFLSQGGVIEAFPPADNVTNLTVDMLIEPNGKISVLSTGDQLHAESPFISSGTTVPQTSVDPQVLTYLCLQIGKACRMRDVVGYFSIDLVTFIDPSTLEQQVWATGLNLAYSDQLALTQLTLYLTNGHLDCSLSTLEVPRFVPKERKKTKCMSALSMPMLATSRYAVMTTQLRHSNLSLVFHYVFLQICRAHGIGYDLEERQGTVFILYEHLKRHKLGMLTIGEDLQGVLMTFARHLFIIHQEISAPNMQGETNFKTTIADIETILRVTKENKMRFEEEQQSKDDKNLSKPKK

SEQ ID NO: 808737 - protein, 341 aa, Homo sapiens
MQSHFLELRVHFKEPALVKISEELAGILAQHAQPVNEKRFPTWRKFLQTFLSQGGVIEAFPPADNVTNLTVDMLIEPNGKISVLSTGDQLHAESPFISSGTTVPQTSVDPQVLTYLCLQIGKACRMRDVVGYFSIDLVTFIDPSTLEQQVWATGLNLAYSDQLALTQLTLYLTNGHLDCSLSTLEVPRFVPKERKKTKCMSALSMPMLATSRYAVMTTQLRHSNLSLVFHYVFLQICRAHGIGYDLEERQGTVFILYEHLKRHKLGMLTIGEDLQGVLMTFARHLFIIHQEISAPNMQGETNFKTTIADIETILRVTKENKMRFEEEQQSKDDKNLSKPKK

SEQ ID NO: 808738 - protein, 305 aa, Homo sapiens
MIERGLIPPTARITFQNPPITPRAAPLHSFDEARKIPTVATFTIPREPPPSPAEVKFFPKKQRSKGKSRRSRGHHDRKAMKVKTPLRALKSLWDYDFLIYDGVIDNTAPDFLAFKEHFSLAWGGIFSLLEHVEKFLRNYAIPEVKIKGNNLVALLPEFELTNKLTRYDLLSVLEDPAHVQMLINLPGQRYKGQDGNSEAAMKIQATWKCYKARKFFLFYRQQKWASGVIAIAWLLYCHKTRLKKILKESRQRHLENFRIRAKHLAANWNRIRTSRRTIIHIPSLGITLLPANLSATSITHHIMAP

SEQ ID NO: 808739 - protein, 854 aa, Homo sapiens [sequence omitted]

SEQ ID NO: 808740 - protein, 89 aa, Homo sapiens
EEEELGGRFKQGNKAVTIGEDLQGVLMTFARHLFIIHQEISAPNMQGETNFKTTIADIETILRVTKENKMRFEEEQQSKDDKNLSKPKK

SEQ ID NO: 808741 - protein, 257 aa, Homo sapiens
MAQNTENHDPVGSILIQIHEDLYQLKEKLTKFSPEEKGETLDIQSLETAIKRTEVGLRIHIEKYLNVVNQNVLTTSVNDESLYTPQASKWLLPTVIDQKSFIFPQESEGTFWQPQRQHSSSLPVFPRAKIKVSKLIKGSNISSLTVLPSSHCTDPYFTPIPVLQADAHKGILSMIERGLIPPTARITFQNPPITPRAAPLHSFDEARKIPTVATFTIPREPPPSPAEVKFFPKKQRSKGKSRRSRGHHDRKVCNLCD

SEQ ID NO: 808742 - protein, 335 aa, Homo sapiens
MTENVVCTGAVNAVKEVWEKRIKKLNEDLKREKEFQHKLVRIWEERVSLTKLREKVTREDGRVILKIEKEEWKTLPSSLLKLNQLQEWQLHRTGLLKIPEFIGRFQNLMVLDLSRNTISEIPPGIGLLTRLQELILRYNKIKTVPKELSNCASLEKLELAVNRDICDLPQELSNLLKLTHLDLSMNDFTTIPLAVLNMPALEWLDMGSNKLEQLPDTIERMQNLHTLWLQRNEITCLPQTISNMKNLGTLVLSNNKLQDIPVCMEEMANLRFVNFRDNPLKLKVSLPPSEGTDEEEERELFGLQFMHTYIQESRRRADHQVNGSTTLPISINTDG

SEQ ID NO: 808743 - protein, 175 aa, Homo sapiens
MTENVVCTGAVNAVKEVWEKRIKKLNEDLKREKEFQHKLVRIWEERVSLTKLREKVTREDGRVILKIEKEEWKTLPSSLLKLNQLQEWQLHRTGLLKIPEFIGRFQNLMVLDLSRNTISEIPPGIGLLTRLQELILRYNKIKTVPKELSNCASLEKLELAVNRDICDLPQEVRKT

SEQ ID NO: 808744 - protein, 335 aa, Homo sapiens; identical to SEQ ID NO: 808742

SEQ ID NO: 808745 - protein, 335 aa, Homo sapiens; identical to SEQ ID NO: 808742

SEQ ID NO: 808746 - protein, 167 aa, Homo sapiens
RRKCPSDDRKPGGRGEKEREKGKDKSGEAGRREAGLKRQRAAFVRRELGRGPAPRSPAPHRVLHRLPRRAAGRGRAGGGLLQAARSEPPAGLGRGAGPAAALPGSVLPLWDLATAAEGEGSGARAGAGGGWGGGRAAAGLGLGIRIGIGPPWTTRRSPRSWTSGSSS

SEQ ID NO: 808747 - protein, 309 aa, Homo sapiens
MDDKAFTKELDQWVEQLNECKQLNENQVRTLCEKAKEILTKESNVQEVRCPVTVCGDVHGQFHDLMELFRIGGKSPDTNYLFMGDYVDRGYYSVETVTLLVALKVRYPERITILRGNHESRQITQVYGFYDECLRKYGNANVWKYFTDLFDYLPLTALVDGQIFCLHGGLSPSIDTLDHIRALDRLQEVPHEGPMCDLLWSDPDDRGGWGISPRGAGYTFGQDISETFNHANGLTLVSRAHQLVMEGYNWCHDRNVVTIFSAPNYCYRCGNQAAIMELDDTLKYSFLQFDPAPRRGEPHVTRRTPDYFL

SEQ ID NO: 808748 - protein, 309 aa, Homo sapiens; identical to SEQ ID NO: 808747

SEQ ID NO: 808749 - protein, 115 aa, Homo sapiens
MCDLLWSDPDDRGGWGISPRGAGYTFGQDISETFNHANGLTLVSRAHQLVMEGYNWCHDRNVVTIFSAPNYCYRCGNQAAIMELDDTLKYSFLQFDPAPRRGEPHVTRRTPDYFL

SEQ ID NO: 808750 - protein, 309 aa, Homo sapiens; identical to SEQ ID NO: 808747

SEQ ID NO: 808751 - protein, 309 aa, Homo sapiens; identical to SEQ ID NO: 808747

SEQ ID NO: 808752 - protein, 253 aa, Homo sapiens
MDDKAFTKELDQWVEQLNECKQLNENQVRTLCEKAKEILTKESNVQEVRCPVTVCGDVHGQFHDLMELFRIGGKSPDTNYLFMGDYVDRGYYSVETVTLLVALKVRYPERITILRGNHESRQITQVYGFYDECLRKYGNANVWKYFTDLFDYLPLTALVDGQIFCLHGGLSPSIDTLDHIRALDRLQEVPHEGPMCDLLWSDPDDRGGWGISPRGAGYTFGQDISETFNHANGLTLVSRAHQLVMEVCTFLTE

SEQ ID NO: 808753 - protein, 179 aa, Homo sapiens
MDDKAFTKELDQWVEQLNECKQLNENQVRTLCEKAKEILTKESNVQEVRCPVTVCGDVHGQFHDLMELFRIGGKSPDTNYLFMGDYVDRGYYSVETVTLLVALKVRYPERITILRGNHESRQITQVYGFYDECLRKYGNANVWKYFTDLFDYLPLTALVDGQVCICVLTSWEEVNGSRD

SEQ ID NO: 808754 - protein, 244 aa, Homo sapiens
MELFRIGGKSPDTNYLFMGDYVDRGYYSVETVTLLVALKVRYPERITILRGNHESRQITQVYGFYDECLRKYGNANVWKYFTDLFDYLPLTALVDGQIFCLHGGLSPSIDTLDHIRALDRLQEVPHEGPMCDLLWSDPDDRGGWGISPRGAGYTFGQDISETFNHANGLTLVSRAHQLVMEGYNWCHDRNVVTIFSAPNYCYRCGNQAAIMELDDTLKYSFLQFDPAPRRGEPHVTRRTPDYFL

SEQ ID NO: 808755 - protein, 324 aa, Homo sapiens
MDDKAFTKELDQWVEQLNECKQLNENQVRTLCEKAKEILTKESNVQEVRCPVTVCGDVHGQFHDLMELFRIGGKSPDTNYLFMGDYVDRGYYSVETVTLLVALKVRYPERITILRGNHESRQITQVYGFYDECLRKYGNANVWKYFTDLFDYLPLTALVDGQIFCLHGGLSPSIDTLDHIRALDRLQEVPHEGPMCDLLWSDPDDRGGWGISPRGAGYTFGQDISETFNHANGLTLVSRAHQLVMEGYNWCHDRNVVTIFSAPNYCYRCGNQAAIMELDDTLKYSFYTAHPRLLPINFSWETCLCMWKYTWLFKIYVFKNKKQQ

SEQ ID NO: 808756 - protein, 309 aa, Homo sapiens; identical to SEQ ID NO: 808747

SEQ ID NO: 808757 - protein, 179 aa, Homo sapiens; identical to SEQ ID NO: 808753

SEQ ID NO: 808758 - protein, 109 aa, Homo sapiens
ACMLGSPGSAAFTHCRSAAAAVKENLSGRAHLLLLGSCAQAVPAASNTHPLDFYGADSSPSSLGSNVTFTVKATHGWVCGCAGSAPSKGPEWKNELTSVLYYTKTMLST

SEQ ID NO: 808759 - protein, 100 aa, Homo sapiens
MWVNPEEVLLANALWITERANPYFILQRRKGHAGDGGGGGGLAGLLVGTLDVVLDSSARVAPYRILYQTPDSLVYWTIACGVVPGKKSLNTGEWVEQNLL

SEQ ID NO: 808760 - protein, 106 aa, Homo sapiens
TTCQNKGPMTASLRQTGFQVTVAKRNTYPALISQGEDKMTKRKKLRTSAPLMRKQDLPAGSSVNQKRSQLPFLLPRTHSGGLFPSLQNPGSWPPLSRAHPVRICKF

SEQ ID NO: 808761 - protein, 550 aa, Homo sapiens
MKDEDRGSGAFSLETIAESSAQSPGCQLLVETLGVPLQEATELGDPTQADSARPEQSSQSPVQAVPGSGDSQPDDPPDRGTGLSASQRASQDHLSEQGADDSKPETDRVPGDGGQKEHLPSIDSEGEKPDRGAPQEGGAQRTAGAGLPGGPQEEGDGVPCTPASAPTSGPAPGLGPASWCLEPGSVAQGSPDPQQTPSRMGREGEGTHSSLGCSSLGMVVIADLSTDPTELEERALEVAGPDGQASAISPASPRRKAADGGHRRALPGCTSLTGETTGESGEAGQDGKPPGDVLVGPTASLALAPGSGESMMGAGDSGHASPDTGPCVNQKQEPGPAQEEAELGGQNLERDLEGFRVSPQASVVLEHREIADDPLQEPGAQQGIPDTTSELAGQRDHLPHSADQGTWADSLAVELDFLLDSQIQDALDASDFEAPPEQLFPSGNKPGPCWPGPSSHANGDPVAVAKAQPRTFVGIQASEASRMEDATNVVRGLIVELSNLNRLIMGTHRDLEAFKRLNYRKTKLGGKAPLPYPSKGPGNIPRGDPPWREL

SEQ ID NO: 808762 - protein, 900 aa, Homo sapiens
ASARGSRGSFPLVHLQGWMPGPPAPKPGLALPPSPGSVAAHSPFLSPALLVGAPRPSIPSPRFPAWPSHFRLGPRAPPHRSAATGLAGSAEPKLQLPAGSAWARRRLAGAVLTVAGCEGGVCALMRGAGPRGARERGRARAGVRGGDICGVQSVCQSPTGSGFTWALGLWSPHFSVVGVVSVWGLSPGAGSTAPTLRPFHLSPPDSRPPAFCEGQFGHLFFPKRVTRIIQATYSQLIQAELVSDKDRGSSTTSVAQISQGEDKMTKRKKLRTSGEGLCPPKPLKNPRLGDFYGDPQSSMLGCLHHPEEPEGKLGPVPSTQQHGEEPGKAVSSSPDEETGSPCRLLRQPEKEPAPLPPSQNSFGRFVPQFAKSRKTVTRKEEMKDEDRGSGAFSLETIAESSAQSPGCQLLVETLGVPLQEATELGDPTQADSARPEQSSQSPVQAVPGSGDSQPDDPPDRGTGLSASQRASQDHLSEQGADDSKPETDRVPGDGGQKEHLPSIDSEGEKPDRGAPQEGGAQRTAGAGLPGGPQEEGDGVPCTPASAPTSGPAPGLGPASWCLEPGSVAQGSPDPQQTPSRMGREGEGTHSSLGCSSLGMVVIADLSTDPTELEERALEVAGPDGQASAISPASPRRKAADGGHRRALPGCTSLTGETTGESGEAGQDGKPPGDVLVGPTASLALAPGSGESMMGAGDSGHASPDTGPCVNQKQEPGPAQEEAELGGQNLERDLEGFRVSPQASVVLEHREIADDPLQEPGAQQGIPDTTSELAGQRDHLPHSADQGTWADSLAVELDFLLDSQIQDALDASDFEAPPEQLFPSGNKPGPCWPGPSSHANGDPVAVAKAQPSRLIMGTHRDLEAFKRLNYRKTKLGGKAPLPYPSKGPGNIPRGDPPWREL

SEQ ID NO: 808763 - protein, 862 aa, Homo sapiens
ASARGSRGSFPLVHLQGWMPGPPAPKPGLALPPSPGSVAAHSPFLSPALLVGAPRPSIPSPRFPAWPSHFRLGPRAPPHRSAATGLAGSAEPKLQLPAGSAWARRRLAGAVLTVAGCEGGVCALMRGAGPRGARERGRARAGVRGGDICGVQSVCQSPTGSGFTWALGLWSPHFSVVGVVSVWGLSPGAGSTAPTLRPFHLSPPDSRPPAFCEGQFGHLFFPKRVTRIIQATYSQLIQAELVSDKDRGSSTTSVAQISQGEDKMTKRKKLRTSGEGLCPPKPLKNPRLGDFYGDPQSSMLGCLHHPEEPEGKLGPVPSTQQHGEEPGKAVSSSPDEETGSPCRLLRQPEKEPAPLPPSQNSFGRFVPQFAKSRKTVTRKEEMKDEDRGSGAFSLETIAESSAQSPGCQLLVETLGVPLQEATELGDPTQADSARPEQSSQSPVQAVPGSGDSQPDDPPDRGTGLSASQRASQDHLSEQGADDSKPETDRVPGDGGQKEHLPSIDSEGEKPDRGAPQEGGAQRTAGAGLPGGPQEEGDGVPCTPASAPTSGPAPGLGPASWCLEPGSVAQGSPDPQQTPSRMGREGEGTHSSLGCSSLGMVVIADLSTDPTELEERALEVAGPDGQASAISPASPRRKAADGGHRRALPGCTSLTGETTGESGEAGQDGKPPGDVLVGPTASLALAPGSGESMMGAGDSGHASPDTGPCVNQKQEPGPAQEEAELGGQNLERDLEGFRVSPQASVVLEHREIADDPLQEPGAQQGIPDTTSELAGQRDHLPHSADQGTWADSLAVELDFLLDSQIQDALDASDFEAPPEQLFPSGNKPGPCWPGPSSHANGDPVAVAKAQPRPPVSRPPACCV

SEQ ID NO: 808764 - protein, 30 aa, Homo sapiens
MGTHRDLEAFKRLNYRKTKLGGKAPLPYPS

SEQ ID NO: 808765 - protein, 931 aa, Homo sapiens
ASARGSRGSFPLVHLQGWMPGPPAPKPGLALPPSPGSVAAHSPFLSPALLVGAPRPSIPSPRFPAWPSHFRLGPRAPPHRSAATGLAGSAEPKLQLPAGSAWARRRLAGAVLTVAGCEGGVCALMRGAGPRGARERGRARAGVRGGDICGVQSVCQSPTGSGFTWALGLWSPHFSVVGVVSVWGLSPGAGSTAPTLRPFHLSPPDSRPPAFCEGQFGHLFFPKRVTRIIQATYSQLIQAELVSDKDRGSSTTSVAQISQGEDKMTKRKKLRTSGEGLCPPKPLKNPRLGDFYGDPQSSMLGCLHHPEEPEGKLGPVPSTQQHGEEPGKAVSSSPDEETGSPCRLLRQPEKEPAPLPPSQNSFGRFVPQFAKSRKTVTRKEEMKDEDRGSGAFSLETIAESSAQSPGCQLLVETLGVPLQEATELGDPTQADSARPEQSSQSPVQAVPGSGDSQPDDPPDRGTGLSASQRASQDHLSEQGADDSKPETDRVPGDGGQKEHLPSIDSEGEKPDRGAPQEGGAQRTAGAGLPGGPQEEGDGVPCTPASAPTSGPAPGLGPASWCLEPGSVAQGSPDPQQTPSRMGREGEGTHSSLGCSSLGMVVIADLSTDPTELEERALEVAGPDGQASAISPASPRRKAADGGHRRALPGCTSLTGETTGESGEAGQDGKPPGDVLVGPTASLALAPGSGESMMGAGDSGHASPDTGPCVNQKQEPGPAQEEAELGGQNLERDLEGFRVSPQASVVLEHREIADDPLQEPGAQQGIPDTTSELAGQRDHLPHSADQGTWADSLAVELDFLLDSQIQDALDASDFEAPPEQLFPSGNKPGPCWPGPSSHANGDPVAVAKAQPRTFVGIQASEASRMEDATNVVRGLIVELSNLNRLIMGTHRDLEAFKRLNYRKTKLGGKAPLPYPSKGPGNIPRGDPPWREL

SEQ ID NO: 808766 - protein, 817 aa, Homo sapiens
ASARGSRGSFPLVHLQGWMPGPPAPKPGLALPPSPGSVAAHSPFLSPALLVGAPRPSIPSPRFPAWPSHFRLGPRAPPHRSAATGLAGSAEPKLQLPAGSAWARRRLAGAVLTVAGCEGGVCVAHARGWDLAGRGKEAERAQISQGEDKMTKRKKLRTSGEGLCPPKPLKNPRLGDFYGDPQSSMLGCLHHPEEPEGKLGPVPSTQQHGEEPGKAVSSSPDEETGSPCRLLRQPEKEPAPLPPSQNSFGRFVPQFAKSRKTVTRKEEMKDEDRGSGAFSLETIAESSAQSPGCQLLVETLGVPLQEATELGDPTQADSARPEQSSQSPVQAVPGSGDSQPDDPPDRGTGLSASQRASQDHLSEQGADDSKPETDRVPGDGGQKEHLPSIDSEGEKPDRGAPQEGGAQRTAGAGLPGGPQEEGDGVPCTPASAPTSGPAPGLGPASWCLEPGSVAQGSPDPQQTPSRMGREGEGTHSSLGCSSLGMVVIADLSTDPTELEERALEVAGPDGQASAISPASPRRKAADGGHRRALPGCTSLTGETTGESGEAGQDGKPPGDVLVGPTASLALAPGSGESMMGAGDSGHASPDTGPCVNQKQEPGPAQEEAELGGQNLERDLEGFRVSPQASVVLEHREIADDPLQEPGAQQGIPDTTSELAGQRDHLPHSADQGTWADSLAVELDFLLDSQIQDALDASDFEAPPEQLFPSGNKPGPCWPGPSSHANGDPVAVAKAQPRTFVGIQASEASRMEDATNVVRGLIVELSNLNRLIMGTHRDLEAFKRLNYRKTKLGGKAPLPYPSKGPGNIPRGDPPWREL

SEQ ID NO: 808767 - protein, 506 aa, Homo sapiens
ASARGSRGSFPLVHLQGWMPGPPAPKPGLALPPSPGSVAAHSPFLSPALLVGAPRPSIPSPRFPAWPSHFRLGPRAPPHRSAATGLAGSAEPKLQLPAGSAWARRRLAGAVLTVAGCEGGVCALMRGAGPRGARERGRARAGVRGGDICGVQSVCQSPTGSGFTWALGLWSPHFSVVGVVSVWGLSPGAGSTAPTLRPFHLSPPDSRPPAFCEGQFGHLFFPKRVTRIIQATYSQLIQAELVSDKDRGSSTTSVAQISQGEDKMTKRKKLRTSGEGLCPPKPLKNPRLGDFYGDPQSSMLGCLHHPEEPEGKLGPVPSTQQHGEEPGKAVSSSPDEETGSPCRLLRQPEKEPAPLPPSQNSFGRFVPQFAKSRKTVTRKEEMKDEDRGSGAFSLLFPSGNKPGPCWPGPSSHANGDPVAVAKAQPRTFVGIQASEASRMEDATNVVRGLIVELSNLNRLIMGTHRDLEAFKRLNYRKTKLGGKAPLPYPSKGPGNIPRGDPPWREL

SEQ ID NO: 808768 - protein, 132 aa, Homo sapiens
MTLQTGGRGCPPHRGPAKTTCQNKGPMTASLRQTGFQVTVAKRNTYQALILKGRSQTEEPPRREGPKGQQGLACLEGPRRRETVSPVPQHQLLPQALLQDWALPLGAWNPGLWPRAPLTPSRPPAGWVGKGK

SEQ ID NO: 808769 - protein, 548 aa, Homo sapiens
MKTPADTGFAFPDWAYKPESSPGSRQIQLWHFILELLRKEEYQGVIAWQGDYGEFVIKDPDEVARLWGVRKCKPQMNYDKLSRALRYYYNKRILHKTKGKRFTYKFNFNKLVLVNYPFIDVGLAGGAVPQSAPPVPSGGSHFRFPPSTPSEVLSPTEDPRSPPACSSSSSSLFSAVVARRLGRGSVSDCSDGTSELEEPLGEDPRARPPGPPDLGAFRGPPLARLPHDPGVFRVYPRPRGGPEPLSPFPVSPLAGPGSLLPPQLSPALPMTPTHLAYTPSPTLSPMYPSGGGGPSGSGGGSHFSFSPEDMKRYLQAHTQSVYNYHLSPRAFLHYPGLVVPQPQRPDKCPLPPMAPETPPVPSSASSSSSSSSSPFKFKLQPPPLGRRQRAAGEKAVAGADKSGGSAGGLAEGAGALAPPPPPPQIKVEPISEGESEEVEVTDISDEDEEDGEVFKTPRAPPAPPKPEPGEAPGASQCMPLKLRFKRRWSEDCRLEGGGGPAGGFEDEGEDKKVRGEGPGEAGGPLTPRRVSSDLQHATAQLSLEHRDS

SEQ ID NO: 808770 - protein, 560 aa, Homo sapiens
VSFPRRRRRRRRRLGLLCAGFAFPDWAYKPESSPGSRQIQLWHFILELLRKEEYQGVIAWQGDYGEFVIKDPDEVARLWGVRKCKPQMNYDKLSRALRYYYNKRILHKTKGKRFTYKFNFNKLVLVNYPFIDVGLAGGAVPQSAPPVPSGGSHFRFPPSTPSEVLSPTEDPRSPPACSSSSSSLFSAVVARRLGRGSVSDCSDGTSELEEPLGEDPRARPPGPPDLGAFRGPPLARLPHDPGVFRVYPRPRGGPEPLSPFPVSPLAGPGSLLPPQLSPALPMTPTHLAYTPSPTLSPMYPSGGGGPSGSGGGSHFSFSPEDMKRYLQAHTQSVYNYHLSPRAFLHYPGLVVPQPQRPDKCPLPPMAPETPPVPSSASSSSSSSSSPFKFKLQPPPLGRRQRAAGEKAVAGADKSGGSAGGLAEGAGALAPPPPPPQIKVEPISEGESEEVEVTDISDEDEEDGEVFKTPRAPPAPPKPEPGEAPGASQCMPLKLRFKRRWSEDCRLEGGGGPAGGFEDEGEDKKVRGEGPGEAGGPLTPRRVSSDLQHATAQLSLEHRDS

SEQ ID NO: 808771 - protein, 478 aa, Homo sapiens
TRLVTGEGSLPLAVEVEGIHQHQPCQLVHGSFPKQVADHTFCVCLHPVIDDGLAGGAVPQSAPPVPSGGSHFRFPPSTPSEVLSPTEDPRSPPACSSSSSSLFSAVVARRLGRGSVSDCSDGTSELEEPLGEDPRARPPGPPDLGAFRGPPLARLPHDPGVFRVYPRPRGGPEPLSPFPVSPLAGPGSLLPPQLSPALPMTPTHLAYTPSPTLSPMYPSGGGGPSGSGGGSHFSFSPEDMKRYLQAHTQSVYNYHLSPRAFLHYPGLVVPQPQRPDKCPLPPMAPETPPVPSSASSSSSSSSSPFKFKLQPPPLGRRQRAAGEKAVAGADKSGGSAGGLAEGAGALAPPPPPPQIKVEPISEGESEEVEVTDISDEDEEDGEVFKTPRAPPAPPKPEPGEAPGASQCMPLKLRFKRRWSEDCRLEGGGGPAGGFEDEGEDKKVRGEGPGEAGGPLTPRRVSSDLQHATAQLSLEHRDS

SEQ ID NO: 808772 - protein, 348 aa, Homo sapiens
AAGRGEALRGPPDLGAFRGPPLARLPHDPGVFRVYPRPRGGPEPLSPFPVSPLAGPGSLLPPQLSPALPMTPTHLAYTPSPTLSPMYPSGGGGPSGSGGGSHFSFSPEDMKRYLQAHTQSVYNYHLSPRAFLHYPGLVVPQPQRPDKCPLPPMAPETPPVPSSASSSSSSSSSPFKFKLQPPPLGRRQRAAGEKAVAGADKSGGSAGGLAEGAGALAPPPPPPQIKVEPISEGESEEVEVTDISDEDEEDGEVFKTPRAPPAPPKPEPGEAPGASQCMPLKLRFKRRWSEDCRLEGGGGPAGGFEDEGEDKKVRGEGPGEAGGPLTPRRVSSDLQHATAQLSLEHRDS

SEQ ID NO: 808773 - protein, 548 aa, Homo sapiens; identical to SEQ ID NO: 808769

SEQ ID NO: 808774 - protein, 548 aa, Homo sapiens; identical to SEQ ID NO: 808769

SEQ ID NO: 808775 - protein, 548 aa, Homo sapiens; identical to SEQ ID NO: 808769

SEQ ID NO: 808776 - protein, 395 aa, Homo sapiens
MKTPADTGFAFPDWAYKPESSPGSRQIQLWHFILELLRKEEYQGVIAWQGDYGEFVIKDPDEVARLWGVRKCKPQMNYDKLSRALRYYYNKRILHKTKGKRFTYKFNFNKLVLVNYPFIDVGLAGGAVPQSAPPVPSGGSHFRFPPSTPSEVLSPTEDPRSPPACSSSSSSLFSAVVARRLGRGSVSDCSDGTSELEEPLGEDPRARPPGPPDLGAFRGPPLARLPHDPGVFRVYPRPRGGPEPLSPFPVSPLAGPGSLLPPQLSPALPMTPTHLAYTPSPTLSPMYPSGGGGPSGSGGGSHFSFSPEDMKRYLQAHTQSVYNYHLSPRAFLHYPGLVVPQPQRPDKCPLPPMAPETPPVPSSASSSSSSSSSPFKFKLQPPPWAGGWGDGKGVP

SEQ ID NO: 808777 - protein, 273 aa, Homo sapiens
MSPKRDGLGTGDGLHSQVLQEQVSTGDNLHECDSQGPSKDTLVREGKTYKCKECGSVFNKNSLLVRHQQIHTGVKPYECQECGKAFPEKVDFVRHMRIHTGEKPCKCVECGKVFNRRSHLLCYRQIHTGEKPYECSECGKTFSYHSVFIQHRVTHTGEKLFGCKECGKTFYYNSSLTRHMKIHTGEKPCKCSECGKTFTYRSVFFRHSMTHTAGKPYECKECGKGFYYSYSLTRHTRSHTGEKPYECLEHRKDFGYHSAFAQQSKIHSGGKNL

SEQ ID NO: 808778 - protein, 357 aa, Homo sapiens
MDLPVNLTSFSLSTPSPLETNHSLGKDDLRPSSPLLSVFGVLILTLLGFLVAATFAWNLLVLATILRVRTFHRVPHNLVASMAVSDVLVAALVMPLSLVHELSGRRWQLGRRLCQLWIACDVLCCTASIWNVTAIALDRYWSITRHMEYTLRTRKCVSNVMIALTWALSAVISLAPLLFGWGETYSEGSEECQVSREPSYAVFSTVGAFYLPLCVVLFVYWKIYKAAKFRVGSRKTNSVSPISEAVEVKDSAKQPQMVFTVRHATVTFQPEGDTWREQKEQRAALMVGILIGVFVLCWIPFFLTELISPLCSCDIPAIWKSIFLWLGYSNSFFNPLIYTAFNKNYNSAFKNFFSRQH

SEQ ID NO: 808779 - protein, 141 aa, Homo sapiens
MLPLCQVLLHMSEQDTSSKYALSYHGIKWASLCAAVSFVNLDLKVLVLWSPSTPSSISRPPLFRPLTCRIRPGSRFNTIYRFRLQQPIQAFPSRSESLALKQPETRIAHTCFSPNMRVLDKWDHAACKILKLPARRDGSRL

SEQ ID NO: 808780 - protein, 105 aa, Homo sapiens
REALCLPAGDTIQRCRTDPDAAAIADATASHAVPPLRCRAGPRTQIRRHAREHARERACAALLARSLRSFQYFGVKFEAVVTVLSLVLLIMVFYVCQPRVDFCND

SEQ ID NO: 808781 - protein, 122 aa, Homo sapiens
MFSYIDKERPVQSLKTSRDTSPSSGSAVSSSKVLDKPSRLTEKELAEAASKWAAEKLEKSDESNLPEISEYEAGSTAPLFTDQPEEPESNTTHGIELFEDSQLTTRSKAIASKTKEIEQVRV

SEQ ID NO: 808782 - protein, 319 aa, Homo sapiens
MAYRRDEMWSEGRYEYERIPRERAPPRSHPSDESGYRWTRDDHSASRQPEYRDMRDGFRRKSFYSSHYARERSPYKRDNTFFRESPVGRKDSPHSRSGSSVSSRSYSPERSKSYSFHQSQHRKSVRPGASYKRQNEGNPERDKERPVQSLKTSRDTSPSSGSAVSSSKVLDKPSRLTEKELAEAASKWAAEKLEKSDESNLPEISEYEAGSTAPLFTDQPEEPESNTTHGIELFEDSQLTTRSKAIASKTKEIEQVYRQDCETFGMVVKMLIEKDPSLEKSIQFALRQNLHEIGERCVEELKHFIAEYDTSTQDFGEPF

SEQ ID NO: 808783 - protein, 312 aa, Homo sapiens
MWSEGRYEYERIPRERAPPRSHPSDESGYRWTRDDHSASRQPEYRDMRDGFRRKSFYSSHYARERSPYKRDNTFFRESPVGRKDSPHSRSGSSVSSRSYSPERSKSYSFHQSQHRKSVRPGASYKRQNEGNPERDKERPVQSLKTSRDTSPSSGSAVSSSKVLDKPSRLTEKELAEAASKWAAEKLEKSDESNLPEISEYEAGSTAPLFTDQPEEPESNTTHGIELFEDSQLTTRSKAIASKTKEIEQVYRQDCETFGMVVKMLIEKDPSLEKSIQFALRQNLHEIGERCVEELKHFIAEYDTSTQDFGEPF

SEQ ID NO: 808784 - protein, 383 aa, Homo sapiens
AALEVPEHVVAYRRDEMWSEGRYEYERIPRERAPPRSHPSDGYNRLVNIVPKKPPLLDRPGEGSYNRYYSHVDYRDYDEGRSFSHDRRSGPPHRGDESGYRWTRDDHSASRQPEYRDMRDGFRRKSFYSSHYARERSPYKRDNTFFRESPVGRKDSPHSRSGSSVSSRSYSPERSKSYSFHQSQHRKSVRPGASYKRQNEGNPERDKERPVQSLKTSRDTSPSSGSAVSSSKVLDKPSRLTEKELAEAASKWAAEKLEKSDESNLPEISEYEAGSTAPLFTDQPEEPESNTTHGIELFEDSQLTTRSKAIASKTKEIEQVYRQDCETFGMVVKMLIEKDPSLEKSIQFALRQNLHEIGERCVEELKHFIAEYDTSTQDFGEPF

SEQ ID NO: 808785 - protein, 294 aa, Homo sapiens
MWSEGRYEYERIPRERAPPRSHPSDESGYRWTRDDHSASRQPEYRDMRDGFRRKSFYSSHYARERSPYNSRSGSSVSSRSYSPERSKSYSFHQSQHRKSVRPGASYKRQNEGNPERDKERPVQSLKTSRDTSPSSGSAVSSSKVLDKPSRLTEKELAEAASKWAAEKLEKSDESNLPEISEYEAGSTAPLFTDQPEEPESNTTHGIELFEDSQLTTRSKAIASKTKEIEQVYRQDCETFGMVVKMLIEKDPSLEKSIQFALRQNLHEIGERCVEELKHFIAEYDTSTQDFGEPF

SEQ ID NO: 808786 - protein, 293 aa, Homo sapiens
MWSEGRYEYERIPRERAPPRSHPSDESGYRWTRDDHSASRQPEYRDMRDGFRRKSFYSSHYARERSPYKRDNTFFRESPVGRKDSPHSRSGSSVSSRSYSPERSKSYSFHQSQHRNKERPVQSLKTSRDTSPSSGSAVSSSKVLDKPSRLTEKELAEAASKWAAEKLEKSDESNLPEISEYEAGSTAPLFTDQPEEPESNTTHGIELFEDSQLTTRSKAIASKTKEIEQVYRQDCETFGMVVKMLIEKDPSLEKSIQFALRQNLHEIGERCVEELKHFIAEYDTSTQDFGEPF

SEQ ID NO: 808787 - protein, 355 aa, Homo sapiens
MAYRRDEMWSEGRYEYERIPRERAPPRSHPSDGYNRLVNIVPKKPPLLDRPGEGSYNRYYSHVDYRDYDEGRSFSHDRRSGPPHRGDESGYRWTRDDHSASRQPEYRDMRDGFRRKSFYSSHYARERSPYKRDNTFFRESPVGRKDSPHSRSGSSVSSRSYSPERSKSYSFHQSQHRNKERPVQSLKTSRDTSPSSGSAVSSSKVLDKPSRLTEKELAEAASKWAAEKLEKSDESNLPEISEYEAGSTAPLFTDQPEEPESNTTHGIELFEDSQLTTRSKAIASKTKEIEQVYRQDCETFGMVVKMLIEKDPSLEKSIQFALRQNLHEIGERCVEELKHFIAEYDTSTQDFGEPF

SEQ ID NO: 808788 - protein, 434 aa, Homo sapiens [sequence omitted]

SEQ ID NO: 808789 - protein, 256 aa, Homo sapiens
RAPEVPTWDNGGERTAAFTGSPGGPESWLTEETKCGLRDDMNMKEFRENEHLLEVIPVMNLVIDGQETIILQAGNLNTDKERPVQSLKTSRDTSPSSGSAVSSSKVLDKPSRLTEKELAEAASKWAAEKLEKSDESNLPEISEYEAGSTAPLFTDQPEEPESNTTHGIELFEDSQLTTRSKAIASKTKEIEQVYRQDCETFGMVVKMLIEKDPSLEKSIQFALRQNLHEIGERCVEELKHFIAEYDTSTQDFGEPF

SEQ ID NO: 808790 - protein, 434 aa, Homo sapiens [sequence omitted]

SEQ ID NO: 808791 - protein, 316 aa, Homo sapiens
MWSEGRYEYERIPRERAPPRSHPSDESGYRWTRDDHSASRQPEYRDMRDGFRRKSFYSSHYARERSPYKRDNTFFRESPVGRKDSPHSRSGSSVSSRSYSPERSKSYSFHQSQHRKSVRPGASYKRQNEGNPERDKERPVQSLKTSRDTSPSSGSAVSSSKVLDKPSRLTEKELAEAASKWAAEKLEKSDESNLPEISEYEAGSTAPLFTDQPEEPESNTTHGIELFEDSQLTTRSKAIASKTKEIEQVYRQDCETFGMVVKMLIEKDPSLEKSIQFALRQNLHEIGERCVEELKHFIAEYDTSTQDFGRHVRGIL

SEQ ID NO: 808792 - protein, 176 aa, Homo sapiens
ERNLKGKGAFRRLRLPPQWFSFFIKVLDKPSRLTEKELAEAASKWAAEKLEKSDESNLPEISEYEAGSTAPLFTDQPEEPESNTTHGIELFEDSQLTTRSKAIASKTKEIEQVYRQDCETFGMVVKMLIEKDPSLEKSIQFALRQNLHEIGERCVEELKHFIAEYDTSTQDFGEPF

SEQ ID NO: 808793 - protein, 294 aa, Homo sapiens
MWSEGRYEYERIPRERAPPRSHPSDESGYRWTRDDHSASRQPEYRDMRDGFRRKSFYSSHYARERSPYKRDNTFFRESPVGRKDSPHSRSGSSVSSRSYSPERSKSYSFHQSQHRKSVRPGASYKRQNEGNPERDKERPVQSLKTSRDTSPSSGSAVSSSKVLDKPSRLTEKELAEAASKWAAAGSTAPLFTDQPEEPESNTTHGIELFEDSQLTTRSKAIASKTKEIEQVYRQDCETFGMVVKMLIEKDPSLEKSIQFALRQNLHEIGERCVEELKHFIAEYDTSTQDFGEPF

SEQ ID NO: 808794 - protein, 254 aa, Homo sapiens
MWSEGRYEYERIPRERAPPRSHPSDESGYRWTRDDHSASRQPEYRDMRDGFRRKSFYSSHYARERSPYKRDNTFFRESPVGRKDSPHSRSGSSVSSRSYSPERSKSYSFHQSQHRKSVRPGASYKRQNEGNPERDKERPVQSLKTSRDTSPSSGSAVSSSKVLDKPSRLTEKELAEAASKWAAEKLEKSDESNLPEISEYEAGSTAPLFTDQPEEPESNTTHGIELFEDSQLTTRSKAIASKTKEIEQDIRDGV

SEQ ID NO: 808795 - protein, 70 aa, Homo sapiens
RAPEVPTWDNGGERTAAFTGSPGGPESWLTEETKCGLRDDMNMKEFRENEHLLEVIPVFTDKTVKLSGWW

SEQ ID NO: 808796 - protein, 107 aa, Homo sapiens
MWSEGRYEYERIPRERAPPRSHPSDGYNRLVNIVPKKPPLLDRPGEGSYNRYYSHVDYRDYDEGRSFSHDRRSGPPHRGDESGYRWTRDDHSASRQPEYSRDGVSPC

SEQ ID NO: 808797 - protein, 319 aa, Homo sapiens; identical to SEQ ID NO: 808782

SEQ ID NO: 808798 - protein, 367 aa, Homo sapiens
MWSEGRYEYERIPRERAPPRSHPSDGYNRLVNIVPKKPPLLDRPGEGSYNRYYSHVDYRDYDEGRSFSHDRRSGPPHRGDESGYRWTRDDHSASRQPEYRDMRDGFRRKSFYSSHYARERSPYKRDNTFFRESPVGRKDSPHSRSGSSVSSRSYSPERSKSYSFHQSQHRKSVRPGASYKRQNEGNPERDKERPVQSLKTSRDTSPSSGSAVSSSKVLDKPSRLTEKELAEAASKWAAEKLEKSDESNLPEISEYEAGSTAPLFTDQPEEPESNTTHGIELFEDSQLTTRSKAIASKTKEIEQVYRQDCETFGMVVKMLIEKDPSLEKSIQFALRQNLHEIGERCVEELKHFIAEYDTSTQDFGEPF

SEQ ID NO: 808799 - protein, 376 aa, Homo sapiens
LALWVDTSFYVFDTLSPKDVGMTQKHQYFIQESDGYNRLVNIVPKKPPLLDRPGEGSYNRYYSHVDYRDYDEGRSFSHDRRSGPPHRGDESGYRWTRDDHSASRQPEYRDMRDGFRRKSFYSSHYARERSPYKRDNTFFRESPVGRKDSPHSRSGSSVSSRSYSPERSKSYSFHQSQHRKSVRPGASYKRQNEGNPERDKERPVQSLKTSRDTSPSSGSAVSSSKVLDKPSRLTEKELAEAASKWAAEKLEKSDESNLPEISEYEAGSTAPLFTDQPEEPESNTTHGIELFEDSQLTTRSKAIASKTKEIEQVYRQDCETFGMVVKMLIEKDPSLEKSIQFALRQNLHEIGERCVEELKHFIAEYDTSTQDFGEPF

SEQ ID NO: 808800 - protein, 348 aa, Homo sapiens
MWSEGRYEYERIPRERAPPRSHPSDGYNRLVNIVPKKPPLLDRPGEGSYNRYYSHVDYRDYDEGRSFSHDRRSGPPHRGDESGYRWTRDDHSASRQPEYRDMRDGFRRKSFYSSHYARERSPYKRDNTFFRESPVGRKDSPHSRSGSSVSSRSYSPERSKSYSFHQSQHRNKERPVQSLKTSRDTSPSSGSAVSSSKVLDKPSRLTEKELAEAASKWAAEKLEKSDESNLPEISEYEAGSTAPLFTDQPEEPESNTTHGIELFEDSQLTTRSKAIASKTKEIEQVYRQDCETFGMVVKMLIEKDPSLEKSIQFALRQNLHEIGERCVEELKHFIAEYDTSTQDFGEPF

SEQ ID NO: 808801 - protein, 293 aa, Homo sapiens; identical to SEQ ID NO: 808786

SEQ ID NO: 808802 - protein, 278 aa, Homo sapiens
AALEVPEHVVAYRRDEMWSEGRYEYERIPRERAPPRSHPSDESGYRWTRDDHSASRQPEYRESPVGRKDSPHSRSGSSVSSRSYSPERSKSYSFHQSQHRNKERPVQSLKTSRDTSPSSGSAVSSSKVLDKPSRLTEKELAEAASKWAAEKLEKSDESNLPEISEYEAGSTAPLFTDQPEEPESNTTHGIELFEDSQLTTRSKAIASKTKEIEQVYRQDCETFGMVVKMLIEKDPSLEKSIQFALRQNLHEIGERCVEELKHFIAEYDTSTQDFGEPF

SEQ ID NO: 808803 - protein, 434 aa, Homo sapiens [sequence omitted]

SEQ ID NO: 808804 - protein, 282 aa, Homo sapiens
MRQKPSESASATGGWVRELVLQELRLRDTTTSGALQCWSGEASFYTRPALLGGATVFEMKPGGDRLSTGRGSSFLGTLDPSGAEKEMQTGLLTTTRNAFGCPSAPGTMPPTACRAGSVPELFPGTAVSSSKVLDKPSRLTEKELAEAASKWAAEKLEKSDESNLPEISEYEAGSTAPLFTDQPEEPESNTTHGIELFEDSQLTTRSKAIASKTKEIEQVYRQDCETFGMVVKMLIEKDPSLEKSIQFALRQNLHEIGERCVEELKHFIAEYDTSTQDFGEPF

SEQ ID NO: 808805 - protein, 328 aa, Homo sapiens
MWSEGRYEYERIPRERAPPRSHPSDESGYRWTRDDHSASRQPEYRDMRDGFRRKSFYSSHYARERSPYKRDNTFFRESPVGRKDSPHSRSGSSVSSRSYSPERSKSYSFHQSQHRKSVRPGASYKRQNEGNPERDKERPVQSLKTSRDTSPSSGSAVSSSKVLDKPSRLTEKELAEAASKWAAEKLEKSDESNLPEISEYEAGSTAPLFTDQPEEPESNTTHGIELFEDSQLTTRSKAIASKTKEIEQVYRQDCETFGMVVKMLIEKDPSLEKSIQFALRQNLHEIESAGQTWQQVPPVRNTEMDHDGTPENEGEETAQSDMLVFTSP

SEQ ID NO: 808806 - protein, 251 aa, Homo sapiens
MWSEGRYEYERIPRERAPPRSHPSDESGYRWTRDDHSASRQPEYRDMRDGFRRKSFYSSHYARERSPYKRDNTFFRESPVGRKDSPHSRSGSSVSSRSYSPERSKSYSFHQSQHRKSVRPGASYKRQNEGNPERDKERPVQSLKTSRDTSPSSGSAVSSSKVLDKPSRLTEKELAEAASKWAAEKLEKSDESNLPEISEYEAGSTAPLFTDQPEEPESNTTHGIELFEDSQLTTRSKAIASKTKEIEQVRV

SEQ ID NO: 808807 - protein, 95 aa, Homo sapiens
CARRKYLPGITAASGRLHLRGLPEGQSRKLLKTLNLIPKRTQWLTEETKCGLRDDMNMKEFRENEHLLEVIPVMNLVIDGQETIILQAGNLNTGT

SEQ ID NO: 808808 - protein, 154 aa, Homo sapiens
MAENSGRAGKSSGSGAGKGAVSAEQVIAGFNRLRQEQRGLASKAAELEMELNEHSLVIDTLKEVDETRKCYRMVGGVLVERTVKEVLPALENNKEQIQKIIETLTQQLQAKGKELNEFREKHNIRLMGEDEKPAAKENSEGAGAKASSAGVLVS

SEQ ID NO: 808809 - protein, 154 aa, Homo sapiens; identical to SEQ ID NO: 808808

SEQ ID NO: 808810 - protein, 154 aa, Homo sapiens; identical to SEQ ID NO: 808808

SEQ ID NO: 808811 - protein, 224 aa, Homo sapiens
MAENSGRAGKSSGSGAGKGAVSAEQVIAGFNRLRQEQRGLASKAAELEMELNEHSLVIDTLKEVDETRKCYRMVGGVLVERTVKEVLPALENNKEQIQKIIETLTQQLQAKGKELNEFREKPPFFWGVFFPFPRPFGPPPPGKIFGSGGQNPSPGSAVLTSRAACWAWGPAKGPGAIPDAANGGVDMARLQLQAGRGQTAGVRGLPGIGRLWGLSVGTSLRDPP

SEQ ID NO: 808812 - protein, 231 aa, Homo sapiens
MGGLWRPGWRCVPFCGWRWIHPGSPTRAAERVEPFLRPEWSGTGGAERGLRWLGTWKRCSLRARHPALQPPRRPKSSNPFTRAQEEERRRQNKTTLTYVAAVAVGMLGASYAAVPLYRLYCQTTGLGGSAVAGHASDKIENMVPVKDRIIKISFNADVHASLQWNFRPQQTEIYVVPGETALAFYRAKNPTDKPVIGISTYNIVPFEAGQYFNKIQASKLHRVYVLESWHL

SEQ ID NO: 808813 - protein, 231 aa, Homo sapiens; identical to SEQ ID NO: 808812

SEQ ID NO: 808814 - protein, 152 aa, Homo sapiens [sequence omitted]

SEQ ID NO: 808815 - protein, 155 aa, Homo sapiens
MGGLWRPGWRCVPFCGWRWIHPGSPTRAAERVEPFLRPEWSGTGGAERGLRWLGTWKRCSLRARHPALQPPRRPKSSNPFTRAQEEERRRQNKTTLTYVAAVAVGMLGASYAAVPLYRLYCQAGVALIAQAGVALIAQAGVALCPGWSSSYAQDG

SEQ ID NO: 808816 - protein, 276 aa, Homo sapiens
MGGLWRPGWRCVPFCGWRWIHPGSPTRAAERVEPFLRPEWSGTGGAERGLRWLGTWKRCSLRARHPALQPPRRPKSSNPFTRAQEEERRRQNKTTLTYVAAVAVGMLGASYAAVPLYRLYCQTTGLGGSAVAGHASDKIENMVPVKDRIIKISFNADVHASLQWNFRPQQTEIYVVPGETALAFYRAKNPTDKPVIGISTYNIVPFEAGQYFNKIQCFCFEEQRLNPQEEVDMPVFFYIDPEFAEDPRMIKVDLITLSYTFFEAKEGHKLPVPGYN

SEQ ID NO: 808817 - protein, 276 aa, Homo sapiens; identical to SEQ ID NO: 808816

SEQ ID NO: 808818 - protein, 230 aa, Homo sapiens
MGGLWRPGWRCVPFCGWRWIHPGSPTRAAERVEPFLRPEWSGTGGAERGLRWLGTWKRCSLRARHPALQPPRRPKSSNPFTRAQEEERRRQNKTTLTYVAAVAVGMLGASYAAVPLYRLYCQTTGLGGSAVAGHASDKIENMVPVKDRIIKISFNADVHASLQWNFRPQQTEIYVVPGETALAFYRAKNPTDKPVIGISTYNIVPFEAGQYFNKIQVHQSVNFTEYDKDT

SEQ ID NO: 808819 - protein, 231 aa, Homo sapiens; identical to SEQ ID NO: 808812

SEQ ID NO: 808820 - protein, 221 aa, Homo sapiens
MGGLWRPGWRCVPFCGWRWIHPGSPTRAAERVEPFLRPEWSGTGGAERGLRWLGTWKRCSLRARHPALQPPRRPKSSNPFTRAQEEERRRQNKTTLTYVAAVAVGMLGASYAAVPLYRLYCQTTGLGGSAVAGHASDKIENMVPVKDRIIKISFNADVHASLQWNFRPQQTEIYVVPGETALAFYRAKNPTDKPVIGISTYNIVPFEAGQYFNKIQLCDDF

SEQ ID NO: 808821 - protein, 276 aa, Homo sapiens; identical to SEQ ID NO: 808816

SEQ ID NO: 808822 - protein, 151 aa, Homo sapiens
GERGFARVYVFFKTVDLYNWKSHSKGLWVSPREFVTLIWRIFSTHNPTWPGVQTVTATLLTAEDKSATMAKTKEEADNMCADNLVTWPVEVSVPIANPNWDPSDNKNQEWLHHYRNMLLRGMREASQSLVNWGNLREIEQGPNENPSAFLN

SEQ ID NO: 808823 - protein, 276 aa, Homo sapiens; identical to SEQ ID NO: 808816

SEQ ID NO: 808824 - protein, 276 aa, Homo sapiens; identical to SEQ ID NO: 808816

SEQ ID NO: 808825 - protein, 276 aa, Homo sapiens; identical to SEQ ID NO: 808816

SEQ ID NO: 808826 - protein, 246 aa, Homo sapiens
MGGLWRPGWRCVPFCGWRWIHPGSPTRAAERVEPFLRPEWSGTGGAERGLRWLGTWKRCSLRARHPALQPPRRPKSSNPFTRAQEEERRRQNKTTLTYVAAVAVGMLGASYAAVPLYRLYCQTTGLGGSAVAGHASDKIENMVPVKDRIIKISFNADVHASLQWNFRPQQTEIYVVPGETALAFYRAKNPTDKPVIGISTYNIVPFEAGQYFNKIQRFLDSFGNQQLFGGESFFLALTATLEVPCS

SEQ ID NO: 808827 - protein, 617 aa, Homo sapiens [sequence omitted]

SEQ ID NO: 808828 - protein, 658 aa, Homo sapiens
AFAAGARVESCAPVPGPELRLRLGRLRCLKMAELGELKHMVMSFRVSELQVLLGFAGRNKSGRKHELLAKALHLLKSSCAPSVQMKIKELYRRRFPRKTLGPSDLSLLSLPPGTSPVGSPGPLAPIPPTLLAPGTLLGPKREVDMHPPLPQPVHPDVTMKPLPFYEVYGELIRPTTLASTSSQRFEEAHFTFALTPQQVQQILTSREVLPGAKCDYTIQVQLRFCLCETSCPQEDYFPPNLFVKVNGKLCPLPGYLPPTKNGAEPKRPSRPINITPLARLSATVPNTIVVNWSSEFGRNYSLSVYLVRQLTAGTLLQKLRAKGIRNPDHSRALIKEKLTADPDSEVATTSLRVSLMCPLGKMRLTVPCRALTCAHLQSFDAALYLQMNEKKPTWTCPVCDKKAPYESLIIDGLFMEILSSCSDCDEIQFMEDGSWCPMKPKKEASEVCPPPGYGLDGLQYSPVQGGDPSENKKKVEVIDLTIESSSDEEDLPPTKKHCSVTSAAIPALPGSKGVLTSGHQPSSVLRSPAMGTLGGDFLSSLPLHEYPPAFPLGADIQGLDLFSFLQTESQHYGPSVITSLDEQDALGHFFQYRGTPSHFLGPLAPTLGSSHCSATPAPPPGRVSSIVAPGGALREGHGGPLPSGPSLTGCRSDIISLD

SEQ ID NO: 808829 - protein, 469 aa, Homo sapiens
AFAAGARVESCAPVPGPELRLRLGRLRCLKMAELGELKHMVMSFRVSELQVLLGFAGRNKSGRKHELLAKALHLLKSSCAPSVQMKIKELYRRRFPRKTLGPSDLSLLSLPPGTSPVGSPGPLAPIPPTLLAPGTLLGPKREVDMHPPLPQPVHPDVTMKPLPFYEVYGELIRPTTLASTSSQRFEEAHFTFALTPQQVQQILTSREVLPGAKCDYTIQVQLRFCLCETSCPQEDYFPPNLFVKVNGKLCPLPGYLPPTKNGAEPKRPSRPINITPLARLSATVPNTIVVNWSSEFGRNYSLSVYLVRQLTAGTLLQKLRAKGIRNPDHSRALIKEKLTADPDSEVATTSLRVSLMCPLGKMRLTVPCRALTCAHLQSFDAALYLQMNEKKPTWTCPVCDKKAPYESLIIDGLFMEILSSCSDCDEIQFMEDGSWCPMKPKKEASEASSTAQSRGEIHQRIRRRSKLLT

SEQ ID NO: 808830 - protein, 412 aa, Homo sapiens
AFAAGARVESCAPVPGPELRLRLGRLRCLKMAELGELKHMVMSFRVSELQVLLGFAGRNKSGRKHELLAKALHLLKSSCAPSVQMKIKELYRRRFPRKTLGPSDLSLLSLPPGTSPVGSPGPLAPIPPTLLAPGTLLGPKREVDMHPPLPQPVHPDVTMKPLPFYEVYGELIRPTTLASTSSQRFEEAHFTFALTPQQVQQILTSREVLPGAKCDYTIQVQLRFCLCETSCPQEDYFPPNLFVKVNGKLCPLPGYLPPTKNGAEPKRPSRPINITPLARLSATVPNTIVVNWSSEFGRNYSLSVYLVRQLTAGTLLQKLRAKGIRNPDHSRALIKEKLTADPDSEVATTSLRVSLMCPLGKMRLTVPCRALTCAHLQSFDAALYLQMNEKKPTWTCPVCDKKAPYESLIIDG

SEQ ID NO: 808831 - protein, 222 aa, Homo sapiens
AFAAGARVESCAPVPGPELRLRLGRLRCLKMAELGELKHMVMSFRVSELQVLLGFAGRNKSGRKHELLAKALHLLKSSCAPSVQMKIKELYRRRFPRKTLGPSDLSLLSLPPGTSPVGSPGPLAPIPPTLLAPGTLLGPKREVDMHPPLPQPVHPDVTMKPLPFYEVYGELIRPTTLGMALCGPLVFWTPYLFPKHFLGFSPMGSVTWDGGDFCGCLCMGLE

SEQ ID NO: 808832 - protein, 72 aa, Homo sapiens
PTKNGAEPKRPSRPINITPLARLSATVPNTIVVNWSSEFGRVSTAKAGAWKSLLRVKGNHPVSWVGEAFSSL

SEQ ID NO: 808833 - protein, 658 aa, Homo sapiens; identical to SEQ ID NO: 808828

SEQ ID NO: 808834 - protein, 710 aa, Homo sapiens
AFAAGARVESCAPVPGPELRLRLGRLRCLKMAELGELKHMVMSFRVSELQVLLGFAGRNKSGRKHELLAKALHLLKSSCAPSVQMKIKELYRRRFPRKTLGPSDLSLLSLPPGTSPVGSPGPLAPIPPTLLAPGTLLGPKREVDMHPPLPQPVHPDVTMKPLPFYEVYGELIRPTTLGMALCGPLVFWTPYLFPKHFLGFSPMGSVTWDGGDFCGCLCMGLENCPFVSSASTSSQRFEEAHFTFALTPQQVQQILTSREVLPGAKCDYTIQVQLRFCLCETSCPQEDYFPPNLFVKVNGKLCPLPGYLPPTKNGAEPKRPSRPINITPLARLSATVPNTIVVNWSSEFGRNYSLSVYLVRQLTAGTLLQKLRAKGIRNPDHSRALIKEKLTADPDSEVATTSLRVSLMCPLGKMRLTVPCRALTCAHLQSFDAALYLQMNEKKPTWTCPVCDKKAPYESLIIDGLFMEILSSCSDCDEIQFMEDGSWCPMKPKKEASEVCPPPGYGLDGLQYSPVQGGDPSENKKKVEVIDLTIESSSDEEDLPPTKKHCSVTSAAIPALPGSKGVLTSGHQPSSVLRSPAMGTLGGDFLSSLPLHEYPPAFPLGADIQGLDLFSFLQTESQHYGPSVITSLDEQDALGHFFQYRGTPSHFLGPLAPTLGSSHCSATPAPPPGRVSSIVAPGGALREGHGGPLPSGPSLTGCRSDIISLD

SEQ ID NO: 808835 - protein, 419 aa, Homo sapiens
AFAAGARVESCAPVPGPELRLRLGRLRCLKMAELGELKHMVMSFRVSELQVLLGFAGRNKSGRKHELLAKALHLLKSSCAPSVQMKIKELYRRRFPRKTLGPSDLSLLSLPPGTSPVGSPGPLAPIPPTLLAPGTLLGPKREVDMHPPLPQPVHPDVTMKPLPFYEVYGELIRPTTLASTSSQRFEEAHFTFALTPQQVQQILTSREVLPGAKCDYTIQVQLRFCLCETSCPQEDYFPPNLFVKVNGKLCPLPGYLPPTKNGAEPKRPSRPINITPLARLSATVPNTIVVNWSSEFGRNYSLSVYLVRQLTAGTLLQKLRAKGIRNPDHSRALIKEKLTADPDSEVATTSLRVSLMCPLGKMRLTVPCRALTCAHLQSFDAALYLQMNEKKPTWTCPVCDKKAPYESLIIDGSVAHGYR

SEQ ID NO: 808836 - protein, 222 aa, Homo sapiens; identical to SEQ ID NO: 808831

SEQ ID NO: 808837 - protein, 216 aa, Homo sapiens
AFAAGARVESCAPVPGPELRLRLGRLRCLKMAELGELKHMVMSFRVSELQVLLGFAGRNKSGRKHELLAKALHLLKSSCAPSVQMKIKELYRRRFPRKTLGPSDLSLLSLPPGTSPVGSPGPLAPIPPTLLAPGTLLGPKREVDMHPPLPQPVHPDVTMKPLPFYEVYGELIRPTTLASTSSQRFEEAHFTFALTPQQVQQILTSSQQRTTRQTRT

SEQ ID NO: 808838 - protein, 344 aa, Homo sapiens
MGFNLTFHLSYKFRLLLLLTLCLTVVGWATSNYFVGAIQEIPKAKEFMANFHKTLILGKGKTLTNEASTKKVELDNCPSVSPYLRGQSKLIFKPDLTLEEVQAENPKVSRGRYRPQECKALQRVAILVPHRNREKHLMYLLEHLHPFLQRQQLDYGIYVIHQAEGKKFNRAKLLNVGYLEALKEENWDCFIFHDVDLVPENDFNLYKCEEHPKHLVVGRNSTGYRLRYSGYFGGVTALSREQFFKVNGFSNNYWGWGGEDDDLRLRVELQRMKISRPLPEVGKYTMVFHTRDKGNEVNAERMKLLHQVSRVWRTDGLSSCSYKLVSVEHNPLYINITVDFWFGA

SEQ ID NO: 808839 - protein, 344 aa, Homo sapiens; identical to SEQ ID NO: 808838

SEQ ID NO: 808840 - protein, 344 aa, Homo sapiens; identical to SEQ ID NO: 808838

SEQ ID NO: 808841 - protein, 246 aa, Homo sapiens
MGFNLTFHLSYKFRLLLLLTLCLTVVGWATSNYFVGAIQEIPKAKEFMANFHKTLILGKGKTLTNEASTKKVELDNCPSVSPYLRGQSKLIFKPDLTLEEVQAENPKVSRGRYRPQECKALQRVAILVPHRNREKHLMYLLEHLHPFLQRQQLDYGIYVIHQAEGKKFNRAKLLNVGYLEALKEENWDCFIFHDVDLVPENDFNLYKCEEHPKHLVVGRNSTGYRLRYSGYFGGVTALSREQFFKG

SEQ ID NO: 808842 - protein, 344 aa, Homo sapiens; identical to SEQ ID NO: 808838

SEQ ID NO: 808843 - protein, 109 aa, Homo sapiens
MYLLEHLHPFLQRQQLDYGIYVIHQAEGKKFNRAKLLNVGYLEALKEENWDCFIFHDVDLVPENDFNLYKCEEHPKHLVVGRNSTGYRLRYSGYFGGVTALSREQFFKG

SEQ ID NO: 808844 - protein, 109 aa, Homo sapiens
MGFNLTFHLSYKFRLLLLLTLCLTVVGWATSNYFVGAIQEIPKAKEFMANFHKTLILGKGKTLTNEASTKKVELDNCPSVSPYLRGQSKLIFKPDLTLEEVQEIRLLNV

SEQ ID NO: 808845 - protein, 176 aa, Homo sapiens
MGFNLTFHLSYKFRLLLLLTLCLTVVGWATSNYFVGAIQEIPKAKEFMANFHKTLILGKGKTLTNEASTKKVELDNCPSVSPYLRGQSKLIFKPDLTLEEVQAENPKVSRGRYRPQECKALQRVAILVPHRNREKHLMYLLEHLHPFLQRQQLDYGIYVIHQAEGKKFRRSRRGSS

SEQ ID NO: 808846 - protein, 102 aa, Homo sapiens
MTWRRPWGSPASAGAVGRAGGLQEAEPGGRHRLRCWRSARRRLCCGPGEPDEVLPGRKKSRAHSYPRSRFRGRPQHFSAGCINLKKPLLPGNPPSPAFQRGN

SEQ ID NO: 808847 - protein, 102 aa, Homo sapiens; identical to SEQ ID NO: 808846

SEQ ID NO: 808848 - protein, 603 aa, Homo sapiens
MFDADTTTNLVTISFILPIGVHVFGLCSTALITDIIQLSTGYQAPYFLTVCKPNYTSLNVSCKENSYIVEDICSGSDLTVINSGRKSFPSQHATLAAFAAVYVSMYFNSTLTDSSKLLKPLLVFTFIICGIICGLTRITQYKNHPVDVYCGFLIGGGIALYLGLYAVGNFLPSDESMFQHRDALRSLTDLNQDPNRLLSAKNGSSSDGIAHTEGILNRNHRDASSLTNLKRANADVEIITPRSPMGKENMVTFSNTLPRANTPSVEDPVRRNASIHASMDSARSKQLLTQWKNKNESRKLSLQVIEPEPGQSPPRSIEMRSSSEPSRVGVNGDHHGPGNQYLKIQPGAVPGCNNSMPGGPRVSIQSRPGSSQLVHIPEETQENISTSPKSSSARAKWLKAAEKTVACNRSNSQPRIMQVIAMSKQQGVLQSSPKNTEGSTVSCTGSIRYKTLTDHEPSGIVRVEAHPENNRPIIQIPSTEGEGSGSWKWKAPEKGSLRQTYELNDLNRDSESCESLKDSFGSGDRKRSNIDSNEHHHHGITTIRVTPVEGSEIGSETLSISSSRDSTLRRKGNIILIPERSNSPENTRNIFYKGTSPTRAYKD

SEQ ID NO: 808849 - protein, 755 aa, Homo sapiens
GRGECDISGAGRLGLEEAARLSCAVHTSPGGGRRPGQAAGMSAKERPKGKVIKDSVTLLPCFYFVELPILASSVVSLYFLELTDVFKPVHSGFSCYDRSLSMPYIEPTQEAIPFLMLLSLAFAGPAITIMVGEGILYCCLSKRRNGVGLEPNINAGGCNFNSFLRRAVRFVGVHVFGLCSTALITDIIQLSTGYQAPYFLTVCKPNYTSLNVSCKENSYIVEDICSGSDLTVINSGRKSFPSQHATLAAFAAVYVSMYFNSTLTDSSKLLKPLLVFTFIICGIICGLTRITQYKNHPVDVYCGFLIGGGIALYLGLYAVGNFLPSDESMFQHRDALRSLTDLNQDPNRLLSAKNGSSSDGIAHTEGILNRNHRDASSLTNLKRANADVEIITPRSPMGKENMVTFSNTLPRANTPSVEDPVRRNASIHASMDSARSKQLLTQWKNKNESRKLSLQVIEPEPGQSPPRSIEMRSSSEPSRVGVNGDHHGPGNQYLKIQPGAVPGCNNSMPGGPRVSIQSRPGSSQLVHIPEETQENISTSPKSSSARAKWLKAAEKTVACNRSNSQPRIMQVIAMSKQQGVLQSSPKNTEGSTVSCTGSIRYKTLTDHEPSGIVRVEAHPENNRPIIQIPSTEGEGSGSWKWKAPEKGSLRQTYELNDLNRDSESCESLKDSFGSGDRKRSNIDSNEHHHHGITTIRVTPVEGSEIGSETLSISSSRDSTLRRKGNIILIPERSNSPENTRNIFYKGTSPTRAYKD

SEQ ID NO: 808850 - protein, 854 aa, Homo sapiens
MALEQALQAARQGELDVLRSLHAAGLLGPSLRDPLDALPVHHAARAGKLHCLRFLVEEAALPAAARARNGATPAHDASATGHLACLQWLLSQGGCRVQDKDNSGATVLHLAARFGHPEVVNWLLHHGGGDPTAATDMGALPIHYAAAKGDFPSLRLLVEHYPEGVNAQTKNGATPLYLACQEGHLEVTQYLVQECGADPHARAHDGMTPLHAAAQMGHSPVIVWLVSCTDVSLSEQDKDGATAMHFAASRGHTKVLSWLLLHGGEISADLWGGTPLHDAAENGELECCQILVVNGAELDVRDRDGYTAADLSDFNGHSHCTRYLRTVENLSVEHRVLSRDPSAELEAKQPDSGMSSPNTTVSVQPLNFDLSSPTSTLSNYDSCSSSHSSIKGQHPPCGLSSARAADIQSYMDMLNPELGLPRGTIGKPTPPPPPPSFPPPPPPPGTQLPPPPPGYPAPKPPVGPQAADIYMQTKNKLRHVETEALKKELSSCDGHDGLRRQDSSRKPRAFSKQPSTGDYYRQLGRCPGETLAARPGMAHSEEVRARQPARAGCPRLGPAARGSLEGPSAPPQAALLPGNHVPNGCAADPKASRELPLPPPPPPPPLPEAASSPPPAPPLPLESAGPGCGQRRSSSSTGSTKSFNMMSPTGDNSELLAEIKAGKSLKPTPQSKGLTTVFSGIGQPAFQPDSPLPSVSPALSPVRSPTPPAAGFQPLLNGSLVPVPPTTPAPGVQLDVEALIPTHDEQGRPIPEWKRQVMVRKMQLKMQEEEEQRRKEEEEEARLASMPAWRRDLLRKKLEEEREQKRKEEERQKQEELRREKEQSEKLRTLGYDESKLAPWQRQVILKKGDIAKY

SEQ ID NO: 808851 - protein, 854 aa, Homo sapiens; identical to SEQ ID NO: 808850

SEQ ID NO: 808852 - protein, 210 aa, Homo sapiens [sequence omitted]

SEQ ID NO: 808853 - protein, 248 aa, Homo sapiens
AVPVSSCPPSLLTPLSLLSSWSLEVRVLRHRKSTKSFNMMSPTGDNSELLAEIKAGKSLKPTPQSKGLTTVFSGIGQPAFQPDSPLPSVSPALSPVRSPTPPAAGFQPLLNGSLVPVPPTTPAPGVQLDVEALIPTHDEQGRPIPEWKRQVMVRKMQLKMQEEEEQRRKEEEEEARLASMPAWRRDLLRKKLEEEREQKRKEEERQKQEELRREKEQSEKLRTLGYDESKLAPWQRQVILKKGDIAKY

SEQ ID NO: 808854 - protein, 802 aa, Homo sapiens
MALEQALQAARQGELDVLRSLHAAGLLGPSLRDPLDALPVHHAARAGKLHCLRFLVEEAALPAAARARNGATPAHDASATGHLACLQWLLSQGGCRVQDKDNSGATVLHLAARFGHPEVVNWLLHHGGGDPTAATDMGALPIHYAAAKGDFPSLRLLVEHYPEGVNAQTKNGATPLYLACQEGHLEVTQYLVQECGADPHARAHDGMTPLHAAAQMGHSPVIVWLVSCTDVSLSEQDKDGATAMHFAASRGHTKVLSWLLLHGGEISADLWGGTPLHDAAENGELECCQILVVNGAELDVRDRDGYTAADLSDFNGHSHCTRYLRTVENLSVEHRVLSRDPSAELEAKQPDSGMSSPNTTVSVQPLNFDLSSPTSTLSNYDSCSSSHSSIKGQHPPCGLSSARAADIQSYMDMLNPELGLPRGTIGKPTPPPPPPSFPPPPPPPGTQLPPPPPGYPAPKPPVGPQAADIYMQTKNKLRHVETEALKKELSSCDGHDGLRRQDSSRKPRAFSKQPSTGDYYRQLGRCPGETLAARPGMAHSEEVRARQPARAGCPRLGPAARGSLEGPSAPPQAALLPGNHVPNGCAADPKASRELPLPPPPPPPPLPEAASSPPPAPPLPLESAGPGCGQRRSSSSTGSTKSFNMMSPTGDNSELLAEIKAGKSLKPTPQSKGLTTVFSGIGQPAFQPDSPLPSVSPALSPVRSPTPPAAGFQPLLNGSLVPVPPTTPAPGVQLDVEALIPTHDEQGRPIPEWKRQVMVRKMQLKMQEEEEQRRKERGGATEAGGAAAGEGTVREAADAGLR

SEQ ID NO: 808855 - protein, 159 aa, Homo sapiens
MSAAKCKQSRLWVKALVMKNKKKKIPKHFLTLVLKKTPSPKVCFSFNFLDFARLSGCKLPTLFWMDRDKVFKQRLCPLHKPFPPPPPQPPAAIITGAVKWLLSDGHTTRRQMKRSGSKRGSASQYQPAVPRGGSAGRTVFPRQAAMPPPTAKAPKGNIR

SEQ ID NO: 808856 - protein, 159 aa, Homo sapiens; identical to SEQ ID NO: 808855

SEQ ID NO: 808857 - protein, 402 aa, Homo sapiens
TELQKKSGTGTSVSKRLNMNPQIRNPMERMYRDTFYDNFENEPILYGRSYTWLCYEVKIKRGRSNLLWDTGVFRGQAQVYFKPQYHAEMCFLSWFCGNQLPAYKCFQITWFVSWTPCPDCVAKLAEFLSEHPNVTLTISAARLYYYWERDYRRALCRLSQAGARVKIMDYEEFAYCWENFVYNEGQQFMPWYKFDENYAFLHRTLKEILRYLMDPDTFTFNFNNDPLVLRRRQTYLCYEVERLDNGTWVLMDQHMGFLCNEAKNLLCGFYGRHAELRFLDLVPSLQLDPAQIYRVTWFISWSPCFSWGCAGEVRAFLQENTHVRLRIFAARIYDYDPLYKEALQMLRDAGAQVSIMTYDEFEYCWDTFVYRQGCPFQPWDGLEEHSQALSGRLRAILQNQGN

SEQ ID NO: 808858 - protein, 510 aa, Homo sapiens
TELQKKSGTGTSVSKRLNMNPQIRNPMERMYRDTFYDNFENEPILYGRSYTWLCYEVKIKRGRSNLLWDTGVFRGQAQVYFKPQYHAEMCFLSWFCGNQLPAYKCFQITWFVSWTPCPDCVAKLAEFLSEHPNVTLTISAARLYYYWERDYRRALCRLSQAGARVKIMDYEEFAYCWENFVYNEGQQFMPWYKFDENYAFLHRTLKEILRYLMDPDTFTFNFNNDPLVLRRRQTYLCYEVERLDNGTWVLMDQHMGFLCNEAKNLLCGFYGRHAELRFLDLVPSLQLDPAQIYRVTWFISWSPCFSWGCAGEVRAFLQENTHVRLRIFAARIYDYDPLYKEALQMLRDAGAQVSIMTYDEFEYCWDTFVYRQGCPFQPWDGLEEHSQALSGRLRAILQVRASSLCLVPHRPPPPPRSPVPCLPLCSEPPLGSLLPTGRPAPSLPFLLTASFSFPPPASLPPLPSLSLSPGHLPVPSFHSLTSCSIQPPCSSRIRETEGWASVSKEGRDLG

SEQ ID NO: 808859 - protein, 172 aa, Homo sapiens
LLLESELAVDRPRHHVAAAVLGELRRLRPAAWRCHDLRARGQRGGRTRGKRGRSEGKSEEQKERDHLLAAARPPCTASLVRVLQPSALATSAPRRARPACRGAPENLRVSWPAPAARGSPNLKRVSPCSGGFPSSTQSPMARSQGAVRVLKSPPNRGAGAGAKGACKAGRGH

SEQ ID NO: 808860 - protein, 571 aa, Homo sapiens
MDRSKRNSIAGFPPRVERLEEFEGGGGGEGNVSQVGRVWPSSYRALISAFSRLTRLDDFTCEKIGSGFFSEVFKVRHRASGQVMALKMNTLSSNRANMLKEVQLMNRLSHPNILRFMGVCVHQGQLHALTEYINSGNLEQLLDSNLHLPWTVRVKLAYDIAVGLSYLHFKGIFHRDLTSKNCLIKRDENGYSAVVADFGLAEKIPDVSMGSEKLAVVGSPFWMAPEVLRDEPYNEKADVFSYGIILCEIIARIQADPDYLPRTENFGLDYDAFQHMVGDCPPDFLQLTFNCCNMDPKLRPSFVEIGKTLEEILSRLQEEEQERDRKLQPTARGLLEKAPGVKRLSSLDDKIPHKSPCPRRTIWLSRSQSDIFSRKPPRTVSVLDPYYRPRDGAARTPKVNPFSARQDLMGGKIKFFDLPSKSVISLVFDLDAPGPGTMPLADWQEPLAPPIRRWRSLPGSPEFLHQEACPFVGREESLSDGPPPRLSSLKYRVKEIPPFRASALPAAQAHEAMDCSILQEENGFGSRPQGTSPCPAGASEEMEVEERPAGSTPATFSTSGIGLQTQGKQDG

SEQ ID NO: 808861 - protein, 555 aa, Homo sapiens
MDRSKRNSIAGFPPRVERLEEFEGGGGGEGNVSQVGRVWPSSYRALISAFSRLTRLDDFTCEKIGSGFFSEVFKVRHRASGQVMALKMNTLSSNRANMLKEVQLMNRLSHPNILSYINSGNLEQLLDSNLHLPWTVRVKLAYDIAVGLSYLHFKGIFHRDLTSKNCLIKRDENGYSAVVADFGLAEKIPDVSMGSEKLAVVGSPFWMAPEVLRDEPYNEKADVFSYGIILCEIIARIQADPDYLPRTENFGLDYDAFQHMVGDCPPDFLQLTFNCCNMDPKLRPSFVEIGKTLEEILSRLQEEEQERDRKLQPTARGLLEKAPGVKRLSSLDDKIPHKSPCPRRTIWLSRSQSDIFSRKPPRTVSVLDPYYRPRDGAARTPKVNPFSARQDLMGGKIKFFDLPSKSVISLVFDLDAPGPGTMPLADWQEPLAPPIRRWRSLPGSPEFLHQEACPFVGREESLSDGPPPRLSSLKYRVKEIPPFRASALPAAQAHEAMDCSILQEENGFGSRPQGTSPCPAGASEEMEVEERPAGSTPATFSTSGIGLQTQGKQDG

SEQ ID NO: 808862 - protein, 360 aa, Homo sapiens
YRSSEATKLHWMAPEVLRDEPYNEKADVFSYGIILCEIIARIQADPDYLPRTENFGLDYDAFQHMVGDCPPDFLQLTFNCCNMDPKLRPSFVEIGKTLEEILSRLQEEEQERDRKLQPTARGLLEKAPGVKRLSSLDDKIPHKSPCPRRTIWLSRSQSDIFSRKPPRTVSVLDPYYRPRDGAARTPKVNPFSARQDLMGGKIKFFDLPSKSVISLVFDLDAPGPGTMPLADWQEPLAPPIRRWRSLPGSPEFLHQEACPFVGREESLSDGPPPRLSSLKYRVKEIPPFRASALPAAQAHEAMDCSILQEENGFGSRPQGTSPCPAGASEEMEVEERPAGSTPATFSTSGIGLQTQGKQDG

SEQ ID NO: 808863 - protein, 116 aa, Homo sapiens [sequence omitted]

SEQ ID NO: 808864 - protein, 103 aa, Homo sapiens
CSVPGMDLLELSVAGCQGQLPTTSTEQARMGGGINELSTYAFHTHPQNFGLDYDAFQHMVGDCPPDFLQLTFNCCNVSVFLPLPFIRGWLNPFHLVRTVQRGC

SEQ ID NO: 808865 - protein, 118 aa, Homo sapiens
FFFQKILNCSLYTFSVVEGFMNQRGARVSSPILIISYETFRLHVGVLQKGSVGLVICDEVLDSQQLDSLNTSRRVLISGTPIQNDLLEYFSLVHFVNSGILGKNLALFATSERSPALS

SEQ ID NO: 808866 - protein, 747 aa, Homo sapiens
MRRSLAPSQLAKRKPEGRSCDDEDWQPGLVTPRKRKSSSETQIQECFLSPFRKPLSQLTNQPPCLDSSQHEAFIRSILSKPFKVPIPNYQGPLGSRALGLKRAGVRRALHDPLEKDALVLYEPPPLSAHDQLKLDKEKLPVHVVVDPILSKVLRPHQREGVKFLWECVTSRRIPGSHGCIMADEMGLGKTLQCITLMWTLLRQSPECKPEIDKAVVVSPSSLVKNWYNEVGKWLGGRIQPLAIDGGSKDEIDQKLEGFMNQRGARVSSPILIISYETFRLHVGVLQKGSVGLVICDEGHRLKNSENQTYQALDSLNTSRRVLISGTPIQNDLLEYFSLVHFVNSGILGTAHEFKKHFELPILKGRDAAASEADRQLGEERLRELTSIVNRCLIRRTSDILSKYLPVKIEQVVCCRLTPLQTELYKRFLRQAKPAEELLEGKMSVSSLSSITSLKKLCNHPALIYDKCVEEEDGFVGALDLFPPGYSSKALEPQLSGKMLVLDYILAVTRSRSSDKVVLVSNYTQTLDLFEKLCRARRYLYVRLDGTMSIKKRAKVVERFNSPSSPDFVFMLSSKAGGCGLNLIGANRLVMFDPDWNPANDEQAMARVWRDGQKKTCYIYRLLSAGTIEEKIFQRQSHKKALSSCVVDEEQDVERHFSLGELKELFILDEASLSDTHDRLHCRRCVNSRQIRPPPDGSDCTSDLAGWNHCTDKWGLRDEVLQAAWDAASTAITFVFHQRSHEEQRGLR

SEQ ID NO: 808867 - protein, 567 aa, Homo sapiens
MADEMGLGKTLQCITLMWTLLRQSPECKPEIDKAVVVSPSSLVKNWYNEVGKWLGGRIQPLAIDGGSKDEIDQKLEGFMNQRGARVSSPILIISYETFRLHVGVLQKGSVGLVICDEGHRLKNSENQTYQALDSLNTSRRVLISGTPIQNDLLEYFSLVHFVNSGILGTAHEFKKHFELPILKGRDAAASEADRQLGEERLRELTSIVNRCLIRRTSDILSKYLPVKIEQVVCCRLTPLQTELYKRFLRQAKPAEELLEGKMSVSSLSSITSLKKLCNHPALIYDKCVEEEDGFVGALDLFPPGYSSKALEPQLSGKMLVLDYILAVTRSRSSDKVVLVSNYTQTLDLFEKLCRARRYLYVRLDGTMSIKKRAKVVERFNSPSSPDFVFMLSSKAGGCGLNLIGANRLVMFDPDWNPANDEQAMARVWRDGQKKTCYIYRLLSAGTIEEKIFQRQSHKKALSSCVVDEEQDVERHFSLGELKELFILDEASLSDTHDRLHCRRCVNSRQIRPPPDGSDCTSDLAGWNHCTDKWGLRDEVLQAAWDAASTAITFVFHQRSHEEQRGLR

SEQ ID NO: 808868 - protein, 489 aa, Homo sapiens
MNQRGARVSSPILIISYETFRLHVGVLQKGSVGLVICDEGHRLKNSENQTYQALDSLNTSRRVLISGTPIQNDLLEYFSLVHFVNSGILGTAHEFKKHFELPILKGRDAAASEADRQLGEERLRELTSIVNRCLIRRTSDILSKYLPVKIEQVVCCRLTPLQTELYKRFLRQAKPAEELLEGKMSVSSLSSITSLKKLCNHPALIYDKCVEEEDGFVGALDLFPPGYSSKALEPQLSGKMLVLDYILAVTRSRSSDKVVLVSNYTQTLDLFEKLCRARRYLYVRLDGTMSIKKRAKVVERFNSPSSPDFVFMLSSKAGGCGLNLIGANRLVMFDPDWNPANDEQAMARVWRDGQKKTCYIYRLLSAGTIEEKIFQRQSHKKALSSCVVDEEQDVERHFSLGELKELFILDEASLSDTHDRLHCRRCVNSRQIRPPPDGSDCTSDLAGWNHCTDKWGLRDEVLQAAWDAASTAITFVFHQRSHEEQRGLR

SEQ ID NO: 808869 - protein, 306 aa, Homo sapiens [sequence omitted]

SEQ ID NO: 808870 - protein, 436 aa, Homo sapiens
MDSLNTSRRVLISGTPIQNDLLEYFSLVHFVNSGILGTAHEFKKHFELPILKGRDAAASEADRQLGEERLRELTSIVNRCLIRRTSDILSKYLPVKIEQVVCCRLTPLQTELYKRFLRQAKPAEELLEGKMSVSSLSSITSLKKLCNHPALIYDKCVEEEDGFVGALDLFPPGYSSKALEPQLSGKMLVLDYILAVTRSRSSDKVVLVSNYTQTLDLFEKLCRARRYLYVRLDGTMSIKKRAKVVERFNSPSSPDFVFMLSSKAGGCGLNLIGANRLVMFDPDWNPANDEQAMARVWRDGQKKTCYIYRLLSAGTIEEKIFQRQSHKKALSSCVVDEEQDVERHFSLGELKELFILDEASLSDTHDRLHCRRCVNSRQIRPPPDGSDCTSDLAGWNHCTDKWGLRDEVLQAAWDAASTAITFVFHQRSHEEQRGLR

SEQ ID NO: 808871 - protein, 444 aa, Homo sapiens
MRRSLAPSQLAKRKPEGRSCDDEDWQPGLVTPRKRKSSSETQIQECFLSPFRKPLSQLTNQPPCLDSSQHEAFIRSILSKPFKVPIPNYQGPLGSRALGLKRAGVRRALHDPLEKDALVLYEPPPLSAHDQLKLDKEKLPVHVVVDPILSKVLRPHQREGVKFLWECVTSRRIPGSHGCIMADEMGLGKTLQCITLMWTLLRQSPECKPEIDKAVVVSPSSLVKNWYNEVGKWLGGRIQPLAIDGGSKDEIDQKLEGFMNQRGARVSSPILIISYETFRLHVGVLQKGSVGLVICDEGHRLKNSENQTYQALDSLNTSRRVLISGTPIQNDLLEYFSLVHFVNSGILGTAHEFKKHFELPILKGRDAAASEADRQLGEERLRELTSIVNRCLIRRTSDILSKYLPVKIEQVVCCRLTPLQTELYKRFLGCCLHCHHLRLPPAFS

SEQ ID NO: 808872 - protein, 747 aa, Homo sapiens; identical to SEQ ID NO: 808866

SEQ ID NO: 808873 - protein, 567 aa, Homo sapiens; identical to SEQ ID NO: 808867

SEQ ID NO: 808874 - protein, 490 aa, Homo sapiens
MYEAGCVLRDEDILIISYETFRLHVGVLQKGSVGLVICDEGHRLKNSENQTYQALDSLNTSRRVLISGTPIQNDLLEYFSLVHFVNSGILGTAHEFKKHFELPILKGRDAAASEADRQLGEERLRELTSIVNRCLIRRTSDILSKYLPVKIEQVVCCRLTPLQTELYKRFLRQAKPAEELLEGKMSVSSLSSITSLKKLCNHPALIYDKCVEEEDGFVGALDLFPPGYSSKALEPQLSGKMLVLDYILAVTRSRSSDKVVLVSNYTQTLDLFEKLCRARRYLYVRLDGTMSIKKRAKVVERFNSPSSPDFVFMLSSKAGGCGLNLIGANRLVMFDPDWNPANDEQAMARVWRDGQKKTCYIYRLLSAGTIEEKIFQRQSHKKALSSCVVDEEQDVERHFSLGELKELFILDEASLSDTHDRLHCRRCVNSRQIRPPPDGSDCTSDLAGWNHCTDKWGLRDEVLQAAWDAASTAITFVFHQRSHEEQRGLR

SEQ ID NO: 808875 - protein, 306 aa, Homo sapiens [sequence omitted]

SEQ ID NO: 808876 - protein, 198 aa, Homo sapiens
MARFTIVDGKMGKGVSFKDVAGMHEAKLEVREFVDYLKSPERFLQLGAKVPKGALLLGPPGCGKTLLAKAVATEAQVPFLAMAGPEFVEVIGGLGAARVRSLFKEARARAPCIVYIDEIDAVGKKRSTTMSGFSNTEEEQTLNQLLVEMDGASLDQLPSQGTMRKLRGKTPACSCLTEPTGSRRAMEGHSLCWGCLLH

SEQ ID NO: 808877 - protein, 489 aa, Homo sapiens
MAVLLLLLRALRRGPGPGPRPLWGPGPAWSPGFPARPGRGRPYMASRPPGDLAEAVGRALQSLQLRLLTPTFEGINGLLLKQHLVQNPVRLWQLLGGTFYFNTSRLKQKNKEKDKSKGKAPEEDEEERRRRERDDQMYRERLRTLLVIAVVMSLLNALSTSGGSISWNDFVHEMLAKGEVQRVQVVPESDVVEVYLHPGAVVFGRPRLALMYRMQVANIDKFEEKLRAAEDELNIEAKDRIPVSYKRTGFFGNALYSVGMTAVGLAILWYVFRLAGMTGREGGFSAFNQLKMARFTIVDGKMGKGVSFKDVAGMHEAKLEVREFVDYLKSPERFLQLGAKVPKGALLLGPPGCGKTLLAKAVATEAQVPFLAMAGPEFVEVIGGLGAARVRSLFKEARARAPCIVYIDEIDAVGKKRSTTMSGFSNTEEEQTLNQLLVEMDGASLDQLPSQGTMRKLRGKTPACSCLTEPTGSRRAMEGHSLCWGCLLH

SEQ ID NO: 808878 - protein, 121 aa, Homo sapiens
RGTLTAPRFLSITSGPLPEHLQPFLHGRPPQRRHERCQRTPTPDTPAPPPKRDLSGASPRAPSPPSRPGAGTGARRVRESYRLQTLSRCGKQETKPKTLVVLFNISGQKRSPICFSPIAAS

SEQ ID NO: 808879 - protein, 124 aa, Homo sapiens
GRGKAGAVLAGTGVYALLPEAGSRLCSLPGFCAATPHPRRLSSLPLHAPAGQGELQASDFISLWKARDQAKNFGRAFQHLRSKEVANLLFSHCCVLEGCGAMIPLLKILLNASPLCCSLNNEDI

SEQ ID NO: 808880 - protein, 116 aa, Homo sapiens
RRQRPEEAGGGGGGGGGRGSRRGRGGGERGGPRAQAVRRRLSALRGRGRRRRLKRLRRAQETSGAAALERACASVREELLPVLQFSEPGKRAVQTSSGSHSGCFDVGWKRVRPKMF

SEQ ID NO: 808881 - protein, 127 aa, Homo sapiens
MRPLDIVELAEPEEVEVLEPEEDFEQFLLPVINEMREDIASLTREHGRAYLRNRSKLWEMDNMLIQIKTQVEASEESALNHLQNPGDAAEGRAAKRCEKAEEKAKEIAKMAEMLVELVRRIEKSESS

SEQ ID NO: 808882 - protein, 127 aa, Homo sapiens; identical to SEQ ID NO: 808881

SEQ ID NO: 808883 - protein, 148 aa, Homo sapiens
SGFVRRYSAHIAIAVPRQWEEMRPLDIVELAEPEEVEVLEPEEDFEQFLLPVINEMREDIASLTREHGRAYLRNRSKLWEMDNMLIQIKTQVEASEESALNHLQNPGDAAEGRAAKRCEKAEEKAKEIAKMAEMLVELVRRIEKSESS

SEQ ID NO: 808884 - protein, 127 aa, Homo sapiens; identical to SEQ ID NO: 808881

SEQ ID NO: 808885 - protein, 145 aa, Homo sapiens
MGTRPRDIAIAVPRQWEEMRPLDIVELAEPEEVEVLEPEEDFEQFLLPVINEMREDIASLTREHGRAYLRNRSKLWEMDNMLIQIKTQVEASEESALNHLQNPGDAAEGRAAKRCEKAEEKAKEIAKMAEMLVELVRRIEKSESS

SEQ ID NO: 808886 - protein, 146 aa, Homo sapiens
WADAWAAHIAIAVPRQWEEMRPLDIVELAEPEEVEVLEPEEDFEQFLLPVINEMREDIASLTREHGRAYLRNRSKLWEMDNMLIQIKTQVEASEESALNHLQNPGDAAEGRAAKRCEKAEEKAKEIAKMAEMLVELVRRIEKSESS

SEQ ID NO: 808887 - protein, 153 aa, Homo sapiens
DAWVDGRVGRPTRPDIAIAVPRQWEEMRPLDIVELAEPEEVEVLEPEEDFEQFLLPVINEMREDIASLTREHGRAYLRNRSKLWEMDNMLIQIKTQVEASEESALNHLQNPGDAAEGRAAKRCEKAEEKAKEIAKMAEMLVELVRRIEKSESS

SEQ ID NO: 808888 - protein, 127 aa, Homo sapiens; identical to SEQ ID NO: 808881

SEQ ID NO: 808889 - protein, 127 aa, Homo sapiens; identical to SEQ ID NO: 808881

SEQ ID NO: 808890 - protein, 69 aa, Homo sapiens
QLGTIFEIIKTQVEASEESALNHLQNPGDAAEGRAAKRCEKAEEKAKEIAKMAEMLVELVRRIEKSESS

SEQ ID NO: 808891 - protein, 127 aa, Homo sapiens; identical to SEQ ID NO: 808881

SEQ ID NO: 808892 - protein, 127 aa, Homo sapiens; identical to SEQ ID NO: 808881

SEQ ID NO: 808893 - protein, 127 aa, Homo sapiens; identical to SEQ ID NO: 808881

SEQ ID NO: 808894 - protein, 127 aa, Homo sapiens; identical to SEQ ID NO: 808881

SEQ ID NO: 808895 - protein, 74 aa, Homo sapiens
ANERVITPPESLRSPLRLRRLGQLEKMNFLEMDYGDGWTTHEKVTLPGLRELKMGKLATFMLKINVPPLKPSGP

SEQ ID NO: 808896 - protein, 148 aa, Homo sapiens
LDFVRRYSAHIAIAVPRQWEEMRPLDIVELAEPEEVEVLEPEEDFEQFLLPVINEMREDIASLTREHGRAYLRNRSKLWEMDNMLIQIKTQVEASEESALNHLQNPGDAAEGRAAKRCEKAEEKAKEIAKMAEMLVELVRRIEKSESS

SEQ ID NO: 808897 - protein, 127 aa, Homo sapiens; identical to SEQ ID NO: 808881

SEQ ID NO: 808898 - protein, 311 aa, Homo sapiens
MARPQPCGPPHARCGSPSLPERPLQVKVVGLFSCPNFQIAKSAAENLKNNHPSKFEDPILVPLQEFAWHQYLQEKKRELKNETWEYSSSVISFVNGQFLGDALDLQKWAHEVWDIVDIKPSALYDALTEDFSAKFLRDTKHDFVFLDICIDSSPIGRLIFELYCDVCPKTCKNFQVLCTGKAGFSQRGIRLHYKNSIFHRIVQNGWIQGGDIVYGKGDNGESIYGPTFEDENFSVPHNKRGVLGMANKGRHSNGSQFYITLQATPYLDRKFVAFGQLIEGTEVLKQLELVPTQNERPIHMCRITDSGDPYA

SEQ ID NO: 808899 - protein, 311 aa, Homo sapiens; identical to SEQ ID NO: 808898

SEQ ID NO: 808900 - protein, 279 aa, Homo sapiens
MARPQPCGPPHARCGSPSLPERPLQVKVVGLFSCPNFQIAKSAAEELKNETWEYSSSVISFVNGQFLGDALDLQKWAHEVWDIVDIKPSALYDALTEDFSAKFLRDTKHDFVFLDICIDSSPIGRLIFELYCDVCPKTCKNFQVLCTGKAGFSQRGIRLHYKNSIFHRIVQNGWIQGGDIVYGKGDNGESIYGPTFEDENFSVPHNKRGVLGMANKGRHSNGSQFYITLQATPYLDRKFVAFGQLIEGTEVLKQLELVPTQNERPIHMCRITDSGDPYA

SEQ ID NO: 808901 - protein, 199 aa, Homo sapiens
MARPQPCGPPHARCGSPSLPERPLQVKVVGLFSCPNFQIAKSAAEELKNETWEYSSSVISFVNGQFLGDALDLQKWAHEVWDIVDIKPSALYDALTEDFSAKFLRDTKHDFVFLDICIDSSPIGRLIFELYCDVCPKTCKNFQVLCTGKAGFSQRGIRLHYKNSIFHRIVQNGWIQGGDIVYGKGDNGESIYGPTFEGN

SEQ ID NO: 808902 - protein, 137 aa, Homo sapiens
MARPQPCGPPHARCGSPSLPERPLQVKVVGLFSCPNFQIAKSAAEVTTEKPPSWAALPATRSRPRGLQAPRLLEAAGVEAPPAEEGAGVSWPGGLRLEDREESIGGQVRVRGRAFHLATFKGRTERRKGSEPRWEIR

SEQ ID NO: 808903 - protein, 311 aa, Homo sapiens; identical to SEQ ID NO: 808898

SEQ ID NO: 808904 - protein, 231 aa, Homo sapiens
MARPQPCGPPHARCGSPSLPERPLQVKVVGLFSCPNFQIAKSAAENLKNNHPSKFEDPILVPLQEFAWHQYLQEKKRELKNETWEYSSSVISFVNGQFLGDALDLQKWAHEVWDIVDIKPSALYDALTEDFSAKFLRDTKHDFVFLDICIDSSPIGRLIFELYCDVCPKTCKNFQVLCTGKAGFSQRGIRLHYKNSIFHRIVQNGWIQGGDIVYGKGDNGESIYGPTFEGN

SEQ ID NO: 808905 - protein, 164 aa, Homo sapiens
MARPQPCGPPHARCGSPSLPERPLQVKVVGLFSCPNFQIAKSAAEELKNETWEYSSSVISFVNGQFLGDALDLQKWAHEVWDIVDIKPSALYDALTEDFSAKFLRDTKVLCTGKAGFSQRGIRLHYKNSIFHRIVQNGWIQGGDIVYGKGDNGESIYGPTFEGN

SEQ ID NO: 808906 - protein, 599 aa, Homo sapiens
MSGPCGEKPVLEASPTMSLWEFEDSHSRQGTPRPGQELAAEEASALELQMKVDFFRKLGYSSTEIHSVLQKLGVQADTNTVLGELVKHGTATERERQTSPDPCPQLPLVPRGGGTPKAPNLEPPLPEEEKEGSDLRPVVIDGSNVAMSHGNKEVFSCRGILLAVNWFLERGHTDITVFVPSWRKEQPRPDVPITDQHILRELEKKKILVFTPSRRVGGKRVVCYDDRFIVKLAYESDGIVVSNDTYRDLQGERQEWKRFIEERLLMYSFVNDKFMPPDDPLGRHGPSLDNFLRKKPLTLEHRKQPCPYGRKCTYGIKCRFFHPERPSCPQRSVADELRANALLSPPRAPSKDKNGRRPSPSSQSSSLLTESEQCSLDGKKLGAQASPGSRQEGLTQTYAPSGRSLAPSGGSGSSFGPTDWLPQTLDSLPYVSQDCLDSGIGSLESQMSELWGVRGGGPGEPGPPRAPYTGYSPYGSELPATAAFSAFGRAMGAGHFSVPADYPPAPPAFPPREYWSEPYPLPPPTSVLQEPPVQSPGAGRSPWGRAGSLAKEQASVYTKLCGVFPPHLVEAVMGRFPQLLDPQQLAAEILSYKSQHPSE

SEQ ID NO: 808907 - protein, 107 aa, Homo sapiens
SGAGRGEAAPPPGRSPGTAPPLARFRVSASPPPARAPPHIKAPPSLPPGLGPMETPPAAAGAWRGEARRGGCGPRRGSGRERSGGVRAEPRGGDGRGREGWRIMVFI

SEQ ID NO: 808908 - protein, 599 aa, Homo sapiens; identical to SEQ ID NO: 808906

SEQ ID NO: 808909 - protein, 520 aa, Homo sapiens
VRKSSTPEEVKKRKKAVLFCLSEDKKNIILEEGKEILVGDVGQTVDDPYATFVKMLPDKDCRYALYDDNHGNKEVFSCRGILLAVNWFLERGHTDITVFVPSWRKEQPRPDVPITDQHILRELEKKKILVFTPSRRVGGKRVVCYDDRFIVKLAYESDGIVVSNDTYRDLQGERQEWKRFIEERLLMYSFVNDKFMPPDDPLGRHGPSLDNFLRKKPLTLEHRKQPCPYGRKCTYGIKCRFFHPERPSCPQRSVADELRANALLSPPRAPSKDKNGRRPSPSSQSSSLLTESEQCSLDGKKLGAQASPGSRQEGLTQTYAPSGRSLAPSGGSGSSFGPTDWLPQTLDSLPYVSQDCLDSGIGSLESQMSELWGVRGGGPGEPGPPRAPYTGYSPYGSELPATAAFSAFGRAMGAGHFSVPADYPPAPPAFPPREYWSEPYPLPPPTSVLQEPPVQSPGAGRSPWGRAGSLAKEQASVYTKLCGVFPPHLVEAVMGRFPQLLDPQQLAAEILSYKSQHPSE

SEQ ID NO: 808910 - protein, 325 aa, Homo sapiens
MPPDDPLGRHGPSLDNFLRKKPLTLEHRKQPCPYGRKCTYGIKCRFFHPERPSCPQRSVADELRANALLSPPRAPSKDKNGRRPSPSSQSSSLLTESEQCSLDGKKLGAQASPGSRQEGLTQTYAPSGRSLAPSGGSGSSFGPTDWLPQTLDSLPYVSQDCLDSGIGSLESQMSELWGVRGGGPGEPGPPRAPYTGYSPYGSELPATAAFSAFGRAMGAGHFSVPADYPPAPPAFPPREYWSEPYPLPPPTSVLQEPPVQSPGAGRSPWGRAGSLAKEQASVYTKLCGVFPPHLVEAVMGRFPQLLDPQQLAAEILSYKSQHPSE

SEQ ID NO: 808911 - protein, 244 aa, Homo sapiens [sequence omitted]

SEQ ID NO: 808912 - protein, 355 aa, Homo sapiens
MSGPCGEKPVLEASPTMSLWEFEDSHSRQGTPRPGQELAAEEASALELQMKVDFFRKLGYSSTEIHSVLQKLGVQADTNTVLGELVKHGTATERERQTSPDPCPQLPLVPRGGGTPKAPNLEPPLPEEEKEGSDLRPVVIDGSNVAMSHGNKEVFSCRGILLAVNWFLERGHTDITVFVPSWRKEQPRPDVPITDQHILRELEKKKILVFTPSRRVGGKRVVCYDDRFIVKLAYESDGIVVSNDTYRDLQGERQEWKRFIEERLLMYSFVNDKLAIGPFSAIRSPCMAPTSREFFAPSAGLCPLMTHWAGTGPAWTTSCVRSHSLWSTGSSRVPMVWNPACPPRPSSLLPFLSPV

SEQ ID NO: 808913 - protein, 83 aa, Homo sapiens
AACVQMFLVFRQQTVPRQGRGWGMEEASAELVLAPVTLALTTPVCGHQQVREPCRPGSRSRWALTCVHPSPPRPAHPAGTGEE

SEQ ID NO: 808914 - protein, 134 aa, Homo sapiens
MWNQLFLYMFISTKFHYLNYFQTNNFQARVCVPGFSAPPILRSLFVCLLFLTQKYRWLGKIHLIELSYAVSVYICISFYSYLAFFFFFTQIWFSLPFVKTRIEQHCTSEMVPRKCLCSSVFFVKTSMQRQSQQS

SEQ ID NO: 808915 - protein, 777 aa, Homo sapiens
MAAPGGRSEPPQLPEYSCSYMVSRPVYSELAFQQQHERRLQERKTLRESLAKCCSCSRKRAFGVLKTLVPILEWLPKYRVKEWLLSDVISGVSTGLVATLQGMAYALLAAVPVGYGLYSAFFPILTYFIFGTSRHISVGPFPVVSLMVGSVVLSMAPDEHFLVSSSNGTVLNTTMIDTAARDTARVLIASALTLLVGIIQLIFGGLQIGFIVRYLADPLVGGFTTAAAFQVLVSQLKIVLNVSTKNYNGVLSIIYTLVEIFQNIGDTNLADFTAGLLTIVVCMAVKELNDRFRHKIPVPIPIEVIVTIIATAISYGANLEKNYNAGIVKSIPRGFLPPELPPVSLFSEMLAASFSIAVVAYAIAVSVGKVYATKYDYTIDGNQEFIAFGISNIFSGFFSCFVATTALSRTAVQESTGGVAGIISAAIVMIAILALGKLLEPLQKSVLAAVVIANLKGMFMQLCDIPRLWRQNKIDAVIWVFTCIVSIILGLDLGLLAGLIFGLLTVVLRVQFPSWNGLGSIPSTDIYKSTKNYKNIEEPQGVKILRFSSPIFYGNVDGFKKCIKSTVGFDAIRVYNKRLKALRKIQKLIKSGQLRATKNGIISDAVSTNNAFEPDEDIEDLEELDIPTKEIEIQVDWNSELPVKVNVPKVPIHSLVLDCGAISFLDVVGVRSLRVIVKEFQRIDVNVYFASLQDYVIEKLEQCGFFDDNIRKDTFFLTVHDAILYLQNQVKSQEGQGSILETITLIQDCKDTLELIETELTEEELDVQDEAMRTLAS

SEQ ID NO: 808916 - protein, 349 aa, Homo sapiens
MIAILALGKLLEPLQKSVLAAVVIANLKGMFMQLCDIPRLWRQNKIDAVIWVFTCIVSIILGLDLGLLAGLIFGLLTVVLRVQFPSWNGLGSIPSTDIYKSTKNYKNIEEPQGVKILRFSSPIFYGNVDGFKKCIKSTVGFDAIRVYNKRLKALRKIQKLIKSGQLRATKNGIISDAVSTNNAFEPDEDIEDLEELDIPTKEIEIQVDWNSELPVKVNVPKVPIHSLVLDCGAISFLDVVGVRSLRVIVKEFQRIDVNVYFASLQDYVIEKLEQCGFFDDNIRKDTFFLTVHDAILYLQNQVKSQEGQGSILETITLIQDCKDTLELIETELTEEELDVQDEAMRTLAS

SEQ ID NO: 808917 - protein, 112 aa, Homo sapiens
EQHSCRIPWSETQDNIKSNESRSFQEGRAARCRAALNDGLAWRPWWQQWPHQAPCSHSTKTQVSERDACTKSPFPLFQVSGCCVILFCSIQFCKEPSECFHQWTMKGIWTSS

SEQ ID NO: 808918 - protein, 471 aa, Homo sapiens
MGSRCVSSNIVLLTQAFRKKFVIPDFEEFTGHVDRIFEDVKELTGGKVAAYIPQLAKSNPDLWGVSLCTVDGQRHSVGHTKIPFCLQSCVKPLTYAISISTLGTDYVHKFVGKEPSGLRYNKLSLNEEGIPHNPMVNAGAIVVSSLIKMDCNKAEKFDFVLQYLNKMAGNEYMGFSNATFQSEKETGDRNYAIGYYLKEKKCFPKGVDMMAALDLYFQLCSVEVTCESGSVMAATLANGGICPITGESVLSAEAVRNTLSLMHSCGMYDFSGQFAFHVGLPAKSAVSGAILLVVPNVMGMMCLSPPLDKLGNSHRGTSFCQKLVSLFNFHNYDNLRHCARKLDPRREGAEIRNKTVVNLLFAAYSGDVSALRRFALSAMDMEQKDYDSRTALHVAAAEGHIEVVKFLIEACKVNPFAKDRWGNIPLDDAVQFNHLEVVKLLQDYQDSYTLSETQAEAAAEALSKENLESMV

SEQ ID NO: 808919 - protein, 559 aa, Homo sapiens
MRSMKALQKALSRAGSHCGRGGWGHPSRSPLLGGGVRHHLSEAAAQGRETPHSHQPQHQDHDSSESGMLSRLGDLLFYTIAEGQERIPIHKFTTALKATGLQTSDPRLRDCMSEMHRVVQESSSGGLLDRDLFRKVAAYIPQLAKSNPDLWGVSLCTVDGQRHSVGHTKIPFCLQSCVKPLTYAISISTLGTDYVHKFVGKEPSGLRYNKLSLNEEGIPHNPMVNAGAIVVSSLIKMDCNKAEKFDFVLQYLNKMAGNEYMGFSNATFQSEKETGDRNYAIGYYLKEKKCFPKGVDMMAALDLYFQLCSVEVTCESGSVMAATLANGGICPITGESVLSAEAVRNTLSLMHSCGMYDFSGQFAFHVGLPAKSAVSGAILLVVPNVMGMMCLSPPLDKLGNSHRGTSFCQKLVSLFNFHNYDNLRHCARKLDPRREGAEIRNKTVVNLLFAAYSGDVSALRRFALSAMDMEQKDYDSRTALHVAAAEGHIEVVKFLIEACKVNPFAKDRWGNIPLDDAVQFNHLEVVKLLQDYQDSYTLSETQAEAAAEALSKENLESMV

SEQ ID NO: 808920 - protein, 262 aa, Homo sapiens [sequence omitted]

SEQ ID NO: 808921 - protein, 446 aa, Homo sapiens
MRSMKALQKALSRAGSHCGRGGWGHPSRSPLLGGGVRHHLSEAAAQGRETPHSHQPQHQDHDSSESGMLSRLGDLLFYTIAEGQERIPIHKFTTALKATGLQTSDPRLRDCMSEMHRVVQESSSGGLLDRDLFRKCVSSNIVLLTQAFRKKFVIPDFEEFTGHVDRIFEDVKELTGGKVAAYIPQLAKSNPDLWGVSLCTVDGQRHSVGHTKIPFCLQSCVKPLTYAISISTLGTDYVHKFVGKEPSGLRYNKLSLNEEGIPHNPMVNAGAIVVSSLIKMDCNKAEKFDFVLQYLNKMAGNEYMGFSNATFQSEKETGDRNYAIGYYLKEKKLCSVEVTCESGSVMAATLANGGICPITGESVLSAEAVRNTLSLMHSCGMYDFSGQFAFHVGLPAKSAVSGAILLVVPNVMGMMCLSPPLDKLGNSHRGTSFCQVRCFAYSTYYF

SEQ ID NO: 808922 - protein, 126 aa, Homo sapiens
FSFIPNAPHLAPVLRVPLTLEPALKGQAPSPAPAPAPPTGPTFSVFQVQRSLTELPRTLSRSLRPSFPATARGPGRTCRAGGLLGHALHEGSAEGPEPGWQSLRARRLGSPEPEPPPWRGRPAPPQ

SEQ ID NO: 808923 - protein, 602 aa, Homo sapiens
MRSMKALQKALSRAGSHCGRGGWGHPSRSPLLGGGVRHHLSEAAAQGRETPHSHQPQHQDHDSSESGMLSRLGDLLFYTIAEGQERIPIHKFTTALKATGLQTSDPRLRDCMSEMHRVVQESSSGGLLDRDLFRKCVSSNIVLLTQAFRKKFVIPDFEEFTGHVDRIFEDVKELTGGKVAAYIPQLAKSNPDLWGVSLCTVDGQRHSVGHTKIPFCLQSCVKPLTYAISISTLGTDYVHKFVGKEPSGLRYNKLSLNEEGIPHNPMVNAGAIVVSSLIKMDCNKAEKFDFVLQYLNKMAGNEYMGFSNATFQSEKETGDRNYAIGYYLKEKKCFPKGVDMMAALDLYFQLCSVEVTCESGSVMAATLANGGICPITGESVLSAEAVRNTLSLMHSCGMYDFSGQFAFHVGLPAKSAVSGAILLVVPNVMGMMCLSPPLDKLGNSHRGTSFCQKLVSLFNFHNYDNLRHCARKLDPRREGAEIRNKTVVNLLFAAYSGDVSALRRFALSAMDMEQKDYDSRTALHVAAAEGHIEVVKFLIEACKVNPFAKDRWGNIPLDDAVQFNHLEVVKLLQDYQDSYTLSETQAEAAAEALSKENLESMV

SEQ ID NO: 808924 - protein, 602 aa, Homo sapiens; identical to SEQ ID NO: 808923

SEQ ID NO: 808925 - protein, 141 aa, Homo sapiens
STSISLFSTHSCPGGSLHPSAGQVKPRPVGCLPVHCGWSTVRCWARGRGGRAQVPNTGQPLSWHLSASRHSVGHTKIPFCLQSCVKPLTYAISISTLGTDYVHKFVGKEPSGLRYNKLSLNEEGEHYQGSDRTYSCPLLLI

SEQ ID NO: 808926 - protein, 1133 aa, Homo sapiens
GTRRYWARAAPGSGRLGTPRGRAPAAAAAAAPALRCAPPPVPAAERSLRARRAPSAPFPEPAAMGAARGSPARPRRLPLLSVLLLPLLGGTQTAIVFIKQPSSQDALQGRRALLRCEVEAPGPVHVYWLLDGAPVQDTERRFAQGSSLSFAAVDRLQDSGTFQCVARDDVTGEEARSANASFNIKWIEAGPVVLKHPASEAEIQPQTQVTLRCHIDGHPRPTYQWFRDGTPLSDGQSNHTVSSKERNLTLRPAGPEHSGLYSCCAHSAFGQACSSQNFTLSIADESFARVVLAPQDVVVARYEEAMFHCQFSAQPPPSLQWLFEDETPITNRSRPPHLRRATVFANGSLLLTQVRPRNAGIYRCIGQGQRGPPIILEATLHLAEIEDMPLFEPRVFTAGSEERVTCLPPKGLPEPSVWWEHAGVRLPTHGRVYQKGHELVLANIAESDAGVYTCHAANLAGQRRQDVNITVATVPSWLKKPQDSQLEEGKPGYLDCLTQATPKPTVVWYRNQMLISEDSRFEVFKNGTLRINSVEVYDGTWYRCMSSTPAGSIEAQARVQVLEKLKFTPPPQPQQCMEFDKEATVPCSATGREKPTIKWERADGSSLPEWVTDNAGTLHFARVTRDDAGNYTCIASNGPQGQIRAHVQLTVAVFITFKVEPERTTVYQGHTALLQCEAQGDPKPLIQWKGKDRILDPTKLGPRMHIFQNGSLVIHDVAPEDSGRYTCIAGNSCNIKHTEAPLYVVDKPVPEESEGPGSPPPYKMIQTIGLSVGAAVAYIIAVLGLMFYCKKRCKAKRLQKQPEGEEPEMECLNGGPLQNGQPSAEIQEEVALTSLGSGPAATNKRHSTSDKMHFPRSSLQPITTLGKSEFGEVFLAKAQGLEEGVAETLVLVKSLQSKDEQQQLDFRRELEMFGKLNHANVVRLLGLCREAEPHYMVLEYVDLGDLKQFLRISKSKDEKLKSQPLSTKQKVALCTQVALGMEHLSNNRFVHKDLAARNCLVSAQRQVKVSALGLSKDVYNSEYYHFRQAWVPLRWMSPEAILEGDFSTKSDVWAFGVLMWEVFTHGEMPHGGQADDEVLADLQAGKARLPQPEGCPSKLYRLMQRCWALSPKDRPSFSEIASALGDSTVDSKP

SEQ ID NO: 808927 - protein, 854 aa, Homo sapiens
MGTLDESFARVVLAPQDVVVARYEEAMFHCQFSAQPPPSLQWLFEDETPITNRSRPPHLRRATVFANGSLLLTQVRPRNAGIYRCIGQGQRGPPIILEATLHLAEIEDMPLFEPRVFTAGSEERVTCLPPKGLPEPSVWWEHAGVRLPTHGRVYQKGHELVLANIAESDAGVYTCHAANLAGQRRQDVNITVATVPSWLKKPQDSQLEEGKPGYLDCLTQATPKPTVVWYRNQMLISEDSRFEVFKNGTLRINSVEVYDGTWYRCMSSTPAGSIEAQARVQVLEKLKFTPPPQPQQCMEFDKEATVPCSATGREKPTIKWERADGSSLPEWVTDNAGTLHFARVTRDDAGNYTCIASNGPQGQIRAHVQLTVAVFITFKVEPERTTVYQGHTALLQCEAQGDPKPLIQWKGKDRILDPTKLGPRMHIFQNGSLVIHDVAPEDSGRYTCIAGNSCNIKHTEAPLYVVDKPVPEESEGPGSPPPYKMIQTIGLSVGAAVAYIIAVLGLMFYCKKRCKAKRLQKQPEGEEPEMECLNGGPLQNGQPSAEIQEEVALTSLGSGPAATNKRHSTSDKMHFPRSSLQPITTLGKSEFGEVFLAKAQGLEEGVAETLVLVKSLQSKDEQQQLDFRRELEMFGKLNHANVVRLLGLCREAEPHYMVLEYVDLGDLKQFLRISKSKDEKLKSQPLSTKQKVALCTQVALGMEHLSNNRFVHKDLAARNCLVSAQRQVKVSALGLSKDVYNSEYYHFRQAWVPLRWMSPEAILEGDFSTKSDVWAFGVLMWEVFTHGEMPHGGQADDEVLADLQAGKARLPQPEGCPSKLYRLMQRCWALSPKDRPSFSEIASALGDSTVDSKP

SEQ ID NO: 808928 - protein, 89 aa, Homo sapiens
LGESGRPGDRTEIPMVARVSGLIVTLLSSSFPGGPLQNGQPSAEIQEEVALTSLGSGPAATNKRHSTSDKMHFPRSSLQPITTLVGMLP

SEQ ID NO: 808929 - protein, 933 aa, Homo sapiens
TSSLSARMKCGFQDDGWAPLPTYQWFRDGTPLSDGQSNHTVSSKERNLTLRPAGPEHSGLYSCCAHSAFGQACSSQNFTLSIADESFARVVLAPQDVVVARYEEAMFHCQFSAQPPPSLQWLFEDETPITNRSRPPHLRRATVFANGSLLLTQVRPRNAGIYRCIGQGQRGPPIILEATLHLAEIEDMPLFEPRVFTAGSEERVTCLPPKGLPEPSVWWEHAGVRLPTHGRVYQKGHELVLANIAESDAGVYTCHAANLAGQRRQDVNITVATVPSWLKKPQDSQLEEGKPGYLDCLTQATPKPTVVWYRNQMLISEDSRFEVFKNGTLRINSVEVYDGTWYRCMSSTPAGSIEAQARVQVLEKLKFTPPPQPQQCMEFDKEATVPCSATGREKPTIKWERADGSSLPEWVTDNAGTLHFARVTRDDAGNYTCIASNGPQGQIRAHVQLTVAVFITFKVEPERTTVYQGHTALLQCEAQGDPKPLIQWKGKDRILDPTKLGPRMHIFQNGSLVIHDVAPEDSGRYTCIAGNSCNIKHTEAPLYVVDKPVPEESEGPGSPPPYKMIQTIGLSVGAAVAYIIAVLGLMFYCKKRCKAKRLQKQPEGEEPEMECLNGGPLQNGQPSAEIQEEVALTSLGSGPAATNKRHSTSDKMHFPRSSLQPITTLGKSEFGEVFLAKAQGLEEGVAETLVLVKSLQSKDEQQQLDFRRELEMFGKLNHANVVRLLGLCREAEPHYMVLEYVDLGDLKQFLRISKSKDEKLKSQPLSTKQKVALCTQVALGMEHLSNNRFVHKDLAARNCLVSAQRQVKVSALGLSKDVYNSEYYHFRQAWVPLRWMSPEAILEGDFSTKSDVWAFGVLMWEVFTHGEMPHGGQADDEVLADLQAGKARLPQPEGCPSKLYRLMQRCWALSPKDRPSFSEIASALGDSTVDSKP

SEQ ID NO: 808930 - protein, 797 aa, Homo sapiens
GTRRYWARAAPGSGRLGTPRGRAPAAAAAAAPALRCAPPPVPAAERSLRARRAPSAPFPEPAAMGAARGSPARPRRLPLLSVLLLPLLGGTQTAIVFIKQPSSQDALQGRRALLRCEVEAPGPVHVYWLLDGAPVQDTERRFAQGSSLSFAAVDRLQDSGTFQCVARDDVTGEEARSANASFNIKWIEAGPVVLKHPASEAEIQPQTQVTLRCHIDGHPRPTYQWFRDGTPLSDGQSNHTVSSKERNLTLRPAGPEHSGLYSCCAHSAFGQACSSQNFTLSIADESFARVVLAPQDVVVARYEEAMFHCQFSAQPPPSLQWLFEDETPITNRSRPPHLRRATVFANGSLLLTQVRPRNAGIYRCIGQGQRGPPIILEATLHLAEIEDMPLFEPRVFTAGSEERVTCLPPKGLPEPSVWWEHAGVRLPTHGRVYQKGHELVLANIAESDAGVYTCHAANLAGQRRQDVNITVATVPSWLKKPQDSQLEEGKPGYLDCLTQATPKPTVVWYRNQMLISEDSRFEVFKNGTLRINSVEVYDGTWYRCMSSTPAGSIEAQARVQVLEKLKFTPPPQPQQCMEFDKEATVPCSATGREKPTIKWERADGSSLPEWVTDNAGTLHFARVTRDDAGNYTCIASNGPQGQIRAHVQLTVAVFITFKVEPERTTVYQGHTALLQCEAQGDPKPLIQWKGKDRILDPTKLGPRMHIFQNGSLVIHDVAPEDSGRYTCIAGNSCNIKHTEAPLYVVDKPVPEESEGPGSPPPYKMIQTIGLSVGAAVAYIIAVLGLMFRGHQQTPQHK

SEQ ID NO: 808931 - protein, 352 aa, Homo sapiens
RGESGRPGDRTEIPMVARVSGLIVTLLSSSFPGGPLQNGQPSAEIQEEVALTSLGSGPAATNKRHSTSDKMHFPRSSLQPITTLGKSEFGEVFLAKAQGLEEGVAETLVLVKSLQSKDEQQQLDFRRELEMFGKLNHANVVRLLGLCREAEPHYMVLEYVDLGDLKQFLRISKSKDEKLKSQPLSTKQKVALCTQVALGMEHLSNNRFVHKDLAARNCLVSAQRQVKVSALGLSKDVYNSEYYHFRQAWVPLRWMSPEAILEGDFSTKSDVWAFGVLMWEVFTHGEMPHGGQADDEVLADLQAGKARLPQPEGCPSKLYRLMQRCWALSPKDRPSFSEIASALGDSTVDSKP

SEQ ID NO: 808932 - protein, 1133 aa, Homo sapiens; identical to SEQ ID NO: 808926

SEQ ID NO: 808933 - protein, 1086 aa, Homo sapiens
GTRRYWARAAPGSGRLGTPRGRAPAAAAAAAPALRCAPPPVPAAERSLRARRAPSAPFPEPAAMGAARGSPARPRRLPLLSVLLLPLLGGTQTAIVFIKQPSSQDALQGRRALLRCEVEAPGPVHVYWLLDGAPVQDTERRFAQGSSLSFAAVDRLQDSGTFQCVARDDVTGEEARSANASFNIKWIEAGPVVLKHPASEAEIQPQTQVTLRCHIDGHPRPTYQWFRDGTPLSDGQSNHTVSSKERNLTLRPAGPEHSGLYSCCAHSAFGQACSSQNFTLSIADESFARVVLAPQDVVVARYEEAMFHCQFSAQPPPSLQWLFEDETPITNRSRPPHLRRATVFANGSLLLTQVRPRNAGIYRCIGQGQRGPPIILEATLHLAEIEDMPLFEPRVFTAGSEERVTCLPPKGLPEPSVWWEHAGVRLPTHGRVYQKGHELVLANIAESDAGVYTCHAANLAGQRRQDVNITVATVPSWLKKPQDSQLEEGKPGYLDCLTQATPKPTVVWYRNQMLISEDSRFEVFKNGTLRINSVEVYDGTWYRCMSSTPAGSIEAQARVQVLEKLKFTPPPQPQQCMEFDKEATVPCSATGREKPTIKWERADGSSLPEWVTDNAGTLHFARVTRDDAGNYTCIASNGPQGQIRAHVQLTVAVFITFKVEPERTTVYQGHTALLQCEAQGDPKPLIQWKGKDRILDPTKLGPRMHIFQNGSLVIHDVAPEDSGRYTCIAGNSCNIKHTEAPLYVVDKPVPEESEGPGSPPPYKMIQTIGLSVGAAVAYIIAVLGLMFYCKKRCKAKRLQKQPEGEEPEMECLNGGPLQNGQPSAEIQEEVALTSLGSGPAATNKRHSTSDKMHFPRSSLQPITTLGKSEFGEVFLAKAQGLEEGVAETLVLVKSLQSKDEQQQLDFRRELEMFGKLNHANVVRLLGLCREAEPHYMVLEYVDLGDLKQFLRISKSKDEKLKSQPLSTKQKVALCTQVALGMEHLSNNRFVHKDLAARNCLVSAQRQVKVSALGLSKDVYNSEYYHFRQAWVPLRWMSPEAILEGDFSTKSDVWAFGVLMWEVFTHGEMPHGGQADDEVLAGVFRSF

SEQ ID NO: 808934 - protein, 1063 aa, Homo sapiens
GTRRYWARAAPGSGRLGTPRGRAPAAAAAAAPALRCAPPPVPAAERSLRARRAPSAPFPEPAAMGAARGSPARPRRLPLLSVLLLPLLGGTQTAIVFIKQPSSQDALQGRRALLRCEVEAPGPVHVYWLLDGAPVQDTERRFAQGSSLSFAAVDRLQDSGTFQCVARDDVTGEEARSANASFNIKWIEAGPVVLKHPASEAEIQPQTQVTLRCHIDGHPRPTYQWFRDGTPLSDGQSNHTVSSKERNLTLRPAGPEHSGLYSCCAHSAFGQACSSQNFTLSIADESFARVVLAPQDVVVARYEEAMFHCQFSAQPPPSLQWLFEDETPITNRSRPPHLRRATVFANGSLLLTQVRPRNAGIYRCIGQGQRGPPIILEATLHLAEIEDMPLFEPRVFTAGSEERVTCLPPKGLPEPSVWWEHAGVRLPTHGRVYQKGHELVLANIAESDAGVYTCHAANLAGQRRQDVNITVATVPSWLKKPQDSQLEEGKPGYLDCLTQATPKPTVVWYRNQMLISEDSRFEVFKNGTLRINSVEVYDGTWYRCMSSTPAGSIEAQARVQVLEKLKFTPPPQPQQCMEFDKEATVPCSATGREKPTIKWERADGSSLPEWVTDNAGTLHFARVTRDDAGNYTCIASNGPQGQIRAHVQLTVAVFITFKVEPERTTVYQGHTALLQCEAQGDPKPLIQWKGKDRILDPTKLGPRMHIFQNGSLVIHDVAPEDSGRYTCIAGNSCNIKHTEAPLYVVDKPVPEESEGPGSPPPYKMIQTIGLSVGAAVAYIIAVLGLMFYCKKRCKAKRLQKQPEGEEPEMECLNGGPLQNGQPSAEIQEEVALTSLGSGPAATNKRHSTSDKMHFPRSSLQPITTLGKSEFGEVFLAKAQGLEEGVAETLVLVKSLQSKDEQQQLDFRRELEMFGKLNHANVVRLLGLCREAEPHYMVLEYVDLVCCWQGTWGSRVGRAVSYKGGSQWLEHRENLVSCSLSRDLTCLLLHFAHLMMLSFCLPCSWMPAFPLSAPSLSICISGALVLSFSGTSHCHTAGMPSRSSSLTLVFFGLLFFPPQKLVPT

SEQ ID NO: 808935 - protein, 874 aa, Homo sapiens
GTRRYWARAAPGSGRLGTPRGRAPAAAAAAAPALRCAPPPVPAAERSLRARRAPSAPFPEPAAMGAARGSPARPRRLPLLSVLLLPLLGGTQTAIVFIKQPSSQDALQGRRALLRCEVEAPGPVHVYWLLDGAPVQDTERRFAQGSSLSFAAVDRLQDSGTFQCVARDDVTGEEARSANASFNIKWIEAGPVVLKHPASEAEIQPQTQVTLRCHIDGHPRPTYQWFRDGTPLSDGQSNHTVSSKERNLTLRPAGPEHSGLYSCCAHSAFGQACSSQNFTLSIADESFARVVLAPQDVVVARYEEAMFHCQFSAQPPPSLQWLFEDETPITNRSRPPHLRRATVFANGSLLLTQVRPRNAGIYRCIGQGQRGPPIILEATLHLAEIEDMPLFEPRVFTAGSEERVTCLPPKGLPEPSVWWEHAGVRLPTHGRVYQKGHELVLANIAESDAGVYTCHAANLAGQRRQDVNITVATVPSWLKKPQDSQLEEGKPGYLDCLTQATPKPTVVWYRNQMLISEDSRFEVFKNGTLRINSVEVYDGTWYRCMSSTPAGSIEAQARVQVLEKLKFTPPPQPQQCMEFDKEATVPCSATGREKPTIKWERADGSSLPEWVTDNAGTLHFARVTRDDAGNYTCIASNGPQGQIRAHVQLTVAVFITFKVEPERTTVYQGHTALLQCEAQGDPKPLIQWKGKDRILDPTKLGPRMHIFQNGSLVIHDVAPEDSGRYTCIAGNSCNIKHTEAPLYVVDKPVPEESEGPGSPPPYKMIQTIGLSVGAAVAYIIAVLGLMFYCKKRCKAKRLQKQPEGEEPEMECLNGGPLQNGQPSAEIQEEVALTSLGSGPAATNKRHSTSDKMHFPRSSLQPITTLAHPSLLSSS

SEQ ID NO: 808936 - protein, 891 aa, Homo sapiens
GTRRYWARAAPGSGRLGTPRGRAPAAAAAAAPALRCAPPPVPAAERSLRARRAPSAPFPEPAAMGAARGSPARPRRLPLLSVLLLPLLGGTQTAIVFIKQPSSQDALQGRRALLRCEVEAPGPVHVYWLLDGAPVQDTERRFAQGSSLSFAAVDRLQDSGTFQCVARDDVTGEEARSANASFNIKWIEAGPVVLKHPASEAEIQPQTQVTLRCHIDGHPRPTYQWFRDGTPLSDGQSNHTVSSKERNLTLRPAGPEHSGLYSCCAHSAFGQACSSQNFTLSIADESFARVVLAPQDVVVARYEEAMFHCQFSAQPPPSLQWLFEDETPITNRSRPPHLRRATVFANGSLLLTQVRPRNAGIYRCIGQGQRGPPIILEATLHLAEIEDMPLFEPRVFTAGSEERVTCLPPKGLPEPSVWWEHAGVRLPTHGRVYQKGHELVLANIAESDAGVYTCHAANLAGQRRQDVNITVATVPSWLKKPQDSQLEEGKPGYLDCLTQATPKPTVVWYRNQMLISEDSRFEVFKNGTLRINSVEVYDGTWYRCMSSTPAGSIEAQARVQVLEKLKFTPPPQPQQCMEFDKEATVPCSATGREKPTIKWERADGSSLPEWVTDNAGTLHFARVTRDDAGNYTCIASNGPQGQIRAHVQLTVAVFITFKVEPERTTVYQGHTALLQCEAQGDPKPLIQWKGKDRILDPTKLGPRMHIFQNGSLVIHDVAPEDSGRYTCIAGNSCNIKHTEAPLYVVDKPVPEESEGPGSPPPYKMIQTIGLSVGAAVAYIIAVLGLMFYCKKRCKAKRLQKQPEGEEPEMECLNGGPLQNGQPSAEIQEEVALTSLGSGPAATNKRHSTSDKMHFQGNLGPLQLGKRIGGGLRGLGRENLLKTPGKPLLRGG

SEQ ID NO: 808937 - protein, 427 aa, Homo sapiens
GTRRYWARAAPGSGRLGTPRGRAPAAAAAAAPALRCAPPPVPAAERSLRARRAPSAPFPEPAAMGAARGSPARPRRLPLLSVLLLPLLGGTQTAIVFIKQPSSQDALQGRRALLRCEVEAPGPVHVYWLLDGAPVQDTERRFAQGSSLSFAAVDRLQDSGTFQCVARDDVTGEEARSANASFNIKWIEAGPVVLKHPASEAEIQPQTQVTLRCHIDGHPRPTYQWFRDGTPLSDGQSNHTVSSKERNLTLRPAGPEHSGLYSCCAHSAFGQACSSQNFTLSIADESFARVVLAPQDVVVARYEEAMFHCQFSAQPPPSLQWLFEDETPITNRSRPPHLRRATVFANGSLLLTQVRPRNAGIYRCIGQGQRGPPIILEATLHLAEIEDMPLFEPRVFTAGSEERVTCPTLLSFPHPKCLADEGVFRSF

SEQ ID NO: 808938 - protein, 202 aa, Homo sapiens
GTRRYWARAAPGSGRLGTPRGRAPAAAAAAAPALRCAPPPVPAAERSLRARRAPSAPFPEPAAMGAARGSPARPRRLPLLSVLLLPLLGGTQTAIVFIKQPSSQDALQGRRALLRCEVEAPGPVHVYWLLDGAPVQDTERRFAQGSSLSFAAVDRLQDSGTFQCVARDDVTGEEARSANASFNIKCESQGGCAQSPCQTLND

SEQ ID NO: 808939 - protein, 785 aa, Homo sapiens
GTRRYWARAAPGSGRLGTPRGRAPAAAAAAAPALRCAPPPVPAAERSLRARRAPSAPFPEPAAMGAARGSPARPRRLPLLSVLLLPLLGGTQTAIVFIKQPSSQDALQGRRALLRCEVEAPGPVHVYWLLDGAPVQDTERRFAQGSSLSFAAVDRLQDSGTFQCVARDDVTGEEARSANASFNIKWIEAGPVVLKHPASEAEIQPQTQVTLRCHIDGHPRPTYQWFRDGTPLSDGQSNHTVSSKERNLTLRPAGPEHSGLYSCCAHSAFGQACSSQNFTLSIADESFARVVLAPQDVVVARYEEAMFHCQFSAQPPPSLQWLFEDETPITNRSRPPHLRRATVFANGSLLLTQVRPRNAGIYRCIGQGQRGPPIILEATLHLAEIEDMPLFEPRVFTAGSEERVTCLPPKGLPEPSVWWEHAGVRLPTHGRVYQKGHELVLANIAESDAGVYTCHAANLAGQRRQDVNITVATVPSWLKKPQDSQLEEGKPGYLDCLTQATPKPTVVWYRNQMLISDGKSEFGEVFLAKAQGLEEGVAETLVLVKSLQSKDEQQQLDFRRELEMFGKLNHANVVRLLGLCREAEPHYMVLEYVDLGDLKQFLRISKSKDEKLKSQPLSTKQKVALCTQVALGMEHLSNNRFVHKDLAARNCLVSAQRQVKVSALGLSKDVYNSEYYHFRQAWVPLRWMSPEAILEGDFSTKSDVWAFGVLMWEVFTHGEMPHGGQADDEVLADLQAGKARLPQPEGCPSKLYRLMQRCWALSPKDRPSFSEIASALGDSTVDSKP

SEQ ID NO: 808940 - protein, 1003 aa, Homo sapiens
GTRRYWARAAPGSGRLGTPRGRAPAAAAAAAPALRCAPPPVPAAERSLRARRAPSAPFPEPAAMGAARGSPARPRRLPLLSVLLLPLLGGTQTAIVFIKQPSSQDALQGRRALLRCEVEAPGPVHVYWLLDGAPVQDTERRFAQGSSLSFAAVDRLQDSGTFQCVARDDVTGEEARSANASFNIKWIEAGPVVLKHPASEAEIQPQTQVTLRCHIDGHPRPTYQWFRDGTPLSDGQSNHTVSSKERNLTLRPAGPEHSGLYSCCAHSAFGQACSSQNFTLSIADESFARVVLAPQDVVVARYEEAMFHCQFSAQPPPSLQWLFEDETPITNRSRPPHLRRATVFANGSLLLTQVRPRNAGIYRCIGQGQRGPPIILEATLHLAEIEDMPLFEPRVFTAGSEERVTCLPPKGLPEPSVWWEHAGVRLPTHGRVYQKGHELVLANIAESDAGVYTCHAANLAGQRRQDVNITVANGSSLPEWVTDNAGTLHFARVTRDDAGNYTCIASNGPQGQIRAHVQLTVAVFITFKVEPERTTVYQGHTALLQCEAQGDPKPLIQWKGKDRILDPTKLGPRMHIFQNGSLVIHDVAPEDSGRYTCIAGNSCNIKHTEAPLYVVDKPVPEESEGPGSPPPYKMIQTIGLSVGAAVAYIIAVLGLMFYCKKRCKAKRLQKQPEGEEPEMECLNGGPLQNGQPSAEIQEEVALTSLGSGPAATNKRHSTSDKMHFPRSSLQPITTLGKSEFGEVFLAKAQGLEEGVAETLVLVKSLQSKDEQQQLDFRRELEMFGKLNHANVVRLLGLCREAEPHYMVLEYVDLGDLKQFLRISKSKDEKLKSQPLSTKQKVALCTQVALGMEHLSNNRFVHKDLAARNCLVSAQRQVKVSALGLSKDVYNSEYYHFRQAWVPLRWMSPEAILEGDFSTKSDVWAFGVLMWEVFTHGEMPHGGQADDEVLADLQAGKARLPQPEGCPSKLYRLMQRCWALSPKDRPSFSEIASALGDSTVDSKP

SEQ ID NO: 808941 - protein, 828 aa, Homo sapiens [sequence omitted]

SEQ ID NO: 808942 - protein, 920 aa, Homo sapiens
GTRRYWARAAPGSGRLGTPRGRAPAAAAAAAPALRCAPPPVPAAERSLRARRAPSAPFPEPAAMGAARGSPARPRRLPLLSVLLLPLLGGTQTAIVFIKQPSSQDALQGRRALLRCEVEAPGPVHVYWLLDGAPVQDTERRFAQGSSLSFAAVDRLQDSGTFQCVARDDVTGEEARSANASFNIKWIEAGPVVLKHPASEAEIQPQTQVTLRCHIDGHPRPTYQWFRDGTPLSDGQSNHTVSSKERNLTLRPAGPEHSGLYSCCAHSAFGQACSSQNFTLSIADESFARVVLAPQDVVVARYEEAMFHCQFSAQPPPSLQWLFEDETPITNRSRPPHLRRATVFANGSLLLTQVRPRNAGIYRCIGQGQRGPPIILEATLHLAEIEDMPLFEPRVFTAGSEERVTCLPPKGLPEPSVWWEHAGVRLPTHGRVYQKGHELVLANIAESDAGVYTCHAANLAGQRRQDVNITVATVPSWLKKPQDSQLEEGKPGYLDCLTQATPKPTVVWYRNQMLISEDSRFEVFKNGTLRINSVEVYDGTWYRCMSSTPAGSIEAQARVQVLEKLKFTPPPQPQQCMEFDKEATVPCSATGREKPTIKWERADGSSLPEWVTDNAGTLHFARVTRDDAGNYTCIASNGPQGQIRAHVQLTVAVFITFKVEPERTTVYQGHTALLQCEAQGDPKPLIQWKGKDRILDPTKLGPRMHIFQNGSLVIHDVAPEDSGRYTCIAGNSCNIKHTEAPLYVVDKPVPEESEGPGSPPPYKMIQTIGLSVGAAVAYIIAVLGLMFYCKKRCKAKRLQKQPEGEEPEMECLNGGPLQNGQPSAEIQEEVALTSLGSGPAATNKRHSTMFTHGEMPHGGQADDEVLADLQAGKARLPQPEGCPSKLYRLMQRCWALSPKDRPSFSEIASALGDSTVDSKP

SEQ ID NO: 808943 - protein, 153 aa, Homo sapiens [sequence omitted]

SEQ ID NO: 808944 - protein, 866 aa, Homo sapiens
GTRRYWARAAPGSGRLGTPRGRAPAAAAAAAPALRCAPPPVPAAERSLRARRAPSAPFPEPAAMGAARGSPARPRRLPLLSVLLLPLLGGTQTAIVFIKQPSSQDALQGRRALLRCEVEAPGPVHVYWLLDGAPVQDTERRFAQGSSLSFAAVDRLQDSGTFQCVARDDVTGEEARSANASFNIKWIEAGPVVLKHPASEAEIQPQTQVTLRCHIDGHPRPTYQWFRDGTPLSDGQSNHTVSSKERNLTLRPAGPEHSGLYSCCAHSAFGQACSSQNFTLSIADESFARVVLAPQDVVVARYEEAMFHCQFSAQPPPSLQWLFEDETPITNRSRPPHLRRATVFANGSLLLTQVRPRNAGIYRCIGQGQRGPPIILEATLHLAEIEDMPLFEPRVFTAGSEERVTCLPPKGLPEPSVWWEHAGVRLPTHGRVYQKGHELVLANIAESDAGVYTCHAANLAGQRRQDVNITVATVPSWLKKPQDSQLEEGKPGYLDCLTQATPKPTVVWYRNQMLISEDSRFEVFKNGTLRINSVEVYDGTWYRCMSSTPAGSIEAQARVQVLEKLKFTPPPQPQQCMEFDKEATVPCSATGREKPTIKWERADGSSLPEWVTDNAGTLHFARVTRDDAGNYTCIASNGPQGQIRAHVQLTVAVFITFKVEPERTTVYQGHTALLQCEAQGDPKPLIQWKGKDRILDPTKLGPRMHIFQNGSLVIHDVAPEDSGRYTCIAGNSCNIKHTEAPLYVVDKPVPEESEGPGSPPPYKMIQTIGLSVGAAVAYIIAVLGLMFYCKKRCKAKRLQKQPEGEEPEMECLNGGPLQNGQPSAEIQEEVALTSLGSGPAATNKRHSTSDKMHFPRSSLQPITTLA

SEQ ID NO: 808945 - protein, 862 aa, Homo sapiens
GTRRYWARAAPGSGRLGTPRGRAPAAAAAAAPALRCAPPPVPAAERSLRARRAPSAPFPEPAAMGAARGSPARPRRLPLLSVLLLPLLGGTQTAIVFIKQPSSQDALQGRRALLRCEVEAPGPVHVYWLLDGAPVQDTERRFAQGSSLSFAAVDRLQDSGTFQCVARDDVTGEEARSANASFNIKWIEAGPVVLKHPASEAEIQPQTQVTLRCHIDGHPRPTYQWFRDGTPLSDGQSNHTVSSKERNLTLRPAGPEHSGLYSCCAHSAFGQACSSQNFTLSIADESFARVVLAPQDVVVARYEEAMFHCQFSAQPPPSLQWLFEDETPITNRSRPPHLRRATVFANGSLLLTQVRPRNAGIYRCIGQGQRGPPIILEATLHLAEIEDMPLFEPRVFTAGSEERVTCLPPKGLPEPSVWWEHAGVRLPTHGRVYQKGHELVLANIAESDAGVYTCHAANLAGQRRQDVNITVATVPSWLKKPQDSQLEEGKPGYLDCLTQATPKPTVVWYRNQMLISEDSRFEVFKNGTLRINSVEVYDGTWYRCMSSTPAGSIEAQARVQVLEKLKFTPPPQPQQCMEFDKEATVPCSATGREKPTIKWERADGSSLPEWVTDNAGTLHFARVTRDDAGNYTCIASNGPQGQIRAHVQLTVAVFITFKVEPERTTVYQGHTALLQCEAQGDPKPLIQWKGKDRILDPTKLGPRMHIFQNGSLVIHDVAPEDSGRYTCIAGNSCNIKHTEAPLYVVDKPVPEESEGPGSPPPYKMIQTIGLSVGAAVAYIIAVLGLMFYCKKRCKAKRLQKQPEGEEPELRLPLHSPAGPCPHPMVLKLLLLKSLVLGQERAGVLSVFPLTSTYAAGHSGSHL

SEQ ID NO: 808946 - protein, 269 aa, Homo sapiens
SRNEGATDSERQVQRVVRERPPAGGAAGTADHGQFLHVARGRARPVRRGEGSLEKAPAAAPPSLPPGYDETKVRGAARGETALLENVAGAGPGALLPGCPARPMHARQGPALRGGGPRGRRGAASAAAPGALVAVRADYGACRQLRHLPHRVRGCRRLLLVPGRPRSRGCRLAGAKACGQAVTEEGVELPVDVGQGHRKRRVLRPRAPWRQREAGPKAGFCTAPGGRLLKEKAVPWQVVQAPAPPATWATPVGLCCLGLHLQQSLYRHL

SEQ ID NO: 808947 - protein, 247 aa, Homo sapiens
PEEETGQSVWRGRRTPSSPCWPPGPVLAEPSGGWDRAPTMGNAQERPSETIDRERKRLVETLQADSGLLLDALLARGVLTGPEYEALDALPDAERRVRRLLLLVQGKGEAACQELLRCAQRTAGAPDPAWDWQHVGPGYRDRSYDPPCPGHWTPEAPGSGTTCPGLPRASDPDEAGGPEGSEAVQSGTPEEPEPELEAEASKEAEPEPEPEPELEPEAEAEPEPELEPEPDPEPEPDFEERDESEDS

SEQ ID NO: 808948 - protein, 314 aa, Homo sapiens
PEEETGQSVWRGRRTPSSPCWPPGPVLAEPSGGWDRAPTMGNAQERPSETIDRERKRLVETLQADSGLLLDALLARGVLTGPEYEALDALPDAERRVRRLLLLVQGKGEAACQELLRCAQRTAGAPDPAWDWQHVGPGERAGRGLGQSRDGAGADKRPGEGRVVVSARSEASVKPHRGKLSLSHSHFLPQATGTAAMTLHAQATGRRRHPARGPHAPGCPELQTLTRPGALRAPRRCNPGPRRSQSQSWKLRPLKRLNRSRSQSQSWNPRLKQNQSRNWSQNRTQSPSPTSRKGTSPKIPEGQSSDRRCPAHAG

SEQ ID NO: 808949 - protein, 247 aa, Homo sapiens; identical to SEQ ID NO: 808947

SEQ ID NO: 808950 - protein, 220 aa, Homo sapiens
PEEETGQSVWRGRRTPSSPCWPPGPVLAEPSGGWDRAPTMGNAQERPSETIDRERKRLVETLQADSGLLLDALLARGVLTGPEYEALDALPDAERRATGTAAMTLHAQATGRRRHPARGPHAPGCPELQTLTRPGALRAPRRCNPGPRRSQSQSWKLRPLKRLNRSRSQSQSWNPRLKQNQSRNWSQNRTQSPSPTSRKGTSPKIPEGQSSDRRCPAHAG

SEQ ID NO: 808951 - protein, 146 aa, Homo sapiens
PEEETGQSVWRGRRTPSSPCWPPGPVLAEPSGGWDRGYRDRSYDPPCPGHWTPEAPGSGTTCPGLPRASDPDEAGGPEGSEAVQSGTPEEPEPELEAEASKEAEPEPEPEPELEPEAEAEPEPELEPEPDPEPEPDFEERDESEDS

SEQ ID NO: 808952 - protein, 599 aa, Homo sapiens
MEGPLTPPPLQGGGAAAVPEPGARQHPGHETAAQRYSARLLQAGYEPESPRLDLATHPTTPRSELSSVVLLAGVGVQMDRLRRASMADYLISGGTGYVPEDGLTAQQLFASADGLTYNDFLILPGFIDFIADEVDLTSALTRKITLKTPLISSPMDTVTEADMAIAMALMGGIGFIHHNCTPEFQANEVRKVKKFEQGFITDPVVLSPSHTVGDVLEAKMRHGFSGIPITETGTMGSKLVGIVTSRDIDFLAEKDHTTLLSEVMTPRIELVVAPAGVTLKEANEILQRSKKGKLPIVNDCDELVAIIARTDLKKNRDYPLASKDSQKQLLCGAAVGTREDDKYRLDLLTQAGVDVIVLDSSQGNSVYQIAMVHYIKQKYPHLQVIGGNVVTAAQAKNLIDAGVDGLRVGMGCGSICITQEVMACGRPQGTAVYKVAEYARRFGVPIIADGGIQTVGHVVKALALGASTVMMGSLLAATTEAPGEYFFSDGVRLKKYRGMGSLDAMEKSSSSQKRYFSEGDKVKIAQGVSGSIQDKGSIQKFVPYLIAGIQHGCQDIGARSLSVLRSMMYSGELKFEKRTMSAQIEGGVHGLHSYEKRLY

SEQ ID NO: 808953 - protein, 529 aa, Homo sapiens
AAARVFMSGRGVSRHMADYLISGGTGYVPEDGLTAQQLFASADGLTYNDFLILPGFIDFIADEVDLTSALTRKITLKTPLISSPMDTVTEADMAIAMALMGGIGFIHHNCTPEFQANEVRKVKKFEQGFITDPVVLSPSHTVGDVLEAKMRHGFSGIPITETGTMGSKLVGIVTSRDIDFLAEKDHTTLLSEVMTPRIELVVAPAGVTLKEANEILQRSKKGKLPIVNDCDELVAIIARTDLKKNRDYPLASKDSQKQLLCGAAVGTREDDKYRLDLLTQAGVDVIVLDSSQGNSVYQIAMVHYIKQKYPHLQVIGGNVVTAAQAKNLIDAGVDGLRVGMGCGSICITQEVMACGRPQGTAVYKVAEYARRFGVPIIADGGIQTVGHVVKALALGASTVMMGSLLAATTEAPGEYFFSDGVRLKKYRGMGSLDAMEKSSSSQKRYFSEGDKVKIAQGVSGSIQDKGSIQKFVPYLIAGIQHGCQDIGARSLSVLRSMMYSGELKFEKRTMSAQIEGGVHGLHSYEKRLY

SEQ ID NO: 808954 - protein, 530 aa, Homo sapiens
MEGPLTPPPLQGGGAAAVPEPGARQHPGHETAAQRYSARLLQAGYEPESDFLILPGFIDFIADEVDLTSALTRKITLKTPLISSPMDTVTEADMAIAMALMGGIGFIHHNCTPEFQANEVRKVKKFEQGFITDPVVLSPSHTVGDVLEAKMRHGFSGIPITETGTMGSKLVGIVTSRDIDFLAEKDHTTLLSEVMTPRIELVVAPAGVTLKEANEILQRSKKGKLPIVNDCDELVAIIARTDLKKNRDYPLASKDSQKQLLCGAAVGTREDDKYRLDLLTQAGVDVIVLDSSQGNSVYQIAMVHYIKQKYPHLQVIGGNVVTAAQAKNLIDAGVDGLRVGMGCGSICITQEVMACGRPQGTAVYKVAEYARRFGVPIIADGGIQTVGHVVKALALGASTVMMGSLLAATTEAPGEYFFSDGVRLKKYRGMGSLDAMEKSSSSQKRYFSEGDKVKIAQGVSGSIQDKGSIQKFVPYLIAGIQHGCQDIGARSLSVLRSMMYSGELKFEKRTMSAQIEGGVHGLHSYEKRLY

SEQ ID NO: 808955 - protein, 529 aa, Homo sapiens; identical to SEQ ID NO: 808953

SEQ ID NO: 808956 - protein, 505 aa, Homo sapiens
MEGPLTPPPLQGGGAAAVPEPGARQHPGHETAAQRYSARLLQAGYEPESDFLILPGFIDFIADEVDLTSALTRKITLKTPLISSPMDTVTEADMAIAMAKFEQGFITDPVVLSPSHTVGDVLEAKMRHGFSGIPITETGTMGSKLVGIVTSRDIDFLAEKDHTTLLSEVMTPRIELVVAPAGVTLKEANEILQRSKKGKLPIVNDCDELVAIIARTDLKKNRDYPLASKDSQKQLLCGAAVGTREDDKYRLDLLTQAGVDVIVLDSSQGNSVYQIAMVHYIKQKYPHLQVIGGNVVTAAQAKNLIDAGVDGLRVGMGCGSICITQEVMACGRPQGTAVYKVAEYARRFGVPIIADGGIQTVGHVVKALALGASTVMMGSLLAATTEAPGEYFFSDGVRLKKYRGMGSLDAMEKSSSSQKRYFSEGDKVKIAQGVSGSIQDKGSIQKFVPYLIAGIQHGCQDIGARSLSVLRSMMYSGELKFEKRTMSAQIEGGVHGLHSYEKRLY

SEQ ID NO: 808957 - protein, 523 aa, Homo sapiens
AAARVFMSGRGVSRHMADYLISGGTGYVPEDGLTAQQLFASADGLTYNDFLILPGFIDFIADEVDLTSALTRKITLKTPLISSPMDTVTEADMAIAMALMGGIGFIHHNCTPEFQANEVRKVKKFEQGFITDPVVLSPSHTVGDVLEAKMRHGFSGIPITETGTMGSKLVGIVTSRDIDFLAEKDHTTLLSEVMTPRIELVVAPAGVTLKEANEILQRSKKGKLPIVNDCDELVAIIARTDLKKNRDYPLASKDSQKQLLCGAAVGTREDDKYRLDLLTQAGVDVIVLDSSQGNSVYQIAMVHYIKQKYPHLQVIGGNVVTAAQAKNLIDAGVDGLRVGMGCGSICITQEVMACGRPQGTAVYKVAEYARRFGVPIIADGGIQTVGHVVKALALGASTVMMGSLLAATTEAPGEYFFSDGVRLKKYRGMGSLDAMEKSSSSQKRYFSEGDKVKIAQGVSGSIQDKGSIQKFVPYLIAGIQHGCQDIGARSLSVLRSMMYSGELKFEKRTMSAQIEGGVHGLHS

SEQ ID NO: 808958 - protein, 563 aa, Homo sapiens
MEGPLTPPPLQGGGAAAVPEPGARQHPGHETAAQRYSARLLQAGYEPESMADYLISGGTGYVPEDGLTAQQLFASADGLTYNDFLILPGFIDFIADEVDLTSALTRKITLKTPLISSPMDTVTEADMAIAMALMGGIGFIHHNCTPEFQANEVRKVKKFEQGFITDPVVLSPSHTVGDVLEAKMRHGFSGIPITETGTMGSKLVGIVTSRDIDFLAEKDHTTLLSEVMTPRIELVVAPAGVTLKEANEILQRSKKGKLPIVNDCDELVAIIARTDLKKNRDYPLASKDSQKQLLCGAAVGTREDDKYRLDLLTQAGVDVIVLDSSQGNSVYQIAMVHYIKQKYPHLQVIGGNVVTAAQAKNLIDAGVDGLRVGMGCGSICITQEVMACGRPQGTAVYKVAEYARRFGVPIIADGGIQTVGHVVKALALGASTVMMGSLLAATTEAPGEYFFSDGVRLKKYRGMGSLDAMEKSSSSQKRYFSEGDKVKIAQGVSGSIQDKGSIQKFVPYLIAGIQHGCQDIGARSLSVLRSMMYSGELKFEKRTMSAQIEGGVHGLHSYEKRLY

SEQ ID NO: 808959 - protein, 514 aa, Homo sapiens
MADYLISGGTGYVPEDGLTAQQLFASADGLTYNDFLILPGFIDFIADEVDLTSALTRKITLKTPLISSPMDTVTEADMAIAMALMGGIGFIHHNCTPEFQANEVRKVKKFEQGFITDPVVLSPSHTVGDVLEAKMRHGFSGIPITETGTMGSKLVGIVTSRDIDFLAEKDHTTLLSEVMTPRIELVVAPAGVTLKEANEILQRSKKGKLPIVNDCDELVAIIARTDLKKNRDYPLASKDSQKQLLCGAAVGTREDDKYRLDLLTQAGVDVIVLDSSQGNSVYQIAMVHYIKQKYPHLQVIGGNVVTAAQAKNLIDAGVDGLRVGMGCGSICITQEVMACGRPQGTAVYKVAEYARRFGVPIIADGGIQTVGHVVKALALGASTVMMGSLLAATTEAPGEYFFSDGVRLKKYRGMGSLDAMEKSSSSQKRYFSEGDKVKIAQGVSGSIQDKGSIQKFVPYLIAGIQHGCQDIGARSLSVLRSMMYSGELKFEKRTMSAQIEGGVHGLHSYEKRLY

SEQ ID NO: 808960 - protein, 489 aa, Homo sapiens
MDRLRRASDFLILPGFIDFIADEVDLTSALTRKITLKTPLISSPMDTVTEADMAIAMALMGGIGFIHHNCTPEFQANEVRKVKKFEQGFITDPVVLSPSHTVGDVLEAKMRHGFSGIPITETGTMGSKLVGIVTSRDIDFLAEKDHTTLLSEVMTPRIELVVAPAGVTLKEANEILQRSKKGKLPIVNDCDELVAIIARTDLKKNRDYPLASKDSQKQLLCGAAVGTREDDKYRLDLLTQAGVDVIVLDSSQGNSVYQIAMVHYIKQKYPHLQVIGGNVVTAAQAKNLIDAGVDGLRVGMGCGSICITQEVMACGRPQGTAVYKVAEYARRFGVPIIADGGIQTVGHVVKALALGASTVMMGSLLAATTEAPGEYFFSDGVRLKKYRGMGSLDAMEKSSSSQKRYFSEGDKVKIAQGVSGSIQDKGSIQKFVPYLIAGIQHGCQDIGARSLSVLRSMMYSGELKFEKRTMSAQIEGGVHGLHSYEKRLY

SEQ ID NO: 808961 - protein, 529 aa, Homo sapiens; identical to SEQ ID NO: 808953

SEQ ID NO: 808962 - protein, 159 aa, Homo sapiens [sequence omitted]

SEQ ID NO: 808963 - protein, 165 aa, Homo sapiens
DAWVDHAVAHASGIAGSAMSSEPPPPPQPPTHQASVGLLDTPRSRERSPSPLRGNVVPSPLPTRRTRTFSATVRASQGPVYKGVCKCFCRSKGHGFITPADGGPDIFLHISDVEGEYVPVEGDEVTYKMCSIPPKNEKLQAVEVVITHLAPGTKHETWSGHVISS

SEQ ID NO: 808964 - protein, 169 aa, Homo sapiens
EGEDVQGASQARKQHNGQDLTVVGTAFVSTHSQSTCVFAILKQLPSTPLGWKDKGGLFLSSLELFPVGFPRAHLLVQSTLPKPRPERAFTAPSLSPVTLGFCLGRILCQRLLLCPSCLATALSINGYSRTAGCQSWKGRDTGLHKGKLLEALGGTEGFGDRARAKIEDS

SEQ ID NO: 808965 - protein, 191 aa, Homo sapiens
MCSTVPWRRTLREGQFLPLLPCGVWLPAASGRVRGVAEFGSRWLALKSPWLWVFFFETESCSVAQAGVQWCDLSSLEPPPPRFKQFSCLSLQVDGITGACHHAQLIFVFVLETGFPHVGQASLELLTLSDPPASASQSAGIAGVSHCARPLALGFLLTFLLPSHKYYVSQMCRDPCLVLGTQRGPMPSWSW

SEQ ID NO: 808966 - protein, 164 aa, Homo sapiens
RSRSEAAGGAERIAGSAMSSEPPPPPQPPTHQASVGLLDTPRSRERSPSPLRGNVVPSPLPTRRTRTFSATVRASQGPVYKGVCKCFCRSKGHGFITPADGGPDIFLHISDVEGEYVPVEGDEVTYKMCSIPPKNEKLQAVEVVITHLAPGTKHETWSGHVISS

SEQ ID NO: 808967 - protein, 164 aa, Homo sapiens; identical to SEQ ID NO: 808966

SEQ ID NO: 808968 - protein, 164 aa, Homo sapiens; identical to SEQ ID NO: 808966

SEQ ID NO: 808969 - protein, 164 aa, Homo sapiens; identical to SEQ ID NO: 808966

SEQ ID NO: 808970 - protein, 164 aa, Homo sapiens; identical to SEQ ID NO: 808966

SEQ ID NO: 808971 - protein, 164 aa, Homo sapiens; identical to SEQ ID NO: 808966

SEQ ID NO: 808972 - protein, 147 aa, Homo sapiens
MSSEPPPPPQPPTHQASVGLLDTPRSRERSPSPLRGNVVPSPLPTRRTRTFSATVRASQGPVYKGVCKCFCRSKGHGFITPADGGPDIFLHISDVEGEYVPVEGDEVTYKMCSIPPKNEKLQAVEVVITHLAPGTKHETWSGHVISS

SEQ ID NO: 808973 - protein, 188 aa, Homo sapiens
GHAGALAPRPAAGAFLRWGLPGLRSSSLAAAVAERRDRRSAMSSEPPPPPQPPTHQASVGLLDTPRSRERSPSPLRGNVVPSPLPTRRTRTFSATVRASQGPVYKGVCKCFCRSKGHGFITPADGGPDIFLHISDVEGEYVPVEGDEVTYKMCSIPPKNEKLQAVEVVITHLAPGTKHETWSGHVISS

SEQ ID NO: 808974 - protein, 147 aa, Homo sapiens; identical to SEQ ID NO: 808972

SEQ ID NO: 808975 - protein, 147 aa, Homo sapiens; identical to SEQ ID NO: 808972

SEQ ID NO: 808976 - protein, 147 aa, Homo sapiens; identical to SEQ ID NO: 808972

SEQ ID NO: 808977 - protein, 138 aa, Homo sapiens
MASLPQLMAAPTSSCTSLMWKGSMSQWKATRSPIKCAPSHPRMRSCRPWRSSSLTWHQAPSMRPGLDMSSAPRRWWKHPLSCACGRLCGEEAADTGDDILPHETGLQPGMVPLKYLLEEGVWGGRCGVWGVPGHQHSL

SEQ ID NO: 808978 - protein, 211 aa, Homo sapiens
RSRSEAAGGAERIAGSAMSSEPPPPPQPPTHQASVGLLDTPRSRERSPSPLRGNVVPSPLPTRRTRTFSATVRASQGPVYKGVCKCFCRSKGHGFITPADGGPDIFLHISDVEGEYVPVEGDEVTYLTWHQAPSMRPGLDMSSAPRRWWKHPLSCACGRLCGEEAADTGDDILPHETGLQPGMVPLKYLLEEGVWGGRCGVWGVPGHQHSL

SEQ ID NO: 808979 - protein, 164 aa, Homo sapiens; identical to SEQ ID NO: 808966

SEQ ID NO: 808980 - protein, 75 aa, Homo sapiens
ARYELVWNRHRGKKRRGAHWWLSGGSNPIPGSGSRVVFLQLLRHMGSTHRIPLPPGAGGPRFPDLAPWQPDRDLA

SEQ ID NO: 808981 - protein, 159 aa, Homo sapiens [sequence omitted]

SEQ ID NO: 808982 - protein, 245 aa, Homo sapiens
MAEIHTPYSSLKKLLSLLNGFVAVSGIILVGLGIGGKCGGASLTNVLGLSSAYLLHVGNLCLVMGCITVLLGCAGWYGATKESRGTLLFCILSMVIVLIMEVTAATVVLLFFPIVGDVALEHTFVTLRKNYRGYNEPDDYSTQWNLVMEKLKCCGVNNYTDFSGSSFEMTTGHTYPRSCCKSIGSVSCDGRDVSPNVIHQKGCFHKLLKITKTQSFTLSGSSLGAAVIQRWGSRYVAQAGLELLA

SEQ ID NO: 808983 - protein, 219 aa, Homo sapiens
MAEIHTPYSSLKKLLSLLNGFVAVSGIILVGLGIGGKCGGASLTNVLGLSSAYLLHVGNLCLVMGCITVLLGCAGWYGATKESRGTLLFVGDVALEHTFVTLRKNYRGYNEPDDYSTQWNLVMEKLKCCGVNNYTDFSGSSFEMTTGHTYPRSCCKSIGSVSCDGRDVSPNVIHQKGCFHKLLKITKTQSFTLSGSSLGAAVIQLPGILATLLLFIKLG

SEQ ID NO: 808984 - protein, 203 aa, Homo sapiens
MAEIHTPYSSLKKLLSLLNGFVAVSGIILVGLGIGGKCGGASLTNVLGLSSAYLLHVGNLCLVMGCITVLLGCAGWYGATKESRGTLLFVGDVALEHTFVTLRKNYRGYNEPDDYSTQWNLVMEKLKCCGVNNYTDFSGSSFEMTTGHTYPRSCCKSIGSVSCDGRDVSPNVIHQKKLRLGEGTSLVQDHRALAELEFEAPLA

SEQ ID NO: 808985 - protein, 73 aa, Homo sapiens
RPLLPPLTYSVPTPTPLPPPARHGPVTCSSKRLTTAWTHSTGLCAAMSSPRPGGGGGKGGPAPWAGKRAGSGG

SEQ ID NO: 808986 - protein, 124 aa, Homo sapiens
MSWGHLLSLIDAESIQKLPDQPSHHTQKRPFPSGEKLPDQPFTHHSQEGPFPPGEKLPDQPLIPQPRGAFLTWREISRPSPLTTARRGLSHRKKKMIRIIFFFRDVFFSDLCLPSTCDHCTCRQ

SEQ ID NO: 808987 - protein, 120 aa, Homo sapiens
GDDIINSAHVRSRFPKRRCRLWSHGWARSPADTLTLFLILTRWYRCSGNAFRGMKRPMPLLTLMFPSSKTILPWLMTTSGEPWHSIPSKMLYSTACTNSLSVTSQDLLCPKRAVHNSDFA

SEQ ID NO: 808988 - protein, 152 aa, Homo sapiens
MEECALSSVLQTHLREDHEGTIRGVLGRLGGLTEESTRCVLQGHDLLLRSALRRLALRGNALATLTQMRLSGKKHLLQELREQRALEQGSSQCLDEHQWQLLRALVRPAWWPHPFQTGGAPAAGPSFQQVCQNPNPITLGAAGCGIHSPGLP

SEQ ID NO: 808989 - protein, 992 aa, Homo sapiens
MARGGAACKSDARLLLGRDALRPAPALLAPAVLLGAALGLGLGLWLGCRAGRQRTRHQKDDTQNLLKNLESNAQTPSETGSPSRRRKREVQMSKDKEAVDECEPPSNSNITAFALKAKVIYPINQKFRPLADGSSNPSLHENLKQAVLPHQPVEASPSSSLGSLSQGEKDDCSSSSSVHSATSDDRFLSRTFLRVNAFPEVLACESVDVDLCIYSLHLKDLLHLDTALRQEKHMMFIQIFKMCLLDLLPKKKSDDELYQKILSKQEKDLEELEKGLQVKLSNTEMSGAGDSEYITLADVEKKEREYSEQLIDNMEAFWKQMANIQHFLVDQFKCSSSKARQLMMTLTERMIAAEGLLCDSQELQALDALERTMGRAHMAKVIEFLKLQVQEETRCRLAAISHGLELLAGEGKLSGRQKEELLTQQHKAFWQEAERFSREFVQRGKDLVTASLAHQVEGTAKLTLAQEEEQRSFLAEAQPTADPEKFLEAFHEVLERQRLMQCDLEEEENVRATEAVVALCQELYFSTVDTFQKFVDALFLQTLPGMTGLPPEECDYLRQEVQENAAWQLGKSNRFRRQQWKLFQELLEQDQQVWMEECALSSVLQTHLREDHEGTIRGVLGRLGGLTEESTRCVLQGHDLLLRSALRRLALRGNALATLTQMRLSGKKHLLQELREQRALEQGSSQCLDEHQWQLLRALEARVLEEASRLEEEAQQTRLQLQQRLLAEAQEVGQLLQQHMECAIGQALLVHARNAATKSRAKDRDDFKRTLMEAAVESVYVTSAGVSRLVQAYYQQIGRIMEDHEERKLQHLKTLQGERMENYKLRKKQELSNPSSGSRTAGGAHETSQAVHQRMLSQQKRFLAQFPVHQQMRLHAQQQQAGVMDLLEAQLETQLQEAEQNFISELAALARVPLAESKLLPAKRGLLEKPLRTKRKKPLPQERGDLGVPNNEDLASGDQTSGSLSSKRLSQQESEAGDSGNSKKMLKRRSNL

SEQ ID NO: 808990 - protein, 992 aa, Homo sapiens; identical to SEQ ID NO: 808989

SEQ ID NO: 808991 - protein, 992 aa, Homo sapiens; identical to SEQ ID NO: 808989

SEQ ID NO: 808992 - protein, 992 aa, Homo sapiens; identical to SEQ ID NO: 808989

SEQ ID NO: 808993 - protein, 992 aa, Homo sapiens; identical to SEQ ID NO: 808989

SEQ ID NO: 808994 - protein, 796 aa, Homo sapiens
LEDPGIPIQSVDVDLCIYSLHLKDLLHLDTALRQEKHMMFIQIFKMCLLDLLPKKKSDDELYQKILSKQEKDLEELEKGLQVKLSNTEMSGAGDSEYITLADVEKKEREYSEQLIDNMEAFWKQMANIQHFLVDQFKCSSSKARQLMMTLTERMIAAEGLLCDSQELQALDALERTMGRAHMAKVIEFLKLQVQEETRCRLAAISHGLELLAGEGKLSGRQKEELLTQQHKAFWQEAERFSREFVQRGKDLVTASLAHQVEGTAKLTLAQEEEQRSFLAEAQPTADPEKFLEAFHEVLERQRLMQCDLEEEENVRATEAVVALCQELYFSTVDTFQKFVDALFLQTLPGMTGLPPEECDYLRQEVQENAAWQLGKSNRFRRQQWKLFQELLEQDQQVWMEECALSSVLQTHLREDHEGTIRGVLGRLGGLTEESTRCVLQGHDLLLRSALRRLALRGNALATLTQMRLSGKKHLLQELREQRALEQGSSQCLDEHQWQLLRALEARVLEEASRLEEEAQQTRLQLQQRLLAEAQEVGQLLQQHMECAIGQALLVHARNAATKSRAKDRDDFKRTLMEAAVESVYVTSAGVSRLVQAYYQQIGRIMEDHEERKLQHLKTLQGERMENYKLRKKQELSNPSSGSRTAGGAHETSQAVHQRMLSQQKRFLAQFPVHQQMRLHAQQQQAGVMDLLEAQLETQLQEAEQNFISELAALARVPLAESKLLPAKRGLLEKPLRTKRKKPLPQERGDLGVPNNEDLASGDQTSGSLSSKRLSQQESEAGDSGNSKKMLKRRSNL

SEQ ID NO: 808995 - protein, 751 aa, Homo sapiens
MCLLDLLPKKKSDDELYQKILSKQEKDLEELEKGLQVKLSNTEMSGAGDSEYITLADVEKKEREYSEQLIDNMEAFWKQMANIQHFLVDQFKCSSSKARQLMMTLTERMIAAEGLLCDSQELQALDALERTMGRAHMAKVIEFLKLQVQEETRCRLAAISHGLELLAGEGKLSGRQKEELLTQQHKAFWQEAERFSREFVQRGKDLVTASLAHQVEGTAKLTLAQEEEQRSFLAEAQPTADPEKFLEAFHEVLERQRLMQCDLEEEENVRATEAVVALCQELYFSTVDTFQKFVDALFLQTLPGMTGLPPEECDYLRQEVQENAAWQLGKSNRFRRQQWKLFQELLEQDQQVWMEECALSSVLQTHLREDHEGTIRGVLGRLGGLTEESTRCVLQGHDLLLRSALRRLALRGNALATLTQMRLSGKKHLLQELREQRALEQGSSQCLDEHQWQLLRALEARVLEEASRLEEEAQQTRLQLQQRLLAEAQEVGQLLQQHMECAIGQALLVHARNAATKSRAKDRDDFKRTLMEAAVESVYVTSAGVSRLVQAYYQQIGRIMEDHEERKLQHLKTLQGERMENYKLRKKQELSNPSSGSRTAGGAHETSQAVHQRMLSQQKRFLAQFPVHQQMRLHAQQQQAGVMDLLEAQLETQLQEAEQNFISELAALARVPLAESKLLPAKRGLLEKPLRTKRKKPLPQERGDLGVPNNEDLASGDQTSGSLSSKRLSQQESEAGDSGNSKKMLKRRSNL

SEQ ID NO: 808996 - protein, 478 aa, Homo sapiens
MSWGHLLSLIDAESIQKLPDQPSHHTQKRPFPSGEKLPDQPFTHHSQEGPFPPGEKLPDQPLIPQPRGAFLTWREISRPSPLTTARRGLSHRKKKLPDQPLTPQPREAFPAWRETSRPALSLQPGEAFPAWKLPDKPLTHHSQERPFPPGQKLPDQPLSPQPGEAFTTWREASRPAPHTTARRGLSHLERNFQTSPSYHSQEGPFSPGEKLPDQPLTPPPGEAFPTGRETSRPAPHTTARRGLSHRERNFQTSPLTTARRGLSHRERNFQTSPSHHSQERPFPPGEKLQASSSHHSQERPFLPGEKLSDQPHTPQPGEAVPAWREASRPALHTTARRGLSHLERNFQTSPSHHSQERPFPPGGKIAPLMEVRDCHPQHCEHTGRDHSSGEGAAQSITGCSSVPGLCPPDASTPTIRGNQGCLQTLPRVHGVITHCAESKGALPWSNPGHSRGYVQKSPEPSEPSGSGSPYLRNFQGHL

SEQ ID NO: 808997 - protein, 992 aa, Homo sapiens; identical to SEQ ID NO: 808989

SEQ ID NO: 808998 - protein, 185 aa, Homo sapiens
LEDPGIPIQSVDVDLCIYSLHLKDLLHLDTALRQEKHMMFIQIFKMCLLDLLPKKKSDDELYQKILSKQEKDLEELEKGLQVKLSNTEMSGAGDSEYITLADVEKKEREYSEQLIDNMEAFWKQMANIQHFLVDQFKCSSSKARQLMMTLTERMIAAEGLLCDSQELQALVMLEGAGGNIKIFRL

SEQ ID NO: 808999 - protein, 58 aa, Homo sapiens
TLMEAAVESVYVTSAGVSRLVQAYYQQIGRIMEDHEERKLQHLKTLQGTGPPLREAPE

SEQ ID NO: 809000 - protein, 992 aa, Homo sapiens; identical to SEQ ID NO: 808989

SEQ ID NO: 809001 - protein, 992 aa, Homo sapiens; identical to SEQ ID NO: 808989

SEQ ID NO: 809002 - protein, 98 aa, Homo sapiens
MLAYTHAHTHTLQHTHTHPHMHTYTRACMYTCTHDTHRHTHMCACTHTHTHTKLAFLANISCLMGKAAAMGMGGPGWGRCWPRAGVSLSCEKVPSSEL

SEQ ID NO: 809003 - protein, 992 aa, Homo sapiens; identical to SEQ ID NO: 808989

SEQ ID NO: 809004 - protein, 992 aa, Homo sapiens; identical to SEQ ID NO: 808989

SEQ ID NO: 809005 - protein, 992 aa, Homo sapiens; identical to SEQ ID NO: 808989

SEQ ID NO: 809006 - protein, 992 aa, Homo sapiens; identical to SEQ ID NO: 808989

SEQ ID NO: 809007 - protein, 583 aa, Homo sapiens
LEDPGIPIQSVDVDLCIYSLHLKDLLHLDTALRQEKHMMFIQIFKMCLLDLLPKKKSDDELYQKILSKQEKDLEELEKGLQVKLSNTEMSGAGDSEYITLADVEKKEREYSEQLIDNMEAFWKQMANIQHFLVDQFKCSSSKARQLMMTLTERMIAAEGLLCDSQELQALDALERTMGRAHMAKVIEFLKLQVQEETRCRLAAISHGLELLAGEGKLSGRQKEELLTQQHKAFWQEAERFSREFVQRGKDLVTASLAHQVEGTAKLTLAQEEEQRSFLAEAQPTADPEKFLEPSHHSQERPFPPEEETSRPAPHTTAKRSLSSLERNFQTSPLTTARRGLSRLETSGQASHTPQPGEAFPTWTETSRPAPLTTARRGLYHLERSFQTSPSHHSQERPFPPGEKLPDQPLIPQPRGAFLTWRETSRPAPHTTARRGLSHRERNFQTSPSHHSQERPFPPGEKLPDQPSHYSQKRPFPPGEELPDQPLTPQPGEAFPAWREASGQLLTPQPGETFSAWRETFRPAPHTTARRGRSCLERSFQTSPSHHSQERPFPPGEKLPDQPLSPQPGEAVPTWRENCSFDGG

SEQ ID NO: 809008 - protein, 436 aa, Homo sapiens
GEGPLGEGNGAVTGIPEGAAEATMAEGPEEARGHPPGQDDGGGDHEPVPSLRGPPTTAVPCPRDDPQAEPQAPGRPTAPGLAAAAAADKLEPPRELRKRGEAASGSGAELQEQAGCEAPEAAAPRERPARLSAREYSRQVHEWLWQSYCGYLTWHSGLAAFPAYCSPQPSPQSFPSGGAAVPQAAAPPPPQLGYYNPFYFLSPGAAGPDPRTAAGISTPAPVAGLGPRAPHVQASVRATPVTRVGSAAPSRSPSETGRQAGREYVIPSLAHRFMAEMVDFFILFFIKATIVLSIMHLSGIKDISKFAMHYIIEEIDEDTSMEDLQKMMVVALIYRLLVCFYEIICIWGAGGATPGKFLLGLRVVTCDTSVLIAPSRVLVIPSSNVSITTSTIRALIKNFSIASFFPAFITLLFFQHNRTAYDIVAGTIVVKRNGVR

SEQ ID NO: 809009 - protein, 436 aa, Homo sapiens; identical to SEQ ID NO: 809008

SEQ ID NO: 809010 - protein, 436 aa, Homo sapiens; identical to SEQ ID NO: 809008

SEQ ID NO: 809011 - protein, 436 aa, Homo sapiens; identical to SEQ ID NO: 809008

SEQ ID NO: 809012 - protein, 436 aa, Homo sapiens; identical to SEQ ID NO: 809008

SEQ ID NO: 809013 - protein, 436 aa, Homo sapiens; identical to SEQ ID NO: 809008

SEQ ID NO: 809014 - protein, 436 aa, Homo sapiens; identical to SEQ ID NO: 809008

SEQ ID NO: 809015 - protein, 436 aa, Homo sapiens; identical to SEQ ID NO: 809008

SEQ ID NO: 809016 - protein, 436 aa, Homo sapiens; identical to SEQ ID NO: 809008

SEQ ID NO: 809017 - protein, 436 aa, Homo sapiens; identical to SEQ ID NO: 809008

SEQ ID NO: 809018 - protein, 81 aa, Homo sapiens
PSFTYYHSGQNLYLSCFADSNPPAQYSWTINGKFQLSGQKLSIPQITTKHSGLYACSVRNSATGKESSKSVTVRVSDWTLP

SEQ ID NO: 809019 - protein, 526 aa, Homo sapiens
PYWPYLTAETLKNRMGHQPPPPTQQHSITDNSLSLKTPPECLLIPFHPQRMIISRKKEKEGGRTAHLTALLRKSLDPRLISTGENTQTAETMGPLSAPPCTQHITWKGLLLTASLLNFWNLPTTAQVIIEAKPPKVSEGKDVLLLVHNLPQNLTGYIWYKGQMTDLYHYITSYVVHGQIIYGPAYSGRETVYSNASLLIQNVTQEDAGSYTLHIIKRGDGTGGVTGYFTVTLYSETPKPSISSSNLNPREVMEAVRLICDPETPDASYLWLLNGQNLPMTHRLQLSKTNRTLYLFGVTKYIAGPYECEIRNPVSASRSDPVTLNLLPKLPMPYITINNLNPREKKDVLAFTCEPKSRNYTYIWWLNGQSLPVSPRVKRPIENRILILPSVTRNETGPYQCEIRDRYGGIRSNPVTLNVLYGPDLPRIYPSFTYYRSGENLDLSCFADSNPPAEYSWTINGKFQLSGQKLFIPQITTNHSGLYACSVRNSATGKEISKSMIVKVSETASPQVTYAGPNTWFQEILLL

SEQ ID NO: 809020 - protein, 423 aa, Homo sapiens
PYWPYLTAETLKNRMGHQPPPPTQQHSITDNSLSLKTPPECLLIPFHPQRMIISRKKEKEGGRTAHLTALLRKSLDPRLISTGENTQTAETMGPLSAPPCTQHITWKGLLLTASLLNFWNLPTTAQVIIEAKPPKVSEGKDVLLLVHNLPQNLTGYIWYKGQMTDLYHYITSYVVHGQIIYGPAYSGRETVYSNASLLIQNVTQEDAGSYTLHIIKRGDGTGGVTGYFTVTLYSETPKPSISSSNLNPREVMEAVRLICDPETPDASYLWLLNGQNLPMTHRLQLSKTNRTLYLFGVTKYIAGPYECEIRNPVSASRSDPVTLNLLHGPDLPRIYPSFTYYRSGENLDLSCFADSNPPAEYSWTINGKFQLSGQKLFIPQITTNHSGLYACSVRNSATGKEISKSMIVKVSGKWIPASLAIGF

SEQ ID NO: 809021 - protein, 543 aa, Homo sapiens
PYWPYLTAETLKNRMGHQPPPPTQQHSITDNSLSLKTPPECLLIPFHPQRMIISRKKEKEGGRTAHLTALLRKSLDPRLISTGENTQTAETMGPLSAPPCTQHITWKGLLLTASLLNFWNLPTTAQVIIEAKPPKVSEGKDVLLLVHNLPQNLTGYIWYKGQMTDLYHYITSYVVHGQIIYGPAYSGRETVYSNASLLIQNVTQEDAGSYTLHIIKRGDGTGGVTGYFTVTLYSETPKPSISSSNLNPREVMEAVRLICDPETPDASYLWLLNGQNLPMTHRLQLSKTNRTLYLFGVTKYIAGPYECEIRNPVSASRSDPVTLNLLLWEMPTLNEGCLWRNQRCHTGQSSVIHTAKLPMPYITINNLNPREKKDVLAFTCEPKSRNYTYIWWLNGQSLPVSPRVKRPIENRILILPSVTRNETGPYQCEIRDRYGGIRSNPVTLNVLYGPDLPRIYPSFTYYRSGENLDLSCFADSNPPAEYSWTINGKFQLSGQKLFIPQITTNHSGLYACSVRNSATGKEISKSMIVKVSGPCHGNQTESH

SEQ ID NO: 809022 - protein, 395 aa, Homo sapiens
PYWPYLTAETLKNRMGHQPPPPTQQHSITDNSLSLKTPPECLLIPFHPQRMIISRKKEKEGGRTAHLTALLRKSLDPRLISTGENTQTAETMGPLSAPPCTQHITWKGLLLTAETPKPSISSSNLNPREVMEAVRLICDPETPDASYLWLLNGQNLPMTHRLQLSKTNRTLYLFGVTKYIAGPYECEIRNPVSASRSDPVTLNLLPKLPMPYITINNLNPREKKDVLAFTCEPKSRNYTYIWWLNGQSLPVSPRVKRPIENRILILPSVTRNETGPYQCEIRDRYGGIRSNPVTLNVLYGPDLPRIYPSFTYYRSGENLDLSCFADSNPPAEYSWTINGKFQLSGQKLFIPQITTNHSGLYACSVRNSATGKEISKSMIVKVSGKWIPASLAIGF

SEQ ID NO: 809023 - protein, 449 aa, Homo sapiens
PYWPYLTAETLKNRMGHQPPPPTQQHSITDNSLSLKTPPECLLIPFHPQRMIISRKKEKEGGRTAHLTALLRKSLDPRLISTGENTQTAETMGPLSAPPCTQHITWKGLLLTASLLNFWNLPTTAQVIIEAKPPKVSEGKDVLLLVHNLPQNLTGYIWYKGQMTDLYHYITSYVVHGQIIYGPAYSGRETVYSNASLLIQNVTQEDAGSYTLHIIKRGDGTGGVTGYFTVTLYSETPKPSISSSNLNPREVMEAVRLICDPETPDASYLWLLNGQNLPMTHRLQLSKTNRTLYLFGVTKYIAGPYECEIRNPVSASRSDPVTLNLLPKLPMPYITINNLNPREKKDVLAFTCEPKSRNYTYIWWLNGQSLPVSPRVKRPIENRILILPSVTRNETGPYQCEIRDRYGGIRSNPVTLNVLCEYPLFLCGPGHQLNSKRPEARPLSLSPVQ

SEQ ID NO: 809024 - protein, 330 aa, Homo sapiens
PYWPYLTAETLKNRMGHQPPPPTQQHSITDNSLSLKTPPECLLIPFHPQRMIISRKKEKEGGRTAHLTALLRKSLDPRLISTGENTQTAETMGPLSAPPCTQHITWKGLLLTASLLNFWNLPTTAQVIIEAKPPKVSEGKDVLLLVHNLPQNLTGYIWYKGQMTDLYHYITSYVVHGQIIYGPAYSGRETVYSNASLLIQNVTQEDAGSYTLHIIKRGDGTGGVTGYFTVTLYYGPDLPRIYPSFTYYRSGENLDLSCFADSNPPAEYSWTINGKFQLSGQKLFIPQITTNHSGLYACSVRNSATGKEISKSMIVKVSGKWIPASLAIGF

SEQ ID NO: 809025 - protein, 385 aa, Homo sapiens
PYWPYLTAETLKNRMGHQPPPPTQQHSITDNSLSLKTPPECLLIPFHPQRMIISRKKEKEGGRTAHLTALLRKSLDPRLISTGENTQTAETMGPLSAPPCTQHITWKGLLLTASLLNFWNLPTTAQVIIEAKPPKVSEGKDVLLLVHNLPQNLTGYIWYKGQMTDLYHYITSYVVHGQIIYGPAYSGRETVYSNASLLIQNVTQEDAGSYTLHIIKRGDGTGGVTGYFTVTLYSETPKPSISSSNLNPREVMEAVRLICDPETPDASYLWLLNGQNLPMTHRLQLSKTNRTLYLFGVTKYIAGPYECEIRNPVSASRSDPVTLNLLREYLLFLCEPGCHPKYKWPEARPLSPSQVQVQRPLSLNIKAGHDFLLQANQSRPRLDQQ

SEQ ID NO: 809026 - protein, 411 aa, Homo sapiens
PYWPYLTAETLKNRMGHQPPPPTQQHSITDNSLSLKTPPECLLIPFHPQRMIISRKKEKEGGRTAHLTALLRKSLDPRLISTGENTQTAETMGPLSAPPCTQHITWKGLLLTASLLNFWNLPTTAQVIIEAKPPKVSEGKDVLLLVHNLPQNLTGYIWYKGQMTDLYHYITSYVVHGQIIYGPAYSGRETVYSNASLLIQNVTQEDAGSYTLHIIKRGDGTGGVTGYFTVTLYYVGQLQRLSHTLNGNTCGLGTRWRWPAETPKPSISSSNLNPREVMEAVRLICDPETPDASYLWLLNGQNLPMTHRLQLSKTNRTLYLFGVTKYIAGPYECEIRNPVSASRSDPVTLNLLREYLLFLCEPGCHPKYKWPEARPLSPSQVQVQRPLSLNIKAGHDFLLQANQSRPRLDQQ

SEQ ID NO: 809027 - protein, 208 aa, Homo sapiens
PYWPYLTAETLKNRMGHQPPPPTQQHSITDNSLSLKTPPECLLIPFHPQRMIISRKKEKEGGRTAHLTALLRKSLDPRLISTGENTQTAETMGPLSAPPCTQHITWKGLLLTASLLNFWNLPTTAQVIIEAKPPKVSEGKDVLLLVHNLPQNLTGYIWYKGQMTDLYHYITSYVVHGLLTDRADTRLNRTRGRVPPDKQSERATSQSP

SEQ ID NO: 809028 - protein, 288 aa, Homo sapiens
STEGGRTAHHLEGAPASLLNFWNLPTTAQVIIEAKPPKVSEGKDVLLLVHNLPQNLTGYIWYKGQMTDLYHYITSYVVHGQIIYGPAYSGRETVYSNASLLIQNVTQEDAGSYTLHIIKRGDGTGGVTGYFTVTLYSETPKPSISSSNLNPREVMEAVRLICDPETPDASYLWLLNGQNLPMTHRLQLSKTNRTLYLFGVTKYIAGPYECEIRNPVSASRSDPVTLNLLREYLLFLCEPGCHPKYKWPEARPLSPSQVQVQRPLSLNIKAGHDFLLQANQSRPRLDQQ

SEQ ID NO: 809029 - protein, 58 aa, Homo sapiens
RWDHGVYRLHNRTLYLFGVTKYIAGPYECEIRNPVSASRSDPVTLNLLPKLPVSNLSV

SEQ ID NO: 809030 - protein, 515 aa, Homo sapiens
PYWPYLTAETLKNRMGHQPPPPTQQHSITDNSLSLKTPPECLLIPFHPQRMIISRKKEKEGGRTAHLTALLRKSLDPRLISTGENTQTAETMGPLSAPPCTQHITWKGLLLTASLLNFWNLPTTAQVIIEAKPPKVSEGKDVLLLVHNLPQNLTGYIWYKGQMTDLYHYITSYVVHGQIIYGPAYSGRETVYSNASLLIQNVTQEDAGSYTLHIIKRGDGTGGVTGYFTVTLYSETPKPSISSSNLNPREVMEAVRLICDPETPDASYLWLLNGQNLPMTHRLQLSKTNRTLYLFGVTKYIAGPYECEIRNPVSASRSDPVTLNLLPKLPMPYITINNLNPREKKDVLAFTCEPKSRNYTYIWWLNGQSLPVSPRVKRPIENRILILPSVTRNETGPYQCEIRDRYGGIRSNPVTLNVLYGPDLPRIYPSFTYYRSGENLDLSCFADSNPPAEYSWTINGKFQLSGQKLFIPQITTNHSGLYACSVRNSATGKEISKSMIVKVSGPCHGNQTESH

SEQ ID NO: 809031 - protein, 515 aa, Homo sapiens; identical to SEQ ID NO: 809030

SEQ ID NO: 809032 - protein, 516 aa, Homo sapiens
PYWPYLTAETLKNRMGHQPPPPTQQHSITDNSLSLKTPPECLLIPFHPQRMIISRKKEKEGGRTAHLTALLRKSLDPRLISTGENTQTAETMGPLSAPPCTQHITWKGLLLTASLLNFWNLPTTAQVIIEAKPPKVSEGKDVLLLVHNLPQNLTGYIWYKGQMTDLYHYITSYVVHGQIIYGPAYSGRETVYSNASLLIQNVTQEDAGSYTLHIIKRGDGTGGVTGYFTVTLYSETPKPSISSSNLNPREVMEAVRLICDPETPDASYLWLLNGQNLPMTHRLQLSKTNRTLYLFGVTKYIAGPYECEIRNPVSASRSDPVTLNLLPKLPMPYITINNLNPREKKDVLAFTCEPKSRNYTYIWWLNGQSLPVSPRVKRPIENRILILPSVTRNETGPYQCEIRDRYGGIRSNPVTLNVLYGPDLPRIYPSFTYYRSGENLDLSCFADSNPPAEYSWTINGKFQLSGQKLFIPQITTNHSGLYACSVRNSATGKEISKSMIVKVSGKWIPASLAIGF

SEQ ID NO: 809033 - protein, 544 aa, Homo sapiens
PYWPYLTAETLKNRMGHQPPPPTQQHSITDNSLSLKTPPECLLTPLPPSADDNLKKEKKEGGRTAHLTALLRKSLDPRLISTGENTQTAETMGPLSAPPCTQHITWKGLLLTASLLNFWNLPTTAQVIIEAKPPKVSEGKDVLLLVHNLPQNLTGYIWYKGQMTDLYHYITSYVVHGQIIYGPAYSGRETVYSNASLLIQNVTQEDAGSYTLHIIKRGDGTGGVTGYFTVTLYSETPKPSISSSNLNPREVMEAVRLICDPETPDASYLWLLNGQNLPMTHRLQLSKTNRTLYLFGVTKYIAGPYECEIRNPVSASRSDPVTLNLLREEMPTLNEGCLWRNQRCHTGQSSVIHTAKLPMPYITINNLNPREKKDVLAFTCEPKSRNYTYIWWLNGQSLPVSPRVKRPIENRILILPSVTRNETGPYQCEIRDRYGGIRSNPVTLNVLYGPDLPRIYPSFTYYRSGENLDLSCFADSNPPAEYSWTINGKFQLSGQKLFIPQITTNHSGLYACSVRNSATGKEISKSMIVKVSGKWIPASLAIGF

SEQ ID NO: 809034 - protein, 542 aa, Homo sapiens
PYWPYLTAETLKNRMGHQPPPPTQQHSITDNSLSLKTPPECLLIPFHPQRMIISRKKEKEGGRTAHLTALLRKSLDPRLISTGENTQTAETMGPLSAPPCTQHITWKGLLLTASLLNFWNLPTTAQVIIEAKPPKVSEGKDVLLLVHNLPQNLTGYIWYKGQMTDLYHYITSYVVHGQIIYGPAYSGRETVYSNASLLIQNVTQEDAGSYTLHIIKRGDGTGGVTGYFTVTLYYVGQLQRLSHTLNGNTCGLGTRWRWPAETPKPSISSSNLNPREVMEAVRLICDPETPDASYLWLLNGQNLPMTHRLQLSKTNRTLYLFGVTKYIAGPYECEIRNPVSASRSDPVTLNLLPKLPMPYITINNLNPREKKDVLAFTCEPKSRNYTYIWWLNGQSLPVSPRVKRPIENRILILPSVTRNETGPYQCEIRDRYGGIRSNPVTLNVLYGPDLPRIYPSFTYYRSGENLDLSCFADSNPPAEYSWTINGKFQLSGQKLFIPQITTNHSGLYACSVRNSATGKEISKSMIVKVSGKWIPASLAIGF

SEQ ID NO: 809035 - protein, 500 aa, Homo sapiens
PYWPYLTAETLKNRMGHQPPPPTQQHSITDNSLSLKTPPECLLIPFHPQRMIISRKKEKEGGRTAHLTALLRKSLDPRLISTGENTQTAETMGPLSAPPCTQHITWKGLLLTASLLNFWNLPTTAQVIIEAKPPKVSEGKDVLLLVHNLPQNLTGYIWYKGQMTDLYHYITSYVVHGQIIYGPAYSGRETVYSNASLLIQNVTQEDAGSYTLHIIKRGDGTGGVTGYFTVTLYSETPKPSISSSNLNPREVMEAVRLICDPETPDASYLWLLNGQNLPMTHRLQLSKTNRTLYLFGVTKYIAGPYECEIRNPVSASRSDPVTLNLLPKLPMPYITINNLNPREKKDVLAFTCEPKSRNYTYIWWLNGQSLPVSPRVKRPIENRILILPSVTRNETGPYQCEIRDRYGGIRSNPVTLNVLYGPDLPRIYPSFTYYRSGENLDLSCFADSNPPAEYSWTINGKFQLSGQKLFIPQITTNHSGLYACSVRNSATGKARTLARL

SEQ ID NO: 809036 - protein, 422 aa, Homo sapiens
PYWPYLTAETLKNRMGHQPPPPTQQHSITDNSLSLKTPPECLLIPFHPQRMIISRKKEKEGGRTAHLTALLRKSLDPRLISTGENTQTAETMGPLSAPPCTQHITWKGLLLTASLLNFWNLPTTAQVIIEAKPPKVSEGKDVLLLVHNLPQNLTGYIWYKGQMTDLYHYITSYVVHGQIIYGPAYSGRETVYSNASLLIQNVTQEDAGSYTLHIIKRGDGTGGVTGYFTVTLYSETPKPSISSSNLNPREVMEAVRLICDPETPDASYLWLLNGQNLPMTHRLQLSKTNRTLYLFGVTKYIAGPYECEIRNPVSASRSDPVTLNLLHGPDLPRIYPSFTYYRSGENLDLSCFADSNPPAEYSWTINGKFQLSGQKLFIPQITTNHSGLYACSVRNSATGKEISKSMIVKVSGPCHGNQTESH

SEQ ID NO: 809037 - protein, 343 aa, Homo sapiens
PYWPYLTAETLKNRMGHQPPPPTQQHSITDNSLSLKTPPECLLIPFHPQRMIISRKKEKEGGRTAHLTALLRKSLDPRLISTGENTQTAETMGPLSAPPCTQHITWKGLLLTASLLNFWNLPTTAQVIIEAKPPKVSEGKDVLLLVHNLPQNLTGYIWYKGQMTDLYHYITSYVVHGQIIYGPAYSGRETVYSNASLLIQNVTQEDAGSYTLHIIKRGDGTGGVTGYFTVTLYSETPKPSISSSNLNPREVMEAVRLICDPETPDASYLWLLNGQNLPMTHRLQLSKTNRTLYLFGVTKYIAGPYECEIRNPVSASRSDPVTLNLLHGPELPRITLLSSLSDV

SEQ ID NO: 809038 - protein, 324 aa, Homo sapiens
PYWPYLTAETLKNRMGHQPPPPTQQHSITDNSLSLKTPPECLLIPFHPQRMIISRKKEKEGGRTAHLTALLRKSLDPRLISTGENTQTAETMGPLSAPPCTQHITWKGLLLTASLLNFWNLPTTAQVIIEAKPPKVSEGKDVLLLVHNLPQNLTGYIWYKGQMTDLYHYITSYVVHGQIIYGPAYSGRETVYSNASLLIQNVTQEDAGSYTLHIIKRGDGTGGVTGYFTVTLYSETPKPSISSSNLNPREVMEAVRLICDPETPDASYLWLLNGQKQPQRTREVPVDHSDGHVPTQISNSQLVSPTEKHSIHENTPMKLEIQHL

SEQ ID NO: 809039 - protein, 264 aa, Homo sapiens
PYWPYLTAETLKNRMGHQPPPPTQQHSITDNSLSLKTPPECLLIPFHPQRMIISRKKEKEGGRTAHLTALLRKSLDPRLISTGENTQTAETMGPLSAPPCTQHITWKGLLLTAETPKPSISSSNLNPREVMEAVRLICDPETPDASYLWLLNGQNLPMTHRLQLSKTNRTLYLFGVTKYIAGPYECEIRNPVSASRSDPVTLNLLREYLLFLCEPGCHPKYKWPEARPLSPSQVQVQRPLSLNIKAGHDFLLQANQSRPRLDQQ

SEQ ID NO: 809040 - protein, 191 aa, Homo sapiens
PVNCYPVSVLPNNLDFKLQCSLINPRYRYIEIFPSRRNEVRTHVGSYKGKKIASFPTAKYITEPEMVFEEHEVNEDIQPMTAFESEKEIELPKEVPEKLPEAADFGTTSSLHFVHMRGLPFQANAQDIINFFAPLKPVRITMEYSSSGKATGEADVHFETHEDAVAAMLKDRSHVHHRYIELFLNSCPKGK

SEQ ID NO: 809041 - protein, 193 aa, Homo sapiens
RPPVPTLPSVPTRTISQESKTTYLEDLPPPPEYELAPSKLEEEVDDVFLIRAQGLPWSCTMEDVLNFFSDCRIRNGENGIHFLLNRDGKRRGDALIEMESEQDVQKALEKHRMYMGQRYVEVYEINNEDVDALMKSLQVKSSPVVNDGVVRLRGLPYSCNEKDIVDFFAGTLQLYYAWELISFFPWYLLLYLR

SEQ ID NO: 809042 - protein, 154 aa, Homo sapiens
MDYRGRRKTGEAYVQFEEPEMANQALLKHREEIGNRYIEIFPSRRNEVRTHVGSYKGKKIASFPTAKYITEPEMVFEEHEVNEDIQPMTAFESEKEIELPKEVPEKLPEAADFGTTSSLHFVHMRGLPFQANAQDIINVCGSKISNLNRFEQKF

SEQ ID NO: 809043 - protein, 487 aa, Homo sapiens
TGRSVALSSTSFRLSEAPHPVPAAHVPGTPHPQPALDSTSVPPSLLEQLPSGPAPPPESMAGTRWVLGALLRGCGCNCSSCRRTGAACLPFYSAAGSIPSYPALRASLLPQSLAAAAAVPTRSYSQESKTTYLEDLPPPPEYELAPSKLEEEVDDVFLIRAQGLPWSCTMEDVLNFFSDCRIRNGENGIHFLLNRDGKRRGDALIEMESEQDVQKALEKHRMYMGQRYVEVYEINNEDVDALMKSLQVKSSPVVNDGVVRLRGLPYSCNEKDIVDFFAGLNIVDITFVMDYRGRRKTGEAYVQFEEPEMANQALLKHREEIGNRYIEIFPSRRNEVRTHVGSYKGKKIASFPTAKYITEPEMVFEEHEVNEDIQPMTAFESEKEIELPKEVPEKLPEAADFGTTSSLHFVHMRGLPFQANAQDIINFFAPLKPVRITMEYSSSGKATGEADVHFETHEDAVAAMLKDRSHVHHRYIELFLNSCPKGK

SEQ ID NO: 809044 - protein, 540 aa, Homo sapiens
RLGGASRSPPPPSDSRRPPTQCPRRMCQAHPTPNRPWIPLPFHHRCWSSCLQALRRLRSPWPARAGYSGRCSGAAAVTAAAAGAPAPPACPSTPPLALSPSGVSGRRRLLLLLGAAAAAASQTRGLQTGPVPPGRLAGPPAVATSAAAAAAASYPALRASLLPQSLAAAAAVPTRSYSQESKTTYLEDLPPPPEYELAPSKLEEEVDDVFLIRAQGLPWSCTMEDVLNFFSDCRIRNGENGIHFLLNRDGKRRGDALIEMESEQDVQKALEKHRMYMGQRYVEVYEINNEDVDALMKSLQVKSSPVVNDGVVRLRGLPYSCNEKDIVDFFAGLNIVDITFVMDYRGRRKTGEAYVQFEEPEMANQALLKHREEIGNRYIEIFPSRRNEVRTHVGSYKGKKIASFPTAKYITEPEMVFEEHEVNEDIQPMTAFESEKEIELPKEVPEKLPEAADFGTTSSLHFVHMRGLPFQANAQDIINFFAPLKPVRITMEYSSSGKATGEADVHFETHEDAVAAMLKDRSHVHHRYIELFLNSCPKGK

SEQ ID NO: 809045 - protein, 470 aa, Homo sapiens
TGRSVALSSTSFRLSEAPHPVPAAHVPGTPHPQPALDSTSVPPSLLEQLPSGPAPPPESMAGTRWVLGALLRGCGCNCSSCRRTGAACLPFYSAAGSIPAAVPTRSYSQESKTTYLEDLPPPPEYELAPSKLEEEVDDVFLIRAQGLPWSCTMEDVLNFFSDCRIRNGENGIHFLLNRDGKRRGDALIEMESEQDVQKALEKHRMYMGQRYVEVYEINNEDVDALMKSLQVKSSPVVNDGVVRLRGLPYSCNEKDIVDFFAGLNIVDITFVMDYRGRRKTGEAYVQFEEPEMANQALLKHREEIGNRYIEIFPSRRNEVRTHVGSYKGKKIASFPTAKYITEPEMVFEEHEVNEDIQPMTAFESEKEIELPKEVPEKLPEAADFGTTSSLHFVHMRGLPFQANAQDIINFFAPLKPVRITMEYSSSGKATGEADVHFETHEDAVAAMLKDRSHVHHRYIELFLNSCPKGK

SEQ ID NO: 809046 - protein, 411 aa, Homo sapiens
MAGTRWVLGALLRGCGCNCSSCRRTGAACLPFYSAAGSIPAAVPTRSYSQESKTTYLEDLPPPPEYELAPSKLEEEVDDVFLIRAQGLPWSCTMEDVLNFFSDCRIRNGENGIHFLLNRDGKRRGDALIEMESEQDVQKALEKHRMYMGQRYVEVYEINNEDVDALMKSLQVKSSPVVNDGVVRLRGLPYSCNEKDIVDFFAGLNIVDITFVMDYRGRRKTGEAYVQFEEPEMANQALLKHREEIGNRYIEIFPSRRNEVRTHVGSYKGKKIASFPTAKYITEPEMVFEEHEVNEDIQPMTAFESEKEIELPKEVPEKLPEAADFGTTSSLHFVHMRGLPFQANAQDIINFFAPLKPVRITMEYSSSGKATGEADVHFETHEDAVAAMLKDRSHVHHRYIELFLNSCPKGK

SEQ ID NO: 809047 - protein, 540 aa, Homo sapiens; identical to SEQ ID NO: 809044

SEQ ID NO: 809048 - protein, 540 aa, Homo sapiens; identical to SEQ ID NO: 809044

SEQ ID NO: 809049 - protein, 525 aa, Homo sapiens
RLGGASRSPPPPSDSRRPPTQCPRRMCQAHPTPNRPWIPLPFHHRCWSSCLQALRRLRSPWPARAGYSGRCSGAAAVTAAAAGAPAPPACPSTPPLALSPSGVSGRRRLLLLLGAAAAAASQTRGLQTGPVPPGRLAGPPAVATSAAAAAAASYPALRASLLPQSLAAAAAVPTRSYSQESKTTYLEDLPPPPEYELAPSKLEEEVDDVFLIRAQGLPWSCTMEDVLNFFSDCRIRNGENGIHFLLNRDGKRRGDALIEMESEQDVQKALEKHRMYMGQRYVEVYEINNEDVDALMKSLQVKSSPVVNDGVVRLRGLPYSCNEKDIVDFFAGLNIVDITFVMDYRGRRKTGEAYVQFEEPEMANQALLKHREEIGNRYIEIFPSRRNEVRTHVGSYKGKKIASFPTAKYITEPEMVFEEHEVNEDIQPMTAFESEKEIELPKEVPEKLPEAADFGTTSSLHFVHMRGLPFQANAQDIINFFAPLKPVRITMEYSSSGKATGEADVHFETHEDAVAAMLKDRSHVR

SEQ ID NO: 809050 - protein, 621 aa, Homo sapiens
RLGGASRSPPPPSDSRRPPTQCPRRMCQAHPTPNRPWIPLPFHHRCWSSCLQALRRLRSPWPARAGYSGRCSGAAAVTAAAAGAPAPPACPSTPPLALSPSGVSGRRRLLLLLGAAAAAASQTRGLQTGPVPPGRLAGPPAVATSAAAAAAASYPALRASLLPQSLAAAAAVPTRSYSQVRGRREGPGARSLPGRVHAPPRPSVPPCAPRGHARGSATLAAHPPPSTLCSYWALEQGKLSQASGLLLVLFSPRISGRLGSESKTTYLEDLPPPPEYELAPSKLEEEVDDVFLIRAQGLPWSCTMEDVLNFFSDCRIRNGENGIHFLLNRDGKRRGDALIEMESEQDVQKALEKHRMYMGQRYVEVYEINNEDVDALMKSLQVKSSPVVNDGVVRLRGLPYSCNEKDIVDFFAGLNIVDITFVMDYRGRRKTGEAYVQFEEPEMANQALLKHREEIGNRYIEIFPSRRNEVRTHVGSYKGKKIASFPTAKYITEPEMVFEEHEVNEDIQPMTAFESEKEIELPKEVPEKLPEAADFGTTSSLHFVHMRGLPFQANAQDIINFFAPLKPVRITMEYSSSGKATGEADVHFETHEDAVAAMLKDRSHVHHRYIELFLNSCPKGK

SEQ ID NO: 809051 - protein, 638 aa, Homo sapiens
RLGGASRSPPPPSDSRRPPTQCPRRMCQAHPTPNRPWIPLPFHHRCWSSCLQALRRLRSPWPARAGYSGRCSGAAAVTAAAAGAPAPPACPSTPPLALSPSGVSGRRRLLLLLGAAAAAASQTRGLQTGPVPPGRLAGPPAVATSAAAAAAASYPALRASLLPQSLAAAAAVPTRSYSQVRGRREGPGARSLPGRVHAPPRPSVPPCAPRGHARGSATLAAHPPPSTLCSYWALEQGKLSQASGLLLVLFSPRISGRLGSVSVAGVNVEALFPAWPMESKTTYLEDLPPPPEYELAPSKLEEEVDDVFLIRAQGLPWSCTMEDVLNFFSDCRIRNGENGIHFLLNRDGKRRGDALIEMESEQDVQKALEKHRMYMGQRYVEVYEINNEDVDALMKSLQVKSSPVVNDGVVRLRGLPYSCNEKDIVDFFAGLNIVDITFVMDYRGRRKTGEAYVQFEEPEMANQALLKHREEIGNRYIEIFPSRRNEVRTHVGSYKGKKIASFPTAKYITEPEMVFEEHEVNEDIQPMTAFESEKEIELPKEVPEKLPEAADFGTTSSLHFVHMRGLPFQANAQDIINFFAPLKPVRITMEYSSSGKATGEADVHFETHEDAVAAMLKDRSHVHHRYIELFLNSCPKGK

SEQ ID NO: 809052 - protein, 398 aa, Homo sapiens
LVGKEPVPIAPSLSCPQGKTSCPGLLKVTSATPLIQKESKTTYLEDLPPPPEYELAPSKLEEEVDDVFLIRAQGLPWSCTMEDVLNFFSDCRIRNGENGIHFLLNRDGKRRGDALIEMESEQDVQKALEKHRMYMGQRYVEVYEINNEDVDALMKSLQVKSSPVVNDGVVRLRGLPYSCNEKDIVDFFAGLNIVDITFVMDYRGRRKTGEAYVQFEEPEMANQALLKHREEIGNRYIEIFPSRRNEVRTHVGSYKGKKIASFPTAKYITEPEMVFEEHEVNEDIQPMTAFESEKEIELPKEVPEKLPEAADFGTTSSLHFVHMRGLPFQANAQDIINFFAPLKPVRITMEYSSSGKATGEADVHFETHEDAVAAMLKDRSHVHHRYIELFLNSCPKGK

SEQ ID NO: 809053 - protein, 378 aa, Homo sapiens
RPPVPTLPSVPTRTISQESKTTYLEDLPPPPEYELAPSKLEEEVDDVFLIRAQGLPWSCTMEDVLNFFSDCRIRNGENGIHFLLNRDGKRRGDALIEMESEQDVQKALEKHRMYMGQRYVEVYEINNEDVDALMKSLQVKSSPVVNDGVVRLRGLPYSCNEKDIVDFFAGLNIVDITFVMDYRGRRKTGEAYVQFEEPEMANQALLKHREEIGNRYIEIFPSRRNEVRTHVGSYKGKKIASFPTAKYITEPEMVFEEHEVNEDIQPMTAFESEKEIELPKEVPEKLPEAADFGTTSSLHFVHMRGLPFQANAQDIINFFAPLKPVRITMEYSSSGKATGEADVHFETHEDAVAAMLKDRSHVHHRYIELFLNSCPKGK

SEQ ID NO: 809054 - protein, 540 aa, Homo sapiens; identical to SEQ ID NO: 809044

SEQ ID NO: 809055 - protein, 540 aa, Homo sapiens; identical to SEQ ID NO: 809044

SEQ ID NO: 809056 - protein, 421 aa, Homo sapiens
GDISSSLRLPRQNSDGGQKNKPREHIIDCGDIVWSLAFGSSVPEKQSRCVNMNGIASDLDKIILVDFQVSPLKWRQSGDHFKLEEEVDDVFLIRAQGLPWSCTMEDVLNFFSDCRIRNGENGIHFLLNRDGKRRGDALIEMESEQDVQKALEKHRMYMGQRYVEVYEINNEDVDALMKSLQVKSSPVVNDGVVRLRGLPYSCNEKDIVDFFAGLNIVDITFVMDYRGRRKTGEAYVQFEEPEMANQALLKHREEIGNRYIEIFPSRRNEVRTHVGSYKGKKIASFPTAKYITEPEMVFEEHEVNEDIQPMTAFESEKEIELPKEVPEKLPEAADFGTTSSLHFVHMRGLPFQANAQDIINFFAPLKPVRITMEYSSSGKATGEADVHFETHEDAVAAMLKDRSHVHHRYIELFLNSCPKGK

SEQ ID NO: 809057 - protein, 281 aa, Homo sapiens [sequence omitted]

SEQ ID NO: 809058 - protein, 540 aa, Homo sapiens; identical to SEQ ID NO: 809044

SEQ ID NO: 809059 - protein, 422 aa, Homo sapiens
RLGGASRSPPPPSDSRRPPTQCPRRMCQAHPTPNRPWIPLPFHHRCWSSCLQALRRLRSPWPARAGYSGRCSGAAAVTAAAAGAPAPPACPSTPPLALSPSGVSGRRRLLLLLGAAAAAASQTRGLQTGPVPPGRLAGPPAVATSAAAAAAASYPALRASLLPQSLAAAAAVPTRSYSQESKTTYLEDLPPPPEYELAPSKLEEEVDDVFLIRGLNIVDITFVMDYRGRRKTGEAYVQFEEPEMANQALLKHREEIGNRYIEIFPSRRNEVRTHVGSYKGKKIASFPTAKYITEPEMVFEEHEVNEDIQPMTAFESEKEIELPKEVPEKLPEAADFGTTSSLHFVHMRGLPFQANAQDIINFFAPLKPVRITMEYSSSGKATGEADVHFETHEDAVAAMLKDRSHVHHRYIELFLNSCPKGK

SEQ ID NO: 809060 - protein, 525 aa, Homo sapiens; identical to SEQ ID NO: 809049

SEQ ID NO: 809061 - protein, 540 aa, Homo sapiens; identical to SEQ ID NO: 809044

SEQ ID NO: 809062 - protein, 313 aa, Homo sapiens
RLGGASRSPPPPSDSRRPPTQCPRRMCQAHPTPNRPWIPLPFHHRCWSSCLQALRRLRSPWPARAGYSGRCSGAAAVTAAAAGAPAPPACPSTPPLALSPSGVSGRRRLLLLLGAAAAAASQTRGLQTGPVPPGRLAGPPAVATSAAAAAAASYPALRASLLPQSLAAAAAVPTRSYSQVRGRREGPGARSLPGRVHAPPRPSVPPCAPRGHARGSATLAAHPPPSTLCSYWALEQGKLSQASGLLLVLFSPRISGRLGSESKTTYLEDLPPPPEYELAPSKLEEEVDDVFLIRAQGLPWSCTMEDVLNFFSG

SEQ ID NO: 809063 - protein, 162 aa, Homo sapiens
TGRSVALSSTSFRLSEAPHPVPAAHVPGTPHPQPALDSTSVPPSLLEQLPSGPAPPPESMAGTRWVLGALLRGCGCNCSSCRRTGAACLPFYSAAGSIPVGRLGPPPPAAAARGRRGRCLPDAWPPDRACASREAGGASRSPKLLTWKTFHHPLSMNWPRPS

SEQ ID NO: 809064 - protein, 355 aa, Homo sapiens
RLGGASRSPPPPSDSRRPPTQCPRRMCQAHPTPNRPWIPLPFHHRCWSSCLQALRRLRSPWPARAGYSGRCSGAAAVTAAAAGAPAPPACPSTPPLALSPSGVSGRRRLLLLLGAAAAAASQTRGLQTGPVPPGRLAGPPAVATSAAAAAAASYPALRASLLPQSLAAAAAVPTRSYSQESKTTYLEDLPPPPEYELAPSKLEEEVDDVFLIRAQGLPWSCTMEDVLNFFSDCRIRNGENGIHFLLNRDGKRRGDALIEMESEQDVQKALEKHRMYMGQRYVEVYEINNEDVDALMKSLQVKSSPVVNDGVVRLRGLPYSCNEKDIVDFFAGTLQLYYAWELISFFPWYLLLYLR

SEQ ID NO: 809065 - protein, 293 aa, Homo sapiens
RLGGASRSPPPPSDSRRPPTQCPRRMCQAHPTPNRPWIPLPFHHRCWSSCLQALRRLRSPWPARAGYSGRCSGAAAVTAAAAGAPAPPACPSTPPLALSPSGVSGRRRLLLLLGAAAAAASQTRGLQTGPVPPGRLAGPPAVATSAAAAAAASYPALRASLLPQSLAAAAAVPTRSYSQVRGRREGPGARSLPGRVHAPPRPSVPPCAPRGHARGSATLAAHPPPSTLCSYWALEQGKLSQASGLLLVLFSPRISGRLGSVSVAGVNVEALFPAWPMESKTTYLEDLPPPPDI

SEQ ID NO: 809066 - protein, 107 aa, Homo sapiens
TFRGFDEPAAAGPERRAGPRLHHAGSASCAAHGARPQPRACLPRQAMGAGGGPRHRPPDPLEPGEGRGPSIPPVVPGSLHVSEHPCPPNPLLRLGRGSPDLAIQRSS

SEQ ID NO: 809067 - protein, 481 aa, Homo sapiens
ALSAALTSPQRPGPSAEPGRDCTMQEAPAALPTEPGPSPVPAFLGKLWALVGDPGTDHLIRWSPSGTSFLVSDQSRFAKEVLPQYFKHSNMASFVRQLNMYGFRKVVSIEQGGLLRPERDHVEFQHPSFVRGREQLLERVRRKVPALRGDDGRWRPEDLGRLLGEVQALRGVQESTEARLRELRQQNEILWREVVTLRQSHGQQHRVIGKLIQCLFGPLQAGPSNAGGKRKLSLMLDEGSSCPTPAKFNTCPLPGALLQDPYFIQSTLSQRQIWALALTGPGAPSSLTSQKTLHPLRGPGFLPPVMAGAPPPLPVAVVQAILEGKGSFSPEGPRNAQQPEPGDPREIPDRGPLGLESGDRSPESLLPPMLLQPPQESVEPAGPLDVLGPSLQGREWTLMDLDMELSLMQPLVPERGEPELAVKGLNSPSPGKDPTLGAPLLLDVQAALGGPALGLPGALTIYSTPESRTASYLGPEASPSP

SEQ ID NO: 809068 - protein, 481 aa, Homo sapiens; identical to SEQ ID NO: 809067

SEQ ID NO: 809069 - protein, 516 aa, Homo sapiens
ALSAALTSPQRPGPSAEPGRDCTMQEAPAALPTEPGPSPVPAFLGKLWALVGDPGTDHLIRWSPSGTSFLVSDQSRFAKEVLPQYFKHSNMASFVRQLNMYGFRKVVSIEQGGLLRPERDHVEFQHPSFVRGREQLLERVRRKVPALRGDDGRWRPEDLGRLLGEVQALRGVQESTEARLRELRQQNEILWREVVTLRQSHGQQHRVIGKLIQCLFGPLQAGPSNAGGKRKLSLMLDEGSSCPTPAKFNTCPLPGALLQDPYFIQSQPLPETNLGLSPHRARGPIISDIPEDSPSPEGTRLSPSSDGRREKGLALLKEEPASPGGDGEAGLALAPNECDFCVTAPPPLPVAVVQAILEGKGSFSPEGPRNAQQPEPGDPREIPDRGPLGLESGDRSPESLLPPMLLQPPQESVEPAGPLDVLGPSLQGREWTLMDLDMELSLMQPLVPERGEPELAVKGLNSPSPGKDPTLGAPLLLDVQAALGGPALGLPGALTIYSTPESRTASYLGPEASPSP

SEQ ID NO: 809070 - protein, 238 aa, Homo sapiens
MLDEGSSCPTPAKFNTCPLPGALLQDPYFIQSEEKMEASLPPNQTQALQHGLSLLPQTFSLRPGPAPPPLPVAVVQAILEGKGSFSPEGPRNAQQPEPGDPREIPDRGPLGLESGDRSPESLLPPMLLQPPQESVEPAGPLDVLGPSLQGREWTLMDLDMELSLMQPLVPERGEPELAVKGLNSPSPGKDPTLGAPLLLDVQAALGGPALGLPGALTIYSTPESRTASYLGPEASPSP

SEQ ID NO: 809071 - protein, 382 aa, Homo sapiens
MASFVRQLNMYGFRKVVSIEQGGLLRPERDHVEFQHPSFVRGREQLLERVRRKVPALRGDDGRWRPEDLGRLLGEVQALRGVQESTEARLRELRQQNEILWREVVTLRQSHGQQHRVIGKLIQCLFGPLQAGPSNAGGKRKLSLMLDEGSSCPTPAKFNTCPLPGALLQDPYFIQSEEKMEASLPPNQTQALQHGLSLLPQTFSLRPGPAPPPLPVAVVQAILEGKGSFSPEGPRNAQQPEPGDPREIPDRGPLGLESGDRSPESLLPPMLLQPPQESVEPAGPLDVLGPSLQGREWTLMDLDMELSLMQPLVPERGEPELAVKGLNSPSPGKDPTLGAPLLLDVQAALGGPALGLPGALTIYSTPESRTASYLGPEASPSP

SEQ ID NO: 809072 - protein, 303 aa, Homo sapiens
MEASLPPNQTQALQHGLSLLPQTFSLRPGPGGCWWGSGSPCAYRPRAGPSLLLQPLPETNLGLSPHRARGPIISDIPEDSPSPEGTRLSPSSDGRREKGLALLKEEPASPGGDGEAGLALAPNECDFCVTAPPPLPVAVVQAILEGKGSFSPEGPRNAQQPEPGDPREIPDRGPLGLESGDRSPESLLPPMLLQPPQESVEPAGPLDVLGPSLQGREWTLMDLDMELSLMQPLVPERGEPELAVKGLNSPSPGKDPTLGAPLLLDVQAALGGPALGLPGALTIYSTPESRTASYLGPEASPSP

SEQ ID NO: 809073 - protein, 303 aa, Homo sapiens; identical to SEQ ID NO: 809072

SEQ ID NO: 809074 - protein, 303 aa, Homo sapiens; identical to SEQ ID NO: 809072

SEQ ID NO: 809075 - protein, 281 aa, Homo sapiens
MLDEGSSCPTPAKFNTCPLPGALLQDPYFIQSEEKMEASLPPNQTQALQHGLSLLPQTFSLRPGPDSLSQRQIWALALTGPGAPSSLTSQKTLHPLRGPGFLPPVMAGAPPPLPVAVVQAILEGKGSFSPEGPRNAQQPEPGDPREIPDRGPLGLESGDRSPESLLPPMLLQPPQESVEPAGPLDVLGPSLQGREWTLMDLDMELSLMQPLVPERGEPELAVKGLNSPSPGKDPTLGAPLLLDVQAALGGPALGLPGALTIYSTPESRTASYLGPEASPSP

SEQ ID NO: 809076 - protein, 235 aa, Homo sapiens
MLDEGSSCPTPAKFNTCPLPGALLQDPYFIQSEEKMEASLPPNQTQALQHGLSLLPQTFSLRPGPDSLSQRQIWALALTGPGAPSSLTSQKTLHPLRGPGFLPPVMAGAPPPLPVAVVQAILEGKGSFSPEGPRNAQQPEPGDPREIPDRGPLGLESGDRSPESLLPPMLLQPPQESVEPAGPLDVLGPSLQGREWTLMDLDMELSLGRTPRSGPHSCWMSRRPWEAQPWACLGL

SEQ ID NO: 809077 - protein, 305 aa, Homo sapiens
MLDEGSSCPTPAKFNTCPLPGALLQDPYFIQSEEKMEASLPPNQTQALQHGLSLLPQTFSLRPGPALTGPGAPSSLTSQKTLHPLRGPGFLPPVMAGGRRAWHCSKKSRPVQGEDGEAGLALAPNECDFCVTAPPPLPVAVVQAILEGKGSFSPEGPRNAQQPEPGDPREIPDRGPLGLESGDRSPESLLPPMLLQPPQESVEPAGPLDVLGPSLQGREWTLMDLDMELSLMQPLVPERGEPELAVKGLNSPSPGKDPTLGAPLLLDVQAALGGPALGLPGALTIYSTPESRTASYLGPEASPSP

SEQ ID NO: 809078 - protein, 112 aa, Homo sapiens
EFRLHCRAFLEPPMPSPLGESGEVKNGCFILTEQKAGGQGSPSLKKGGGTFPLVSAVPLLLGKDPTLGAPLLLDVQAALGGPALGLPGALTIYSTPESRTASYLGPEASPSP

SEQ ID NO: 809079 - protein, 193 aa, Homo sapiens
MLDEGSSCPTPAKFNTCPLPGALLQDPYFIQSEEKMEASLPPNQTQALQHGLSLLPQTFSLRPGPDSLSQRQIWALALTGPGAPSSLTSQKTLHPLRGPGFLPPVMAGAPPPLPVAVVQAILEGKGSFSPLSGVSEAPTTKWPLSTTPTIPAHKLRFFFFYFFFFFFFFFFFFFFFFIPLKQVDGGGVEQWGI

SEQ ID NO: 809080 - protein, 111 aa, Homo sapiens
MVGVACSYKGWGQTAGPPLSPPPPPGPGISPLCSRTSGAGMQDSSGENLLVKVLGKGTGVAGGCAPWESSSHQSTHQMPVPERDPPPDCALLGQSGGDCPPTGPWLSGVLL

SEQ ID NO: 809081 - protein, 140 aa, Homo sapiens
MAENREPRGAVEAELDPVEYTLRKRLPSRLPRRPNDIYVNMKTDFKAQLARCQKLLDGGARGQNACSEIYIHGLGLAINRAINIALQLQAGSFGSLQVAANTSTVELVDELEPETDTREPLTRIRNNSAIHIRVFRVTPK

SEQ ID NO: 809082 - protein, 140 aa, Homo sapiens; identical to SEQ ID NO: 809081

SEQ ID NO: 809083 - protein, 123 aa, Homo sapiens
GKGRGERKPGRRFIARGVRARVRTPQPVQDPGAGRAPTSWLAACTHILLSLGPGVAVTWAGRRTLEWPGGERASRAWRALWNEERDRHTGATDSDPQQLSHPHPSLQGHTQVIEKTLLHLSPP

SEQ ID NO: 809084 - protein, 140 aa, Homo sapiens; identical to SEQ ID NO: 809081

SEQ ID NO: 809085 - protein, 110 aa, Homo sapiens
MAENREPRGAVEAELDPVEYTLRKRLPSRLPRRPNDIYVNMKTDFKAQLARCQKLLDGGARGQNACSEIYIHGLGLAINRAINIALQWLPIPPPWSLLMSWSQRPTHGSH

SEQ ID NO: 809086 - protein, 121 aa, Homo sapiens
MAENREPRGAVEAELDPVEYTLRKRLPSRLPRRPNDIYVNMKTDFKAQLARCQKLLDGGARGQNACSEIYIHGLGLAINRAINIALQLQAGSFGSLQVAANTSTVELVDELEPSSGSHPSN

SEQ ID NO: 809087 - protein, 178 aa, Homo sapiens
MTSDFQFANQYEKAFSSKYLQNWSPTKPTKESISSHEGYTQIIANDRGHLLPSVPRSKANPWGSFMGTWQMPLKIPPARVTLTSRTTAGAASLTKWIQKNPDLLKASNGLCPEILGKPHDPDSQKKLRKKSITKTVQQARSPTIIPSSPAANLNSPDELQSSHPSAGHTPGPQRPAKS

SEQ ID NO: 809088 - protein, 142 aa, Homo sapiens
QRDTHKHSFISVDALIQFFAIEEVLEKLLNLGDTSRTTNQDKIMATDFQFANQYEKAFSSKYLQNWSPTKPTKESISSHEGYTQIIANDRGHLLPSVPRSKVRYYLHSYQESQIIKAQNWEMCSLSQPLSGKLKFNLIHVVM

SEQ ID NO: 809089 - protein, 97 aa, Homo sapiens
SVPSSHQSNCEECDVSLSLIPPKTVLPALSRRPPVPSLVRLLTLPHARSVKPKSLSSGSGQQRKEVLSLEAYLPQNCARSETLEGSASREGPERSAY

SEQ ID NO: 809090 - protein, 97 aa, Homo sapiens; identical to SEQ ID NO: 809089

SEQ ID NO: 809091 - protein, 79 aa, Homo sapiens
GRVGRGRVGDHAWGTEVAGLSLIKMTTSQKHRDFVAEPMGEKPVGSLAGIGEVLGKKLEERGFDKGLCCPWPVSGAKER

SEQ ID NO: 809092 - protein, 97 aa, Homo sapiens; identical to SEQ ID NO: 809089

SEQ ID NO: 809093 - protein, 135 aa, Homo sapiens
MDPEIDLDSMRNLKASLENSLREVEARYALQMEQLNGILLHLESELAQTRAEGQRQAQEYEALLNIKVKLEAEIATYRRLLEDGEDFNLGDALDSSNSMQTIQKTTTRRIVDGKVVSETNDTKVLRHYSQQKQGT

SEQ ID NO: 809094 - protein, 97 aa, Homo sapiens; identical to SEQ ID NO: 809089

SEQ ID NO: 809095 - protein, 97 aa, Homo sapiens; identical to SEQ ID NO: 809089

SEQ ID NO: 809096 - protein, 97 aa, Homo sapiens; identical to SEQ ID NO: 809089

SEQ ID NO: 809097 - protein, 91 aa, Homo sapiens
RALGESLAALRGGGGVLRVGAGPREGAGRSGARWGRSWGADVNPAGVGAGVRSARCALRPVGRETLWLAFHAKWPFQAGSVVLVQPRSQRE

SEQ ID NO: 809098 - protein, 91 aa, Homo sapiens; identical to SEQ ID NO: 809097

SEQ ID NO: 809099 - protein, 97 aa, Homo sapiens; identical to SEQ ID NO: 809089

SEQ ID NO: 809100 - protein, 97 aa, Homo sapiens; identical to SEQ ID NO: 809089

SEQ ID NO: 809101 - protein, 135 aa, Homo sapiens; identical to SEQ ID NO: 809093

SEQ ID NO: 809102 - protein, 97 aa, Homo sapiens; identical to SEQ ID NO: 809089

SEQ ID NO: 809103 - protein, 97 aa, Homo sapiens; identical to SEQ ID NO: 809089

SEQ ID NO: 809104 - protein, 79 aa, Homo sapiens
IHSGKLVTVTGAWLGLVKSWARSWRKGVLTRAYVVLGQFLVLKKDEDLFREWLKDTCGANAKQSRDCFGCLREWCDAFL

SEQ ID NO: 809105 - protein, 97 aa, Homo sapiens; identical to SEQ ID NO: 809089

SEQ ID NO: 809106 - protein, 91 aa, Homo sapiens; identical to SEQ ID NO: 809097

SEQ ID NO: 809107 - protein, 97 aa, Homo sapiens; identical to SEQ ID NO: 809089

SEQ ID NO: 809108 - protein, 105 aa, Homo sapiens
HNLEEAADPGHLVERRGGQNPRCFLGLCALNGTGMAVLLLSLTEQLSSTLPPFPCFAAYVVLGQFLVLKKDEDLFREWLKDTCGANAKQSRDCFGCLREWCDAFL

SEQ ID NO: 809109 - protein, 147 aa, Homo sapiens
DLGPKRLHLSDKFLSLSPLPESMVLGFGPGLPRHCLTQAAHQTMITFEFSQTLNRSIHVLLMLPVPRPHLEDHCSQGSSNGLLKQTKKIYLAPHFQPARAGSLHLLQSKHLIPCSGLAGRREQDLFFILCLSGRTEKKVRWLKRGDR

SEQ ID NO: 809110 - protein, 122 aa, Homo sapiens
HKFQQMGNVVQDFSRGEKFFGICLGIREINLLKEWGHSFKRCSTICNLPGRVSTKISTTFKIRVEWPGVVPHTCNPSTLGGRGGWTTRSRDRDHPGQHGENPSLLKIQKLAERVGRCLYSQL

SEQ ID NO: 809111 - protein, 145 aa, Homo sapiens
QRLGGADAASAAAAPAAWTSFCVPYSAVRNDQFGLSHFNWPVQGANYHVLRTGCFPFIKYHCSKAPWQDLARQNRFFTALKVVNLGEWRLPRPRVKPARPGRPLSHRARDERSQAGRVPRESALPPGAGFAWGPLYSSPRGSPAC

SEQ ID NO: 809112 - protein, 145 aa, Homo sapiens; identical to SEQ ID NO: 809111

SEQ ID NO: 809113 - protein, 127 aa, Homo sapiens
QRLGGADAASAAAAPAAWTSFCVPYSAVRNDQFGLSHFNWPVQGANYHVLRTGCFPFIKYHCSKAPWQDLARQNRFFTALKVVNLGIPTLLYGLGSWLFARVTETVHTSYGPITVYFLNKEDEGAMY

SEQ ID NO: 809114 - protein, 145 aa, Homo sapiens; identical to SEQ ID NO: 809111

SEQ ID NO: 809115 - protein, 216 aa, Homo sapiens
MHDIERHGPSRQDQTPLSSSLRQEPDPRKKLTTKTCSNQQTHKCEAMRPIPSLISSQVSRIAALCLQRTLHQIRWTQQEELVVQPGSPDERTSWKRLSSSLHHNLNQTPWTQLNALIQHLPATSHQKNHCDDLRQNQERYEPITKDKTNRKHTNQESQATTELRKRDTQEPQRHETQRLPNKIKDDSPHNKSNNNHHNRHRQKAKWAKDLHKTKQT

SEQ ID NO: 809116 - protein, 225 aa, Homo sapiens
MDLRAGDSWGMLACLCTVLWHLPAVPALNRTGDPGPGPSIQKTYDLTRYLEHQLRSLAGTYLNYLGPPFNEPDFNPPRLGAETLPRATVDLEVWRSLNDKLRLTQNYEAYSHLLCYLRGLNRQAATAELRRSLAHFCTSLQGLLGSIAGVMAALGYPLPQPLPGTEPTWTPGPAHSDFLQKMDDFWLLKELQTWLWRSAKDFNRLKKKMQPPAAAVTLHLGAHGF

SEQ ID NO: 809117 - protein, 214 aa, Homo sapiens
PDTPRINGMGLADGIIKASPEPRLALPLRQPPGEEPHPAGPAPAPWTSEQLNYLGPPFNEPDFNPPRLGAETLPRATVDLEVWRSLNDKLRLTQNYEAYSHLLCYLRGLNRQAATAELRRSLAHFCTSLQGLLGSIAGVMAALGYPLPQPLPGTEPTWTPGPAHSDFLQKMDDFWLLKELQTWLWRSAKDFNRLKKKMQPPAAAVTLHLGAHGF

SEQ ID NO: 809118 - protein, 148 aa, Homo sapiens
MWNFFRRELTSNGFPENFSLDVPANTYNALKSRLCDPNADHTSCPSPCSLHAAGALPGTGRQRWRVELAHLADRKLSLRDVSRLRQGGERRSGIAVKVVRGGAGFAARLQGSVTLVQQGWFFPRLGGCQAWWRMGAVVWCGELLTCTS

SEQ ID NO: 809119 - protein, 348 aa, Homo sapiens
MLQEEERGPRLGAVHLCPNTGHQVLFQWQTAWEAINVPEFCSQTAGVGSSNQLCDWTGVIASFQVNYEEQEQSVDNMEAHSRMFKLSRPRQPVHRVILLLCCPTPPPVTMEEEIATLAIDNGSSMCKAGFAGDDAPQAVFPSIVGRPRHQGVMVGMGQKDSYVGDEAQSKRGILTLKYPIEHGIVTNWDDMEKIWHHTFYNELRVAPEEHPVLLTEAPLNPKANREKMTQIMFETFNTPAMYVAIQAVLSLYASGRTTGIVMDSGDGVTHTVPIYVGYALPHAVLHLDLAGRDLTGYLMKILTERGYSFTTSAQREIMPHIREKLCYITLDFEKEMATAASSSSLEKS

SEQ ID NO: 809120 - protein, 103 aa, Homo sapiens [sequence omitted]

SEQ ID NO: 809121 - protein, 196 aa, Homo sapiens
MVGMGQKDSYVGDEAQSKRGILTLKYPIEHGIVTNWDDMEKIWHHTFYNELRVAPEEHPVLLTEAPLNPKANREKMTQIMFETFNTPAMYVAIQAVLSLYASGRTTGIVMDSGDGVTHTVPIYVGYALPHAVLHLDLAGRDLTGYLMKILTERGYSFTTSAQREIMPHIREKLCYITLDFEKEMATAASSSSLEKS

SEQ ID NO: 809122 - protein, 285 aa, Homo sapiens
ILGLCYPIEHGIVTNWDDMEKIWHHTFNELRVAPEEHPVLLTEAPLNPKANREKMTQVRLGRRPCSSRPFPSHFLPILISDGSSPGQGVMVGMGQKDSYVGDEAQSKRGILTLKYPIEHGIVTNWDDMEKIWHHTFYNELRVAPEEHPVLLTEAPLNPKANREKMTQIMFETFNTPAMYVAIQAVLSLYASGRTTGIVMDSGDGVTHTVPIYVGYALPHAVLHLDLAGRDLTGYLMKILTERGYSFTTSAQREIMPHIREKLCYITLDFEKEMATAASSSSLEKS

SEQ ID NO: 809123 - protein, 196 aa, Homo sapiens; identical to SEQ ID NO: 809121

SEQ ID NO: 809124 - protein, 226 aa, Homo sapiens
KTSAKKGTGSYGLDFPTLTDPQDKTTGSCQPLEKSQKDSYVGDEAQSKRGILTLKYPIEHGIVTNWDDMEKIWHHTFYNELRVAPEEHPVLLTEAPLNPKANREKMTQIMFETFNTPAMYVAIQAVLSLYASGRTTGIVMDSGDGVTHTVPIYVGYALPHAVLHLDLAGRDLTGYLMKILTERGYSFTTSAQREIMPHIREKLCYITLDFEKEMATAASSSSLEKS

SEQ ID NO: 809125 - protein, 199 aa, Homo sapiens
IVTNWVLQGQDATLALGLVAHVGVLLAHAPIEHGIVTNWDDMEKIWHHTFYNELRVAPEEHPVLLTEAPLNPKANREKMTQIMFETFNTPAMYVAIQAVLSLYASGRTTGIVMDSGDGVTHTVPIYVGYALPHAVLHLDLAGRDLTGYLMKILTERGYSFTTSAQREIMPHIREKLCYITLDFEKEMATAASSSSLEKS

SEQ ID NO: 809126 - protein, 191 aa, Homo sapiens
MGGSGSRLSKELLAEYQDLTFLTKQEILLAHRRFCELLPQEQRSVESSLRAQVPFEQILSLPELKANPFKERICRVFSTSPAKDSLSFEDFLDLLSVFSDTATPDIKSHYAFRIFDFDDDGTLNREDLSRLVNCLTGEGEDTRLSASEMKQLIDNILEESDIDRDGTINLSEFQHVISRSPDFASSFKIVL

SEQ ID NO: 809127 - protein, 193 aa, Homo sapiens
MSTQTSLQQSATKQQRKYRDLTFLTKQEILLAHRRFCELLPQEQRSVESSLRAQVPFEQILSLPELKANPFKERICRVFSTSPAKDSLSFEDFLDLLSVFSDTATPDIKSHYAFRIFDFDDDGTLNREDLSRLVNCLTGEGEDTRLSASEMKQLIDNILEESDIDRDGTINLSEFQHVISRSPDFASSFKIVL

SEQ ID NO: 809128 - protein, 191 aa, Homo sapiens; identical to SEQ ID NO: 809126

SEQ ID NO: 809129 - protein, 191 aa, Homo sapiens; identical to SEQ ID NO: 809126

SEQ ID NO: 809130 - protein, 191 aa, Homo sapiens; identical to SEQ ID NO: 809126

SEQ ID NO: 809131 - protein, 105 aa, Homo sapiens
MEPSTSLSSSTSSPVLQTLPAPLRLSCDSSPSVCPGTLSKNLSTAELWPRSSLCCQLRAKLAQPGAGAVQPHPGQGRPSLSGPLLTAVVIAPFVFVLISNKGLEV

SEQ ID NO: 809132 - protein, 138 aa, Homo sapiens
LILEDPRDRVQDLTFLTKQEILLAHRRFCELLPQEQRSVESSLRAQVPFEQILSLPELKANPFKERICRVFSTSPAKDSLSFEDFLDLLSVFSDTATPDIKSHYAFRIFDFDDDGTRSEVGTRSEVGTRSEVGTRSEV

SEQ ID NO: 809133 - protein, 228 aa, Homo sapiens
MDRLEPAARLPNPAGNAWQLLGGGGPGGGGPRSGCRGDRAVTGPRAEVRKLSASDLTFLTKQEILLAHRRFCELLPQEQRSVESSLRAQVPFEQILSLPELKANPFKERICRVFSTSPAKDSLSFEDFLDLLSVFSDTATPDIKSHYAFRIFDFDDDGTLNREDLSRLVNCLTGEGEDTRLSASEMKQLIDNILEESDIDRDGTINLSEFQHVISRSPDFASSFKIVL

SEQ ID NO: 809134 - protein, 233 aa, Homo sapiens
MSTQTSLQQSATKQQRKYRDLTFLTKQEILLSVYVVLAPHLVDNEQQARSGNEHTGRPIAENTDSSPLSTRAHRRFCELLPQEQRSVESSLRAQVPFEQILSLPELKANPFKERICRVFSTSPAKDSLSFEDFLDLLSVFSDTATPDIKSHYAFRIFDFDDDGTLNREDLSRLVNCLTGEGEDTRLSASEMKQLIDNILEESDIDRDGTINLSEFQHVISRSPDFASSFKIVL

SEQ ID NO: 809135 - protein, 121 aa, Homo sapiens
MSSRQGVGMNTQGDRSLRTPTVPLSLPEPTGGFVSCFPRSSGAWSRHFGHKCPSSRFSAFQSSRPTPSRSESAGSSPHPQPKTALALRTSWISSVCSVTQPRQTSSPIMPSASLTLMMTEP

SEQ ID NO: 809136 - protein, 231 aa, Homo sapiens
MGGSGSRLSKELLAEYQDLTFLTKQEILLSVYVVLAPHLVDNEQQARSGNEHTGRPIAENTDSSPLSTRAHRRFCELLPQEQRSVESSLRAQVPFEQILSLPELKANPFKERICRVFSTSPAKDSLSFEDFLDLLSVFSDTATPDIKSHYAFRIFDFDDDGTLNREDLSRLVNCLTGEGEDTRLSASEMKQLIDNILEESDIDRDGTINLSEFQHVISRSPDFASSFKIVL

SEQ ID NO: 809137 - protein, 176 aa, Homo sapiens
MLPRLGLPKCWDYRAHRRFCELLPQEQRSVESSLRAQVPFEQILSLPELKANPFKERICRVFSTSPAKDSLSFEDFLDLLSVFSDTATPDIKSHYAFRIFDFDDDGTLNREDLSRLVNCLTGEGEDTRLSASEMKQLIDNILEESDIDRDGTINLSEFQHVISRSPDFASSFKIVL

SEQ ID NO: 809138 - protein, 134 aa, Homo sapiens
MLSPFPSWANPFKERICRVFSTSPAKDSLSFEDFLDLLSVFSDTATPDIKSHYAFRIFDFDDDGTLNREDLSRLVNCLTGEGEDTRLSASEMKQLIDNILEESDIDRDGTINLSEFQHVISRSPDFASSFKIVL

SEQ ID NO: 809139 - protein, 157 aa, Homo sapiens
MSTQTSLQQSATKQQRKYPGLDVPDEAGDPPANPFKERICRVFSTSPAKDSLSFEDFLDLLSVFSDTATPDIKSHYAFRIFDFDDDGTLNREDLSRLVNCLTGEGEDTRLSASEMKQLIDNILEESDIDRDGTINLSEFQHVISRSPDFASSFKIVL

SEQ ID NO: 809140 - protein, 191 aa, Homo sapiens; identical to SEQ ID NO: 809126

SEQ ID NO: 809141 - protein, 191 aa, Homo sapiens; identical to SEQ ID NO: 809126

SEQ ID NO: 809142 - protein, 191 aa, Homo sapiens; identical to SEQ ID NO: 809126

SEQ ID NO: 809143 - protein, 158 aa, Homo sapiens [sequence omitted]

SEQ ID NO: 809144 - protein, 191 aa, Homo sapiens; identical to SEQ ID NO: 809126

SEQ ID NO: 809145 - protein, 198 aa, Homo sapiens
MGGSGSRLSKELLAEYQDLTFLTKQEILLSVYVVLAPHLVDNEQQARSGNEHTGRPIAENTDSSPLSTRAHRRFCELLPQEQRSVESSLRAQVPFEQILSLPELKANPFKERICRVFSTSPAKDSLSFEDFLDLLSVFSDTATPDIKSHYAFRIFDFDDDGTLNREDLSRLVNCLTGEGEDTRLSASEMKQLIDNVSS

SEQ ID NO: 809146 - protein, 166 aa, Homo sapiens
MGGSGSRLSKELLAEYQDLTFLTKQEILLAHRRFCELLPQEQRSVESSLRAQVPFEQILSLPELKANPFKERICRVFSTSPAKDSLSFEDFLDLLSVFSDTATPDIKSHYAFRIFDFDDDGTLNREDLSRLVNCLTGEGEDTRLSASEMKQLIDNSISRFMGILIE

SEQ ID NO: 809147 - protein, 226 aa, Homo sapiens
MGGSGSRLSKELLAEYQDLTFLTKQEILLSVYVVLAPHLVDNEQQARSGNEHTGRPIAENTDSSPLSTRAHRRFCELLPQEQRSVESSLRAQVPFEQILSLPELKANPFKERICRVFSTSPAKDSLSFEDFLDLLSVFSDTATPDIKSHYAFRIFDFDDDGTLNREDLSRLVNCLTGEGEDTRLSASEMKQLIDNILEESDIDRDGTINLSEFQHVISRSPDFASP

SEQ ID NO: 809148 - protein, 114 aa, Homo sapiens
MSTQTSLQQSATKQQRKYRDLTFLTKQEILLSVYVVLAPHLVDNEQQARSGNEHTGRPIAENTDSSPLSTRAHRRFCELLPQEQRSVESSLRAQVPFEQILSLPELKVQALTLL

SEQ ID NO: 809149 - protein, 45 aa, Homo sapiens
MGGSGSRLSKELLAEYQVRGTPGPGELACGPLLGSRVRELAAGRP

SEQ ID NO: 809150 - protein, 201 aa, Homo sapiens
MVRQLYMWNKGDWVMEEVNSPSYYLLFLSILSWVGFVGGAAYLSVFPIISSSVRGDFDMSFLCPVFTLQATALTTLVHVFCVLLLFQLCLSCPSDFPVKCHIPSSHQALSFSVVLKTLFPSSVLTEEEALRHDSLSSPKQKKKRRRIDRTMIGEPMNFVHLTHIGSGEMGAGDGLAMTGAVQEQMRSKGNRDRPWSNSRGL

SEQ ID NO: 809151 - protein, 201 aa, Homo sapiens; identical to SEQ ID NO: 809150

SEQ ID NO: 809152 - protein, 253 aa, Homo sapiens
MAPWALLSPGVLVRTGHTVLTWGITLVLFLHDTELRQWEEQGELLLPLTFLLLVLGSLLLYLAVSLMDPGYVNVQPQPQEELKEEQTAMVPPAIPLRRCRYCLVLQPLRARHCRECRRCVRRYDHHCPWMENCVGERNHPLFVVYLALQLVVLLWGLYLAWSGLRFFQPWGLWLRSSGLLFATFLLLSLFSLVASLLLVSHLYLVASNTTTWEFISSHRIAYLRQRPSNPFDRGLTRNWPFLCAQPGTRWGEG

SEQ ID NO: 809153 - protein, 278 aa, Homo sapiens
RFFRVGPRAEAMAPWALLSPGVLVRTGHTVLTWGITLVLFLHDTELRQWEEQGELLLPLTFLLLVLGSLLLYLAVSLMDPGYVNVQPQPQEELKEEQTAMVPPAIPLRRCRYCLVLQPLRARHCRECRRCVRRYDHHCPWMENCVGERNHPLFVVYLALQLVVLLWGLYLAWSGLRFFQPWGLWLRSSGLLFATFLLLSLFSLVASLLLVSHLYLVASNTTTWEFISSHRIAYLRQRPSNPFDRGLTRNLAHFFCGWPSGSWETLWAEEEEEGSSPAV

SEQ ID NO: 809154 - protein, 267 aa, Homo sapiens
MAPWALLSPGVLVRTGHTVLTWGITLVLFLHDTELRQWEEQGELLLPLTFLLLVLGSLLLYLAVSLMDPGYVNVQPQPQEELKEEQTAMVPPAIPLRRCRYCLVLQPLRARHCRECRRCVRRYDHHCPWMENCVGERNHPLFVVYLALQLVVLLWGLYLAWSGLRFFQPWGLWLRSSGLLFATFLLLSLFSLVASLLLVSHLYLVASNTTTWEFISSHRIAYLRQRPSNPFDRGLTRNLAHFFCGWPSGSWETLWAEEEEEGSSPAV

SEQ ID NO: 809155 - protein, 215 aa, Homo sapiens
MAPWALLSPGVLVRTGHTVLTWGITLVLFLHDTELRQWEEQGELLLPLTFLLLVLGSLLLYLAVSLMDPGYVNVQPQPQEELKEEQTAMVPPAIPLRRCRYCLVLQPLRARHCRECRRCVRRYDHHCPWMENCVGERNHPLFVVYLALQLVVLLWGLYLAWSGLRFFQPWGLWLRSSGLLFATFLLLAHFFCGWPSGSWETLWAEEEEEGSSPAV

SEQ ID NO: 809156 - protein, 278 aa, Homo sapiens; identical to SEQ ID NO: 809153

SEQ ID NO: 809157 - protein, 227 aa, Homo sapiens
MAPWALLSPGVLVRTGHTVLTWGITLVLFLHDTELRQWEEQGELLLPLTFLLLVLGSLLLYLAVSLMDPGYVNVQPQPQEELKEEQTAMVPPAIPLRRCRYCLVLQPLRARHCRECRRCVRRYDHHCPWMENCVGERNHPLFVVYLALQLVVLLWGLYLACPGVCGCGPAGSCSPPSCCCPSSRWWPACSSSRTSTWWPATPPPGNSSPHTASPISASAPATPSTEA

SEQ ID NO: 809158 - protein, 227 aa, Homo sapiens; identical to SEQ ID NO: 809157

SEQ ID NO: 809159 - protein, 522 aa, Homo sapiens
MVRSGKNGDLHLKQIAYYKRTGEYHSTTLPSERSGIRRAAKKFVFKEKKLFYVGKDRKQNRLVIVSEEEKKKVLRECHENDSGAHHGISRTLTLVESNYYWTSVTNDVKQWVYACQHCQVAKNTVIVAPKQHLLKVENPWSLVTVDLMGPFHTSNRSHVYAIIMTDLFTKWIVILPLCDVSASEVSKAIINIFFLYGPPQKIIMDQRDEFIQQINIELYRLFGIKQIVISHTSGTVNPMESTPNTIKAFLSKHCADHPNNWDDHLSAVSFAFNVTHLEPTKNTPYFQMFSRNPYMPETSDSLHEVDGDNTSMFAKILDAIKEADKIMENKTTSLGQMENNNLDELNKSKIIVKKKPKQLNPFHLKVGHEVLRQRKNWWKDGRFQSEWVGPCVIDYITESGCAVLRDNTGVRLKRPIKMSHLKPYIRESSEQESLYLLQGSVVADHDYIGLPEIPIGAYQANILVEDATIGIVDNELLTSSKDRELLEYRNTKISPLIDDHSSLEKQTFSLLDSSNQVLEYLS

SEQ ID NO: 809160 - protein, 317 aa, Homo sapiens
MVRSGKNGDLHLKQIAYYKRTGEYHSTTLPSERSGIRRAAKKFVFKEKKLFYVGKDRKQNRLVIVSEEEKKKVLRECHENDSGAHHGISRTLTLVESNYYWTSVTNDVKQWVYACQHCQVAKNTVIVAPKQHLLKVENPWSLVTVDLMGPFHTSNRSHVYAIIMTDLFTKWIVILPLCDVSASEVSKAIINIFFLYGPPQKIIMDQRDEFIQQINIELYRLFGIKQIVISHTSGTVNPMESTPNTIKAFLSKHCADHPNNWDDHLSAVSFAFNVTHLEPTKNTPYFQMFSRNPYMPETSDSLHEVDGDNTNGEQQFG

SEQ ID NO: 809161 - protein, 222 aa, Homo sapiens
MVRSGKNGDLHLKQIAYYKRTGEYHSTTLPSERSGIRRAAKKFVFKEKKLFYVGKDRKQNRLVIVSEEEKKKVLRECHENDSGAHHGISRTLTLVESNYYWTSVTNDVKQWVYACQHCQVAKNTVIVAPKQHLLKVENPWSLVTVDLMGPFHTSNRSHVYAIIMTDLFTKWIVILPLCDVSASEVSKAIINIFFLYGPPQKIIMDQRDEFIQQKVFISCKVQ

SEQ ID NO: 809162 - protein, 359 aa, Homo sapiens [sequence omitted]

SEQ ID NO: 809163 - protein, 286 aa, Homo sapiens
MVRSGKNGDLHLKQIAYYKRTGEYHSTTLPSERSGIRRAAKKFVFKEKKLFYVGKDRKQNRLVIVSEEEKKKVLRECHENDSGAHHGISRTLTLVESNYYWTSVTNDVKQWVYACQHCQVAKNTVIVAPKQHLLKVENPWSLVTVDLMGPFHTSNRSHVYAIIMTDLFTKWIVILPLCDVSASEVSKAIINIFFLYGPPQKIIMDQRDEFIQQINIELYRLFGIKQIVISHTSGTVNPMESTPNTIKAFLSKHCADHPNNWDDHLSAVSFAFNVTHLKVFISCKVQ

SEQ ID NO: 809164 - protein, 176 aa, Homo sapiens
GGERGKEERRRAGGRGAGGAGRRARGGGSGEERAGRRQPRWEESAHFQCQGIVGSSHGLSRAPHLSAAPAPALASRPRFSSAPCSQGGGGGGPATMIHFILLFSRQGKLRLQKWYITLPDKERKKITREIVQIILSRGHRTSSFVDWKELKLVYKRSVSWILSLILKRLISSWTSL

SEQ ID NO: 809165 - protein, 249 aa, Homo sapiens
GGERGKEERRRAGGRGAGGAGRRARGGGSGEERAGRRQPRWEESAHFQCQGIVGSSHGLSRAPHLSAAPAPALASRPRFSSAPCSQGGGGGGPATMIHFILLFSRQGKLRLQKWYITLPDKERKKITREIVQIILSRGHRTSSFVDWKELKLVYKRYASLYFCCAIENQDNELLTLEIVHRYVELLDKYFGNVCELDIIFNFEKAYFILDEFIIGGEIQETSKKIAVKAIEDSDMLQETMEEYMNKPTF

SEQ ID NO: 809166 - protein, 199 aa, Homo sapiens
GGERGKEERRRAGGRGAGGAGRRARGGGSGEERAGRRQPRWEESAHFQCQGIVGSSHGLSRAPHLSAAPAPALASRPRFSSAPCSQGGGGGGPATMIHFILLFSRQGKLRLQKWYITLPDKERKKITREIVQIILSRGHRTSSFVDWKELKLVYKRYASLYFCCAIENQDNELLTLEIVHRYVELLDKYFGNTWPFARA

SEQ ID NO: 809167 - protein, 249 aa, Homo sapiens
GGERGKEERRRAGGRGAGGAGRRARGGGSGEERAGRRQPRWEESAHFQCQGIVGSSHGLSRAPHLSAAPAPALASRPRFSSAPCSQGGGGGGPATMIHFILLFSRQGKLRLQKWYITLPDKERKKITREIVQIILSRGHRTSSFVDWKELKLVYKRYASLYFCCAIENQDNELLTLEIVHRYVELLDKYFGNVCELDIIFNFEKAYFILDEFIIGGEIQETSKKIAVKAIEDSDMLQEVSTVSQTMGER

SEQ ID NO: 809168 - protein, 199 aa, Homo sapiens
MSGALDVLQMKEEDVLKFLAAGTHLGGTNLDFQMEQYIYKRKSDGIYIINLKRTWEKLLLAARAIVAIENPADVSVISSRNTGQRAVLKFAAATGATPIAGRFTPGTFTNQIQAAFREPRLLVVTDPRADHQPLTEASYVNLPTIALCNTDSPLRYVDIAIPCNNKGAHSVGLMWWMLAREVLRMRGTISREHPWEVMP

SEQ ID NO: 809169 - protein, 113 aa, Homo sapiens
MYQFMLVYSLPDVYMKRLSANIFHHSACNYEKFSSKKCNLAKLSTNRIGSIMFYVCSILTLCASLPCRLFRNYRISNFPRVFMKMFRFKELYCFRQNKACSSNRKIHEFQKYH

SEQ ID NO: 809170 - protein, 130 aa, Homo sapiens
MTDVWSWQHLSPFTPGPEPGQPTMGMLCFCSPSFTMPVSSPPRWGLGGMDRQRMSSTQGLQDLPVAHSARLSTTTPAKEDSIWQSFFQVPSYTCASAFLSWMMVFSLFLSLLSLTALVFHVAHPLSSVNL

SEQ ID NO: 809171 - protein, 114 aa, Homo sapiens
MAECPTLGEAVTDHPDRLWAWEKFVYLDEKQHAWLPLTIEIKDRLQLRVLLRREDVVLGRPMTPTQIGPSLLPIMWQLYPDGRYRSSDSSFWRLVYHIKIDGVEDMLLELLPDD

SEQ ID NO: 809172 - protein, 114 aa, Homo sapiens; identical to SEQ ID NO: 809171

SEQ ID NO: 809173 - protein, 114 aa, Homo sapiens; identical to SEQ ID NO: 809171

SEQ ID NO: 809174 - protein, 114 aa, Homo sapiens; identical to SEQ ID NO: 809171

SEQ ID NO: 809175 - protein, 114 aa, Homo sapiens; identical to SEQ ID NO: 809171

SEQ ID NO: 809176 - protein, 114 aa, Homo sapiens; identical to SEQ ID NO: 809171

SEQ ID NO: 809177 - protein, 130 aa, Homo sapiens; identical to SEQ ID NO: 809170

SEQ ID NO: 809178 - protein, 119 aa, Homo sapiens
MTIISHSDPCPDGWMAGRRDSGFLRLEKPWQAEPESMPCPFLLLRIKDRLQLRVLLRREDVVLGRPMTPTQIGPSLLPIMWQLYPDGRYRSSDSSFWRLVYHIKIDGVEDMLLELLPDD

SEQ ID NO: 809179 - protein, 114 aa, Homo sapiens; identical to SEQ ID NO: 809171

SEQ ID NO: 809180 - protein, 116 aa, Homo sapiens
MTIISHSDPCPDGWMAGRRDSGFLRLEKPWQAEPESMPCPFLLLRIKDRLQLRVLLRREDVVLGRPMTPTQIGPSLLPIMWQLYPDGRYRSSDSSFWRLVYHIKVLAAPVSFHPRA

SEQ ID NO: 809181 - protein, 102 aa, Homo sapiens
TRLQTLPARKHACKRCLPTQVHVQLKERPERSPYLCSGLRSLWVSGPHPGTQQEARPASPVDEPSEPLACPRGKGIEVGFPPFYRWSRTWVLQSCMWHEYFL

SEQ ID NO: 809182 - protein, 566 aa, Homo sapiens
MAAVPPGLEPWNRVRIPKAGNRSAVTVQNPGAALDLCIAAVIKECHLVILSLKSQTLDAETDVLCAVLYSNHNRMGRHKPHLALKQVEQCLKRLKNMNLEGSIQDLFELFSSNENQPLTTKVCVVPSQPVVELVLMKVLGACKLLLRLLDCCCKTFLLTVKHLGLQEFIILNLVMVGLVSRLWVLYKGVLKRLILLYEPLFGLLQEVARIQPMPYFKDFTFPSDITEFLGQPYFEAFKKKMPIAFAAKGINKLLNKLFLINEQSPRASEETLLGISKKAKQMKINVQNNVDLGQPVKNKRVFKEESSEFDVRAFCNQLKHKATQETSFDFKCSQSRLKTTKYSSQKVIGTPHAKSIVQRFREAESFTQLSEEIQMAVVWCRSKKLKAQAIFLGNKLLKSNRLKHLEAQGTSLPKKLECIKTSICNHLLRGSGIKTSKHHLRQRRSQNKFLRRQRKPQRKLQSTLLREIQQFSQGTRKSATDTSAKWRLSHCTVHRTDLYPNSKQLLNSGVSMPVIQTKEKMIHENLRGIHENETDSWTVMQINKNSTSGTIKETDDIDDIFALMGV

SEQ ID NO: 809183 - protein, 159 aa, Homo sapiens
MAAVPPGLEPWNRVRIPKAGNRSAVTVQNPGAALDLCIAAVIKECHLVILSLKSQTLDAETDVLCAVLYSNHNRMGRHKPHLALKQVEQCLKRLKNMNLEGSIQDLFELFSSNENQPLTTKVCVVPSQPVVELVLMKVLGACKLLLRLLDCCCKTFLYP

SEQ ID NO: 809184 - protein, 566 aa, Homo sapiens; identical to SEQ ID NO: 809182

SEQ ID NO: 809185 - protein, 492 aa, Homo sapiens [sequence omitted]

SEQ ID NO: 809186 - protein, 470 aa, Homo sapiens [sequence omitted]

SEQ ID NO: 809187 - protein, 422 aa, Homo sapiens
MGRHKPHLALKQVEQCLKRLKNMNLEGSIQDLFELFSSKVLYKGVLKRLILLYEPLFGLLQEVARIQPMPYFKDFTFPSDITEFLGQPYFEAFKKKMPIAFAAKGINKLLNKLFLINEQSPRASEETLLGISKKAKQMKINVQNNVDLGQPVKNKRVFKEESSEFDVRAFCNQLKHKATQETSFDFKCSQSRLKTTKYSSQKVIGTPHAKSIVQRFREAESFTQLSEEIQMAVVWCRSKKLKAQAIFLGNKLLKSNRLKHLEAQGTSLPKKLECIKTSICNHLLRGSGIKTSKHHLRQRRSQNKFLRRQRKPQRKLQSTLLREIQQFSQGTRKSATDTSAKWRLSHCTVHRTDLYPNSKQLLNSGVSMPVIQTKEKMIHENLRGIHENETDSWTVMQINKNSTSGTIKETDDIDDIFALMGV

SEQ ID NO: 809188 - protein, 496 aa, Homo sapiens
MAAVPPGLEPWNRVRIPKAGNRSAVTVQNPGAALDLCIAAVIKECHLVILSLKSQTLDAETDVLCAVLYSNHNRMGRHKPHLALKQVEQCLKRLKNMNLEGSIQDLFELFSSKVLYKGVLKRLILLYEPLFGLLQEVARIQPMPYFKDFTFPSDITEFLGQPYFEAFKKKMPIAFAAKGINKLLNKLFLINEQSPRASEETLLGISKKAKQMKINVQNNVDLGQPVKNKRVFKEESSEFDVRAFCNQLKHKATQETSFDFKCSQSRLKTTKYSSQKVIGTPHAKSIVQRFREAESFTQLSEEIQMAVVWCRSKKLKAQAIFLGNKLLKSNRLKHLEAQGTSLPKKLECIKTSICNHLLRGSGIKTSKHHLRQRRSQNKFLRRQRKPQRKLQSTLLREIQQFSQGTRKSATDTSAKWRLSHCTVHRTDLYPNSKQLLNSGVSMPVIQTKEKMIHENLRGIHENETDSWTVMQINKNSTSGTIKETDDIDDIFALMGV

SEQ ID NO: 809189 - protein, 548 aa, Homo sapiens
MAAVPPGLEPWNRVRIPKAGNRSAVTVQNPGAALDLCIAAVIKECHLVILSLKSQTLDAETDVLCAVLYSNHNRMGRHKPHLALKQVEQCLKRLKNMNLEGSIQDLFELFSSNENQPLTTKVCVVPSQPVVELVLMKVLGACKLLLRLLDCCCKTFLLTVKHLGLQEFIILNLVMVGLVSRLWVLYKGVLKRLILLYEPLFGLLQEVARIQPMPYFKDFTFPSDITEFLGQPYFEAFKKKMPIAFAAKGINKLLNKLFLINEQSPRASEETLLGISKKAKQMKINVQNNVDLGQPVKNKRVFKEESSEFDVRAFCNQLKHKATQETSFDFKCSQSRLKTTKYSSQKVIGTPHAKSIVQRFREAESFTQLSEEIQMAVVWCRSKKLKAQAIFLGNKLLKSNRLKHLEAQGTSLPKKLECIKTSICNHLLRGSGIKTSKHHLRQRRSQNKFLRRQRKPQRKLQSTLLREIQQFSQGTRKSATDTSAKWRLSHCTVHRTDLYPNSKQLLNSGVSMPVIQTKEKMIHENLRGIHENETDSWTVMQINTLMGV

SEQ ID NO: 809190 - protein, 364 aa, Homo sapiens
MCCPQSASGGVGVDEGFGSLQVVAPLVGLLLQNFSFDCETSRFARVHYFKPCDGWAGEQVMSPRASEETLLGISKKAKQMKINVQNNVDLGQPVKNKRVFKEESSEFDVRAFCNQLKHKATQETSFDFKCSQSRLKTTKYSSQKVIGTPHAKSIVQRFREAESFTQLSEEIQMAVVWCRSKKLKAQAIFLGNKLLKSNRLKHLEAQGTSLPKKLECIKTSICNHLLRGSGIKTSKHHLRQRRSQNKFLRRQRKPQRKLQSTLLREIQQFSQGTRKSATDTSAKWRLSHCTVHRTDLYPNSKQLLNSGVSMPVIQTKEKMIHENLRGIHENETDSWTVMQINKNSTSGTIKETDDIDDIFALMGV

SEQ ID NO: 809191 - protein, 269 aa, Homo sapiens
MRSPYIQESSEFDVRAFCNQLKHKATQETSFDFKCSQSRLKTTKYSSQKVIGTPHAKSIVQRFREAESFTQLSEEIQMAVVWCRSKKLKAQAIFLGNKLLKSNRLKHLEAQGTSLPKKLECIKTSICNHLLRGSGIKTSKHHLRQRRSQNKFLRRQRKPQRKLQSTLLREIQQFSQGTRKSATDTSAKWRLSHCTVHRTDLYPNSKQLLNSGVSMPVIQTKEKMIHENLRGIHENETDSWTVMQINKNSTSGTIKETDDIDDIFALMGV

SEQ ID NO: 809192 - protein, 192 aa, Homo sapiens
MAVVWCRSKKLKAQAIFLGNKLLKSNRLKHLEAQGTSLPKKLECIKTSICNHLLRGSGIKTSKHHLRQRRSQNKFLRRQRKPQRKLQSTLLREIQQFSQGTRKSATDTSAKWRLSHCTVHRTDLYPNSKQLLNSGVSMPVIQTKEKMIHENLRGIHENETDSWTVMQINKNSTSGTIKETDDIDDIFALMGV

SEQ ID NO: 809193 - protein, 110 aa, Homo sapiens [sequence omitted]

SEQ ID NO: 809194 - protein, 566 aa, Homo sapiens; identical to SEQ ID NO: 809182

SEQ ID NO: 809195 - protein, 411 aa, Homo sapiens
MAAVPPGLEPWNRVRIPKAGNRSAVTVQNPGAALDLCIAAVIKECHLVILSLKSQTLDAETDVLCAVLYSNHNRMGRHKPHLALKQVEQCLKRLKNMNLEGSIQDLFELFSSNENQPLTTKVCVVPSQPVVELVLMKVLGACKLLLRLLDCCCKTFLLTVKHLGLQEFIILNLVMVGLVSRLWVLYKGVLKRLILLYEPLFGLLQEVARIQPMPYFKDFTFPSDITEFLGQPYFEAFKKKMPIAFAAKGINKLLNKLFLINEQSPRASEETLLGISKKAKQMKINVQNNVDLGQPVKNKRVFKEESSEFDVRAFCNQLKHKATQETSFDFKCSQSRLKTTKYSSQKVIGTPHAKSIVQRFREAESFTQLSEEIQMAVVWCRSKKLKAQAIFLGNKLLKSNRLKHLEAQGTR

SEQ ID NO: 809196 - protein, 337 aa, Homo sapiens
MAAVPPGLEPWNRVRIPKAGNRSAVTVQNPGAALDLCIAAVIKECHLVILSLKSQTLDAETDVLCAVLYSNHNRMGRHKPHLALKQVEQCLKRLKNMNLEGSIQDLFELFSSNENQPLTTKVCVVPSQPVVELVLMKVLGACKLLLRLLDCCCKTFLLTVKHLGLQEFIILNLVMVGLVSRLWVLYKGVLKRLILLYEPLFGLLQEVARIQPMPYFKDFTFPSDITEFLGQPYFEAFKKKMPIAFAAKGINKLLNKLFLINEQSPRASEETLLGISKKAKQMKINVQNNVDLGQPVKNKRVFKEESSEFDVRAFCNQLKHKATQVCLASLNLAYDFC

SEQ ID NO: 809197 - protein, 281 aa, Homo sapiens
MLFIFPLSLPWRPSCWKESCSTGQRQAGRSREDSVTPPPSSPWPTPPAGAMSTKQEARRDEGEARTRGQEAQLRDRAHLSQQRRLKQATQFLHKDSADLLPLDSLKRLGTSKDLQPRSVIQRRLVEGNPNWLQGEPPRMQDLIHGQESRRKTSRTEIPALLVNCKCQDQLLRVAVDTGTQYNRISAGCLSRLGLEKRVLKASAGDLAPGPPTQVEQLELQLGQETVVCSAQVVDAESPEFCLGLQTLLSLKCCIDLEHGVLRLKAPFSELPFLPLYQEPGQ

SEQ ID NO: 809198 - protein, 294 aa, Homo sapiens
MLFIFPLSLPWRPSCWKESCSTGQRQAGRSREDSVTPPPSSPWPTPPAGAMSTKQEARRDEGEARTRGQEAQLRDRAHLSQQRRLKQATQFLHKDSADLLPLDSLKRLGTSKDLQPRSVIQRRLVEGNPNWLQGEPPRMQDLIHGQESRRKTSRTEIPALLVNCKCQDQLLRVAVDTGTQYNRISAGCLSRLGLEKRVLKASAGDLAPGPPTQVEQLELQLGQETVVCSAQVVGKSPLLQQPWCSPHLSLWGGAKAETFTPCSTRSSQRCSDYPPSLCQCPRIWGWGGQRRSNG

SEQ ID NO: 809199 - protein, 129 aa, Homo sapiens
MFEDSEDSCRNLVPVQRVVYNVLSELEKTFNLSVLEALFSEVNMQEYPDLIHIYKSFKNAIQDKLSFQESDRKEREERPDIKLSLKQGEVPESPEARKESDQACGKMDTVDIANNSTLGKPKRKRSKNK

SEQ ID NO: 809200 - protein, 351 aa, Homo sapiens
MFEDSEDSCRNLVPVQRVVYNVLSELEKTFNLSVLEALFSEVNMQEYPDLIHIYKSFKNAIQDKLSFQESDRKEREERPDIKLSLKQGEVPESPEARKESDQACGKMDTVDIANNSTLGKPKRKRRKKKGHGWSRTGTRTQKNNQQNDNSKADGQLVSSEKKANMNLKDLSKIRGRKRGKPGTHFTQSDRAPQKRVRSRASRKHKDETVDFQAPLLPVTCGGVKGILHKEKLEQGTLAKCIQTEDGKWFTPMEFEIKGGYARSKNWRLSVRCGGWPLRRLMEEGSLPNPPRIYYRNKKRILKSQNNSSVDPCMRNLDECEVCRDGGELFCCDTCSRVFHEDCHIPPVESEK

SEQ ID NO: 809201 - protein, 526 aa, Homo sapiens
MFEDSEDSCRNLVPVQRVVYNVLSELEKTFNLSVLEALFSEVNMQEYPDLIHIYKSFKNAIQDKLSFQESDRKEREERPDIKLSLKQGEVPESPEARKESDQACGKMDTVDIANNSTLGKPKRKRRKKKGHGWSRTGTRTQKNNQQNDNSKADGQLVSSEKKANMNLKDLSKIRGRKRGKPGTHFTQSDRAPQKRVRSRASRKHKDETVDFQAPLLPVTCGGVKGILHKEKLEQGTLAKCIQTEDGKWFTPMEFEIKGGYARSKNWRLSVRCGGWPLRRLMEEGSLPNPPRIYYRNKKRILKSQNNSSVDPCMRNLDECEVCRDGGELFCCDTCSRVFHEDCHIPPVESEKMSACVQMGKEQVHRVLGPSSVIQRAVGDAGSRRTPWNCIFCRMKESPGSQQCCQESEVLERQMCPEEQLKCEFLLLKVYCCSESSFFAKIPYYYYIREACQGLKEPMWLDKIKKRLNEHGYPQVEGFVQDMRLIFQNHRASYKYKDFGQMGLRLEAEFEKDFKEVFAIQETNGNS

SEQ ID NO: 809202 - protein, 356 aa, Homo sapiens
MFEDSEDSCRNLVPVQRVVYNVLSELEKTFNLSVLEALFSEVNMQEYPDLIHIYKSFKNAIQDKLSFQESDRKEREERPDIKLSLKQGEVPESPEARKESDQACGKMDTVDIANNSTLGKPKRKRRKKKGHGWSRTGTRTQKNNQQNDNSKADGQLVSSEKKANMNLKDLSKIRGRKRGKPGTHFTQSDRAPQKRVRSRASRKHKDETVDFQAPLLPVTCGGVKGILHKEKLEQGTLAKCIQTEDGKWFTPMEFEIKGGYARSKNWRLSVRCGGWPLRRLMEEGSLPNPPRIYYRNKKRILKSQNNSSVDPCMRNLDECEVCRDGGELFCCDTCSRVFHEDCHIPPVESEKMSACV

SEQ ID NO: 809203 - protein, 493 aa, Homo sapiens
MFEDSEDSCRNLVPVQRVVYNVLSELEKTFNLSVLEALFSEVNMQEYPDLIHIYKSFKNAIQDKLSFQESDRKEREERPDIKLSLKQGEVPESPEARKESDQACGKMDTVDIANNSTLGKPKRKRRKKKGHGWSRTGTRTQKNNQQNDNSKADGQLVSSEKKANMNLKDLSKIRGRKRGKPGTHFTQSDRAPQKRVRSRASRKHKDETVDFQAPLLPVTCGGVKGILHKEKLEQGTLAKCIQTEDGKWFTPMEFEIKGGYARSKNWRLSVRCGGWPLRRLMEEGSLPNPPRIYYRNKKRILKSQNNSSVDPCMRNLDECEVCRDGGELFCCDTCSRVFHEDCHIPPVESEKTPWNCIFCRMKESPGSQQCCQESEVLERQMCPEEQLKCEFLLLKVYCCSESSFFAKIPYYYYIREACQGLKEPMWLDKIKKRLNEHGYPQVEGFVQDMRLIFQNHRASYKYKDFGQMGLRLEAEFEKDFKEVFAIQETNGNS

SEQ ID NO: 809204 - protein, 344 aa, Homo sapiens
VIQRILSDEFTEKSPIKASRKHKDETVDFQAPLLPVTCGGVKGILHKEKLEQGTLAKCIQTEDGKWFTPMEFEIKGGYARSKNWRLSVRCGGWPLRRLMEEGSLPNPPRIYYRNKKRILKSQNNSSVDPCMRNLDECEVCRDGGELFCCDTCSRVFHEDCHIPPVESEKMSACVQMGKEQVHRVLGPSSVIQRAVGDAGSRRTPWNCIFCRMKESPGSQQCCQESEVLERQMCPEEQLKCEFLLLKVYCCSESSFFAKIPYYYYIREACQGLKEPMWLDKIKKRLNEHGYPQVEGFVQDMRLIFQNHRASYKYKDFGQMGLRLEAEFEKDFKEVFAIQETNGNS

SEQ ID NO: 809205 - protein, 233 aa, Homo sapiens
MFEDSEDSCRNLVPVQRVVYNVLSELEKTFNLSVLEALFSEVNMQEYPDLIHIYKSFKNAIQDKLSFQESDRKEREERPDIKLSLKQGEVPESPEARKESDQACGKMDTVDIANNSTLGKPKRKRRKKKGHGWSRTGTRTQKNNQQNDNSKADGQLVSSEKKANMNLKDLSKIRGRKRGKPGTHFTQSDRAPQKRVRSRGKKEKRNALSITKHLISCALCCIFSNKPISLIVL

SEQ ID NO: 809206 - protein, 72 aa, Homo sapiens
MFSKKPHGDVKKSTQKVLDTKKDALTRLKHLRIVIENAESIDLKQFFDQHFSHIYYVFFENFVTIEASLKQK

SEQ ID NO: 809207 - protein, 787 aa, Homo sapiens
MEPAGERFPEQRQVLILLLLLEVTLAGWEPRRYSVMEETERGSFVANLANDLGLGVGELAERGARVVSEDNEQGLQLDLQTGQLILNEKLDREKLCGPTEPCIMHFQVLLKKPLEVFRAELLVTDINDHSPEFPEREMTLKIPETSSLGTVFPLKKARDLDVGSNNVQNYNISPNSHFHVSTRTRGDGRKYPELVLDTELDREEQAELRLTLTAVDGGSPPRSGTVQILILVLDANDNAPEFVQALYEVQVPENSPVGSLVVKVSARDLDTGTNGEISYSLYYSSQEIDKPFELSSLSGEIRLIKKLDFETMSSYDLDIEASDGGGLSGKCSVSVKVLDVNDNFPELSISSLTSPIPENSPETEVALFRIRDRDSGENGKMICSIQDDVPFKLKPSVENFYRLVTEGALDRETRAEYNITITITDLGTPRLKTEQSITVLVSDVNDNAPAFTQTSYTLFVRENNSPALHIGSVSATDRDSGTNAQVTYSLLPPRDPHLPLTSLVSINTDNGHLFALQSLDYEALQAFEFRVGATDRGFPALSSEALVRVLVLDANDNSPFVLYPLQNGSAPCTELVPRAAEPGYLVTKVVAVDGDSGQNAWLSYQLLKATEPGLFGVWAHNGEVRTARLLSERDVAKHRLVVLVKDNGEPPRSATATLQVLLVDGFSQPYLPLPEAAPAQAQADSLTVYLVVALASVSSLFLFSVFLFVAVRLCRRSRAASVGRCSVPEGPFPGHLVDVSGTGTLSQSYQYEVCLTGGSESNDFKFLKPIFPNIVSQDSRRKSEFLE

SEQ ID NO: 809208 - protein, 495 aa, Homo sapiens
YRYRRPRPRASPRIMATSATSPHAPGFPAEGRCGYYVEKKKRFCRMVVAAGKRFCGEHAGAMEEEDARKRILCPLDPKHTVYEDQLAKHLKKCNSREKPKPDFYIQDINAGLRDETEIPEQLVPISSLSEEQLEKLIKKLRKASEGLNSTLKDHIMSHPALHDALNDPKNGDSATKHLKQQASILGNIENLKLLGPRRCFVEFGAGKGKLSHWVDIALKDAEKVHFILVEKVTTRFKVDGKHRKKNSVFERLQIDIQHLCLNKIPVLREEKLPVVGIGKHLCGMATDLALRCLVETYAASFEERNEEPLAKRIKNDKTEKEIYTLAKEGNEKNVPEKWNPVAGIVIALCCHHRCDWRHYVGKEYFRALGLGAVEFHYFQRMSSWATCGMRKTSLETSNSTTKRQDNQNDDSEEHDDGGYRITDDGADCLPGLLSVEEKKKIGHLCKLLIDQGRIQYLQQKGFSPALQYYTDPLVSLENVLLTALPNHSSSPETTA

SEQ ID NO: 809209 - protein, 431 aa, Homo sapiens
YRYRRPRPRASPRIMATSATSPHAPGFPAEGRCGYYVEKKKRFCRMVVAAGKRFCGEHAGAMEEEDARKRILCPLDPKHTVYEDQLAKHLKKCNSREKPKPDFYIQDINAGLRDETEIPEQLVPISSLSEEQLEKLIKKLRKASEGLNSTLKDHIMSHPALHDALNDPKNGDSATKHLKQQASILGNIENLKLLGPRRCFVEFGAGKGKLSHWVDIALKDAEKVHFILVEKVTTRFKVDGKHRKKNSVFERLQIDIQHLCLNKIPVLREEKLPVVGIGKHLCGMATDLALRCLVETYAASFEERNEEPLAKRIKNDKTEKEIYTLAKEGNEKNVPEKWNPVAGIVIALCCHHRCDWRHYVGKEYFRALGLGAVEFHYFQRMSSWATCGMRKTSLETSNSTTKRQDNQNDDSEEHDDGGYRITDDGADCLPG

SEQ ID NO: 809210 - protein, 301 aa, Homo sapiens
YRYRRPRPRASPRIMATSATSPHAPGFPAEGRCGYYVEKKKRFCRMVVAAGKRFCGEHAGAMEEEDARKRILCPLDPKHTVYEDQLAKHLKKCNSREKPKPDFYIQDINAGLRDETEIPEQLVPISSLSEEQLEKLIKKLRKASEGLNSTLKDHIMSHPALHDALNDPKNGDSATKHLKQQASILGNIENLKLLGPRRCFVEFGAGKGKLSHWVDIALKDAEKVHFILVEKVTTRFKVDGKHRKKNSVFERLQIDIQHLCLNKIPVLREEKLPVVGIGKHLCGMATGVIGDIMWAKNISGL

SEQ ID NO: 809211 - protein, 189 aa, Homo sapiens
YRYRRPRPRASPRIMATSATSPHAPGFPAEGRCGYYVEKKKRFCRMVVAAGKRFCGEHAGAMEEEDARKRILCPLDPKHTVYEDQLAKHLKKCNSREKPKPDFYIQDINAGLRDETEIPEQLVPISSLSEEQLEKLIKKLRKASEGLNSTLKDHIMSHPALHDALNDPKNGDSATKHLKQQVCLGYSNY

SEQ ID NO: 809212 - protein, 175 aa, Homo sapiens
YRYRRPRPRASPRIMATSATSPHAPGFPAEGRCGYYVEKKKRFCRMVVAAGKRFCGEHAGAMEEEDARKRILCPLDPKHTVYEDQLAKHLKKCNSREKPKPDFYIQDINAGLRDETEIPEQLVPISSLSEEQLEKLIKKLRKASEALHDALNDPKNGDSATKHLKQQVCLGYSNY

SEQ ID NO: 809213 - protein, 431 aa, Homo sapiens; identical to SEQ ID NO: 809209

SEQ ID NO: 809214 - protein, 431 aa, Homo sapiens; identical to SEQ ID NO: 809209

SEQ ID NO: 809215 - protein, 189 aa, Homo sapiens; identical to SEQ ID NO: 809211

SEQ ID NO: 809216 - protein, 734 aa, Homo sapiens
MWGLLLALAAFAPAVGPALGAPRNSVLGLAQPGTTKVPGSTPALHSSPAQPPAETANGTSEQHVRIRVIKKKKVIMKKRKKLTLTRPTPLVTAGPLVTPTPAGTLDPAEKQETGCPPLGLESLRVSDSRLEASSSQSFGLGPHRGRLNIQSGLEDGDLYDGAWCAEEQDADPWFQVDAGHPTRFSGVITQGRNSVWRYDWVTSYKVQFSNDSRTWWGSRNHSSGMDAVFPANSDPETPVLNLLPEPQVARFIRLLPQTWLQGGAPCLRAEILACPVSDPNDLFLEAPASGSSDPLDFQHHNYKAMRKLMKQVQEQCPNITRIYSIGKSYQGLKLYVMEMSDKPGEHELGEPEVRYVAGMHGNEALGRELLLLLMQFLCHEFLRGNPRVTRLLSEMRIHLLPSMNPDGYEIAYHRGSELVGWAEGRWNNQSIDLNHNFADLNTPLWEAQDDGKVPHIVPNHHLPLPTYYTLPNATVAPETRAVIKWMKRIPFVLSANLHGGELVVSYPFDMTRTPWAARELTPTPDDAVFRWLSTVYAGSNLAMQDTSRRPCHSQDFSVHGNIINGADWHTVPGSMNDFSYLHTNCFEVTVELSCDKFPHENELPQEWENNKDALLTYLEQVRMGIAGVVRDKDTELGIADAVIAVDGINHDVTTAWGGDYWRLLTPGDYMVTASAEGYHSVTRNCRVTFEEGPFPCNFVLTKTPKQRLRELLAAGAKVPPDLRRRLERLRGQKD

SEQ ID NO: 809217 - protein, 659 aa, Homo sapiens
MKKRKKLTLTRPTPLVTAGPLVTPTPAGTLDPAEKQETGCPPLGLESLRVSDSRLEASSSQSFGLGPHRGRLNIQSGLEDGDLYDGAWCAEEQDADPWFQVDAGHPTRFSGVITQGRNSVWRYDWVTSYKVQFSNDSRTWWGSRNHSSGMDAVFPANSDPETPVLNLLPEPQVARFIRLLPQTWLQGGAPCLRAEILACPVSDPNDLFLEAPASGSSDPLDFQHHNYKAMRKLMKQVQEQCPNITRIYSIGKSYQGLKLYVMEMSDKPGEHELGEPEVRYVAGMHGNEALGRELLLLLMQFLCHEFLRGNPRVTRLLSEMRIHLLPSMNPDGYEIAYHRGSELVGWAEGRWNNQSIDLNHNFADLNTPLWEAQDDGKVPHIVPNHHLPLPTYYTLPNATVAPETRAVIKWMKRIPFVLSANLHGGELVVSYPFDMTRTPWAARELTPTPDDAVFRWLSTVYAGSNLAMQDTSRRPCHSQDFSVHGNIINGADWHTVPGSMNDFSYLHTNCFEVTVELSCDKFPHENELPQEWENNKDALLTYLEQVRMGIAGVVRDKDTELGIADAVIAVDGINHDVTTAWGGDYWRLLTPGDYMVTASAEGYHSVTRNCRVTFEEGPFPCNFVLTKTPKQRLRELLAAGAKVPPDLRRRLERLRGQKD

SEQ ID NO: 809218 - protein, 55 aa, Homo sapiens [sequence omitted]

SEQ ID NO: 809219 - protein, 104 aa, Homo sapiens
METSHAHESNCKIKGYGVVQQLLHSQLCGAGEDLGPIGVSYVYSFRAVPFSLILSNASLHSLGGKDSIQVGCLKELMGPLSELADQILGNLFNFYDFPSHILKW

SEQ ID NO: 809220 - protein, 104 aa, Homo sapiens; identical to SEQ ID NO: 809219

SEQ ID NO: 809221 - protein, 560 aa, Homo sapiens
MLLTIIPLQRSWRKFPPPVTVMRKTQVPKASLTSQENHLLHQPTLGIHCLLFQVIQAQGYLLKEARTSPGDMELDQNATEKVQTMFTAIDELLYEQKLSVHTKSLQEECQQWTASFPHLRILGRQIITPSEGYRLYPRSPSAVSASYETTLSQERDSTIFGIRGKKLHFSSSYAHKASSIAKSSSFCSMERDEEDSIIVSEGIIEEYLAFDHIDIEEGFHGKKSEAATEKQKLGYPPIAPFYCMKEDVLAYVFDSVWCKVVSCMEQLTRSHWEGFASDDESNVAVTRPDSESSCVLSELHPLVLPRVPQSKVLYITSNPMSLCQASRHQPNVNDLLVHGMPLQPRNLSLMDKLLDLDDKLLMRPGSSTILSTRNWPNRAVEFSTSSLSYTVQSTRRRNPPPRTLHPISTSHSCAETPRSVEEILRGARVPVAPDSLSSPSPTPLSRNNLLPPIGTAEVEHVSTVGPQRQMKPHGDSSRAQSAVVDEPNYQQPQERLLLPDFFPRPNTTQSFLLDTQYRRSCAVEYPHQARPGRGSAGPQLHGSTKSQSGGRPVSRTRQGP

SEQ ID NO: 809222 - protein, 518 aa, Homo sapiens
MLLTIIPLQRSWRKFPPPVTVMRKTQVPKASLTSQENHLLHQPTLGIHCLLFQVIQAQGYLLKEARTSPGDMELDQNATEKVQTMFTAIDELLYEQKLSVHTKSLQEECQQWTASFPHLRILGRQIITPSEGYRLYPRSPSAVSASYETTLSQERDSTIFGIRGKKLHFSSSYAHKASSIAKSSSFCSMERDEEDSIIVSEGIIEEYLAFDHIDIEEGFHGKKSEAATEKQKLGYPPIAPFYCMKEDVLAYVFDSVWCKVVSCMEQLTRSHWEGFASDDESNVAVTRPDSESSCVLSELHPLVLPRVPQSKVLYITSNPMSLCQASRHQPNVNDLLVHGMPLQPRNLSLMDKLLDLDDKLLMRPGSSTILSTRNWPNRAVEFSTSSLSYTVQSTRRRNPPPRTLHPISTSHSCAETPRSVEEILRGARVPVAPDSLSSPSPTPLSRNNLLPPIGTAEVEHVSTVGPQRQMLDTQYRRSCAVEYPHQARPGRGSAGPQLHGSTKSQSGGRPVSRTRQGP

SEQ ID NO: 809223 - protein, 370 aa, Homo sapiens
MCEPGVNSAEGFGIRGKKLHFSSSYAHKASSIAKSSSFCSMERDEEDSIIVSEGIIEEYLAFDHIDIEEGFHGKKSEAATEKQKLGYPPIAPFYCMKEDVLAYVFDSVWCKVVSCMEQLTRSHWEGFASDDESNVAVTRPDSESSCVLSELHPLVLPRVPQSKVLYITSNPMSLCQASRHQPNVNDLLVHGMPLQPRNLSLMDKLLDLDDKLLMRPGSSTILSTRNWPNRAVEFSTSSLSYTVQSTRRRNPPPRTLHPISTSHSCAETPRSVEEILRGARVPVAPDSLSSPSPTPLSRNNLLPPIGTAEVEHVSTVGPQRQMLDTQYRRSCAVEYPHQARPGRGSAGPQLHGSTKSQSGGRPVSRTRQGP

SEQ ID NO: 809224 - protein, 368 aa, Homo sapiens
AIWGVVWYVFGIRGKKLHFSSSYAHKASSIAKSSSFCSMERDEEDSIIVSEGIIEEYLAFDHIDIEEGFHGKKSEAATEKQKLGYPPIAPFYCMKEDVLAYVFDSVWCKVVSCMEQLTRSHWEGFASDDESNVAVTRPDSESSCVLSELHPLVLPRVPQSKVLYITSNPMSLCQASRHQPNVNDLLVHGMPLQPRNLSLMDKLLDLDDKLLMRPGSSTILSTRNWPNRAVEFSTSSLSYTVQSTRRRNPPPRTLHPISTSHSCAETPRSVEEILRGARVPVAPDSLSSPSPTPLSRNNLLPPIGTAEVEHVSTVGPQRQMLDTQYRRSCAVEYPHQARPGRGSAGPQLHGSTKSQSGGRPVSRTRQGP

SEQ ID NO: 809225 - protein, 581 aa, Homo sapiens
MLLTIIPLQRSWRKFPPPVTVMRKTQVPKASLTSQENHLLHQPTLGIHCLLFQVIQAQGYLLKEARTSPGDMELDQNATEKVQTMFTAIDELLYEQKLSVHTKSLQEECQQWTASFPHLRILGRQIITPSEGYRLYPRSPSAVSASYETTLSQERDSTIFGIRGKKLHFSSSYAHKASSIAKSSSFCSMERDEEDSIIVSEGIIEEYLAFDHIDIEEGFHGKKSEAATEKQKLGYPPIAPFYCMKEDVLAYVFDSVWCKVVSCMEQLTRSHWEGFASALNYQNGASYDLVTTEDGTSLDDESNVAVTRPDSESSCVLSELHPLVLPRVPQSKVLYITSNPMSLCQASRHQPNVNDLLVHGMPLQPRNLSLMDKLLDLDDKLLMRPGSSTILSTRNWPNRAVEFSTSSLSYTVQSTRRRNPPPRTLHPISTSHSCAETPRSVEEILRGARVPVAPDSLSSPSPTPLSRNNLLPPIGTAEVEHVSTVGPQRQMKPHGDSSRAQSAVVDEPNYQQPQERLLLPDFFPRPNTTQSFLLDTQYRRSCAVEYPHQARPGRGSAGPQLHGSTKSQSGGRPVSRTRQGP

SEQ ID NO: 809226 - protein, 117 aa, Homo sapiens
CLGVVLFYLLDDLQKRVVFQLFMQIGLLWSQQLWLWAAQDPLPTPSFPKNPNPNPCQLQLAQHFNCYSGSHTGATTAPKQQYLSFSCLSGDNLSAQKNASNRVGISPCGKFLGSTLE

SEQ ID NO: 809227 - protein, 534 aa, Homo sapiens
MLLTIIPLQRSWRKFPPPVTVMRKTQVPKASLTSQENHLLHQPTLGIHCLLFQVIQAQGYLLKEARTSPGDMELDQNATEKVQTMFTAIDELLYEQKLSVHTKSLQEECQQWTASFPHLRILGRQIITPSEGYRLYPRSPSAVSASYETTLSQERDSTIFCSMERDEEDSIIVSEGIIEEYLAFDHIDIEEGFHGKKSEAATEKQKLGYPPIAPFYCMKEDVLAYVFDSVWCKVVSCMEQLTRSHWEGFASDDESNVAVTRPDSESSCVLSELHPLVLPRVPQSKVLYITSNPMSLCQASRHQPNVNDLLVHGMPLQPRNLSLMDKLLDLDDKLLMRPGSSTILSTRNWPNRAVEFSTSSLSYTVQSTRRRNPPPRTLHPISTSHSCAETPRSVEEILRGARVPVAPDSLSSPSPTPLSRNNLLPPIGTAEVEHVSTVGPQRQMKPHGDSSRAQSAVVDEPNYQQPQERLLLPDFFPRPNTTQSFLLDTQYRRSCAVEYPHQARPGRGSAGPQLHGSTKSQSGGRPVSRTRQGP

SEQ ID NO: 809228 - protein, 292 aa, Homo sapiens
MLLTIIPLQRSWRKFPPPVTVMRKTQVPKASLTSQENHLLHQPTLGIHCLLFQVIQAQGYLLKEARTSPGDMELDQNATEKVQTMFTAIDELLYEQKLSVHTKSLQEECQQWTASFPHLRILGRQIITPSEGYRLYPRSPSAVSASYETTLSQERDSTIFGIRGKKLHFSSSYAHKASSIAKSSSFCSMERDEEDSIIVSEGIIEEYLAFDHIDIEEGFHGKKSEAATEKQKLGYPPIAPFYCMKEDVLAYVFDSVWCKVVSCMEQLTRSHWEGFASAQWHPTRSPLPHRRP

SEQ ID NO: 809229 - protein, 117 aa, Homo sapiens; identical to SEQ ID NO: 809226

SEQ ID NO: 809230 - protein, 263 aa, Homo sapiens
KIKAWGKSINNQIGNINFWQSWMSLCQASRHQPNVNDLLVHGMPLQPRNLSLMDKLLDLDDKLLMRPGSSTILSTRNWPNRAVEFSTSSLSYTVQSTRRRNPPPRTLHPISTSHSCAETPRSVEEILRGARVPVAPDSLSSPSPTPLSRNNLLPPIGTAEVEHVSTVGPQRQMKPHGDSSRAQSAVVDEPNYQQPQERLLLPDFFPRPNTTQSFLLDTQYRRSCAVEYPHQARPGRGSAGPQLHGSTKSQSGGRPVSRTRQGP

SEQ ID NO: 809231 - protein, 241 aa, Homo sapiens
MSLCQASRHQPNVNDLLVHGMPLQPRNLSLMDKLLDLDDKLLMRPGSSTILSTRNWPNRAVEFSTSSLSYTVQSTRRRNPPPRTLHPISTSHSCAETPRSVEEILRGARVPVAPDSLSSPSPTPLSRNNLLPPIGTAEVEHVSTVGPQRQMKPHGDSSRAQSAVVDEPNYQQPQERLLLPDFFPRPNTTQSFLLDTQYRRSCAVEYPHQARPGRGSAGPQLHGSTKSQSGGRPVSRTRQGP

SEQ ID NO: 809232 - protein, 252 aa, Homo sapiens
MSLCQASRHQPNVNDLLVHGMPLQPRNLSLMDKLLDLDDKLLMRPGSSTILSTRNWPNRAVEFSTSSLSYTVQSTRRRNPPPRTLHPISTSHSCAETPRSVEEILRGARVRFQKQNFWKPCPVAPDSLSSPSPTPLSRNNLLPPIGTAEVEHVSTVGPQRQMKPHGDSSRAQSAVVDEPNYQQPQERLLLPDFFPRPNTTQSFLLDTQYRRSCAVEYPHQARPGRGSAGPQLHGSTKSQSGGRPVSRTRQGP

SEQ ID NO: 809233 - protein, 506 aa, Homo sapiens
MLLTIIPLQRSWRKFPPPVTVMRKTQVPKASLTSQENHLLHQPTLGIHCLLFQVIQAQGYLLKEARTSPGDMELDQNATEKVQTMFTAIDELLYEQKLSVHTKSLQEECQQWTASFPHLRILGRQIITPSEGYRLYPRSPSAVSASYETTLSQERDSTIFGIRGKKLHFSSSYAHKASSIAKSSSFCSMERDEEDSIIVSEGIIEEYLAFDHIDIEEGFHGKKSEAATEKQKLGYPPIAPFYCMKEDVLAYVFDSVWCKVVSCMEQLTRSHWEGFASDDESNVAVTRPDSESSCVLSELHPLVLPRVPQSKMSLCQASRHQPNVNDLLVHGMPLQPRNLSLMDKLLDLDDKLLMRPGSSTILSTRNWPNRAVEFSTSSLSYTVQSTRRRNPPPRTLHPISTSHSCAETPRSVEEILRGARVPVAPDSLSSPSPTPLSRNNLLPPIGTAEVEHVSTVGPQRQMKPHGDSSRAQSAVVDEPNYQQPQERLLLPDFFPRPNTTQSFLVE

SEQ ID NO: 809234 - protein, 514 aa, Homo sapiens [sequence omitted]

SEQ ID NO: 809235 - protein, 514 aa, Homo sapiens [sequence omitted]

SEQ ID NO: 809236 - protein, 514 aa, Homo sapiens [sequence omitted]

SEQ ID NO: 809237 - protein, 514 aa, Homo sapiens [sequence omitted]

SEQ ID NO: 809238 - protein, 429 aa, Homo sapiens [sequence omitted]

SEQ ID NO: 809239 - protein, 485 aa, Homo sapiens
MLLTIIPLQRSWRKFPPPVTVMRKTQVPKASLTSQENHLLHQPTLGIHCLLFQVIQAQGYLLKEARTSPGDMELDQNATEKVQTMFTAIDELLYEQKLSVHTKSLQEECQQWTASFPHLRILGRQIITPSEGYRLYPRSPSAVSASYETTLSQERDSTIFGIRGKKLHFSSSYAHKASSIAKSSSFCSMERDEEDSIIVSEGIIEEYLAFDHIDIEEGFHGKKSEAATEKQKLGYPPIAPFYCMKEDVLAYVFDSVWCKVVSCMEQLTRSHWEGFASDDESNVAVTRPDSESSCVLSELHPLVLPRVPQSKVLYITSNPMSLCQASRHQPNVNDLLVHGMPLQPRNLSLMDKLLDLDDKLLMRPGSSTILSTRNWPNRAVEFSTSSLSYTVQSTRRRNPPPRTLHPISTSHSCAETPRSVEEILRGARVPVAPDSLSSPSPTPLSRNNLLPPIGTAEVEHVSTVGPQRQMVCFFHIASPCTYHTT

SEQ ID NO: 809240 - protein, 419 aa, Homo sapiens
MLLTIIPLQRSWRKFPPPVTVMRKTQVPKASLTSQENHLLHQPTLGIHCLLFQVIQAQGYLLKEARTSPGDMELDQNATEKVQTMFTAIDELLYEQKLSVHTKSLQEECQQWTASFPHLRILGRQIITPSEGYRLYPRSPSAVSASYETTLSQERDSTIFGIRGKKLHFSSSYAHKASSIAKSSSFCSMERDEEDSIIVSEGIIEEYLAFDHIDIEEGFHGKKSEAATEKQKLGYPPIAPFYCMKEDVLAYVFDSVWCKVVSCMEQLTRSHWEGFASDDESNVAVTRPDSESSCVLSELHPLVLPRVPQSKVLYITSNPMSLCQASRHQPNVNDLLVHGMPLQPRNLSLMDKLLDLDDKLLMRPGSSTILSTRNWPNRAVEFSTSSLSYTVQSTRRRNPPPRTLPQWHPTRSPLPHRRP

SEQ ID NO: 809241 - protein, 337 aa, Homo sapiens
MLLTIIPLQRSWRKFPPPVTVMRKTQVPKASLTSQENHLLHQPTLGIHCLLFQVIQAQGYLLKEARTSPGDMELDQNATEKVQTMFTAIDELLYEQKLSVHTKSLQEECQQWTASFPHLRILGRQIITPSEGYRLYPRSPSAVSASYETTLSQERDSTIFGIRGKKLHFSSSYAHKASSIAKSSSFCSMERDEEDSIIVSEGIIEEYLAFDHIDIEEGFHGKKSEAATEKQKLGYPPIAPFYCMKEDVLAYVFDSVWCKVVSCMEQLTRSHWEGFASDDESNVAVTRPDSESSCVLSELHPLVLPRVPQSKVLYITSNPPSGTRLALLSLTDAPESK

SEQ ID NO: 809242 - protein, 63 aa, Homo sapiens
MICGGDKSSTCECNTLKNMPARRVICVHVVCLYSVVGIVCLHHVVCLYRLVVHLWLSLLLETE

SEQ ID NO: 809243 - protein, 200 aa, Homo sapiens
MFRKGKKRHSSSSSQSSEISTKSKSVDSSLGGLSRSSTVASLDTDSTKSSGQSNNNSDTCAEFRIKYVGAIEKLKLSEGKGLEGPLDLINYIDVAQQDGKLPFVPPEEEFIMGVSKYGIKVSTSDQYDVLHRHALYLIIRMVCYDDGLGAGKSLLALKTTDASNEEYSLWVYQCNSLEQAQAICKVLSTAFDSVLTSEKP

SEQ ID NO: 809244 - protein, 193 aa, Homo sapiens
KTGLLQWRFFTCFSVSQSVDSSLGGLSRSSTVASLDTDSTKSSGQSNNNSDTCAEFRIKYVGAIEKLKLSEGKGLEGPLDLINYIDVAQQDGKLPFVPPEEEFIMGVSKYGIKVSTSDQYDVLHRHALYLIIRMVCYDDGLGAGKSLLALKTTDASNEEYSLWVYQCNSLEQAQAICKVLSTAFDSVLTSEKP

SEQ ID NO: 809245 - protein, 150 aa, Homo sapiens
MFRKGKKRHSSSSSQSSEISTKSKSVDSSLGGLSRSSTVASLDTDSTKSSGQSNNNSDTCAEFRIKYVGAIEKLKLSEGKGLEGPLDLINYIDVAQQDGKLPFVPPEEEFIMGVSKYGIKVSTSDQYEQAQAICKVLSTAFDSVLTSEKP

SEQ ID NO: 809246 - protein, 150 aa, Homo sapiens; identical to SEQ ID NO: 809245

SEQ ID NO: 809247 - protein, 106 aa, Homo sapiens
MGPRLRGQSNNNSDTCAEFRIKYVGAIEKLKLSEGKGLEGPLDLINYIDVAQQDGKLPFVPPEEEFIMGVSKYGIKVSTSDQYEQAQAICKVLSTAFDSVLTSEKP

SEQ ID NO: 809248 - protein, 200 aa, Homo sapiens; identical to SEQ ID NO: 809243

SEQ ID NO: 809249 - protein, 200 aa, Homo sapiens; identical to SEQ ID NO: 809243

SEQ ID NO: 809250 - protein, 108 aa, Homo sapiens
ARAWFRAGPRSRGAGGGAWNHADRAWACGLQLPEPLSPRRGGKAGGRGPFPCLFLCPASAASRLSGSGLSVPFAVTSSAPSAWKVLHHGDRQVPSRLASGRNFGAGSP

SEQ ID NO: 809251 - protein, 200 aa, Homo sapiens; identical to SEQ ID NO: 809243

SEQ ID NO: 809252 - protein, 200 aa, Homo sapiens; identical to SEQ ID NO: 809243

SEQ ID NO: 809253 - protein, 200 aa, Homo sapiens; identical to SEQ ID NO: 809243

SEQ ID NO: 809254 - protein, 200 aa, Homo sapiens; identical to SEQ ID NO: 809243

SEQ ID NO: 809255 - protein, 200 aa, Homo sapiens; identical to SEQ ID NO: 809243

SEQ ID NO: 809256 - protein, 200 aa, Homo sapiens; identical to SEQ ID NO: 809243

SEQ ID NO: 809257 - protein, 200 aa, Homo sapiens; identical to SEQ ID NO: 809243

SEQ ID NO: 809258 - protein, 200 aa, Homo sapiens; identical to SEQ ID NO: 809243

SEQ ID NO: 809259 - protein, 200 aa, Homo sapiens; identical to SEQ ID NO: 809243

SEQ ID NO: 809260 - protein, 150 aa, Homo sapiens; identical to SEQ ID NO: 809245

SEQ ID NO: 809261 - protein, 150 aa, Homo sapiens; identical to SEQ ID NO: 809245

SEQ ID NO: 809262 - protein, 136 aa, Homo sapiens
MFRKGKKRHSSSSSQSSEISTKSKSVDSSLGGLSRSSTVASLDTDSTKSSGQSNNNSDTCAEFRIKYVGAIEKLKLSEGKGLEGPLDLINYIDVAQQDGKLPFVPPEEEFIMGVSKYGIKVSTSDQYMFCTGMLST

SEQ ID NO: 809263 - protein, 62 aa, Homo sapiens
MFRKGKKRHSSSSSQSSEISTKSKSVDSSLGGLSRSSTVASLDTDSTKSSDAPSCASGSSRS

SEQ ID NO: 809264 - protein, 112 aa, Homo sapiens
MEFIFTLKQDGKLPFVPPEEEFIMGVSKYGIKVSTSDQYDVLHRHALYLIIRMVCYDDGLGAGKSLLALKTTDASNEEYSLWVYQCNSLEQAQAICKVLSTAFDSVLTSEKP

SEQ ID NO: 809265 - protein, 161 aa, Homo sapiens
ARPGGRGQEGWKSRRWSGNGSSCLGAKGRGTPTRTPKSATRGWARGCEVRSFSEKHHPGQNERKLSVQTAVCGTFEDSQIVFNSIGIFSGSSNGGEKCFARAKNDTVVAVPKVAKSVLRASLWILALGVFHDPALWPASTQIPPKAQDKATIIQIPVQNFE

SEQ ID NO: 809266 - protein, 106 aa, Homo sapiens; identical to SEQ ID NO: 809247

SEQ ID NO: 809267 - protein, 108 aa, Homo sapiens; identical to SEQ ID NO: 809250

SEQ ID NO: 809268 - protein, 104 aa, Homo sapiens
FSVCSNYEWDYVLHLTLCFTARNFCTLILYAKTLLKFISRRSFGAKTMGFSRYRIMSSVNRDSLTSCLFLSSLLYLDALPVLHIQCNVGCGFAMASSHHFGTSD

SEQ ID NO: 809269 - protein, 104 aa, Homo sapiens; identical to SEQ ID NO: 809268

SEQ ID NO: 809270 - protein, 104 aa, Homo sapiens; identical to SEQ ID NO: 809268

SEQ ID NO: 809271 - protein, 104 aa, Homo sapiens; identical to SEQ ID NO: 809268

SEQ ID NO: 809272 - protein, 104 aa, Homo sapiens; identical to SEQ ID NO: 809268

SEQ ID NO: 809273 - protein, 104 aa, Homo sapiens; identical to SEQ ID NO: 809268

SEQ ID NO: 809274 - protein, 104 aa, Homo sapiens; identical to SEQ ID NO: 809268

SEQ ID NO: 809275 - protein, 104 aa, Homo sapiens; identical to SEQ ID NO: 809268

SEQ ID NO: 809276 - protein, 128 aa, Homo sapiens
MAAVGSLLGRLRQSTVKATGPALRRLHTSSWRADSSRASLTRVHRQAYARLYPVLLVKQDGSTIHIRYREPRRMLAMPIDLDTLSPEERRARLRKREAQLQSRKEYEQELSDDLHVERYRQFWTRTKK

SEQ ID NO: 809277 - protein, 128 aa, Homo sapiens; identical to SEQ ID NO: 809276

SEQ ID NO: 809278 - protein, 128 aa, Homo sapiens; identical to SEQ ID NO: 809276

SEQ ID NO: 809279 - protein, 128 aa, Homo sapiens; identical to SEQ ID NO: 809276

SEQ ID NO: 809280 - protein, 128 aa, Homo sapiens; identical to SEQ ID NO: 809276

SEQ ID NO: 809281 - protein, 128 aa, Homo sapiens; identical to SEQ ID NO: 809276

SEQ ID NO: 809282 - protein, 128 aa, Homo sapiens; identical to SEQ ID NO: 809276

SEQ ID NO: 809283 - protein, 128 aa, Homo sapiens; identical to SEQ ID NO: 809276

SEQ ID NO: 809284 - protein, 128 aa, Homo sapiens; identical to SEQ ID NO: 809276

SEQ ID NO: 809285 - protein, 128 aa, Homo sapiens; identical to SEQ ID NO: 809276

SEQ ID NO: 809286 - protein, 128 aa, Homo sapiens; identical to SEQ ID NO: 809276

SEQ ID NO: 809287 - protein, 128 aa, Homo sapiens; identical to SEQ ID NO: 809276

SEQ ID NO: 809288 - protein, 94 aa, Homo sapiens
APASDVVGCSAAAPNAVSTLISCVASSLVLVPPGSGSQDRLSSDPSAATVAAAGLAGKERELSPKTLLDQPQAPVLVRPRERDVGIGHVAGFPF

SEQ ID NO: 809289 - protein, 149 aa, Homo sapiens
APASDVVGCSAAAPNAVSTLISCVASSLVLVPPGSGSQDRLSSDPSAATVAAAGWRLVWAGNRGGRRCTLPVESGGREAGKGTGGCTCNKPLSPCRSSRKGEGAFPEDPPGPAPGSCAGEAEGEGCGHRTRSRISILEAAGPVFRSLPW

SEQ ID NO: 809290 - protein, 164 aa, Homo sapiens
MAAVGSLLGLAASSWLGGQNASDHSLWLLRKPRGSSCPGTGHQLCRLRQSTVKATGPALRRLHTSSWRADSSRASLTRVHRQAYARLYPVLLVKQDGSTIHIRYREPRRMLAMPIDLDTLSPEERRARLRKREAQLQSRKEYEQELSDDLHVERYRQFWTRTKK

SEQ ID NO: 809291 - protein, 108 aa, Homo sapiens [sequence omitted]

SEQ ID NO: 809292 - protein, 115 aa, Homo sapiens
RCSPPAAATVPGVPQRKFCRQVGSPHRSAAAFIHKRLPFRRYFRPGHANGSASFLQSGWTQSSVAVLNFRAATSHGLKRQLSSSKWVSANQMCAKCQIHWMWKKKCQIVSNSSYI

SEQ ID NO: 809293 - protein, 125 aa, Homo sapiens
RCSPPAAATVPGVPQRKFCRQVGSPHRSAAAFIHKRLPFRRYFRPGHANGSASFLQSGWTQSSVAVLNFRAATSHGLKRQLSSSKWCPKEGSLNAPGDKRLITRGTLPDPPSTPVDTSCTPSAAR

SEQ ID NO: 809294 - protein, 61 aa, Homo sapiens
MEDIIVISDDNGSESSEGRPPGPVRGGLRTGPVRRTSGALTRRTRDQGSKLEPIPHRRLTN

SEQ ID NO: 809295 - protein, 1621 aa, Homo sapiens
MAKSGGCGAGAGVGGGNGALTWVNNAAKKEESETANKNDSSKKLSVERVYQKKTQLEHILLRPDTYIGSVEPLTQFMWVYDEDVGMNCREVTFVPGLYKIFDEILVNAADNKQRDKNMTCIKVSIDPESNIISIWNNGKGIPVVEHKVEKVYVPALIFGQLLTSSNYDDDEKKVTGGRNGYGAKLCNIFSTKFTVETACKEYKHSFKQTWMNNMMKTSEAKIKHFDGEDYTCITFQPDLSKFKMEKLDKDIVALMTRRAYDLAGSCRGVKVMFNGKKLPVNGFRSYVDLYVKDKLDETGVALKVIHELANERWDVCLTLSEKGFQQISFVNSIATTKGGRHVDYVVDQVVGKLIEVVKKKNKAGVSVKPFQVKNHIWVFINCLIENPTFDSQTKENMTLQPKSFGSKCQLSEKFFKAASNCGIVESILNWVKFKAQTQLNKKCSSVKYSKIKGIPKLDDANDAGGKHSLECTLILTEGDSAKSLAVSGLGVIGRDRYGVFPLRGKILNVREASHKQIMENAEINNIIKIVGLQYKKSYDDAESLKTLRYGKIMIMTDQDQDGSHIKGLLINFIHHNWPSLLKHGFLEEFITPIVKASKNKQELSFYSIPEFDEWKKHIENQKAWKIKYYKGLGTSTAKEAKEYFADMERHRILFRYAGPEDDAAITLAFSKKKIDDRKEWLTNFMEDRRQRRLHGLPEQFLYGTATKHLTYNDFINKELILFSNSDNERSIPSLVDGFKPGQRKVLFTCFKRNDKREVKVAQLAGSVAEMSAYHHGEQALMMTIVNLAQNFVGSNNINLLQPIGQFGTRLHGGKDAASPRYIFTMLSTLARLLFPAVDDNLLKFLYDDNQRVEPEWYIPIIPMVLINGAEGIGTGWACKLPNYDAREIVNNVRRMLDGLDPHPMLPNYKNFKGTIQELGQNQYAVSGEIFVVDRNTVEITELPVRTWTQVYKEQVLEPMLNGTDKTPALISDYKEYHTDTTVKFVVKMTEEKLAQAEAAGLHKVFKLQTTLTCNSMVLFDHMGCLKKYETVQDILKEFFDLRLSYYGLRKEWLVGMLGAESTKLNNQARFILEKIQGKITIENRSKKDLIQMLVQRGYESDPVKAWKEAQEKAAEEDETQNQHDDSSSDSGTPSGPDFNYILNMSLWSLTKEKVEELIKQRDAKGREVNDLKRKSPSDLWKEDLAAFVEELDKVESQEREDVLAGMSGKAIKGKVGKPKVKKLQLEETMPSPYGRRIIPEITAMKADASKKLLKKKKGDLDTAAVKVEFDEEFSGAPVEGAGEEALTPSVPINKGPKPKREKKEPGTRVRKTPTSSGKPSAKKVKKRNPWSDDESKSESDLEETEPVVIPRDSLLRRAAAERPKYTFDFSEEEDDDADDDDDDNNDLEELKVKASPITNDGEDEFVPSDGLDKDEYTFSPGKSKATPEKSLHDKKSQDFGNLFSFPSYSQKSEDDSAKFDSNEEDSASVFSPSFGLKQTDKVPSKTVAAKKGKPSSDTVPKPKRAPKQKKVVEAVNSDSDSEFGIPKKTTTPKGKGRGAKKRKASGSENEGDYNPGRKTSKTTSKKPKKTSFDQDSDVDIFPSDFPTEPPSLPRTGRARKEVKYFAESDEEEDDVDFAMFN

SEQ ID NO: 809296 - protein, 1621 aa, Homo sapiens; identical to SEQ ID NO: 809295

SEQ ID NO: 809297 - protein, 1621 aa, Homo sapiens; identical to SEQ ID NO: 809295

SEQ ID NO: 809298 - protein, 1621 aa, Homo sapiens; identical to SEQ ID NO: 809295

SEQ ID NO: 809299 - protein, 1545 aa, Homo sapiens
MWVYDEDVGMNCREVTFVPGLYKIFDEILVNAADNKQRDKNMTCIKVSIDPESNIISIWNNGKGIPVVEHKVEKVYVPALIFGQLLTSSNYDDDEKKVTGGRNGYGAKLCNIFSTKFTVETACKEYKHSFKQTWMNNMMKTSEAKIKHFDGEDYTCITFQPDLSKFKMEKLDKDIVALMTRRAYDLAGSCRGVKVMFNGKKLPVNGFRSYVDLYVKDKLDETGVALKVIHELANERWDVCLTLSEKGFQQISFVNSIATTKGGRHVDYVVDQVVGKLIEVVKKKNKAGVSVKPFQVKNHIWVFINCLIENPTFDSQTKENMTLQPKSFGSKCQLSEKFFKAASNCGIVESILNWVKFKAQTQLNKKCSSVKYSKIKGIPKLDDANDAGGKHSLECTLILTEGDSAKSLAVSGLGVIGRDRYGVFPLRGKILNVREASHKQIMENAEINNIIKIVGLQYKKSYDDAESLKTLRYGKIMIMTDQDQDGSHIKGLLINFIHHNWPSLLKHGFLEEFITPIVKASKNKQELSFYSIPEFDEWKKHIENQKAWKIKYYKGLGTSTAKEAKEYFADMERHRILFRYAGPEDDAAITLAFSKKKIDDRKEWLTNFMEDRRQRRLHGLPEQFLYGTATKHLTYNDFINKELILFSNSDNERSIPSLVDGFKPGQRKVLFTCFKRNDKREVKVAQLAGSVAEMSAYHHGEQALMMTIVNLAQNFVGSNNINLLQPIGQFGTRLHGGKDAASPRYIFTMLSTLARLLFPAVDDNLLKFLYDDNQRVEPEWYIPIIPMVLINGAEGIGTGWACKLPNYDAREIVNNVRRMLDGLDPHPMLPNYKNFKGTIQELGQNQYAVSGEIFVVDRNTVEITELPVRTWTQVYKEQVLEPMLNGTDKTPALISDYKEYHTDTTVKFVVKMTEEKLAQAEAAGLHKVFKLQTTLTCNSMVLFDHMGCLKKYETVQDILKEFFDLRLSYYGLRKEWLVGMLGAESTKLNNQARFILEKIQGKITIENRSKKDLIQMLVQRGYESDPVKAWKEAQEKAAEEDETQNQHDDSSSDSGTPSGPDFNYILNMSLWSLTKEKVEELIKQRDAKGREVNDLKRKSPSDLWKEDLAAFVEELDKVESQEREDVLAGMSGKAIKGKVGKPKVKKLQLEETMPSPYGRRIIPEITAMKADASKKLLKKKKGDLDTAAVKVEFDEEFSGAPVEGAGEEALTPSVPINKGPKPKREKKEPGTRVRKTPTSSGKPSAKKVKKRNPWSDDESKSESDLEETEPVVIPRDSLLRRAAAERPKYTFDFSEEEDDDADDDDDDNNDLEELKVKASPITNDGEDEFVPSDGLDKDEYTFSPGKSKATPEKSLHDKKSQDFGNLFSFPSYSQKSEDDSAKFDSNEEDSASVFSPSFGLKQTDKVPSKTVAAKKGKPSSDTVPKPKRAPKQKKVVEAVNSDSDSEFGIPKKTTTPKGKGRGAKKRKASGSENEGDYNPGRKTSKTTSKKPKKTSFDQDSDVDIFPSDFPTEPPSLPRTGRARKEVKYFAESDEEEDDVDFAMFN

SEQ ID NO: 809300 - protein, 1621 aa, Homo sapiens; identical to SEQ ID NO: 809295

SEQ ID NO: 809301 - protein, 975 aa, Homo sapiens
MERHRILFRYAGPEDDAAITLAFSKKKIDDRKEWLTNFMEDRRQRRLHGLPEQFLYGTATKHLTYNDFINKELILFSNSDNERSIPSLVDGFKPGQRKVLFTCFKRNDKREVKVAQLAGSVAEMSAYHHGEQALMMTIVNLAQNFVGSNNINLLQPIGQFGTRLHGGKDAASPRYIFTMLSTLARLLFPAVDDNLLKFLYDDNQRVEPEWYIPIIPMVLINGAEGIGTGWACKLPNYDAREIVNNVRRMLDGLDPHPMLPNYKNFKGTIQELGQNQYAVSGEIFVVDRNTVEITELPVRTWTQVYKEQVLEPMLNGTDKTPALISDYKEYHTDTTVKFVVKMTEEKLAQAEAAGLHKVFKLQTTLTCNSMVLFDHMGCLKKYETVQDILKEFFDLRLSYYGLRKEWLVGMLGAESTKLNNQARFILEKIQGKITIENRSKKDLIQMLVQRGYESDPVKAWKEAQEKAAEEDETQNQHDDSSSDSGTPSGPDFNYILNMSLWSLTKEKVEELIKQRDAKGREVNDLKRKSPSDLWKEDLAAFVEELDKVESQEREDVLAGMSGKAIKGKVGKPKVKKLQLEETMPSPYGRRIIPEITAMKADASKKLLKKKKGDLDTAAVKVEFDEEFSGAPVEGAGEEALTPSVPINKGPKPKREKKEPGTRVRKTPTSSGKPSAKKVKKRNPWSDDESKSESDLEETEPVVIPRDSLLRRAAAERPKYTFDFSEEEDDDADDDDDDNNDLEELKVKASPITNDGEDEFVPSDGLDKDEYTFSPGKSKATPEKSLHDKKSQDFGNLFSFPSYSQKSEDDSAKFDSNEEDSASVFSPSFGLKQTDKVPSKTVAAKKGKPSSDTVPKPKRAPKQKKVVEAVNSDSDSEFGIPKKTTTPKGKGRGAKKRKASGSENEGDYNPGRKTSKTTSKKPKKTSFDQDSDVDIFPSDFPTEPPSLPRTGRARKEVKYFAESDEEEDDVDFAMFN

SEQ ID NO: 809302 - protein, 852 aa, Homo sapiens
MSAYHHGEQALMMTIVNLAQNFVGSNNINLLQPIGQFGTRLHGGKDAASPRYIFTMLSTLARLLFPAVDDNLLKFLYDDNQRVEPEWYIPIIPMVLINGAEGIGTGWACKLPNYDAREIVNNVRRMLDGLDPHPMLPNYKNFKGTIQELGQNQYAVSGEIFVVDRNTVEITELPVRTWTQVYKEQVLEPMLNGTDKTPALISDYKEYHTDTTVKFVVKMTEEKLAQAEAAGLHKVFKLQTTLTCNSMVLFDHMGCLKKYETVQDILKEFFDLRLSYYGLRKEWLVGMLGAESTKLNNQARFILEKIQGKITIENRSKKDLIQMLVQRGYESDPVKAWKEAQEKAAEEDETQNQHDDSSSDSGTPSGPDFNYILNMSLWSLTKEKVEELIKQRDAKGREVNDLKRKSPSDLWKEDLAAFVEELDKVESQEREDVLAGMSGKAIKGKVGKPKVKKLQLEETMPSPYGRRIIPEITAMKADASKKLLKKKKGDLDTAAVKVEFDEEFSGAPVEGAGEEALTPSVPINKGPKPKREKKEPGTRVRKTPTSSGKPSAKKVKKRNPWSDDESKSESDLEETEPVVIPRDSLLRRAAAERPKYTFDFSEEEDDDADDDDDDNNDLEELKVKASPITNDGEDEFVPSDGLDKDEYTFSPGKSKATPEKSLHDKKSQDFGNLFSFPSYSQKSEDDSAKFDSNEEDSASVFSPSFGLKQTDKVPSKTVAAKKGKPSSDTVPKPKRAPKQKKVVEAVNSDSDSEFGIPKKTTTPKGKGRGAKKRKASGSENEGDYNPGRKTSKTTSKKPKKTSFDQDSDVDIFPSDFPTEPPSLPRTGRARKEVKYFAESDEEEDDVDFAMFN

SEQ ID NO: 809303 - protein, 1584 aa, Homo sapiens
MAKSGGCGAGAGVGGGNGALTWVNNAAKKEESETANKNDSSKKLSVERVYQKKTQLEHILLRPDTYIGSVEPLTQFMWVYDEDVGMNCREVTFVPGLYKIFDEILVNAADNKQRDKNMTCIKVSIDPESNIISIWNNGKGIPVVEHKVEKVYVPALIFGQLLTSSNYDDDEKKVTGGRNGYGAKLCNIFSTKFTVETACKEYKHSFKQTWMNNMMKTSEAKIKHFDGEDYTCITFQPDLSKFKMEKLDKDIVALMTRRAYDLAGSCRGVKVMFNGKKLPVNGFRSYVDLYVKDKLDETGVALKVIHELANERWDVCLTLSEKGFQQISFVNSIATTKGGRHVDYVVDQVVGKLIEVVKKKNKAGVSVKPFQVKNHIWVFINCLIENPTFDSQTKENMTLQPKSFGSKCQLSEKFFKAASNCGIVESILNWVKFKAQTQLNKKCSSVKYSKIKGIPKLDDANDAGGKHSLECTLILTEGDSAKSLAVSGLGVIGRDRYGVFPLRGKILNVREASHKQIMENAEINNIIKIVGLQYKKSYDDAESLKTLRYGKIMIMTDQDQDGSHIKGLLINFIHHNWPSLLKHGFLEEFITPIVKASKNKQELSFYSIPEFDEWKKHIENQKAWKIKYYKGLGTSTAKEAKEYFADMERHRILFRYAGPEDDAAITLAFSKKKIDDRKEWLTNFMEDRRQRRLHGLPEQFLYGTATKHLTYNDFINKELILFSNSDNERSIPSLVDGFKPGQRKVLFTCFKRNDKREVKVAQLAGSVAEMSAYHHGEQALMMTIVNLAQNFVGSNNINLLQPIGQFGTRLHGGKDAASPRYIFTMLSTLARLLFPAVDDNLLKFLYDDNQRVEPEWYIPIIPMVLINGAEGIGTGWACKLPNYDAREIVNNVRRMLDGLDPHPMLPNYKNFKGTIQELGQNQYAVSGEIFVVDRNTVEITELPVRTWTQVYKEQVLEPMLNGTDKTPALISDYKEYHTDTTVKFVVKMTEEKLAQAEAAGLHKVFKLQTTLTCNSMVLFDHMGCLKKYETVQDILKEFFDLRLSYYGLRKEWLVGMLGAESTKLNNQARFILEKIQGKITIENRSKKDLIQMLVQRGYESDPVKAWKEAQEKAAEEDETQNQHDDSSSDSGTPSGPDFNYILNMSLWSLTKEKVEELIKQRDAKGREVNDLKRKSPSDLWKEDLAAFVEELDKVESQEREDVLAGMSGKAIKGKVGKPKVKKLQLEETMPSPYGRRIIPEITAMKADASKKLLKKKKGDLDTAAVKVEFDEEFSGAPVEGAGEEALTPSVPINKGPKPKREKKEPGTRVRKTPTSSGKPSAKKVKKRNPWSDDESKSESDLEETEPVVIPRDSLLRRAAAERPKYTFDFSEEEDDDADDDDDDNNDLEELKVKASPITNDGEDEFVPSDGLDKDEYTFSPGKSKATPEKSLHDKKSQDFGNLFSFPSYSQKSEDGKPSSDTVPKPKRAPKQKKVVEAVNSDSDSEFGIPKKTTTPKGKGRGAKKRKASGSENEGDYNPGRKTSKTTSKKPKKTSFDQDSDVDIFPSDFPTEPPSLPRTGRARKEVKYFAESDEEEDDVDFAMFN

SEQ ID NO: 809304 - protein, 478 aa, Homo sapiens
MSLWSLTKEKVEELIKQRDAKGREVNDLKRKSPSDLWKEDLAAFVEELDKVESQEREDVLAGMSGKAIKGKVGKPKVKKLQLEETMPSPYGRRIIPEITAMKADASKKLLKKKKGDLDTAAVKVEFDEEFSGAPVEGAGEEALTPSVPINKGPKPKREKKEPGTRVRKTPTSSGKPSAKKVKKRNPWSDDESKSESDLEETEPVVIPRDSLLRRAAAERPKYTFDFSEEEDDDADDDDDDNNDLEELKVKASPITNDGEDEFVPSDGLDKDEYTFSPGKSKATPEKSLHDKKSQDFGNLFSFPSYSQKSEDDSAKFDSNEEDSASVFSPSFGLKQTDKVPSKTVAAKKGKPSSDTVPKPKRAPKQKKVVEAVNSDSDSEFGIPKKTTTPKGKGRGAKKRKASGSENEGDYNPGRKTSKTTSKKPKKTSFDQDSDVDIFPSDFPTEPPSLPRTGRARKEVKYFAESDEEEDDVDFAMFN

SEQ ID NO: 809305 - protein, 1598 aa, Homo sapiens
MAKSGGCGAGAGVGGGNGALTWVNNAAKKEESETANKNDSSKKLSVERVYQKKTQLEHILLRPDTYIGSVEPLTQFMWVYDEDVGMNCREVTFVPGLYKIFDEILVNAADNKQRDKNMTCIKVSIDPESNIISIWNNGKGIPVVEHKVEKVYVPALIFGQLLTSSNYDDDEKKVTGGRNGYGAKLCNIFSTKFTVETACKEYKHSFKQTWMNNMMKTSEAKIKHFDGEDYTCITFQPDLSKFKMEKLDKDIVALMTRRAYDLAGSCRGVKVMFNGKKLPVNGFRSYVDLYVKDKLDETGVALKVIHELANERWDVCLTLSEKGFQQISFVNSIATTKGGRHVDYVVDQVVGKLIEVVKKKNKAGVSVKPFQVKNHIWVFINCLIENPTFDSQTKENMTLQPKSFGSKCQLSEKFFKAASNCGIVESILNWVKFKAQTQLNKKCSSVKYSKIKGIPKLDDANDAGGKHSLECTLILTEGDSAKSLAVSGLGVIGRDRYGVFPLRGKILNVREASHKQIMENAEINNIIKIVGLQYKKSYDDAESLKTLRYGKIMIMTDQDQDGSHIKGLLINFIHHNWPSLLKHGFLEEFITPIVKASKNKQELSFYSIPEFDEWKKHIENQKAWKIKYYKGLGTSTAKEAKEYFADMERHRILFRYAGPEDDAAITLAFSKKKIDDRKEWLTNFMEDRRQRRLHGLPEQFLYGTATKHLTYNDFINKELILFSNSDNERSIPSLVDGFKPGQRKVLFTCFKRNDKREVKVAQLAGSVAEMSAYHHGEQALMMTIVNLAQNFVGSNNINLLQPIGQFGTRLHGGKDAASPRYIFTMLSTLARLLFPAVDDNLLKFLYDDNQRVEPEWYIPIIPMVLINGAEGIGTGWACKLPNYDAREIVNNVRRMLDGLDPHPMLPNYKNFKGTIQELGQNQYAVSGEIFVVDRNTVEITELPVRTWTQVYKEQVLEPMLNGTDKTPALISDYKEYHTDTTVKFVVKMTEEKLAQAEAAGLHKVFKLQTTLTCNSMVLFDHMGCLKKYETVQDILKEFFDLRLSYYGLRKEWLVGMLGAESTKLNNQARFILEKIQGKITIENRSKKDLIQMLVQRGYESDPVKAWKEAQEKAAEEDETQNQHDDSSSDSGTPSGPDFNYILNMSLWSLTKEKVEELIKQRDAKGREVNDLKRKSPSDLWKEDLAAFVEELDKVESQEREDVLAGMSGKAIKGKVGKPKVKKLQLEETMPSPYGRRIIPEITAMKADASKKLLKKKKGDLDTAAVKVEFDEEFSGAPVEGAGEEALTPSVPINKGPKPKREKKEPGTRVRKTPTSSGKPSAKKVKKRNPWSDDESKSESDLEETEPVVIPRDSLLRRAAAERPKYTFDFSEEEDDDADDDDDDNNDLEELKVKASPITNDGEDEFVPSDGLDKDEYTFSPGKSKATPEKSLHDKKSQDFGNLFSFPSYSQKSEDDSAKFDSNEEDSASVFSPSFGLKQTDKVPSKTVAAKKGKPSSDTVPKPKRAPKQKKVVEAVNSDSDSEFGIPKKTTTPKGKGRGAKKRKASGSENEGDYNPGRKTSKTTSKRLQIQSLKPKRAPKQKKVVEAVNSDSDSELGIP

SEQ ID NO: 809306 - protein, 1574 aa, Homo sapiens
MAKSGGCGAGAGVGGGNGALTWVNNAAKKEESETANKNDSSKKLSVERVYQKKTQLEHILLRPDTYIGSVEPLTQFMWVYDEDVGMNCREVTFVPGLYKIFDEILVNAADNKQRDKNMTCIKVSIDPESNIISIWNNGKGIPVVEHKVEKVYVPALIFGQLLTSSNYDDDEKKVTGGRNGYGAKLCNIFSTKFTVETACKEYKHSFKQTWMNNMMKTSEAKIKHFDGEDYTCITFQPDLSKFKMEKLDKDIVALMTRRAYDLAGSCRGVKVMFNGKKLPVNGFRSYVDLYVKDKLDETGVALKVIHELANERWDVCLTLSEKGFQQISFVNSIATTKGGRHVDYVVDQVVGKLIEVVKKKNKAGVSVKPFQVKNHIWVFINCLIENPTFDSQTKENMTLQPKSFGSKCQLSEKFFKAASNCGIVESILNWVKFKAQTQLNKKCSSVKYSKIKGIPKLDDANDAGGKHSLECTLILTEGDSAKSLAVSGLGVIGRDRYGVFPLRGKILNVREASHKQIMENAEINNIIKIVGLQYKKSYDDAESLKTLRYGKIMIMTDQDQDGSHIKGLLINFIHHNWPSLLKHGFLEEFITPIVKASKNKQELSFYSIPEFDEWKKHIENQKAWKIKYYKGLGTSTAKEAKEYFADMERHRILFRYAGPEDDAAITLAFSKKKIDDRKEWLTNFMEDRRQRRLHGLPEQFLYGTATKHLTYNDFINKELILFSNSDNERSIPSLVDGFKPGQRKVLFTCFKRNDKREVKVAQLAGSVAEMSAYHHGEQALMMTIVNLAQNFVGSNNINLLQPIGQFGTRLHGGKDAASPRYIFTMLSTLARLLFPAVDDNLLKFLYDDNQRVEPEWYIPIIPMVLINGAEGIGTGWACKLPNYDAREIVNNVRRMLDGLDPHPMLPNYKNFKGTIQELGQNQYAVSGEIFVVDRNTVEITELPVRTWTQVYKEQVLEPMLNGTDKTPALISDYKEYHTDTTVKFVVKMTEEKLAQAEAAGLHKVFKLQTTLTCNSMVLFDHMGCLKKYETVQDILKEFFDLRLSYYGLRKEWLVGMLGAESTKLNNQARFILEKIQGKITIENRSKKDLIQMLVQRGYESDPVKAWKEAQEKAAEEDETQNQHDDSSSDSGTPSGPDFNYILNMSLWSLTKEKVEELIKQRDAKGREVNDLKRKSPSDLWKEDLAAFVEELDKVESQEREDVLAGMSGKAIKGKVGKPKVKKLQLEETMPSPYGRRIIPEITAMKADASKKLLKKKKGDLDTAAVKVEFDEEFSGAPVEGAGEEALTPSVPINKGPKPKREKKEPGTRVRKTPTSSGKPSAKKVKKRNPWSDDESKSESDLEETEPVVIPRDSLLRRAAAERPKYTFDFSEEEDDDADDDDDDNNDLEELKVKASPITNDGEDEFVPSDGLDKDEYTFSPGKSKATPEKSLHDKKSQDFGNLFSFPSYSQKSEDDSAKFDSNEEDSASVFSPSFGLKQTDKVPSKTVAAKKGKPSSDTVPKPKRAPKQKKVVEAVNSDSDSEFGIPKKTTTPKGKGRGAKKRKASGSENEGDYNPGRKTSKTTSKKVTGNIIAY

SEQ ID NO: 809307 - protein, 362 aa, Homo sapiens
CQYNVTDTCQLRYLCQNGRCIPTPGSYRCECNKGFQLDLRGECIDVCTRVRKTPTSSGKPSAKKVKKRNPWSDDESKSESDLEETEPVVIPRDSLLRRAAAERPKYTFDFSEEEDDDADDDDDDNNDLEELKVKASPITNDGEDEFVPSDGLDKDEYTFSPGKSKATPEKSLHDKKSQDFGNLFSFPSYSQKSEDDSAKFDSNEEDSASVFSPSFGLKQTDKVPSKTVAAKKGKPSSDTVPKPKRAPKQKKVVEAVNSDSDSEFGIPKKTTTPKGKGRGAKKRKASGSENEGDYNPGRKTSKTTSKKPKKTSFDQDSDVDIFPSDFPTEPPSLPRTGRARKEVKYFAESDEEEDDVDFAMFN

SEQ ID NO: 809308 - protein, 350 aa, Homo sapiens
MRYLTSIQVRYRSKGSQILKRDKKELLDSYEYDEIIIHTVSLVKTYVSSEYVTRKRNPWSDDESKSESDLEETEPVVIPRDSLLRRAAAERPKYTFDFSEEEDDDADDDDDDNNDLEELKVKASPITNDGEDEFVPSDGLDKDEYTFSPGKSKATPEKSLHDKKSQDFGNLFSFPSYSQKSEDDSAKFDSNEEDSASVFSPSFGLKQTDKVPSKTVAAKKGKPSSDTVPKPKRAPKQKKVVEAVNSDSDSEFGIPKKTTTPKGKGRGAKKRKASGSENEGDYNPGRKTSKTTSKKPKKTSFDQDSDVDIFPSDFPTEPPSLPRTGRARKEVKYFAESDEEEDDVDFAMFN

SEQ ID NO: 809309 - protein, 1503 aa, Homo sapiens
MAKSGGCGAGAGVGGGNGALTWVNNAAKKEESETANKNDSSKKLSVERVYQKKTQLEHILLRPDTYIGSVEPLTQFMWVYDEDVGMNCREVTFVPGLYKIFDEILVNAADNKQRDKNMTCIKVSIDPESNIISIWNNGKGIPVVEHKVEKVYVPALIFGQLLTSSNYDDDEKKVTGGRNGYGAKLCNIFSTKFTVETACKEYKHSFKQTWMNNMMKTSEAKIKHFDGEDYTCITFQPDLSKFKMEKLDKDIVALMTRRAYDLAGSCRGVKVMFNGKKLPVNGFRSYVDLYVKDKLDETGVALKVIHELANERWDVCLTLSEKGFQQISFVNSIATTKGGRHVDYVVDQVVGKLIEVVKKKNKAGVSVKPFQVKNHIWVFINCLIENPTFDSQTKENMTLQPKSFGSKCQLSEKFFKAASNCGIVESILNWVKFKAQTQLNKKCSSVKYSKIKGIPKLDDANDAGGKHSLECTLILTEGDSAKSLAVSGLGVIGRDRYGVFPLRGKILNVREASHKQIMENAEINNIIKIVGLQYKKSYDDAESLKTLRYGKIMIMTDQDQDGSHIKGLLINFIHHNWPSLLKHGFLEEFITPIVKASKNKQELSFYSIPEFDEWKKHIENQKAWKIKYYKGLGTSTAKEAKEYFADMERHRILFRYAGPEDDAAITLAFSKKKIDDRKEWLTNFMEDRRQRRLHGLPEQFLYGTATKHLTYNDFINKELILFSNSDNERSIPSLVDGFKPGQRKVLFTCFKRNDKREVKVAQLAGSVAEMSAYHHGEQALMMTIVNLAQNFVGSNNINLLQPIGQFGTRLHGGKDAASPRYIFTMLSTLARLLFPAVDDNLLKFLYDDNQRVEPEWYIPIIPMVLINGAEGIGTGWACKLPNYDAREIVNNVRRMLDGLDPHPMLPNYKNFKGTIQELGQNQYAVSGEIFVVDRNTVEITELPVRTWTQVYKEQVLEPMLNGTDKTPALISDYKEYHTDTTVKFVVKMTEEKLAQAEAAGLHKVFKLQTTLTCNSMVLFDHMGCLKKYETVQDILKEFFDLRLSYYGLRKEWLVGMLGAESTKLNNQARFILEKIQGKITIENRSKKDLIQMLVQRGYESDPVKAWKEAQEKAAEEDETQNQHDDSSSDSGTPSGPDFNYILNMSLWSLTKEKVEELIKQRDAKGREVNDLKRKSPSDLWKEDLAAFVEELDKVESQEREDVLAGMSGKAIKGKVGKPKVKKLQLEETMPSPYGRRIIPEITAMKADASKKLLKKKKGDLDTAAVKVEFDEEFSGAPVEGAGEEALTPSVPINKGPKPKREKKEPGTRVRKTPTSSGKPSAKKVKKRNPWSDDESKSESDLEETEPVVIPRDSLLRRAAAERPKYTFDFSEEEDDDADDDDDDNNDLEELKVKASPITNDGEDEFVPSDGLDKDEYTFSPGKSKATPEKSLHDKKSQDFGNLFSFPSYSQKSEDDSAKFDSNEEDSASVFSPSFGLKQTDKVPSKTVAAKKGMYLYLIELSIG

SEQ ID NO: 809310 - protein, 1444 aa, Homo sapiens
MAKSGGCGAGAGVGGGNGALTWVNNAAKKEESETANKNDSSKKLSVERVYQKKTQLEHILLRPDTYIGSVEPLTQFMWVYDEDVGMNCREVTFVPGLYKIFDEILVNAADNKQRDKNMTCIKVSIDPESNIISIWNNGKGIPVVEHKVEKVYVPALIFGQLLTSSNYDDDEKKVTGGRNGYGAKLCNIFSTKFTVETACKEYKHSFKQTWMNNMMKTSEAKIKHFDGEDYTCITFQPDLSKFKMEKLDKDIVALMTRRAYDLAGSCRGVKVMFNGKKLPVNGFRSYVDLYVKDKLDETGVALKVIHELANERWDVCLTLSEKGFQQISFVNSIATTKGGRHVDYVVDQVVGKLIEVVKKKNKAGVSVKPFQVKNHIWVFINCLIENPTFDSQTKENMTLQPKSFGSKCQLSEKFFKAASNCGIVESILNWVKFKAQTQLNKKCSSVKYSKIKGIPKLDDANDAGGKHSLECTLILTEGDSAKSLAVSGLGVIGRDRYGVFPLRGKILNVREASHKQIMENAEINNIIKIVGLQYKKSYDDAESLKTLRYGKIMIMTDQDQDGSHIKGLLINFIHHNWPSLLKHGFLEEFITPIVKASKNKQELSFYSIPEFDEWKKHIENQKAWKIKYYKGLGTSTAKEAKEYFADMERHRILFRYAGPEDDAAITLAFSKKKIDDRKEWLTNFMEDRRQRRLHGLPEQFLYGTATKHLTYNDFINKELILFSNSDNERSIPSLVDGFKPGQRKVLFTCFKRNDKREVKVAQLAGSVAEMSAYHHGEQALMMTIVNLAQNFVGSNNINLLQPIGQFGTRLHGGKDAASPRYIFTMLSTLARLLFPAVDDNLLKFLYDDNQRVEPEWYIPIIPMVLINGAEGIGTGWACKLPNYDAREIVNNVRRMLDGLDPHPMLPNYKNFKGTIQELGQNQYAVSGEIFVVDRNTVEITELPVRTWTQVYKEQVLEPMLNGTDKTPALISDYKEYHTDTTVKFVVKMTEEKLAQAEAAGLHKVFKLQTTLTCNSMVLFDHMGCLKKYETVQDILKEFFDLRLSYYGLRKEWLVGMLGAESTKLNNQARFILEKIQGKITIENRSKKDLIQMLVQRGYESDPVKAWKEAQEKAAEEDETQNQHDDSSSDSGTPSGPDFNYILNMSLWSLTKEKVEELIKQRDAKGREVNDLKRKSPSDLWKEDLAAFVEELDKVESQEREDVLAGMSGKAIKGKVGKPKVKKLQLEETMPSPYGRRIIPEITAMKADASKKLLKKKKGDLDTAAVKVEFDEEFSGAPVEGAGEEALTPSVPINKGPKPKREKKEPGTRVRKTPTSSGKPSAKKVKKRNPWSDDESKSESDLEETEPVVIPRDSLLRRAAAERPKYTFDFSEEEDDDADGTILLPSEMIPSDEEEEDDEEEEEEEEPRLTINQREDEDGMANEDELDNTYTGSGDEDALSDGTKM

SEQ ID NO: 809311 - protein, 172 aa, Homo sapiens
MWLSPPPMIVEAFPTYSASVFSPSFGLKQTDKVPSKTVAAKKGKPSSDTVPKPKRAPKQKKVVEAVNSDSDSEFGIPKKTTTPKGKGRGAKKRKASGSENEGDYNPGRKTSKTTSKKPKKTSFDQDSDVDIFPSDFPTEPPSLPRTGRARKEVKYFAESDEEEDDVDFAMFN

SEQ ID NO: 809312 - protein, 1118 aa, Homo sapiens
MAKSGGCGAGAGVGGGNGALTWVNNAAKKEESETANKNDSSKKLSVERVYQKKTQLEHILLRPDTYIGSVEPLTQFMWVYDEDVGMNCREVTFVPGLYKIFDEILVNAADNKQRDKNMTCIKVSIDPESNIISIWNNGKGIPVVEHKVEKVYVPALIFGQLLTSSNYDDDEKKVTGGRNGYGAKLCNIFSTKFTVETACKEYKHSFKQTWMNNMMKTSEAKIKHFDGEDYTCITFQPDLSKFKMEKLDKDIVALMTRRAYDLAGSCRGVKVMFNGKKLPVNGFRSYVDLYVKDKLDETGVALKVIHELANERWDVCLTLSEKGFQQISFVNSIATTKGGRHVDYVVDQVVGKLIEVVKKKNKAGVSVKPFQVKNHIWVFINCLIENPTFDSQTKENMTLQPKSFGSKCQLSEKFFKAASNCGIVESILNWVKFKAQTQLNKKCSSVKYSKIKGIPKLDDANDAGGKHSLECTLILTEGDSAKSLAVSGLGVIGRDRYGVFPLRGKILNVREASHKQIMENAEINNIIKIVGLQYKKSYDDAESLKTLRYGKIMIMTDQDQDGSHIKGLLINFIHHNWPSLLKHGFLEEFITPIVKASKNKQELSFYSIPEFDEWKKHIENQKAWKIKYYKGLGTSTAKEAKEYFADMERHRILFRYAGPEDDAAITLAFSKKKIDDRKEWLTNFMEDRRQRRLHGLPEQFLYGTATKHLTYNDFINKELILFSNSDNERSIPSLVDGFKPGQRKVLFTCFKRNDKREVKVAQLAGSVAEMSAYHHGEQALMMTIVNLAQNFVGSNNINLLQPIGQFGTRLHGGKDAASPRYIFTMLSTLARLLFPAVDDNLLKFLYDDNQRVEPEWYIPIIPMVLINGAEGIGTGWACKLPNYDAREIVNNVRRMLDGLDPHPMLPNYKNFKGTIQELGQNQYAVSGEIFVVDRNTVEITELPVRTWTQVYKEQVLEPMLNGTDKTPALISDYKEYHTDTTVKFVVKMTEEKLAQAEAAGLHKVFKLQTTLTCNSMVLFDHMGCLKKYETVQDILKEFFDLRLSYYGLRKEWLVGMLGAESTKLNNQARFILEKIQGKITIENRSKKDLIQMLVQRGYESDPVKAWKEAQEKVIICRK

SEQ ID NO: 809313 - protein, 1088 aa, Homo sapiens
MAKSGGCGAGAGVGGGNGALTWVNNAAKKEESETANKNDSSKKLSVERVYQKKTQLEHILLRPDTYIGSVEPLTQFMWVYDEDVGMNCREVTFVPGLYKIFDEILVNAADNKQRDKNMTCIKVSIDPESNIISIWNNGKGIPVVEHKVEKVYVPALIFGQLLTSSNYDDDEKKVTGGRNGYGAKLCNIFSTKFTVETACKEYKHSFKQTWMNNMMKTSEAKIKHFDGEDYTCITFQPDLSKFKMEKLDKDIVALMTRRAYDLAGSCRGVKVMFNGKKLPVNGFRSYVDLYVKDKLDETGVALKVIHELANERWDVCLTLSEKGFQQISFVNSIATTKGGRHVDYVVDQVVGKLIEVVKKKNKAGVSVKPFQVKNHIWVFINCLIENPTFDSQTKENMTLQPKSFGSKCQLSEKFFKAASNCGIVESILNWVKFKAQTQLNKKCSSVKYSKIKGIPKLDDANDAGGKHSLECTLILTEGDSAKSLAVSGLGVIGRDRYGVFPLRGKILNVREASHKQIMENAEINNIIKIVGLQYKKSYDDAESLKTLRYGKIMIMTDQDQDGSHIKGLLINFIHHNWPSLLKHGFLEEFITPIVKASKNKQELSFYSIPEFDEWKKHIENQKAWKIKYYKGLGTSTAKEAKEYFADMERHRILFRYAGPEDDAAITLAFSKKKIDDRKEWLTNFMEDRRQRRLHGLPEQFLYGTATKHLTYNDFINKELILFSNSDNERSIPSLVDGFKPGQRKVLFTCFKRNDKREVKVAQLAGSVAEMSAYHHGEQALMMTIVNLAQNFVGSNNINLLQPIGQFGTRLHGGKDAASPRYIFTMLSTLARLLFPAVDDNLLKFLYDDNQRVEPEWYIPIIPMVLINGAEGIGTGWACKLPNYDAREIVNNVRRMLDGLDPHPMLPNYKNFKGTIQELGQNQYAVSGEIFVVDRNTVEITELPVRTWTQVYKEQVLEPMLNGTDKTPALISDYKEYHTDTTVKFVVKMTEEKLAQAEAAGLHKVFKLQTTLTCNSMVLFDHMGCLKKYETVQDILKEFFDLRLSYYGLRKEWLVGMLGAESTKLNNQARFILEKIQGKITIGKIQPLK

SEQ ID NO: 809314 - protein, 1090 aa, Homo sapiens
MAKSGGCGAGAGVGGGNGALTWVNNAAKKEESETANKNDSSKKLSVERVYQKKTQLEHILLRPDTYIGSVEPLTQFMWVYDEDVGMNCREVTFVPGLYKIFDEILVNAADNKQRDKNMTCIKVSIDPESNIISIWNNGKGIPVVEHKVEKVYVPALIFGQLLTSSNYDDDEKKVTGGRNGYGAKLCNIFSTKFTVETACKEYKHSFKQTWMNNMMKTSEAKIKHFDGEDYTCITFQPDLSKFKMEKLDKDIVALMTRRAYDLAGSCRGVKVMFNGKKLPVNGFRSYVDLYVKDKLDETGVALKVIHELANERWDVCLTLSEKGFQQISFVNSIATTKGGRHVDYVVDQVVGKLIEVVKKKNKAGVSVKPFQVKNHIWVFINCLIENPTFDSQTKENMTLQPKSFGSKCQLSEKFFKAASNCGIVESILNWVKFKAQTQLNKKCSSVKYSKIKGIPKLDDANDAGGKHSLECTLILTEGDSAKSLAVSGLGVIGRDRYGVFPLRGKILNVREASHKQIMENAEINNIIKIVGLQYKKSYDDAESLKTLRYGKIMIMTDQDQDGSHIKGLLINFIHHNWPSLLKHGFLEEFITPIVKASKNKQELSFYSIPEFDEWKKHIENQKAWKIKYYKGLGTSTAKEAKEYFADMERHRILFRYAGPEDDAAITLAFSKKKIDDRKEWLTNFMEDRRQRRLHGLPEQFLYGTATKHLTYNDFINKELILFSNSDNERSIPSLVDGFKPGQRKVLFTCFKRNDKREVKVAQLAGSVAEMSAYHHGEQALMMTIVNLAQNFVGSNNINLLQPIGQFGTRLHGGKDAASPRYIFTMLSTLARLLFPAVDDNLLKFLYDDNQRVEPEWYIPIIPMVLINGAEGIGTGWACKLPNYDAREIVNNVRRMLDGLDPHPMLPNYKNFKGTIQELGQNQYAVSGEIFVVDRNTVEITELPVRTWTQVYKEQVLEPMLNGTDKTPALISDYKEYHTDTTVKFVVKMTEEKLAQAEAAGLHKVFKLQTTLTCNSMVLFDHMGCLKKYETVQDILKEFFDLRLSYYGLRKEWLVGMLGAESTKLNNQARFILEKIQGKITIGSRRGLFYL

SEQ ID NO: 809315 - protein, 962 aa, Homo sapiens
MAKSGGCGAGAGVGGGNGALTWVNNAAKKEESETANKNDSSKKLSVERVYQKKTQLEHILLRPDTYIGSVEPLTQFMWVYDEDVGMNCREVTFVPGLYKIFDEILVNAADNKQRDKNMTCIKVSIDPESNIISIWNNGKGIPVVEHKVEKVYVPALIFGQLLTSSNYDDDEKKVTGGRNGYGAKLCNIFSTKFTVETACKEYKHSFKQTWMNNMMKTSEAKIKHFDGEDYTCITFQPDLSKFKMEKLDKDIVALMTRRAYDLAGSCRGVKVMFNGKKLPVNGFRSYVDLYVKDKLDETGVALKVIHELANERWDVCLTLSEKGFQQISFVNSIATTKGGRHVDYVVDQVVGKLIEVVKKKNKAGVSVKPFQVKNHIWVFINCLIENPTFDSQTKENMTLQPKSFGSKCQLSEKFFKAASNCGIVESILNWVKFKAQTQLNKKCSSVKYSKIKGIPKLDDANDAGGKHSLECTLILTEGDSAKSLAVSGLGVIGRDRYGVFPLRGKILNVREASHKQIMENAEINNIIKIVGLQYKKSYDDAESLKTLRYGKIMIMTDQDQDGSHIKGLLINFIHHNWPSLLKHGFLEEFITPIVKASKNKQELSFYSIPEFDEWKKHIENQKAWKIKYYKGLGTSTAKEAKEYFADMERHRILFRYAGPEDDAAITLAFSKKKIDDRKEWLTNFMEDRRQRRLHGLPEQFLYGTATKHLTYNDFINKELILFSNSDNERSIPSLVDGFKPGQRKVLFTCFKRNDKREVKVAQLAGSVAEMSAYHHGEQALMMTIVNLAQNFVGSNNINLLQPIGQFGTRLHGGKDAASPRYIFTMLSTLARLLFPAVDDNLLKFLYDDNQRVEPEWYIPIIPMVLINGAEGIGTGWACKLPNYDAREIVNNVRRMLDGLDPHPMLSKLTKTLNTAPIHELGSKPSMHASGDNIVQRTRTTVEHHKSYPEQQDTGYYRHGNNP

SEQ ID NO: 809316 - protein, 882 aa, Homo sapiens
MAKSGGCGAGAGVGGGNGALTWVNNAAKKEESETANKNDSSKKLSVERVYQKKTQLEHILLRPDTYIGSVEPLTQFMWVYDEDVGMNCREVTFVPGLYKIFDEILVNAADNKQRDKNMTCIKVSIDPESNIISIWNNGKGIPVVEHKVEKVYVPALIFGQLLTSSNYDDDEKKVTGGRNGYGAKLCNIFSTKFTVETACKEYKHSFKQTWMNNMMKTSEAKIKHFDGEDYTCITFQPDLSKFKMEKLDKDIVALMTRRAYDLAGSCRGVKVMFNGKKLPVNGFRSYVDLYVKDKLDETGVALKVIHELANERWDVCLTLSEKGFQQISFVNSIATTKGGRHVDYVVDQVVGKLIEVVKKKNKAGVSVKPFQVKNHIWVFINCLIENPTFDSQTKENMTLQPKSFGSKCQLSEKFFKAASNCGIVESILNWVKFKAQTQLNKKCSSVKYSKIKGIPKLDDANDAGGKHSLECTLILTEGDSAKSLAVSGLGVIGRDRYGVFPLRGKILNVREASHKQIMENAEINNIIKIVGLQYKKSYDDAESLKTLRYGKIMIMTDQDQDGSHIKGLLINFIHHNWPSLLKHGFLEEFITPIVKASKNKQELSFYSIPEFDEWKKHIENQKAWKIKYYKGLGTSTAKEAKEYFADMERHRILFRYAGPEDDAAITLAFSKKKIDDRKEWLTNFMEDRRQRRLHGLPEQFLYGTATKHLTYNDFINKELILFSNSDNERSIPSLVDGFKPGQRKVLFTCFKRNDKREVKVAQLAGSVAEMSAYHHGEQALMMTIVNLAQNFVGSNNINLLQPIGQFGTRLHGGKDAASPRYIFTMLSTLARLLFPAVDDNLLKFLYDDNQRVEPEWYIPISPSSTNALSTIYKPWDYRIYHS

SEQ ID NO: 809317 - protein, 84 aa, Homo sapiens
LVELGGTLGGYGSEVKAIYPGFYIQTIRKPKKTSFDQDSDVDIFPSDFPTEPPSLPRTGRARKEVKYFAESDEEEDDVDFAMFN

SEQ ID NO: 809318 - protein, 673 aa, Homo sapiens
MAKSGGCGAGAGVGGGNGALTWVNNAAKKEESETANKNDSSKKLSVERVYQKKTQLEHILLRPDTYIGSVEPLTQFMWVYDEDVGMNCREVTFVPGLYKIFDEILVNAADNKQRDKNMTCIKVSIDPESNIISIWNNGKGIPVVEHKVEKVYVPALIFGQLLTSSNYDDDEKKVTGGRNGYGAKLCNIFSTKFTVETACKEYKHSFKQTWMNNMMKTSEAKIKHFDGEDYTCITFQPDLSKFKMEKLDKDIVALMTRRAYDLAGSCRGVKVMFNGKKLPVNGFRSYVDLYVKDKLDETGVALKVIHELANERWDVCLTLSEKGFQQISFVNSIATTKGGRHVDYVVDQVVGKLIEVVKKKNKAGVSVKPFQVKNHIWVFINCLIENPTFDSQTKENMTLQPKSFGSKCQLSEKFFKAASNCGIVESILNWVKFKAQTQLNKKCSSVKYSKIKGIPKLDDANDAGGKHSLECTLILTEGDSAKSLAVSGLGVIGRDRYGVFPLRGKILNVREASHKQIMENAEINNIIKIVGLQYKKSYDDAESLKTLRYGKIMIMTDQDQDGSHIKGLLINFIHHNWPSLLKHGFLEEFITPIVKASKNKQELSFYSIPEFDEWKKHIENQKAWKIKYYKGLGTSTAKEAKEYFADMERHRILFRYAGPEDDAAITLVIKLIF

SEQ ID NO: 809319 - protein, 813 aa, Homo sapiens
MAKSGGCGAGAGVGGGNGALTWVNNAAKKEESETANKNDSSKKLSVERVYQKKTQLEHILLRPDTYIGSVEPLTQFMWVYDEDVGMNCREVTFVPGLYKIFDEILVNAADNKQRDKNMTCIKVSIDPESNIISIWNNGKGIPVVEHKVEKVYVPALIFGQLLTSSNYDDDEKKVTGGRNGYGAKLCNIFSTKFTVETACKEYKHSFKQTWMNNMMKTSEAKIKHFDGEDYTCITFQPDLSKFKMEKLDKDIVALMTRRAYDLAGSCRGVKVMFNGKKLPVNGFRSYVDLYVKDKLDETGVALKVIHELANERWDVCLTLSEKGFQQISFVNSIATTKGGRHVDYVVDQVVGKLIEVVKKKNKAGVSVKPFQVKNHIWVFINCLIENPTFDSQTKENMTLQPKSFGSKCQLSEKFFKAASNCGIVESILNWVKFKAQTQLNKKCSSVKYSKIKGIPKLDDANDAGGKHSLECTLILTEGDSAKSLAVSGLGVIGRDRYGVFPLRGKILNVREASHKQIMENAEINNIIKIVGLQYKKSYDDAESLKTLRYGKIMIMTDQDQDGSHIKGLLINFIHHNWPSLLKHGFLEEFITPIVKASKNKQELSFYSIPEFDEWKKHIENQKAWKIKYYKGLGTSTAKEAKEYFADMERHRILFRYAGPEDDAAITLAFSKKKIDDRKEWLTNFMEDRRQRRLHGLPEQFLYGTATKHLTYNDFINKELILFSNSDNERSIPSLVDGFKPGQRKVLFTCFKRNDKREVKVAQLAGSVAEMSAYHHGEQALMMTIVNLAQNFIIVVGLLTFCSYTYSFMLFFTH

SEQ ID NO: 809320 - protein, 163 aa, Homo sapiens
AFSRLNGNPVRGFFPPALKLKLQGFFYLPPVPIFKKLFEEGLNIQKQRLRDLRNYAKEKRDEQRRRHQDELDSMENYYKDQFSLLAEAISQEHQELKAREKSQAQTLHKVKRELRSKMEKEIQQLQDMITQNDDDVFFRELEAERFRSRLQLASFQYSKSPSL

SEQ ID NO: 809321 - protein, 143 aa, Homo sapiens
MLKSALGDRIKEKTDHKEENTGNEEVEDGTEETLSQHSDGIVEYGPKKSRPGLSMRRKPPYRSHSLSPSPVNKHKQFHLERKRQRKPRETDVRQFQAQAFTEAFERELRRHKVQENIGPLRIHEKEEETVGKSLHCNKCHLIR

SEQ ID NO: 809322 - protein, 821 aa, Homo sapiens
MAGSDAEWVTIANNLLFKCHIHLRIHELQDCDANVFIALYQSILGEKVPDLIVIPRSQEDDAHNVQAVIDSLALDYLQVSLSHITGENIVKGDKESIKNLLEIFDGLLEYLTERISETSHEKSETEQYFKESDRGERLEEPESTKESKSSWKRVSFGRCSLSSEMLGPSWDGDEAESTGEIIRLGDTAHTFSLRSNGAQCPNEMLSKKALASPSSKSHEDMLYPPSVLSKSRTSFVEDTETLSVSGIPNARKLGEPIRAAIPLHPPYHPSEPRAPCPIGKEYLHSSHCSPAVNSTGEHTEFSGDLDDGLFLISKLPKGSKWEVYPAQVQGPRTRKPPKGKRNENRATASSCNSPFPQRPRKRLTEQELHDVSEKLSQRLSELDWMLKSALGDRIKEKTDHKEENTGNEEVEDGTEETLSQHSDGIVEYGPKKSRPGLSMRRKPPYRSHSLSPSPVNKHKQFHLERKRQRKPRETDVRQFQAQAFTEAFERELRRHKVQENIGPLRIHEKEEETEKIYRGEAVRKGTPECSQPWKIYSRKTTTQSLRGGLPKPNKAVPMKVSEHSLLPLMLEQFPFLYVSGPTLSKMWKQQIAQVEQLKKEACRENRSKKKLQDEIEEALRRHDLLTTLVKKEYEHNKRLQDFKDCIRRQRLTQSKIKENRQQIVRARKYYDDYRVQLCAKMMRMRTREEMIFKKLFEEGLNIQKQRLRDLRNYAKEKRDEQRRRHQDELDSMENYYKDQFSLLAEAISQEHQELKAREKSQAQTLHKVKRELRSKMEKEIQQLQDMITQNDDDVFFRELEAERFRSRLQLASFQYSKSPSL

SEQ ID NO: 809323 - protein, 583 aa, Homo sapiens
MAGSDAEWVTIANNLLFKCHIHLRIHELQDCDANVFIALYQSILGEKVPDLIVIPRSQEDDAHNVQAVIDSLALDYLQVSLSHITGENIVKGDKESIKNLLEIFDGLLEYLTERISETSHEKSETEQYFKESDRGERLEEPESTKESKSSWKRVSFGRCSLSSEMLGPSWDGDEAESTGEIIRLGDTAHTFSLRSNGAQCPNEMLSKKALASPSSKSHEDMLYPPSVLSKSRTSFVEDTETLSVSGIPNARKLGEPIRAAIPLHPPYHPSEPRAPCPIGKEYLHSSHCSPAVNSTGEHTEFSGDLDDGLFLISKLPKGSKWEVYPAQVQGPRTRKPPKGKRNENRATASSCNSPFPQRPRKRLTEQELHDVSEKLSQRLSELDWMLKSALGDRIKEKTDHKEENTGNEEVEDGTEETLSQHSDGIVEYGPKKSRPGLSMRRKPPYRSHSLSPSPVNKHKQFHLERKRQRKPRETDVRQFQAQAFTEAFERELRRHKVQENIGPLRIHEKEEETEKIYRGEAVRKGTPECSQPWKIYSRKTTTQSLRGGLPKPNKAVPSKNHRIVLYGKLATFESMCNIPRTQH

SEQ ID NO: 809324 - protein, 419 aa, Homo sapiens [sequence omitted]

SEQ ID NO: 809325 - protein, 610 aa, Homo sapiens
TQKRDLLGAQSSPGSQKALKFRGDFHDEQEQGSLWQDCGSVLPGHRRLPGRVGVRRRPASETWQARMLSILGEKVPDLIVIPRSQEDDAHNVQAVIDSLALDYLQVSLSHITGENIVKGDKESIKNLLEIFDGLLEYLTERISETSHEKSETEQYFKESDRGERLEEPESTKESKSSWKRVSFGRCSLSSEMLGPSWDGDEAESTGEIIRLGDTAHTFSLRSNGAQCPNEMLSKKALASPSSKSHEDMLYPPSVLSKSRTSFVEDTETLSVSGIPNARKLGEPIRAAIPLHPPYHPSEPRAPCPIGKEYLHSSHCSPAVNSTGEHTEFSGDLDDGLFLISKLPKGSKWEVYPAQVQGPRTRKPPKGKRNENRATASSCNSPFPQRPRKRLTEQELHDVSEKLSQRLSELDWMLKSALGDRIKEKTDHKEENTGNEEVEDGTEETLSQHSDGIVEYGPKKSRPGLSMRRKPPYRSHSLSPSPVNKHKQFHLERKRQRKPRETDVRQFQAQAFTEAFERELRRHKVQENIGPLRIHEKEEETEKIYRGEAVRKGTPECSQPWKIYSRKTTTQSLRGGLPKPNKAVPSKNHRIVLYGKLATFESMCNIPRTQH

SEQ ID NO: 809326 - protein, 465 aa, Homo sapiens
MLSSKRESLFLFLHPAALQVLRGRALWSGWALSEGGNFSRCSLSSEMLGPSWDGDEAESTGEIIRLGDTAHTFSLRSNGAQCPNEMLSKKALASPSSKSHEDMLYPPSVLSKSRTSFVEDTETLSVSGIPNARKLGEPIRAAIPLHPPYHPSEPRAPCPIGKEYLHSSHCSPAVNSTGEHTEFSGDLDDGLFLISKLPKGSKWEVYPAQVQGPRTRKPPKGKRNENRATASSCNSPFPQRPRKRLTEQELHDVSEKLSQRLSELDWMLKSALGDRIKEKTDHKEENTGNEEVEDGTEETLSQHSDGIVEYGPKKSRPGLSMRRKPPYRSHSLSPSPVNKHKQFHLERKRQRKPRETDVRQFQAQAFTEAFERELRRHKVQENIGPLRIHEKEEETEKIYRGEAVRKGTPECSQPWKIYSRKTTTQSLRGGLPKPNKAVPSKNHRIVLYGKLATFESMCNIPRTQH

SEQ ID NO: 809327 - protein, 552 aa, Homo sapiens
MAGSDAEWVTIANNLLFKCHIHLRIHELQDCDANVFIALYQSILGEKVPDLIVIPRSQEDDAHNVQAVIDSLALDYLQVSLSHITGENIVKGDKESIKNLLEIFDGLLEYLTERISETSHEKSETEQYFKESDRGERLEEPESTKESKSSWKRVSFGRCSLSSEMLGPSWDGDEAESTGEIIRLGDTAHTFSLRSNGAQCPNEMLSKKALASPSSKSHEDMLYPPSVLSKSRTSFVEDTETLSVSGIPNARKLGEPIRAAIPLHPPYHPSEPRAPCPIGKEYLHSSHCSPAVNSTGEHTEFSGDLDDGLFLISKLPKGSKWEVYPAQVQGPRTRKPPKGKRNENRATASSCNSPFPQRPRKRLTEQELHDVSEKLSQRLSELDWMLKSALGDRIKEKTDHKEENTGNEEVEDGTEETLSQHSDGIVEYGPKKSRPGLSMRRKPPYRSHSLSPSPVNKHKQFHLERKRQRKPRETDVRQFQAQEKIYRGEAVRKGTPECSQPWKIYSRKTTTQSLRGGLPKPNKAVPSKNHRIVLYGKLATFESMCNIPRTQH

SEQ ID NO: 809328 - protein, 418 aa, Homo sapiens
MVLLCHPGWSAVAQSRLTATSASASQAAGITSAQCPNEMLSKKALASPSSKSHEDMLYPPSVLSKSRTSFVEDTETLSVSGIPNARKLGEPIRAAIPLHPPYHPSEPRAPCPIGKEYLHSSHCSPAVNSTGEHTEFSGDLDDGLFLISKLPKGSKWEVYPAQVQGPRTRKPPKGKRNENRATASSCNSPFPQRPRKRLTEQELHDVSEKLSQRLSELDWMLKSALGDRIKEKTDHKEENTGNEEVEDGTEETLSQHSDGIVEYGPKKSRPGLSMRRKPPYRSHSLSPSPVNKHKQFHLERKRQRKPRETDVRQFQAQAFTEAFERELRRHKVQENIGPLRIHEKEEETEKIYRGEAVRKGTPECSQPWKIYSRKTTTQSLRGGLPKPNKAVPSKNHRIVLYGKLATFESMCNIPRTQH

SEQ ID NO: 809329 - protein, 583 aa, Homo sapiens; identical to SEQ ID NO: 809323

SEQ ID NO: 809330 - protein, 199 aa, Homo sapiens
MLKSALGDRIKEKTDHKEENTGNEEVEDGTEETLSQHSDGIVEYGPKKSRPGLSMRRKPPYRSHSLSPSPVNKHKQFHLERKRQRKPRETDVRQFQAQAFTEAFERELRRHKVQENIGPLRIHEKEEETEKIYRGEAVRKGTPECSQPWKIYSRKTTTQSLRGGLPKPNKAVPSKNHRIVLYGKLATFESMCNIPRTQH

SEQ ID NO: 809331 - protein, 233 aa, Homo sapiens
MSKSFPQRPRKRLTEQELHDVSEKLSQRLSELDWMLKSALGDRIKEKTDHKEENTGNEEVEDGTEETLSQHSDGIVEYGPKKSRPGLSMRRKPPYRSHSLSPSPVNKHKQFHLERKRQRKPRETDVRQFQAQAFTEAFERELRRHKVQENIGPLRIHEKEEETEKIYRGEAVRKGTPECSQPWKIYSRKTTTQSLRGGLPKPNKAVPSKNHRIVLYGKLATFESMCNIPRTQH

SEQ ID NO: 809332 - protein, 583 aa, Homo sapiens; identical to SEQ ID NO: 809323

SEQ ID NO: 809333 - protein, 583 aa, Homo sapiens; identical to SEQ ID NO: 809323

SEQ ID NO: 809334 - protein, 583 aa, Homo sapiens; identical to SEQ ID NO: 809323

SEQ ID NO: 809335 - protein, 583 aa, Homo sapiens; identical to SEQ ID NO: 809323

SEQ ID NO: 809336 - protein, 583 aa, Homo sapiens; identical to SEQ ID NO: 809323

SEQ ID NO: 809337 - protein, 200 aa, Homo sapiens
AAVRSVRDGSESRIMVDSSTRGSQHEGSELTQSKIKENRQQIVRARKYYDDYRVQLCAKMMRMRTREEMIFKKLFEEGLNIQKQRLRDLRNYAKEKRDEQRRRHQDELDSMENYYKDQFSLLAEAISQEHQELKAREKSQAQTLHKVKRELRSKMEKEIQQLQDMITQNDDDVFFRELEAERFRSRLQLASFQYSKSPSL

SEQ ID NO: 809338 - protein, 583 aa, Homo sapiens; identical to SEQ ID NO: 809323

SEQ ID NO: 809339 - protein, 583 aa, Homo sapiens; identical to SEQ ID NO: 809323

SEQ ID NO: 809340 - protein, 527 aa, Homo sapiens [sequence omitted]

SEQ ID NO: 809341 - protein, 241 aa, Homo sapiens [sequence omitted]

SEQ ID NO: 809342 - protein, 143 aa, Homo sapiens
MAGSDAEWVTIANNLLFKCHIHLRIHELQDCDANVFIALYQSILGEKVPDLIVIPRSQEDDAHNVQAVIDSLALDYLQVSLSHITGENIVKGDKESIKNLLEIFDGLLEYLTERISETSHEKSLIYTYLAIFPRADQVLQNAS

SEQ ID NO: 809343 - protein, 60 aa, Homo sapiens [sequence omitted]

SEQ ID NO: 809344 - protein, 105 aa, Homo sapiens
MAGVCWSRGAPWGAIDLAPWGQVDCVDHGVSGAAIGESLSVSSTGVSDPRAERMTYVVGTWEHSKFLVHSILMISEYLYARSRILVHASRSYSFGLGSSRHTSEG

SEQ ID NO: 809345 - protein, 60 aa, Homo sapiens [sequence omitted]

SEQ ID NO: 809346 - protein, 132 aa, Homo sapiens
EGRGKGARTRTRKSRATLDRAWEGAPAFALLLQREGRALPRGGVRLVLTLAAEPKVDRGGGLHIPVVALRFLPLSLRAHGGGQSGGDGGARTTRRPVLFLLRTCPARSVSRRPAPGLCSDLALAAPRPSGRS

SEQ ID NO: 809347 - protein, 132 aa, Homo sapiens; identical to SEQ ID NO: 809346

SEQ ID NO: 809348 - protein, 132 aa, Homo sapiens; identical to SEQ ID NO: 809346

SEQ ID NO: 809349 - protein, 132 aa, Homo sapiens; identical to SEQ ID NO: 809346

SEQ ID NO: 809350 - protein, 132 aa, Homo sapiens; identical to SEQ ID NO: 809346

SEQ ID NO: 809351 - protein, 132 aa, Homo sapiens; identical to SEQ ID NO: 809346

SEQ ID NO: 809352 - protein, 132 aa, Homo sapiens; identical to SEQ ID NO: 809346

SEQ ID NO: 809353 - protein, 132 aa, Homo sapiens; identical to SEQ ID NO: 809346

SEQ ID NO: 809354 - protein, 132 aa, Homo sapiens; identical to SEQ ID NO: 809346

SEQ ID NO: 809355 - protein, 136 aa, Homo sapiens
EGRGKGARTRTRKSRATLDRAWEGAPAFALLLQREGRALPRGGVRLVLTLAAEPKVDRGGGLHIPVVALRFLPLSLRAHGGGQSGGDGGARTTRRPVLFLLRTCPARSVSRRPAPGLCSDLALAAPRPTAPEEAGE

SEQ ID NO: 809356 - protein, 82 aa, Homo sapiens
SFLEQFVCVACLVVSDHGLSCGLRNPGHDNAWILINMEALVRNTMLLTKCQIGDLRIVTESNQLGVQGTSTAKLSLVCKCFF

SEQ ID NO: 809357 - protein, 36 aa, Homo sapiens
MNKAIKFDENSCPISDLQGMLMGQLSSGVVLQLYKF

SEQ ID NO: 809358 - protein, 120 aa, Homo sapiens
MVAKQRIRMANEKHSKNITQRGNVAKTSRNAPEEKASVGPWLLALFIFVVCGSGKWLGGSHQVESWVERIWDDVVTGQYESYLRSSQPTCRGLHIILFRLNQITCSTYAQRVVLQKLLPA

SEQ ID NO: 809359 - protein, 89 aa, Homo sapiens
GGDACIYQTEPKVDRGGGLHIPVVALRFLPLSLRAHGGGQSGGDGGARTTRRPVLFLLRTCPARSVSRRPAPGLCSDLALAAPRPSGRS

SEQ ID NO: 809360 - protein, 132 aa, Homo sapiens; identical to SEQ ID NO: 809346

SEQ ID NO: 809361 - protein, 132 aa, Homo sapiens; identical to SEQ ID NO: 809346

SEQ ID NO: 809362 - protein, 142 aa, Homo sapiens
MTVGARLRSKAESSLLRRGPRGRGRTEGDEEAAAILEHLEYADEAEAAAESGTSAADERGPGTRGARRVHFALLPERYEPLEEPAPSEQPRKRYRRKLKKYGKNVGKVIIKGCRYVVIGLQGFAAAYSAPFAVATSVVSFVR

SEQ ID NO: 809363 - protein, 142 aa, Homo sapiens; identical to SEQ ID NO: 809362

SEQ ID NO: 809364 - protein, 142 aa, Homo sapiens; identical to SEQ ID NO: 809362

SEQ ID NO: 809365 - protein, 142 aa, Homo sapiens; identical to SEQ ID NO: 809362

SEQ ID NO: 809366 - protein, 142 aa, Homo sapiens; identical to SEQ ID NO: 809362

SEQ ID NO: 809367 - protein, 101 aa, Homo sapiens
PPPGSAAQARAGGGGGGSGGVGGGNGKAGEGRTQEQRLRVGEAGGEEARRNAAAGFSAALLPLPLLLLLLLPPPAGQRLTGRAALRCRRDASCCCCCCRRP

SEQ ID NO: 809368 - protein, 69 aa, Homo sapiens
AIAGELGSLRSRPAVTWSSGMPRSSLSGCRCPSFVPEYVLNLPARDPEAPSPCLHSDHPPHFQSMREPR

SEQ ID NO: 809369 - protein, 164 aa, Homo sapiens
MLHILSPMYFFLWGSCFFPLSSSDGLSTVTLVGIIVGVLLAIGFIGGIIVVVMRKMSGRYSEVNSLHPCDRQMKAIVSRTQIFELIEISDISWVWWLVPVVSAAGQLQTSLGNIVRPCLKKIISGTMVMFQSSLLGPLECSGSHLESQCFERLRRQEVHLCPGI

SEQ ID NO: 809370 - protein, 162 aa, Homo sapiens
MWKVSALLFVLGSASLWVLAEGASTGQPEDDTETTGLEGGVAMPGAEDDVVTPGTSEDRYKSGLTTLVATSVNSVTGIRIEDLPTSESTVHAQEQSPSATASNVATSHSTEKVDGDTQTTVEKDGLSTVTLVGIIVGVLLAIGFIGGIIVVVMRKMSGRYSP

SEQ ID NO: 809371 - protein, 162 aa, Homo sapiens; identical to SEQ ID NO: 809370

SEQ ID NO: 809372 - protein, 120 aa, Homo sapiens
MPGAEDDVVTPGTSEDRYKSGLTTLVATSVNSVTGIRIEDLPTSESTVHAQEQSPSATASNVATSHSTEKVDGDTQTTVEKDGLSTVTLVGIIVGVLLAIGFIGGIIVVVMRKMSGRYSP

SEQ ID NO: 809373 - protein, 104 aa, Homo sapiens
MNLTPLGTHVATSVNSVTGIRIEDLPTSESTVHAQEQSPSATASNVATSHSTEKVDGDTQTTVEKDGLSTVTLVGIIVGVLLAIGFIGGIIVVVMRKMSGRYSP

SEQ ID NO: 809374 - protein, 251 aa, Homo sapiens
NYTLGTRLGGALFGSALSAAMAQADIALIGLAVMGQNLILNMNDHGFVVCAFNRTVSKVDDFLANEAKGTKVVGAQSLKEMVSKLKKPRRIILLVKAGQAVDDFIEKLVPLLDTGDIIIDGGNSEYRDTTRRCRDLKAKGILFVGSGVSGGEEGARYGPSLMPGGNKEAWPHIKTIFQGIAAKVGTGEPCCDWVGDEGAGHFVKMVHNGIEYGDMQLICEAYHLMKDVLGMAQDEMAQGLEVRLPRLTLPV

SEQ ID NO: 809375 - protein, 109 aa, Homo sapiens
RSFWREPLRVFPSLVLRASPLFGSALSAAMAQADIALIGLAVMGQNLILNMNDHGFVVSGVGALSSLWFPGALAEAGDRFGSLRVSWPCFANVLCCCSWHFCMERRSTL

SEQ ID NO: 809376 - protein, 512 aa, Homo sapiens
RSFWREPLRVFPSLVLRASPLFGSALSAAMAQADIALIGLAVMGQNLILNMNDHGFVVCAFNRTVSKVDDFLANEAKGTKVVGAQSLKEMVSKLKKPRRIILLVKAGQAVDDFIEKLVPLLDTGDIIIDGGNSEYRDTTRRCRDLKAKGILFVGSGVSGGEEGARYGPSLMPGGNKEAWPHIKTIFQGIAAKVGTGEPCCDWVGDEGAGHFVKMVHNGIEYGDMQLICEAYHLMKDVLGMAQDEMAQAFEDWNKTELDSFLIEITANILKFQDTDGKHLLPKIRDSAGQKGTGKWTAISALEYGVPVTLIGEAVFARCLSSLKDERIQASKKLKGPQKFQFDGDKKSFLEDIRKALYASKIISYAQGFMLLRQAATEFGWTLNYGGIALMWRGGCIIRSVFLGKIKDAFDRNPELQNLLLDDFFKSAVENCQDSWRRAVSTGVQAGIPMPCFTTALSFYDGYRHEMLPASLIQAQRDYFGAHTYELLAKPGQFIHTNWTGHGGTVSSSSYNA

SEQ ID NO: 809377 - protein, 512 aa, Homo sapiens; identical to SEQ ID NO: 809376

SEQ ID NO: 809378 - protein, 505 aa, Homo sapiens
QAVPARGVRIASPLFGSALSAAMAQADIALIGLAVMGQNLILNMNDHGFVVCAFNRTVSKVDDFLANEAKGTKVVGAQSLKEMVSKLKKPRRIILLVKAGQAVDDFIEKLVPLLDTGDIIIDGGNSEYRDTTRRCRDLKAKGILFVGSGVSGGEEGARYGPSLMPGGNKEAWPHIKTIFQGIAAKVGTGEPCCDWVGDEGAGHFVKMVHNGIEYGDMQLICEAYHLMKDVLGMAQDEMAQAFEDWNKTELDSFLIEITANILKFQDTDGKHLLPKIRDSAGQKGTGKWTAISALEYGVPVTLIGEAVFARCLSSLKDERIQASKKLKGPQKFQFDGDKKSFLEDIRKALYASKIISYAQGFMLLRQAATEFGWTLNYGGIALMWRGGCIIRSVFLGKIKDAFDRNPELQNLLLDDFFKSAVENCQDSWRRAVSTGVQAGIPMPCFTTALSFYDGYRHEMLPASLIQAQRDYFGAHTYELLAKPGQFIHTNWTGHGGTVSSSSYNA

SEQ ID NO: 809379 - protein, 483 aa, Homo sapiens
MAQADIALIGLAVMGQNLILNMNDHGFVVCAFNRTVSKVDDFLANEAKGTKVVGAQSLKEMVSKLKKPRRIILLVKAGQAVDDFIEKLVPLLDTGDIIIDGGNSEYRDTTRRCRDLKAKGILFVGSGVSGGEEGARYGPSLMPGGNKEAWPHIKTIFQGIAAKVGTGEPCCDWVGDEGAGHFVKMVHNGIEYGDMQLICEAYHLMKDVLGMAQDEMAQAFEDWNKTELDSFLIEITANILKFQDTDGKHLLPKIRDSAGQKGTGKWTAISALEYGVPVTLIGEAVFARCLSSLKDERIQASKKLKGPQKFQFDGDKKSFLEDIRKALYASKIISYAQGFMLLRQAATEFGWTLNYGGIALMWRGGCIIRSVFLGKIKDAFDRNPELQNLLLDDFFKSAVENCQDSWRRAVSTGVQAGIPMPCFTTALSFYDGYRHEMLPASLIQAQRDYFGAHTYELLAKPGQFIHTNWTGHGGTVSSSSYNA

SEQ ID NO: 809380 - protein, 503 aa, Homo sapiens
TRGSTHAVASPLFGSALSAAMAQADIALIGLAVMGQNLILNMNDHGFVVCAFNRTVSKVDDFLANEAKGTKVVGAQSLKEMVSKLKKPRRIILLVKAGQAVDDFIEKLVPLLDTGDIIIDGGNSEYRDTTRRCRDLKAKGILFVGSGVSGGEEGARYGPSLMPGGNKEAWPHIKTIFQGIAAKVGTGEPCCDWVGDEGAGHFVKMVHNGIEYGDMQLICEAYHLMKDVLGMAQDEMAQAFEDWNKTELDSFLIEITANILKFQDTDGKHLLPKIRDSAGQKGTGKWTAISALEYGVPVTLIGEAVFARCLSSLKDERIQASKKLKGPQKFQFDGDKKSFLEDIRKALYASKIISYAQGFMLLRQAATEFGWTLNYGGIALMWRGGCIIRSVFLGKIKDAFDRNPELQNLLLDDFFKSAVENCQDSWRRAVSTGVQAGIPMPCFTTALSFYDGYRHEMLPASLIQAQRDYFGAHTYELLAKPGQFIHTNWTGHGGTVSSSSYNA

SEQ ID NO: 809381 - protein, 512 aa, Homo sapiens; identical to SEQ ID NO: 809376

SEQ ID NO: 809382 - protein, 512 aa, Homo sapiens; identical to SEQ ID NO: 809376

SEQ ID NO: 809383 - protein, 512 aa, Homo sapiens; identical to SEQ ID NO: 809376

SEQ ID NO: 809384 - protein, 512 aa, Homo sapiens; identical to SEQ ID NO: 809376

SEQ ID NO: 809385 - protein, 483 aa, Homo sapiens; identical to SEQ ID NO: 809379

SEQ ID NO: 809386 - protein, 503 aa, Homo sapiens
NYTLGTRLGGALFGSALSAAMAQADIALIGLAVMGQNLILNMNDHGFVVCAFNRTVSKVDDFLANEAKGTKVVGAQSLKEMVSKLKKPRRIILLVKAGQAVDDFIEKLVPLLDTGDIIIDGGNSEYRDTTRRCRDLKAKGILFVGSGVSGGEEGARYGPSLMPGGNKEAWPHIKTIFQGIAAKVGTGEPCCDWVGDEGAGHFVKMVHNGIEYGDMQLICEAYHLMKDVLGMAQDEMAQAFEDWNKTELDSFLIEITANILKFQDTDGKHLLPKIRDSAGQKGTGKWTAISALEYGVPVTLIGEAVFARCLSSLKDERIQASKKLKGPQKFQFDGDKKSFLEDIRKALYASKIISYAQGFMLLRQAATEFGWTLNYGGIALMWRGGCIIRSVFLGKIKDAFDRNPELQNLLLDDFFKSAVENCQDSWRRAVSTGVQAGIPMPCFTTALSFYDGYRHEMLPASLIQAQRDYFGAHTYELLAKPGQFIHTNWTGHGGTVSSSSYNA

SEQ ID NO: 809387 - protein, 506 aa, Homo sapiens
NRKMYEGSYAVCNFSHQGLRRSIVQLADIALIGLAVMGQNLILNMNDHGFVVCAFNRTVSKVDDFLANEAKGTKVVGAQSLKEMVSKLKKPRRIILLVKAGQAVDDFIEKLVPLLDTGDIIIDGGNSEYRDTTRRCRDLKAKGILFVGSGVSGGEEGARYGPSLMPGGNKEAWPHIKTIFQGIAAKVGTGEPCCDWVGDEGAGHFVKMVHNGIEYGDMQLICEAYHLMKDVLGMAQDEMAQAFEDWNKTELDSFLIEITANILKFQDTDGKHLLPKIRDSAGQKGTGKWTAISALEYGVPVTLIGEAVFARCLSSLKDERIQASKKLKGPQKFQFDGDKKSFLEDIRKALYASKIISYAQGFMLLRQAATEFGWTLNYGGIALMWRGGCIIRSVFLGKIKDAFDRNPELQNLLLDDFFKSAVENCQDSWRRAVSTGVQAGIPMPCFTTALSFYDGYRHEMLPASLIQAQRDYFGAHTYELLAKPGQFIHTNWTGHGGTVSSSSYNA

SEQ ID NO: 809388 - protein, 471 aa, Homo sapiens
RSFWREPLRVFPSLVLRASPLFGSALSAAMAQADIALIGLAVMGQNLILNMNDHGFVVCAFNRTVSKVDDFLANEAKGTKVVGAQSLKEMVSKLKKPRRIILLVKAGQAVDDFIEKLVPLLDTGDIIIDGGNSEYRDTTRRCRDLKAKGILFVGSGVSGGEEGARYGPSLMPGGNKEAWPHIKTIFQGIAAKVGTGEPCCDWVGDEGAGHFVKMVHNGIEYGDMQLICEAYHLMKDVLGMAQDEMAQAFEDWNKTELDSFLIEITANILKFQDTDGKHLLPKIRDSAGQKGTGKWTAISALEYGVPVTLIGEAVFARCLSSLKDERIQASKKLKGPQKFQFDGDKKSFLEDIRKALYASKIISYAQGFMLLRQAATEFGWTLNYGGIALMWRGGCIIRSVFLGKIKDAFDRNPELQNLLLDDFFKSAVENCQAQRDYFGAHTYELLAKPGQFIHTNWTGHGGTVSSSSYNA

SEQ ID NO: 809389 - protein, 449 aa, Homo sapiens
PTRRGRVGLANEAKGTKVVGAQSLKEMVSKLKKPRRIILLVKAGQAVDDFIEKLVPLLDTGDIIIDGGNSEYRDTTRRCRDLKAKGILFVGSGVSGGEEGARYGPSLMPGGNKEAWPHIKTIFQGIAAKVGTGEPCCDWVGDEGAGHFVKMVHNGIEYGDMQLICEAYHLMKDVLGMAQDEMAQAFEDWNKTELDSFLIEITANILKFQDTDGKHLLPKIRDSAGQKGTGKWTAISALEYGVPVTLIGEAVFARCLSSLKDERIQASKKLKGPQKFQFDGDKKSFLEDIRKALYASKIISYAQGFMLLRQAATEFGWTLNYGGIALMWRGGCIIRSVFLGKIKDAFDRNPELQNLLLDDFFKSAVENCQDSWRRAVSTGVQAGIPMPCFTTALSFYDGYRHEMLPASLIQAQRDYFGAHTYELLAKPGQFIHTNWTGHGGTVSSSSYNA

SEQ ID NO: 809390 - protein, 490 aa, Homo sapiens
RSFWREPLRVFPSLVLRASPLFGSALSAAMAQADIALIGLAVMGQNLILNMNDHGFVVCAFNRTVSKVDDFLANEAKGTKVVGAQSLKEMVSKLKKPRRIILLVKAGQAVDDFIEKLRRCRDLKAKGILFVGSGVSGGEEGARYGPSLMPGGNKEAWPHIKTIFQGIAAKVGTGEPCCDWVGDEGAGHFVKMVHNGIEYGDMQLICEAYHLMKDVLGMAQDEMAQAFEDWNKTELDSFLIEITANILKFQDTDGKHLLPKIRDSAGQKGTGKWTAISALEYGVPVTLIGEAVFARCLSSLKDERIQASKKLKGPQKFQFDGDKKSFLEDIRKALYASKIISYAQGFMLLRQAATEFGWTLNYGGIALMWRGGCIIRSVFLGKIKDAFDRNPELQNLLLDDFFKSAVENCQDSWRRAVSTGVQAGIPMPCFTTALSFYDGYRHEMLPASLIQAQRDYFGAHTYELLAKPGQFIHTNWTGHGGTVSSSSYNA

SEQ ID NO: 809391 - protein, 528 aa, Homo sapiens
RSFWREPLRVFPSLVLRASPLFGSALSAAMAQADIALIGLAVMGQNLILNMNDHGFVVCAFNRTVSKVDDFLANEAKGTKVVGAQSLKEMVSKLKKPRRIILLVKAGQAVDDFIEKLVPLLDTGDIIIDGGNSEYRDTTRRCRDLKAKGILFVGSGVSGGEEGARYGPSLMPGGNKEAWPHIKTIFQGIAAKVGTGEPCCDWVGDEGAGHFVKMVHNGIEYGDMQLICEAYHLMKDVLGMAQDEMAQAFEDWNKTELDSFLIEITANILKFQDTDGKHLLPKIRDSAGQKGTGKWTAISALEYGVPVTLIGEAVFARCLSSLKDERIQASKKLKGPQKFQFDGDKKSFLEDIRKALYASKIISYAQGFMLLRQAATEFGWTLNYGGIALMWRGGCIIRSVFLGKIKDAFDRNPELQNLLLDDFFKSAVENCQDSWRRAVSTGVQAGIPMPCFTTALSFYDGYRHEMLPASLIQAQRDYFGAHTYELLAKPGQFIHTNWTGHGGTVSSSSYNAFALFSVQFFKSVVRDS

SEQ ID NO: 809392 - protein, 299 aa, Homo sapiens
MVHNGIEYGDMQLICEAYHLMKDVLGMAQDEMAQAFEDWNKTELDSFLIEITANILKFQDTDGKHLLPKIRDSAGQKGTGKWTAISALEYGVPVTLIGEAVFARCLSSLKDERIQASKKLKGPQKFQFDGDKKSFLEDIRKALYASKIISYAQGFMLLRQAATEFGWTLNYGGIALMWRGGCIIRSVFLGKIKDAFDRNPELQNLLLDDFFKSAVENCQDSWRRAVSTGVQAGIPMPCFTTALSFYDGYRHEMLPASLIQAQRDYFGAHTYELLAKPGQFIHTNWTGHGGTVSSSSYNA

SEQ ID NO: 809393 - protein, 367 aa, Homo sapiens
RSFWREPLRVFPSLVLRASPLFGSALSAAMAQADIALIGLAVMGQNLILNMNDHGFVVGDEGAGHFVKMVHNGIEYGDMQLICEAYHLMKDVLGMAQDEMAQAFEDWNKTELDSFLIEITANILKFQDTDGKHLLPKIRDSAGQKGTGKWTAISALEYGVPVTLIGEAVFARCLSSLKDERIQASKKLKGPQKFQFDGDKKSFLEDIRKALYASKIISYAQGFMLLRQAATEFGWTLNYGGIALMWRGGCIIRSVFLGKIKDAFDRNPELQNLLLDDFFKSAVENCQDSWRRAVSTGVQAGIPMPCFTTALSFYDGYRHEMLPASLIQAQRDYFGAHTYELLAKPGQFIHTNWTGHGGTVSSSSYNA

SEQ ID NO: 809394 - protein, 369 aa, Homo sapiens
KDLLRAQGLGDIIDTSMGSLTSSPSSCSLSSQVGLTSVTSIQERIMSTPGGEEAIERLKVGDEGAGHFVKMVHNGIEYGDMQLICEAYHLMKDVLGMAQDEMAQAFEDWNKTELDSFLIEITANILKFQDTDGKHLLPKIRDSAGQKGTGKWTAISALEYGVPVTLIGEAVFARCLSSLKDERIQASKKLKGPQKFQFDGDKKSFLEDIRKALYASKIISYAQGFMLLRQAATEFGWTLNYGGIALMWRGGCIIRSVFLGKIKDAFDRNPELQNLLLDDFFKSAVENCQDSWRRAVSTGVQAGIPMPCFTTALSFYDGYRHEMLPASLIQAQRDYFGAHTYELLAKPGQFIHTNWTGHGGTVSSSSYNA

SEQ ID NO: 809395 - protein, 471 aa, Homo sapiens; identical to SEQ ID NO: 809388

SEQ ID NO: 809396 - protein, 480 aa, Homo sapiens
RSFWREPLRVFPSLVLRASPLFGSALSAAMAQADIALIGLAVMGQNLILNMNDHGFVVCAFNRTVSKVDDFLANEAKGTKVVGAQSLKEMVSKLKKPRRIILLVKAGQAVDDFIEKLVPLLDTGDIIIDGGNSEYRDTTRRCRDLKAKGILFVGSGVSGGEEGARYGPSLMPGGNKEAWPHIKTIFQGIAAKVGTGEPCCDWVGDEGAGHFVKMVHNGIEYGDMQLICEAYHLMKDVLGMAQDEMAQAFEDWNKTELDSFLIEITANILKFQDTDGKHLLPKIRDSAGQKGTGKWTAISALEYGVPVTLIGEAVFARCLSSLKDERIQASKKLKGPQKFQFDGDKKSFLEDIRKALYASKIISYAQGFMLLRQAATEFGWTLNYGGIALMWRGGCIIRSVFWTDPACLDRNENSELLRQTPKLQLVKPARTPGRETQTGRQALNPMPVTHGTRLTKEHKQQGSGSHYGTRKTGDTTNVDK

SEQ ID NO: 809397 - protein, 144 aa, Homo sapiens [sequence omitted]

SEQ ID NO: 809398 - protein, 196 aa, Homo sapiens
GEFGTRERERERTSKKLKGPQKFQFDGDKKSFLEDIRKALYASKIISYAQGFMLLRQAATEFGWTLNYGGIALMWRGGCIIRSVFLGKIKDAFDRNPELQNLLLDDFFKSAVENCQDSWRRAVSTGVQAGIPMPCFTTALSFYDGYRHEMLPASLIQAQRDYFGAHTYELLAKPGQFIHTNWTGHGGTVSSSSYNA

SEQ ID NO: 809399 - protein, 326 aa, Homo sapiens
RSFWREPLRVFPSLVLRASPLFGSALSAAMAQADIALIGLAVMGQNLILNMNDHGFVVCAFNRTVSKVDDFLANEAKGTKVVGAQSLKEMVSKLKKPRRIILLVKAGQAVDDFIEKLVPLLDTGDIIIDGGNSEYRDTTRRCRDLKAKGILFVGSGVSGGEEGARYGPSLMPGGNKEAWPHIKTIFQGIAAKVGTGEPCCDWVGDEGAGHFVKMVHNGIEYGDMQLICEAYHLMKDVLGMAQDEMAQAFEDWNKTELDSFLIEITANILKFQDTDGKHLLPKIRDSAKARNGRIRLDKVRPLGSGWPGSPEGEIRKRAHPVVKPGG

SEQ ID NO: 809400 - protein, 112 aa, Homo sapiens
GVPAEFGIFDRNPELQNLLLDDFFKSAVENCQDSWRRAVSTGVQAGIPMPCFTTALSFYDGYRHEMLPASLIQAQRDYFGAHTYELLAKPGQFIHTNWTGHGGTVSSSSYNA

SEQ ID NO: 809401 - protein, 155 aa, Homo sapiens
RSFWREPLRVFPSLVLRASPLFGSALSAAMAQADIALIGLAVMGQNLILNMNDHGFVPVLPLPSPSMTGTDMRCFQPASSRLSGITSGLTPMNSWPNQGSLSTPTGQAMVAPCHPRHTMPDHAAPVTLHDSTDQDIPCASWHCHLALCPIFCSVF

SEQ ID NO: 809402 - protein, 253 aa, Homo sapiens
RSFWREPLRVFPSLVLRASPLFGSALSAAMAQADIALIGLAVMGQNLILNMNDHGFVVCAFNRTVSKVDDFLANEAKGTKVVGAQSLKEMVSKLKKPRRIILLVKAGQAVDDFIEKLVPLLDTGDIIIDGGNSEYRDTTRRCRDLKAKGILFVGSGVSGGEEGARYGPSLMPGGNKEAWPHIKTIFQGIAAKVGTGEPCCDWVGDEGAGHFVKMVHNGIEYGDMQLICEAYHLMKDVLGMAQDEMAQALASWD

SEQ ID NO: 809403 - protein, 231 aa, Homo sapiens
RSFWREPLRVFPSLVLRASPLFGSALSAAMAQADIALIGLAVMGQNLILNMNDHGFVVCAFNRTVSKVDDFLANEAKGTKVVGAQSLKEMVSKLKKPRRIILLVKAGQAVDDFIEKLRRCRDLKAKGILFVGSGVSGGEEGARYGPSLMPGGNKEAWPHIKTIFQGIAAKVGTGEPCCDWVGDEGAGHFVKMVHNGIEYGDMQLICEAYHLMKDVLGMAQDEMAQALASWD

SEQ ID NO: 809404 - protein, 110 aa, Homo sapiens
MVHNGIEYGDMQLICEAYHLMKDVLGMAQDEMAQGEAPALPLCPFCRECSLCHRHRIFSSFLSPWPFGWPAWTQPNLRETVSNRPIHYASQSLSRKSPQSLGGYHHHHLA

SEQ ID NO: 809405 - protein, 380 aa, Homo sapiens
MGSGCRIECIFFSEFHPTLGPKITYQVPEDFISRELFDTVQVYIITKPELQNKLITVTAMEKKLIGCPVCIEHKKYSRNALLFNLGFVCDAQAKTCALEPIVKKLAGYLTTLELESSFVSMEESKQKLVPIMTILLEELNASGRCTLPIDESNTIHLKVIEQRPDPPVAQEYDVPVFTKDKEDFFNSQWDLTTQQILPYIDGFRHIQKISAEADVELNLVRIAIQNLLYYGVVTLVSILQYSNVYCPTPKVQDLVDDKSLQEACLSYVTKQGHKRASLRDVFQLYCSLSPGTTVRDLIGRHPQQLQHVDERKLIQFGLMKNLIRRLQKYPVRVTREEQSHPARLYTGCHSYDEICCKTGMSYHELDERLENDPNIIICWK

SEQ ID NO: 809406 - protein, 380 aa, Homo sapiens; identical to SEQ ID NO: 809405

SEQ ID NO: 809407 - protein, 334 aa, Homo sapiens
MEESKQKLVPIMTILLEELNASGRCTLPIDESNTIHLKVIEQRPDPPVAQEYDVPVFTKDKEDFFNSQWDLTTQQILPYIDGFRHIQKISAEADVELNLVRIAIQNLLYYGVVTLVSILQYSNVYCPTPKVQDLVDDKSLQEACLSYVTKQGHKRASLRDVFQLYCSLSPGTTVRDLIGRHPQQLQHVDERSEENLLGHLGVTSGKLDPLCLSGALDHGALPIQAGFLEMMGYRDKIEGRLQERVGLPERRPGQGVTPSSDPHPRKLIQFGLMKNLIRRLQKYPVRVTREEQSHPARLYTGCHSYDEICCKTGMSYHELDERLENDPNIIICWK

SEQ ID NO: 809408 - protein, 436 aa, Homo sapiens
MRRSPFVLHPVQMSTDGAHCHSPPQVPEDFISRELFDTVQVYIITKPELQNKLITVTAMEKKLIGCPVCIEHKKYSRNALLFNLGFVCDAQAKTCALEPIVKKLAGYLTTLEICNEMGLGLPTGRVGEGVPMSPKSPKPGTLQTSSGLRAANQPGVLGCAHHAFHALSSLESSFVSMEESKQKLVPIMTILLEELNASGRCTLPIDESNTIHLKVIEQRPDPPVAQEYDVPVFTKDKEDFFNSQWDLTTQQILPYIDGFRHIQKISAEADVELNLVRIAIQNLLYYGVVTLVSILQYSNVYCPTPKVQDLVDDKSLQEACLSYVTKQGHKRASLRDVFQLYCSLSPGTTVRDLIGRHPQQLQHVDERKLIQFGLMKNLIRRLQKYPVRVTREEQSHPARLYTGCHSYDEICCKTGMSYHELDERLENDPNIIICWK

SEQ ID NO: 809409 - protein, 379 aa, Homo sapiens
MRRSPFVLHPVQMSTDGAHCHSPPQVPEDFISRELFDTVQVYIITKPELQNKLITVTAMEKKLIGCPVCIEHKKYSRNALLFNLGFVCDAQAKTCALEPIVKKLAGYLTTLELESSFVSMEESKQKLVPIMTILLEELNASGRCTLPIDESNTIHLKVIEQRPDPPVAQEYDVPVFTKDKEDFFNSQWDLTTQQILPYIDGFRHIQKISAEADVELNLVRIAIQNLLYYGVVTLVSILQYSNVYCPTPKVQDLVDDKSLQEACLSYVTKQGHKRASLRDVFQLYCSLSPGTTVRDLIGRHPQQLQHVDERKLIQFGLMKNLIRRLQKYPVRVTREEQSHPARLYTGCHSYDEICCKTGMSYHELDERLENDPNIIICWK

SEQ ID NO: 809410 - protein, 504 aa, Homo sapiens
MRRSPFVLHPVQMSTDGAHCHSPPQVPEDFISRELFDTVQVYIITKPELQNKLITVTAMEKKLIGCPVCIEHKKYSRNALLFNLGFVCDAQAKTCALEPIVKKLAGYLTTLELESSFVSMEESKQKLVPIMTILLEELNASGRCTLPIGMASLCKDSRGVEERWESEPSYVREKGKTHEHIGGQEIAWAEVPMSRVQCMMELGLGVGGKQSSPALPLGQSFPFVGLRFSLHKKRKISSYPEAPACPKGCWEAWMVIEDLLEEVALRIWMGPPADESNTIHLKVIEQRPDPPVAQEYDVPVFTKDKEDFFNSQWDLTTQQILPYIDGFRHIQKISAEADVELNLVRIAIQNLLYYGVVTLVSILQYSNVYCPTPKVQDLVDDKSLQEACLSYVTKQGHKRASLRDVFQLYCSLSPGTTVRDLIGRHPQQLQHVDERKLIQFGLMKNLIRRLQKYPVRVTREEQSHPARLYTGCHSYDEICCKTGMSYHELDERLENDPNIIICWK

SEQ ID NO: 809411 - protein, 378 aa, Homo sapiens
MEKKLIGCPVCIEHKKYSRNALLFNLGFVCDAQAKTCALEPIVKKLAGYLTTLEICNEMGLGLPTGRVGEGVPMSPKSPKPGTLQTSSGLRAANQPGVLGCAHHAFHALSSLESSFVSMEESKQKLVPIMTILLEELNASGRCTLPIDESNTIHLKVIEQRPDPPVAQEYDVPVFTKDKEDFFNSQWDLTTQQILPYIDGFRHIQKISAEADVELNLVRIAIQNLLYYGVVTLVSILQYSNVYCPTPKVQDLVDDKSLQEACLSYVTKQGHKRASLRDVFQLYCSLSPGTTVRDLIGRHPQQLQHVDERKLIQFGLMKNLIRRLQKYPVRVTREEQSHPARLYTGCHSYDEICCKTGMSYHELDERLENDPNIIICWK

SEQ ID NO: 809412 - protein, 321 aa, Homo sapiens [sequence omitted]

SEQ ID NO: 809413 - protein, 169 aa, Homo sapiens
MRRSPFVLHPVQMSTDGAHCHSPPQVPEDFISRELFDTVQVYIITKPELQNKLITVTAMEKKLIGCPVCIEHKKYSRNALLFNLGFVCDAQAKTCALEPIVKKLAGYLTTLELESSFVSMEESKQKLVPIMTILLEELNASGRCTLPIGMASLCKDSRGVEERWESEPS

SEQ ID NO: 809414 - protein, 436 aa, Homo sapiens; identical to SEQ ID NO: 809408

SEQ ID NO: 809415 - protein, 510 aa, Homo sapiens
MRRSPFVLHPVQMSTDGAHCHSPPQVPEDFISRELFDTVQVYIITKPELQNKLITVTAMEKKLIGCPVCIEHKKYSRNALLFNLGFVCDAQAKTCALEPIVKKLAGYLTTLEICNEMGLGLPTGRVGEGVPMSPKSPKPGTLQTSSGLRAANQPGVLGCAHHAFHALSSLESSFVSMEESKQKLVPIMTILLEELNASGRCTLPIDESNTIHLKVIEQRPDPPVAQEYDVPVFTKDKEDFFNSQWDLTTQQILPYIDGFRHIQKISAEADVELNLVRIAIQNLLYYGVVTLVSILQYSNVYCPTPKVQDLVDDKSLQEACLSYVTKQGHKRASLRDVFQLYCSLSPGTTVRDLIGRHPQQLQHVDERSEENLLGHLGVTSGKLDPLCLSGALDHGALPIQAGFLEMMGYRDKIEGRLQERVGLPERRPGQGVTPSSDPHPRKLIQFGLMKNLIRRLQKYPVRVTREEQSHPARLYTGCHSYDEICCKTGMSYHELDERLENDPNIIICWK

SEQ ID NO: 809416 - protein, 436 aa, Homo sapiens; identical to SEQ ID NO: 809408

SEQ ID NO: 809417 - protein, 277 aa, Homo sapiens
MSTDGAHCHSPPQVPEDFISRELFDTVQVYIITKPELQNKLITVTAMEKKLIGCPVCIEHKKYSRNALLFNLGFVCDAQAKTCALEPIVKKLAGYLTTLELESSFVSMEESKQKLVPIMTILLEELNASGRCTLPIDESNTIHLKVIEQRPDPPVAQEYDVPVFTKDKEDFFNSQWDLTTQQILPYIDGFRHIQKISAEADVELNLVRIAIQNLLYYGVVTLVSILQYSNVYCPTPKVQDLVDDKSLQEACLSYVTKQGSGGFWGKPSWGGQGHMMS

SEQ ID NO: 809418 - protein, 436 aa, Homo sapiens; identical to SEQ ID NO: 809408

SEQ ID NO: 809419 - protein, 324 aa, Homo sapiens
MSTDGAHCHSPPQVPEDFISRELFDTVQVYIITKPELQNKLITVTAMEKKLIGCPVCIEHKKYSRNALLFNLGFVCDAQAKTCALEPIVKKLAGYLTTLEICNEMGLGLPTGRVGEGVPMSPKSPKPGTLQTSSGLRAANQPGVLGCAHHAFHALSSLESSFVSMEESKQKLVPIMTILLEELNASGRCTLPIDESNTIHLKVIEQRPDPPVAQEYDVPVFTKDKEDFFNSQWDLTTQQILPYIDGFRHIQKISAEADVELNLVRIAIQNLLYYGVVTLVSILQEADPVRAYEEPHQATTEVSCAGDSGRAEPPCPALYRLPQL

SEQ ID NO: 809420 - protein, 277 aa, Homo sapiens
MSTDGAHCHSPPQVPEDFISRELFDTVQVYIITKPELQNKLITVTAMEKKLIGCPVCIEHKKYSRNALLFNLGFVCDAQAKTCALEPIVKKLAGYLTTLEICNEMGLGLPTGRVGEGVPMSPKSPKPGTLQTSSGLRAANQPGVLGCAHHAFHALSSLESSFVSMEESKQKLVPIMTILLEELNASGRCTLPIDESNTIHLKVIEQRPDPPVAQEYDVPVFTKDKEDFFNSQWDLTTQQILPYIDGFRHIQKISAEADVELNLVLRRCDTGVHPPGS

SEQ ID NO: 809421 - protein, 435 aa, Homo sapiens
MSTDGAHCHSPPQVPEDFISRELFDTVQVYIITKPELQNKLITVTAMEKKLIGCPVCIEHKKYSRNALLFNLGFVCDAQAKTCALEPIVKKLAGYLTTLEICNEMGLGLPTGRVGEGVPMSPKSPKPGTLQTSSGLRAANQPGVLGCAHHAFHALSSLESSFVSMEESKQKLVPIMTILLEELNASGRCTLPIDESNTIHLKVIEQRPDPPVAQEYDVPVFTKDKEDFFNSQWDLTTQQILPYIDGFRHIQKISAEADVELNLVRIAIQNLLYYGVVTLVSILQYSNVYCPTPKVQDLVDDKSLQEACLSYVTKQGHKRASLRDVFQLYCSLSPGTTVRDLIGRHPQQLQHVDERKLIQFGLMKNLIRRLQKYPVRVTREEQSHPARLYTGCHSYDEICCKTGGGRRAVRVGSGQGGQAKATDLSSTTPPRHELP

SEQ ID NO: 809422 - protein, 277 aa, Homo sapiens; identical to SEQ ID NO: 809417

SEQ ID NO: 809423 - protein, 300 aa, Homo sapiens
MSTDGAHCHSPPQVPEDFISRELFDTVQVYIITKPELQNKLITVTAMEKKLIGCPVCIEHKKYSRNALLFNLGFVCDAQAKTCALEPIVKKLAGYLTTLELESSFVSMEESKQKLVPIMTILLEELNASGRCTLPIDESNTIHLKVIEQRPDPPVAQEYDVPVFTKDKEDFFNSQWDLTTQQILPYIDGFRHIQKISAEADVELNLVRIAIQNLLYYGVVTLVSILQYSNVYCPTPKVQDLVDDKSLQEACLSYVTKQGHKRASLRDVFHYDEICCKTGMSYHELDERLENDPNIIICWK

SEQ ID NO: 809424 - protein, 272 aa, Homo sapiens
MSTDGAHCHSPPQVPEDFISRELFDTVQVYIITKPELQNKLITVTAMEKKLIGCPVCIEHKKYSRNALLFNLGFVCDAQAKTCALEPIVKKLAGYLTTLEICNEMGLGLPTGRVGEGVPMSPKSPKPGTLQTSSGLRAANQPGVLGCAHHAFHALSSLESSFVSMEESKQKLVPIMTILLEELNASGRCTLPIDESNTIHLKVIEQRPDPPVAQEYDVPVFTKDKEDFFNSQWDLTTQQILPYIDGFRHIQKISAEADVELNLVRIAIQNLL

SEQ ID NO: 809425 - protein, 272 aa, Homo sapiens; identical to SEQ ID NO: 809424

SEQ ID NO: 809426 - protein, 311 aa, Homo sapiens
MSNPSAPPPYEDRNPLYPGPLPPGGYGQPSVLPGGYPAYPGYPQPGYGHPAGYPQPMPPTHPMPMNYGPGHGYDGEERAVSDSFGPGEWDDRKVRHTFIRKVYSIISVQLLITVAIIAIFTFVEPVSAFVRRNVAVYYVSYAVFVVTYLILACCQGPRRRFPWNIILLTLFTFAMGFMTGTISSMYQTKAVIIAMIITAVVSISVTIFCFQTKVDFTSCTGLFCVLGIVLLVTGIVTSIVLYFQYVYWLHMLYAALGAICFTLFLAYDTQLVLGNRKHTISPEDYITGALQIYTDIIYIFTFVLQLMGDRN

SEQ ID NO: 809427 - protein, 343 aa, Homo sapiens
MARYEACVYFGRGSPLPPGGYGQPSVLPGGYPAYPGYPQPGYGHPAGYPQPMPPTHPMPMNYGPGHGYDGEERAVSDSFGPGEWDDRKVRHTFIRKVYSIISVQLLITVAIIAIFTFVEPVSAFVRRNVAVYYVSYAVFVVTYLILACCQGPRRRFPWNIILLTLFTFAMGFMTGTISSMYQTKAVIIAMIITAVVSISVTIFCFQTKVDFTSCTGLFCVLGIVLLVTGIVTSIVLYFQYVYWLHMLYAALGAICFTLFLLTTHQLVWAPEATEAGVTYWACGFPASLISLGGVVGSPRGALSRLGPPRRGPGGGVALPWKRAVGGSPGVWGRAPWGGESPAP

SEQ ID NO: 809428 - protein, 309 aa, Homo sapiens
MSNPSAPPPYEDRNPLYPGPLPPGGYGQPSVLPGGYPAYPGYPQPGYGHPAGYPQPMPPTHPMPMNYGPGHGYDGEERAVSDSFGPGEWDDRKVRHTFIRKVYSIISVQLLITVAIIAIFTFVEPVSAFVRRNVAVYYVSYAVFVVTYLILACCQGPRRRYPWNIILLTHYNLYANGHFMTGNHFQYVHTKADHHCNDHTTAGGNPYQSTIITGFKTKGGIHLVTRPLCVLWTWCPSITWHRSHSTRALRPKRPARGTPTRDKTQTGAAHRATPGPGRHKTHRAPWRAAERTMTPRGIIQRGPQQGQPR

SEQ ID NO: 809429 - protein, 178 aa, Homo sapiens
LWVRAGAPGCRIQQCPGTETAEYQLIVRRNVAVYYVSYAVFVVTYLILACCQGPRRRFPWNIILLTLFTFAMGFMTGTISSMYQTKAVIIAMIITAVVSISVTIFCFQTKVDFTSCTGLFCVLGIVLLVTGIVTSIVLYFQYVYWLHMLYAALGAICFTLFLAHYNCAAVSYDSATAL

SEQ ID NO: 809430 - protein, 41 aa, Homo sapiens
MGAEYFGKKDSFIAAEWKLTRNEEEDDDDSYCSGVYKGPCV

SEQ ID NO: 809431 - protein, 122 aa, Homo sapiens
GREHGSGAEEEVHIASEPGISLGSPLGQAAAREGSGVGGKYWGLAASWGRPGVPDGDPCPAVCVQVYSIISVQLLITVAIIAIFTFVEPVSAFVRRNVAVYYVSYAVFVVTYLILACCQGPR

SEQ ID NO: 809432 - protein, 311 aa, Homo sapiens; identical to SEQ ID NO: 809426

SEQ ID NO: 809433 - protein, 311 aa, Homo sapiens; identical to SEQ ID NO: 809426

SEQ ID NO: 809434 - protein, 275 aa, Homo sapiens
RGAEPQPSLALPGPGGLATLRGQERSVWNGAGPGHGYDGEERAVSDSFGPGEWDDRKVRHTFIRKVYSIISVQLLITVAIIAIFTFVEPVSAFVRRNVAVYYVSYAVFVVTYLILACCQGPRRRFPWNIILLTLFTFAMGFMTGTISSMYQTKAVIIAMIITAVVSISVTIFCFQTKVDFTSCTGLFCVLGIVLLVTGIVTSIVLYFQYVYWLHMLYAALGAICFTLFLAYDTQLVLGNRKHTISPEDYITGALQIYTDIIYIFTFVLQLMGDRN

SEQ ID NO: 809435 - protein, 137 aa, Homo sapiens
MGFMTGTISSMYQTKAVIIAMIITAVVSISVTIFCFQTKVDFTSCTGLFCVLGIVLLVTGIVTSIVLYFQYVYWLHMLYAALGAICFTLFLAYDTQLVLGNRKHTISPEDYITGALQIYTDIIYIFTFVLQLMGDRN

SEQ ID NO: 809436 - protein, 208 aa, Homo sapiens
LWVRAGAPGCRIQQCPGTETAEYQLIVRRNVAVYYVSYAVFVVTYLILACCQGPRRRFPWNIILLTLFTFAMGFMTGTISSMYQTKAVIIAMIITAVVSISVTIFCFQTKVDFTSCTGLFCVLGIVLLVTGIVTSIVLYFQYVYWLHMLYAALGAICFTLFLAYDTQLVLGNRKHTISPEDYITGALQIYTDIIYIFTFVLQLMGDRN

SEQ ID NO: 809437 - protein, 81 aa, Homo sapiens
AEVSYTKLFCPLLLQVYWLHMLYAALGAICFTLFLAYDTQLVLGNRKHTISPEDYITGALQIYTDIIYIFTFVLQLMGDRN

SEQ ID NO: 809438 - protein, 87 aa, Homo sapiens
RQAIPHQAVAGIVTSIVLYFNVYWLHMLYAALGAICFTLFLAYDTQLVLGNRKHTISPEDYITGALQIYTDIIYIFTFVLQLMGDRN

SEQ ID NO: 809439 - protein, 82 aa, Homo sapiens
YRCNRCTGSIRMNFTSIYEWAGTLAGPGEPEAHHQPRGLHHWRPADLHRHHLHLHLCAAADGGSQLRSKPPFSPDPGLSLPS

SEQ ID NO: 809440 - protein, 311 aa, Homo sapiens; identical to SEQ ID NO: 809426

SEQ ID NO: 809441 - protein, 311 aa, Homo sapiens; identical to SEQ ID NO: 809426

SEQ ID NO: 809442 - protein, 102 aa, Homo sapiens
DEYAYDIKEPTIMSNACLTATRGGEKCSWSYFFPQQSQRALSPASWTHRPLSCIPLAWHLLAQEGRRDLCPWVSLLQSLLVSVTYVLFIWVRDGGQIIERAK

SEQ ID NO: 809443 - protein, 155 aa, Homo sapiens
TAGTGGWDDGGGARAPQQSQRAGAPSATQSPDLGGRGRGSERRKGEESGAHGAPGGNPGGGQGQREGGAGGGTDNRTSKVTYTGQHGTASPLGLLLACDAIRQSRPHVAICSPFLKAAGASLQASGSLVRVNSCFLYSGSSEQKVRGRVIRVARK

SEQ ID NO: 809444 - protein, 311 aa, Homo sapiens; identical to SEQ ID NO: 809426

SEQ ID NO: 809445 - protein, 104 aa, Homo sapiens
MSNPSAPPPYEDRNPLYPGPLPPGGYGQPSVLPGGYPAYPGYPQPGYGHPAGYPQPMPPTHPMPMNYECLGVPHLAREIPKPTVVLKTSGFFPSANPGRVLRGR

SEQ ID NO: 809446 - protein, 311 aa, Homo sapiens; identical to SEQ ID NO: 809426

SEQ ID NO: 809447 - protein, 348 aa, Homo sapiens
MSNPSAPPPYEDRNPLYPGPLPPGGYGQPSVLPGGYPAYPGYPQPGYGHPAGYPQPMPPTHPMPMNYGPGHGYDGEERAVSDSFGPGEWDDRKVRHTFIRKVYSIISVQLLITVAIIAIFTFVEPVSAFVRRNVAVYYVSYAVFVVTYLILACCQGPRRRFPWNIILLTLFTFAMGFMTGTISSMYQTKAVIIAMIITAVVSISVTIFCFQTKVDFTSCTGLFCVLGIVLLVTGIVTSIVLYFQYVYWLHMLYAALGAICFTLFLLTTHQLVWAPEATEAGVTYWACGFPASLISLGGVVGSPRGALSRLGPPRRGPGGGVALPWKRAVGGSPGVWGRAPWGGESPAP

SEQ ID NO: 809448 - protein, 282 aa, Homo sapiens
MSNPSAPPPYEDRNPLYPGPLPPGGYGQPSVLPGGYPAYPGYPQPGYGHPAGYPQPMPPTHPMPMNYGPGHGYDGEERAVSDSFGPGEWDDRKVRHTFIRKVYSIISVQLLITVAIIAIFTFVEPVSAFVRRNVAVYYVSYAVFVVTYLILACCQGPRRRFPWNIILLTLFTFAMGFMTGTISSMYQTKAVIIAMIITAVVSISVTIFCFQTKVDFTSCTGLFCVLGIVLLVTGIVTSIVLYFQYVYWLHMLYAALGAICFTLFLAHYNCAAVSYDSATALQ

SEQ ID NO: 809449 - protein, 309 aa, Homo sapiens; identical to SEQ ID NO: 809428

SEQ ID NO: 809450 - protein, 331 aa, Homo sapiens
SRAFERARKSPSKRPLQAAGGPGKRRRLRAKQPPPTQLHTSQTHTSKNANPAAPTSGLSAPAPAAPRGRGDARGRRDSPAPGRPEGAPGREGLQTAASARGNRQTPAFVAPAPRPYPADGCSAPARGGGPRAEDRGGLALFVTGEVRGPLAVGAGGERRPVASREVLQVELDVHVFALLPGRQRHIVGDQLTLQLVFCQDRGVFQELRHLGDLRSPLPTAFAAAAHAGALAPGRGPRCRLRASRLLPGKSAAERNKNSRTQSQARPGHKRPQSRTTNQLRPSWKLAPTPAHTLQAGGEQPASPTPQERAPPLAGDGRKRGGDWRDGSRGFH

SEQ ID NO: 809451 - protein, 331 aa, Homo sapiens; identical to SEQ ID NO: 809450

SEQ ID NO: 809452 - protein, 300 aa, Homo sapiens
SRAFERARKSPSKRPLQAAGGPGKRRRLRAKQPPPTQLHTSQTHTSKNANPAAPTSGLSAPAPAAPRGRGDARGRRDSPAPGRPEGAPGREGLQTAASARGNRQTPAFVAPAPRPYPADGCSAPARGGGPRAEDRGGLALFVTGEVRGPLAVGAGGERRPVASREVLQDRGVFQELRHLGDLRSPLPTAFAAAAHAGALAPGRGPRCRLRASRLLPGKSAAERNKNSRTQSQARPGHKRPQSRTTNQLRPSWKLAPTPAHTLQAGGEQPASPTPQERAPPLAGDGRKRGGDWRDGSRGFH

SEQ ID NO: 809453 - protein, 227 aa, Homo sapiens
SRAFERARKSPSKRPLQAAGGPGKRRRLRAKQPPPTQLHTSQTHTSKNANPAAPTSGLSAPAPAAPRGRGDARGRRDSPAPGRPEGAPGREGLQTAASARGNRQTPAFVAPAPRPYPADGAHAGALAPGRGPRCRLRASRLLPGKSAAERNKNSRTQSQARPGHKRPQSRTTNQLRPSWKLAPTPAHTLQAGGEQPASPTPQERAPPLAGDGRKRGGDWRDGSRGFH

SEQ ID NO: 809454 - protein, 331 aa, Homo sapiens; identical to SEQ ID NO: 809450

SEQ ID NO: 809455 - protein, 234 aa, Homo sapiens
MWAHESIHLSTCTRECSDRYLDIKFGHQVTEKHKHHPGTRRHMPIASHRPRQEVPPQTLPQTLPHPLGPLALAPRFSAEISPGPPAVSLAPTNTGVHTQRTCIETHDTSFHLGVTVGWRQPPPPQHLRPKDTPVPGAQPPPGPRPWPTQLRERPSPEPPPPGLGLPGSKTPALPARPRVGWMGPKAQPHTPFPSTCHLPIPFRFVGFFVFPDCSGHSPRSRAPAPGFCLDIASP

SEQ ID NO: 809456 - protein, 95 aa, Homo sapiens
CCRGLAAGEASPGGGGSVTGPPRQQDPGTPRQAQGGVDGPKGPAPHSFPVHLSPTYPLSVCWVFRLSRLQWTQPPISSPGPRLLSGHCIALVFFL

SEQ ID NO: 809457 - protein, 234 aa, Homo sapiens; identical to SEQ ID NO: 809455

SEQ ID NO: 809458 - protein, 261 aa, Homo sapiens
MIYKCPMCREFFSERADLFMHQKIHTAEKPHKCDKCDKGFFHISELHIHWRDHTGEKVYKCDDCGKDFSTTTKLNRHKKIHTVEKPYKCYECGKAFNWSSHLQIHMRVHTGEKPYVCSECGRGFSNSSNLCMHQRVHTGEKPFKCEECGKAFRHTSSLCMHQRVHTGEKPYKCYECGKAFSQSSSLCIHQRVHTGEKPYRCCGCGKAFSQSSSLCIHQRVHTGEKPFKCDECGKAFSQSTSLCIHQRVHTKERNHLKISVI

SEQ ID NO: 809459 - protein, 261 aa, Homo sapiens; identical to SEQ ID NO: 809458

SEQ ID NO: 809460 - protein, 261 aa, Homo sapiens; identical to SEQ ID NO: 809458

SEQ ID NO: 809461 - protein, 215 aa, Homo sapiens
MIYKCPMCREFFSERADLFMHQKIHTAEKPHKCDKCDKGFFHISELHIHWRDHTGEKVYKCDDCGKDFSTTTKLNRHKKIHTVEKPYKCYECGKAFNWSSHLQIHMRVHTGEKPYVCSECGRGFSNSSNLCMHQRVHTGEKPFKCEECGKAFRHTSSLCMHQRVHTGEKPYKCYECGKAFSQKYEPLHPPESPHKGEKPSQNISYIKRFAKSLKS

SEQ ID NO: 809462 - protein, 261 aa, Homo sapiens; identical to SEQ ID NO: 809458

SEQ ID NO: 809463 - protein, 261 aa, Homo sapiens; identical to SEQ ID NO: 809458

SEQ ID NO: 809464 - protein, 261 aa, Homo sapiens; identical to SEQ ID NO: 809458

SEQ ID NO: 809465 - protein, 261 aa, Homo sapiens; identical to SEQ ID NO: 809458

SEQ ID NO: 809466 - protein, 2254 aa, Homo sapiens
MFRRARLSVKPNVRPGVGARGSTASNPQRGRESPRPPEPATDSASKPAEPTDVPTVDFGGAEPQEKAPRSSTEKTGGDNDVEESSRSSSTVSQRRKRISSTSSLVKSSVSVPSESHPLSTINQEAPQPTATSTKEKQPCSDRYRIYKAQKLREMLKEELRKEKKQWKNKYAINESQRPPDRSKMTMRDFIYYLPDNNPMTSSLEQEKKTEKPSTPVQTREQEGKSTPNAEDNEMEEETDDGPLLVPRVKVAEDGSIILDEESLTVEVLRTKGPCVVEENDPIFERGSTTTYSSFRKNYYSKPWSNKETDMFFLAISMVGTDFSMIGQLFPHRARIEIKNKFKREEKTNGWRIDKAFQEKRPFDFDFFAHLLQKVLAEEEKRKQKSVKNHSLKEKKSTKPRKNVKVKKVACEGVNNDPDESMSSRISDTERSQKDAQTVEEESLTLSREDAEQVALEVDLNQKKRRRKKQDGANELGVNNLLENATVQAGPSKGEKHKNKCQAIRPELKEGECSKEQMLSCTQNIDGIVGFASTEKVEKRTDPILSLSNQQDATSVATESSESSTSDLPSFEVGIRALCEVNNAEGSCIEERNVDLKNNSLEIDQTENVKPMLRGRFQRPKPNLSRAGKKSVLSQGKTESESKNSHSKTSVEKNHVEKDKMNTLDILRMETTERENPEAETVSVLGEKNCLQEGSQLKALRPVQVRGRLQKPKPNAGKAAERKEILISQEEIGANVEKNENESCADRDTPQHMEDQSRKDFEEEDVILQPEKNDSFQNVQPDEPKVLNECLSVQENNKANKLNQVPILRTRFQKPKPNIGRGTGRREISSKEEVLEKILVSGEMAAALRETVRLDTSPKEMVPAEINTKEMQSDLKETGRRAISPREKILDVIDDTIEMETGLKAMGREICLREKTPEVIDATEEIDKDLEEAGRREISPQKNGPEEVKPLGEVETDLKATGNESSPREKTPEVTDATEEIDKNLEETGRRKISPRENGPEEVKPVDEMETDLNATGRESSPREKTPEVIDATEEIDLEETEREVSPQENGLEEVKPLGEMETDLKATGRDSFPRGKTPEVIDAIEEIEIDLEETEREISPQENGLEEVKPLGEMQTDLKATGREISPREKTPEVIDATEEIDKDLEETGRREISPEENGPEEVKPVDEMETDLKTTGREGSSREKTREVIDAAEVIETDLEETEREISPQENGPEEVKPVGKMETDLKEIREEISQREKVLAEFSAIREKEIDLKETGKRDIPMMEKVSGKMAVVEEMEADLKETGKENFRERGSEEICVTEEKVAELKQTGKTDISPRENELEETSTSRQTDTHLMQSGSNDFSAMPSLDIQNISSEVLSMMHTPVEEKRNSEKEVSSHFSHFKISSQTHESDKTEVQGIQSPDVPEQFSDINLSKSLPQEQKPLEIKPAPFVRSRFKRPKPNLARAALKRETTESEKYIYEKKSETKKMETIVMQENNEQTDTLPSQHDEASLMISREKDTLGHRNEEAVILPCTQTERNLSPSNSCEPKEESQSAPVQKNDSVVSVGTNNVNTFQQEMKESVIQTARQVRGRLQRPRPNIRKTGQRQIVDKGEAKGIIKEGRTILPKDETEKKVLTVSNSQIETEIEVPSSAVPEHRMYENQSQVVLVENLHVNKTNETIRHENKPYVPSSAQMTRRKFQKAKPNLGRAHSKKEEPVLEKVTTDQSKEGKPEDHLLQKGASNTQLLLKEKAELLTSLEVSARKDCVGSKESALAKIDAELEEVGPSRRVGEETVGDNSPSSVVEEQYLNKLTSCPQPLNETSYSKIALDGKTTISSTSEYERNRGERRSHKKFKPNVTRGRGSKRVRGKTSKKEPRASKAMLVTLRASQEEDDDADDFESDYEEESYHLAPEEVNKAPVFVPVGLRSPEPVSAQIEETMEELEITVNVPDVGCIAVVEHELPNTDVTTEEMKQEENLSVPFEMTTSEHIQDEPGTNDGSTEAAITLLTMGDLVLQSEISSEQGDVGVCILPHVHSKDKSHIPSSLDNVNHKIVHECQELSSPVITTSPASFEENKIVLEEQSSREEISLMEKVKENATPTRNTISKVTSNLRIRSRLAKPKPNLEKTLGTNRLDDYQEVSSLCVTKGAEMETQRETEKNASKATELENKNLGPVTTAENKDQSKLACVHGIKGTSISSEVNLTERNENQEESSQEVHMLSVAPVASSETGPCTLGLDRGLGENSVEEPQIKDSKGDSVLTLPVPEVKECTV

SEQ ID NO: 809467 - protein, 762 aa, Homo sapiens
MLRGRFQRPKPNLSRAGKKSVLSQGKTESESKNSHSKTSVEKNHVEKDKMNTLDILRMETTERENPEAETVSVLGEKNCLQEGSQLKALRPVQVRGRLQKPKPNAGKAAERKEILISQEEIGANVEKNENESCADRDTPQHMEDQSRKDFEEEDVILQPEKNDSFQNVQPDEPKVLNECLSVQENNKANKLNQVPILRTRFQKPKPNIGRGTGRREISSKEEVLEKILVSGEMAAALRETVRLDTSPKEMVPAEINTKEMQSDLKETGRRAISPREKILDVIDDTIEMETGLKAMGREICLREKTPEVIDATEEIDKDLEEAGRREISPQKNGPEEVKPLGEVETDLKATGNESSPREKTPEVTDATEEIDKNLEETGRRKISPRENGPEEVKPVDEMETDLNATGRESSPREKTPEVIDATEEIDLEETEREVSPQENGLEEVKPLGEMETDLKATGRDSFPRGKTPEVIDAIEEIEIDLEETEREISPQENGLEEVKPLGEMQTDLKATGREISPREKTPEVIDATEEIDKDLEETGRREISPEENGPEEVKPVDEMETDLKTTGREGSSREKTREVIDAAEVIETDLEETEREISPQENGPEEVKPVGKMETDLKEIREEISQREKVLAEFSAIREKEIDLKETGKRDIPMMEKVSGKMAVVEEMEADLKETGKENFRERGSEEICVTEEKVAELKQTGKTDISPRENELEETSTSRQTDTHLMQSGSNDFSAMPSLDIQVCIFLSFKSFLNAFFRGNK

SEQ ID NO: 809468 - protein, 2624 aa, Homo sapiens
MFRRARLSVKPNVRPGVGARGSTASNPQRGRESPRPPEPATDSASKPAEPTDVPTVDFGGAEPQEKAPRSSTEKTGGDNDVEESSRSSSTVSQRRKRISSTSSLVKSSVSVPSESHPLSTINQEAPQPTATSTKEKQPCSDRYRIYKAQKLREMLKEELRKEKKQWKNKYAINESQRPPDRSKMTMRDFIYYLPDNNPMTSSLEQEKKTEKPSTPVQTREQEGKSTPNAEDNEMEEETDDGPLLVPRVKVAEDGSIILDEESLTVEVLRTKGPCVVEENDPIFERGSTTTYSSFRKNYYSKPWSNKETDMFFLAISMVGTDFSMIGQLFPHRARIEIKNKFKREEKTNGWRIDKAFQEKRPFDFDFFAHLLQKVLAEEEKRKQKSVKNHSLKEKKSTKPRKNVKVKKVACEGVNNDPDESMSSRISDTERSQKDAQTVEEESLTLSREDAEQVALEVDLNQKKRRRKKQDGANELGVNNLLENATVQAGPSKGEKHKNKCQAIRPELKEGECSKEQMLSCTQNIDGIVGFASTEKVEKRTDPILSLSNQQDATSVATESSESSTSDLPSFEVGIRALCEVNNAEGSCIEERNVDLKNNSLEIDQTENVKPMLRGRFQRPKPNLSRAGKKSVLSQGKTESESKNSHSKTSVEKNHVEKDKMNTLDILRMETTERENPEAETVSVLGEKNCLQEGSQLKALRPVQVRGRLQKPKPNAGKAAERKEILISQEEIGANVEKNENESCADRDTPQHMEDQSRKDFEEEDVILQPEKNDSFQNVQPDEPKVLNECLSVQENNKANKLNQVPILRTRFQKPKPNIGRGTGRREISSKEEVLEKILVSGEMAAALRETVRLDTSPKEMVPAEINTKEMQSDLKETGRRAISPREKILDVIDDTIEMETGLKAMGREICLREKTPEVIDATEEIDKDLEEAGRREISPQKNGPEEVKPLGEVETDLKATGNESSPREKTPEVTDATEEIDKNLEETGRRKISPRENGPEEVKPVDEMETDLNATGRESSPREKTPEVIDATEEIDLEETEREVSPQENGLEEVKPLGEMETDLKATGRDSFPRGKTPEVIDAIEEIEIDLEETEREISPQENGLEEVKPLGEMQTDLKATGREISPREKTPEVIDATEEIDKDLEETGRREISPEENGPEEVKPVDEMETDLKTTGREGSSREKTREVIDAAEVIETDLEETEREISPQENGPEEVKPVGKMETDLKEIREEISQREKVLAEFSAIREKEIDLKETGKRDIPMMEKVSGKMAVVEEMEADLKETGKENFRERGSEEICVTEEKVAELKQTGKTDISPRENELEETSTSRQTDTHLMQSGSNDFSAMPSLDIQNISSEVLSMMHTPVEEKRNSEKEVSSHFSHFKISSQTHESDKTEVQGIQSPDVPEQFSDINLSKSLPQEQKPLEIKPAPFVRSRFKRPKPNLARAALKRETTESEKYIYEKKSETKKMETIVMQENNEQTDTLPSQHDEASLMISREKDTLGHRNEEAVILPCTQTERNLSPSNSCEPKEESQSAPVQKNDSVVSVGTNNVNTFQQEMKESVIQTARQVRGRLQRPRPNIRKTGQRQIVDKGEAKGIIKEGRTILPKDETEKKVLTVSNSQIETEIEVPSSAVPEHRMYENQSQVVLVENLHVNKTNETIRHENKPYVPSSAQMTRRKFQKAKPNLGRAHSKKEEPVLEKVTTDQSKEGKPEDHLLQKGASNTQLLLKEKAELLTSLEVSARKDCVGSKESALAKIDAELEEVGPSRRVGEETVGDNSPSSVVEEQYLNKLTSCPQPLNETSYSKIALDGKTTISSTSEYERNRGERRSHKKFKPNVTRGRGSKRVRGKTSKKEPRASKAMLVTLRASQEEDDDADDFESDYEEESYHLAPEEVNKAPVFVPVGLRSPEPVSAQIEETMEELEITVNVPDVGCIAVVEHELPNTDVTTEEMKQEENLSVPFEMTTSEHIQDEPGTNDGSTEAAITLLTMGDLVLQSEISSEQGDVGVCILPHVHSKDKSHIPSSLDNVNHKIVHECQELSSPVITTSPASFEENKIVLEEQSSREEISLMEKVKENATPTRNTISKVTSNLRIRSRLAKPKPNLEKTLGTNRLDDYQEVSSLCVTKGAEMETQRETEKNASKATELENKNLGPVTTAENKDQSKLACVHGIKGTSISSEVNLTERNENQEESSQEVHMLSVAPVASSETGPCTLGLDRGLGENSVEEPQIKDSKGDSVLTLPVPEYTPTSIPEVQQENIINPQDLTVNLVANVPQDGEDEQAFILTLVEIPANAVEEFTDATAQFMPNPLLPAPILVKSVNTEERGDMSICLPATSVGQDAMGLSISGRDNSKKPPDNLDLVSRKRFQCRLDKNDHIPPAKKRSLTLRDDCQEYTTEVHSKELTNVFEETGESHKGQDIFLTSGSTLTTPEPQRQQVEAAFQSRGSRSPDACMDKNVPQLPQDEMIVSDKEERTDAAPKSQQMDSRTSSSKASLSRPGRRPLGFLSLICSKNSLESDEPMQVHSKKRLKPLIPGLRKKLKRSNPFNESQEKNRESSDLLPSPSVITTQSENISSSATQVSCDQPLLKEGYKSAQKRAPQGEATTVSEYFFNDIFIEVDETE

SEQ ID NO: 809469 - protein, 1372 aa, Homo sapiens
MFRRARLSVKPNVRPGVGARGSTASNPQRGRESPRPPEPATDSASKPAEPTDVPTVDFGGAEPQEKAPRSSTEKTGGDNDVEESSRSSSTVSQRRKRISSTSSLVKSSVSVPSESHPLSTINQEAPQPTATSTKEKQPCSDRYRIYKAQKLREMLKEELRKEKKQWKNKYAINESQRPPDRSKMTMRDFIYYLPDNNPMTSSLEQEKKTEKPSTPVQTREQEGKSTPNAEDNEMEEETDDGPLLVPRVKVAEDGSIILDEESLTVEVLRTKGPCVVEENDPIFERGSTTTYSSFRKNYYSKPWSNKETDMFFLAISMVGTDFSMIGQLFPHRARIEIKNKFKREEKTNGWRIDKAFQEKRPFDFDFFAHLLQKVLAEEEKRKQKSVKNHSLKEKKSTKPRKNVKVKKVACEGVNNDPDESMSSRISDTERSQKDAQTVEEESLTLSREDAEQVALEVDLNQKKRRRKKQDGANELGVNNLLENATVQAGPSKGEKHKNKCQAIRPELKEGECSKEQMLSCTQNIDGIVGFASTEKVEKRTDPILSLSNQQDATSVATESSESSTSDLPSFEVGIRALCEVNNAEGSCIEERNVDLKNNSLEIDQTENVKPMLRGRFQRPKPNLSRAGKKSVLSQGKTESESKNSHSKTSVEKNHVEKDKMNTLDILRMETTERENPEAETVSVLGEKNCLQEGSQLKALRPVQVRGRLQKPKPNAGKAAERKEILISQEEIGANVEKNENESCADRDTPQHMEDQSRKDFEEEDVILQPEKNDSFQNVQPDEPKVLNECLSVQENNKANKLNQVPILRTRFQKPKPNIGRGTGRREISSKEEVLEKILVSGEMAAALRETVRLDTSPKEMVPAEINTKEMQSDLKETGRRAISPREKILDVIDDTIEMETGLKAMGREICLREKTPEVIDATEEIDKDLEEAGRREISPQKNGPEEVKPLGEVETDLKATGNESSPREKTPEVTDATEEIDKNLEETGRRKISPRENGPEEVKPVDEMETDLNATGRESSPREKTPEVIDATEEIDLEETEREVSPQENGLEEVKPLGEMETDLKATGRDSFPRGKTPEVIDAIEEIEIDLEETEREISPQENGLEEVKPLGEMQTDLKATGREISPREKTPEVIDATEEIDKDLEETGRREISPEENGPEEVKPVDEMETDLKTTGREGSSREKTREVIDAAEVIETDLEETEREISPQENGPEEVKPVGKMETDLKEIREEISQREKVLAEFSAIREKEIDLKETGKRDIPMMEKVSGKMAVVEEMEADLKETGKENFRERGSEEICVTEEKVAELKQTGKTDISPRENELEETSTSRQTDTHLMQSGSNDFSAMPSLDIQVCIFLSFKSFLNAFFRGNK

SEQ ID NO: 809470 - protein, 2624 aa, Homo sapiens; identical to SEQ ID NO: 809468

SEQ ID NO: 809471 - protein, 2624 aa, Homo sapiens; identical to SEQ ID NO: 809468

SEQ ID NO: 809472 - protein, 2624 aa, Homo sapiens; identical to SEQ ID NO: 809468

SEQ ID NO: 809473 - protein, 633 aa, Homo sapiens
MGDLVLQSEISSEQGDVGVCILPHVHSKDKSHIPSSLDNVNHKIVHECQELSSPVITTSPASFEENKIVLEEQSSREEISLMEKVKENATPTRNTISKVTSNLRIRSRLAKPKPNLEKTLGTNRLDDYQEVSSLCVTKGAEMETQRETEKNASKATELENKNLGPVTTAENKDQSKLACVHGIKGTSISSEVNLTERNENQEESSQEVHMLSVAPVASSETGPCTLGLDRGLGENSVEEPQIKDSKGDSVLTLPVPEYTPTSIPEVQQENIINPQDLTVNLVANVPQDGEDEQAFILTLVEIPANAVEEFTDATAQFMPNPLLPAPILVKSVNTEERGDMSICLPATSVGQDAMGLSISGRDNSKKPPDNLDLVSRKRFQCRLDKNDHIPPAKKRSLTLRDDCQEYTTEVHSKELTNVFEETGESHKGQDIFLTSGSTLTTPEPQRQQVEAAFQSRGSRSPDACMDKNVPQLPQDEMIVSDKEERTDAAPKSQQMDSRTSSSKASLSRPGRRPLGFLSLICSKNSLESDEPMQVHSKKRLKPLIPGLRKKLKRSNPFNESQEKNRESSDLLPSPSVITTQSENISSSATQVSCDQPLLKEGYKSAQKRAPQGEATTVSEYFFNDIFIEVDETE

SEQ ID NO: 809474 - protein, 791 aa, Homo sapiens
MFRRARLSVKPNVRPGVGARGSTASNPQRGRESPRPPEPATDSASKPAEPTDVPTVDFGGAEPQEKAPRSSTEKTGGDNDVEESSRSSSTVSQRRKRISSTSSLVKSSVSVPSESHPLSTINQEAPQPTATSTKEKQPCSDRYRIYKAQKLREMLKEELRKEKKQWKNKYAINESQRPPDRSKMTMRDFIYYLPDNNPMTSSLEQEKKTEKPSTPVQTREQEGKSTPNAEDNEMEEETDDGPLLVPRVKVAEDGSIILDEESLTVEVLRTKGPCVVEENDPIFERGSTTTYSSFRKNYYSKPWSNKETDMFFLAISMVGTDFSMIGQLFPHRARIEIKNKFKREEKTNGWRIDKAFQEKRPFDFDFFAHLLQKVLAEEEKRKQKSVKNHSLKEKKSTKPRKNVKVKKVACEGVNNDPDESMSSRISDTERSQKDAQTVEEESLTLSREDAEQVALEVDLNQKKRRRKKQDGANELGVNNLLENATVQAGPSKGEKHKNKCQAIRPELKEGECSKEQMLSCTQNIDGIVGFASTEKVEKRTDPILSLSNQQDATSVATESSESSTSDLPSFEVGIRALCEVNNAEGSCIEERNVDLKNNSLEIDQTENVKPMLRGRFQRPKPNLSRAGKKSVLSQGKTESESKNSHSKTSVEKNHVEKDKMNTLDILRMETTERENPEAETVSVLGEKNCLQEGSQLKALRPVQVRGRLQKPKPNAGKAAERKEILISQEEIGANVEKNENESCADRDTPQHMEDQSRKDFEEEDVILQPEKNDSFQNVQPDEPKVLNECLR

SEQ ID NO: 809475 - protein, 280 aa, Homo sapiens
MDATIAPHRIPPEMPQYGEENHIFELMQNMLEQLLIHQPEDPIPFMIQHLHRDNDNVPRIVILGPPASGKTTIAMWLCKHLNSSLLTLENLILNEFSYTATEARRLYLQRKTVPSALLVQLIQERLAEEDCIKQGWILDGIPETREQALRIQTLGITPRHVIVLSAPDTVLIERNLGKRIDPQTGEIYHTTFDWPPESEIQNRLMVPEDISELETAQKLLEYHRNIVRVIPSYPKILKVISADQPCVDVFYQALTYVQSNHRTNAPFTPRVLLLGPVGSG

SEQ ID NO: 809476 - protein, 76 aa, Homo sapiens
MDATIAPHRIPPEMPQYGEENHIFELMQVTGHPCPSRRWRRLGSLHCDVGCAAGTRSWGRVARPRSSPTRDVRFVC

SEQ ID NO: 809477 - protein, 88 aa, Homo sapiens
MDATIAPHRIPPEMPQYGEENHIFELMQNMLEQLLIHQPEDPIPFMIQHLHRDNDNAALKELTSAPVKLVLGTAEDRAQRCPVWRFRR

SEQ ID NO: 809478 - protein, 117 aa, Homo sapiens
MDATIAPHRIPPEMPQYGEENHIFELMQNMLEQLLIHQPEDPIPFMIQHLHRDNDNVPRIVILGPPASGKTTIAMWLCKHLNSSLLTLENLILNEFSYTATEARRLYLQRKAFPSGF

SEQ ID NO: 809479 - protein, 326 aa, Homo sapiens
MHRTTRIKITELNPHLMCVLCGGYFIDATTIIECLHSFCKTCIVRYLETSKYCPICDVQVHKTRPLLNIRSDKTLQDIVYKLVPGLFKNEMKRRRDFYAAHPSADAANGSNEDRGEVADEDKRIITDDEIISLSIEFFDQNRLDRKVNKDKEKSKEEVNDKRYLRCPAAMTVMHLRKFLRSKMDIPNTFQIDVMYEEEPLKDYYTLMDIAYIYTWRRNGPLPLKYRVRPTCKRMKISHQRDGLTNAGELESDSGSDKANSPAGGIPSTSSCLPSPSTPVQSPHPQFPHISSTMNGTSNSPSGNHQSSFANRPRKSSVNGSSATSSG

SEQ ID NO: 809480 - protein, 326 aa, Homo sapiens; identical to SEQ ID NO: 809479

SEQ ID NO: 809481 - protein, 326 aa, Homo sapiens; identical to SEQ ID NO: 809479

SEQ ID NO: 809482 - protein, 326 aa, Homo sapiens; identical to SEQ ID NO: 809479

SEQ ID NO: 809483 - protein, 368 aa, Homo sapiens
PDAGGSPLLRLQRLHASPPGGIPESAGRPGGRGRVRIFYQAEMHRTTRIKITELNPHLMCVLCGGYFIDATTIIECLHSFCKTCIVRYLETSKYCPICDVQVHKTRPLLNIRSDKTLQDIVYKLVPGLFKNEMKRRRDFYAAHPSADAANGSNEDRGEVADEDKRIITDDEIISLSIEFFDQNRLDRKVNKDKEKSKEEVNDKRYLRCPAAMTVMHLRKFLRSKMDIPNTFQIDVMYEEEPLKDYYTLMDIAYIYTWRRNGPLPLKYRVRPTCKRMKISHQRDGLTNAGELESDSGSDKANSPAGGIPSTSSCLPSPSTPVQSPHPQFPHISSTMNGTSNSPSGNHQSSFANRPRKSSVNGSSATSSG

SEQ ID NO: 809484 - protein, 326 aa, Homo sapiens; identical to SEQ ID NO: 809479

SEQ ID NO: 809485 - protein, 265 aa, Homo sapiens
MHRTTRIKITELNPHLMCVLCGGYFIDATTIIECLHSFCKTCIVRYLETSKYCPICDVQVHKTRPLLNIRSDKTLQDIVYKLVPGLFKNEMKRRRDFYAAHPSADAANGSNEDRGEVADEDKRIITDDEIISLSIEFFDQNRLDRKVNKDKEKSKEEVNDKRYLRCPAAMTVMHLRKFLRSKMDIPNTFQIDVMYEEEPLKDYYTLMDIAYIYTWRRNGPLPLKYRVRPTCKRMKISHQRDGLTNAGELESDSGSDKANSPAGVL

SEQ ID NO: 809486 - protein, 323 aa, Homo sapiens [sequence omitted]

SEQ ID NO: 809487 - protein, 142 aa, Homo sapiens
MHRTTRIKITELNPHLMCVLCGGYFIDATTIIECLHSFCKTCIVRYLETSKYCPICDVQVHKTRPLLNIRSDKTLQDIVYKLVPGLFKNEMKRRRDFYAAHPSADAANGSNEDRGEVADEDKRIITDDEIISLSIEFFDQNR

SEQ ID NO: 809488 - protein, 249 aa, Homo sapiens
MPNVYIFFPHSDEMKRRRDFYAAHPSADAANGSNEDRGEVADEDKRIITDDEIISLSIEFFDQNRLDRKVNKDKEKSKEEVNDKRYLRCPAAMTVMHLRKFLRSKMDIPNTFQIDVMYEEEPLKDYYTLMDIAYIYTWRRNGPLPLKYRVRPTCKRMKISHQRDGLTNAGELESDSGSDKANSPAGGIPSTSSCLPSPSTPVQSPHPQFPHISSTMNGTSNSPSGNHQSSFANRPRKSSVNGSSATSSG

SEQ ID NO: 809489 - protein, 222 aa, Homo sapiens
MAANGSNEDRGEVADEDKRIITDDEIISLSIEFFDQNRLDRKVNKDKEKSKEEVNDKRYLRCPAAMTVMHLRKFLRSKMDIPNTFQIDVMYEEEPLKDYYTLMDIAYIYTWRRNGPLPLKYRVRPTCKRMKISHQRDGLTNAGELESDSGSDKANSPAGGIPSTSSCLPSPSTPVQSPHPQFPHISSTMNGTSNSPSGNHQSSFANRPRKSSVNGSSATSSG

SEQ ID NO: 809490 - protein, 142 aa, Homo sapiens; identical to SEQ ID NO: 809487

SEQ ID NO: 809491 - protein, 926 aa, Homo sapiens
MPVRKQDTQRALHLLEEYRSKLSQTEDRQLRSSIERVINIFQSNLFQALIDIQEFYEVTLLDNPKCIDRSKPSEPIQPVNTWEISSLPSSTVTSETLPSSLSPSVEKYRYQDEDTPPQEHISPQITNEVIGPELVHVSEKNLSEIENVHGFVSHSHISPIKPTEAVLPSPPTVPVIPVLPVPAENTVILPTIPQANPPPVLVNTDSLETPTYVNGTDADYEYEEITLERGNSGLGFSIAGGTDNPHIGDDSSIFITKIITGGAAAQDGRLRVNDCILRVNEVDVRDVTHSKAVEALKEAGSIVRLYVKRRKPVSEKIMEIKLIKGPKGLGFSIAGGVGNQHIPGDNSIYVTKIIEGGAAHKDGKLQIGDKLLAVNNVCLEEVTHEEAVTALKNTSDFVYLKVAKPTSMYMNDGYAPPDITNSSSQPVDNHVSPSSFLGQTPASPARYSPVSKAVLGDDEITREPRKVVLHRGSTGLGFNIVGGEDGEGIFISFILAGGPADLSGELRKGDRIISVNSVDLRAASHEQAAAALKNAGQAVTIVAQYRPEEYSRFEAKIHDLREQMMNSSISSGSGSLRTSQKRSLYVRALFDYDKTKDSGLPSQGLNFKFGDILHVINASDDEWWQARQVTPDGESDEVGVIPSKRRVEKKERARLKTVKFNSKTRDKGQSFNDKRKKNLFSRKFPFYKNKDQSEQETSDADQHVTSNASDSESSYRGQEEYVLSYEPVNQQEVNYTRPVIILGPMKDRINDDLISEFPDKFGSCVPHTTRPKRDYEVDGRDYHFVTSREQMEKDIQEHKFIEAGQYNNHLYGTSVQSVREVAGKGKHCILDVSGNAIKRLQIAQLYPISIFIKPKSMENIMEMNKRLTEEQARKTFERAMKLEQEFTEHFTAIVQGDTLEDIYNQVKQIIEEQSGSYIWVPAKEKL

SEQ ID NO: 809492 - protein, 904 aa, Homo sapiens
MPVRKQDTQRALHLLEEYRSKLSQTEDRQLRSSIERVINIFQSNLFQALIDIQEFYEVTLLDNPKCIDRSKPSEPIQPVNTWEISSLPSSTVTSETLPSSLSPSVEKYRYQDEDTPPQEHISPQITNEVIGPELVHVSEKNLSEIENVHGFVSHSHISPIKPTEAVLPSPPTVPVIPVLPVPAENTVILPTIPQANPPPVLVNTDSLETPTYVNGTDADYEYEEITLERGNSGLGFSIAGGTDNPHIGDDSSIFITKIITGGAAAQDGRLRVNDCILRVNEVDVRDVTHSKAVEALKEAGSIVRLYVKRRKPVSEKIMEIKLIKGPKGLGFSIAGGVGNQHIPGDNSIYVTKIIEGGAAHKDGKLQIGDKLLAVNNVCLEEVTHEEAVTALKNTSDFVYLKVAKPTSMYMNDGYAPPDITNSSSQPVDNHVSPSSFLGQTPASPARYSPVSKAVLGDDEITREPRKVVLHRGSTGLGFNIVGGEDGEGIFISFILAGGPADLSGELRKGDRIISVNSVDLRAASHEQAAAALKNAGQAVTIVAQYRPEEYSRFEAKIHDLREQMMNSSISSGSGSLRTSQKRSLYVRALFDYDKTKDSGLPSQGLNFKFGDILHVINASDDEWWQARQVTPDGESDEVGVIPSKRRVEKKERARLKTVKFNSKTRDKGQSFNDKRKKNLKHVTSNASDSESSYRGQEEYVLSYEPVNQQEVNYTRPVIILGPMKDRINDDLISEFPDKFGSCVPHTTRPKRDYEVDGRDYHFVTSREQMEKDIQEHKFIEAGQYNNHLYGTSVQSVREVAGKGKHCILDVSGNAIKRLQIAQLYPISIFIKPKSMENIMEMNKRLTEEQARKTFERAMKLEQEFTEHFTAIVQGDTLEDIYNQVKQIIEEQSGSYIWVPAKEKL

SEQ ID NO: 809493 - protein, 108 aa, Homo sapiens
MPVRKQDTQRALHLLEEYRSKLSQTEDRQLRSSIERVINIFQSNLFQALIDIQEFYEVTLLDNPKCIDRSKPSEPIQPVNTWEISSLPSSTVTSETLPSSLSPSVEVR

SEQ ID NO: 809494 - protein, 926 aa, Homo sapiens; identical to SEQ ID NO: 809491

SEQ ID NO: 809495 - protein, 529 aa, Homo sapiens
MPVRKQDTQRALHLLEEYRSKLSQTEDRQLRSSIERVINIFQSNLFQALIDIQEFYEVTLLDNPKCIDRSKPSEPIQPVNTWEISSLPSSTVTSETLPSSLSPSVEKYRYQDEDTPPQEHISPQITNEVIGPELVHVSEKNLSEIENVHGFVSHSHISPIKPTEAVLPSPPTVPVIPVLPVPAENTVILPTIPQANPPPVLVNTDSLETPTYVNGTDADYEYEEITLERGNSGLGFSIAGGTDNPHIGDDSSIFITKIITGGAAAQDGRLRVNDCILRVNEVDVRDVTHSKAVEALKEAGSIVRLYVKRRKPVSEKIMEIKLIKGPKGLGFSIAGGVGNQHIPGDNSIYVTKIIEGGAAHKDGKLQIGDKLLAVNNVCLEEVTHEEAVTALKNTSDFVYLKVAKPTSMYMNDGYAPPDITNSSSQPVDNHVSPSSFLGQTPASPARYSPVSKAVLGDDEITREPRKVVLHRGSTGLGFNIVGGEDGEGIFISFILAGGPADLSGELRKGDRIISGKQCLPRELEDTLDS

SEQ ID NO: 809496 - protein, 471 aa, Homo sapiens
MPVRKQDTQRALHLLEEYRSKLSQTEDRQLRSSIERVINIFQSNLFQALIDIQEFYEVTLLDNPKCIDRSKPSEPIQPVNTWEISSLPSSTVTSETLPSSLSPSVEKYRYQDEDTPPQEHISPQITNEVIGPELVHVSEKNLSEIENVHGFVSHSHISPIKPTEAVLPSPPTVPVIPVLPVPAENTVILPTIPQANPPPVLVNTDSLETPTYVNGTDADYEYEEITLERGNSGLGFSIAGGTDNPHIGDDSSIFITKIITGGAAAQDGRLRVNDCILRVNEVDVRDVTHSKAVEALKEAGSIVRLYVKRRKPVSEKIMEIKLIKGPKGLGFSIAGGVGNQHIPGDNSIYVTKIIEGGAAHKDGKLQIGDKLLAVNNVCLEEVTHEEAVTALKNTSDFVYLKVAKPTSMYMNDGYAPPDITNYGVSLLLPRLECSGVISDHHNLCLPDSSHSLASVAGITGMRHHALLILYF

SEQ ID NO: 809497 - protein, 479 aa, Homo sapiens
MPVRKQDTQRALHLLEEYRSKLSQTEDRQLRSSIERVINIFQSNLFQALIDIQEFYEVTLLDNPKCIDRSKPSEPIQPVNTWEISSLPSSTVTSETLPSSLSPSVEKYRYQDEDTPPQEHISPQITNEVIGPELVHVSEKNLSEIENVHGFVSHSHISPIKPTEAVLPSPPTVPVIPVLPVPAENTVILPTIPQANPPPVLVNTDSLETPTYVNGTDADYEYEEITLERGNSGLGFSIAGGTDNPHIGDDSSIFITKIITGGAAAQDGRLRVNDCILRVNEVDVRDVTHSKAVEALKEAGSIVRLYVKRRKPVSEKIMEIKLIKGPKGLGFSIAGGVGNQHIPGDNSIYVTKIIEGGAAHKDGKLQIGDKLLAVNNVCLEEVTHEEAVTALKNTSDFVYLKVAKPTSMYMNDGYAPPDITNSSSQPVDNHVSPSSFLGQTPASPARYSPVSKAVLGDDEITRRRWRRNIYFLYLSRRTC

SEQ ID NO: 809498 - protein, 407 aa, Homo sapiens
MPVRKQDTQRALHLLEEYRSKLSQTEDRQLRSSIERVINIFQSNLFQALIDIQEFYEVTLLDNPKCIDRSKPSEPIQPVNTWEISSLPSSTVTSETLPSSLSPSVEKYRYQDEDTPPQEHISPQITNEVIGPELVHVSEKNLSEIENVHGFVSHSHISPIKPTEAVLPSPPTVPVIPVLPVPAENTVILPTIPQANPPPVLVNTDSLETPTYVNGTDADYEYEEITLERGNSGLGFSIAGGTDNPHIGDDSSIFITKIITGGAAAQDGRLRVNDCILRVNEVDVRDVTHSKAVEALKEAGSIVRLYVKRRKPVSEKIMEIKLIKGPKGLGFSIAGGVGNQHIPGDNSIYVTKIIEGGAAHKDGKLQIGDKLLAVSIRNLLSFKSFCSLFIFLIDTGISPYQKGLNDV

SEQ ID NO: 809499 - protein, 893 aa, Homo sapiens
MPVRKQDTQRALHLLEEYRSKLSQTEDRQLRSSIERVINIFQSNLFQALIDIQEFYEVTLLDNPKCIDRSKPSEPIQPVNTWEISSLPSSTVTSETLPSSLSPSVEKYRYQDEDTPPQEHISPQITNEVIGPELVHVSEKNLSEIENVHGFVSHSHISPIKANPPPVLVNTDSLETPTYVNGTDADYEYEEITLERGNSGLGFSIAGGTDNPHIGDDSSIFITKIITGGAAAQDGRLRVNDCILRVNEVDVRDVTHSKAVEALKEAGSIVRLYVKRRKPVSEKIMEIKLIKGPKGLGFSIAGGVGNQHIPGDNSIYVTKIIEGGAAHKDGKLQIGDKLLAVNNVCLEEVTHEEAVTALKNTSDFVYLKVAKPTSMYMNDGYAPPDITNSSSQPVDNHVSPSSFLGQTPASPARYSPVSKAVLGDDEITREPRKVVLHRGSTGLGFNIVGGEDGEGIFISFILAGGPADLSGELRKGDRIISVNSVDLRAASHEQAAAALKNAGQAVTIVAQYRPEEYSRFEAKIHDLREQMMNSSISSGSGSLRTSQKRSLYVRALFDYDKTKDSGLPSQGLNFKFGDILHVINASDDEWWQARQVTPDGESDEVGVIPSKRRVEKKERARLKTVKFNSKTRDKGQSFNDKRKKNLFSRKFPFYKNKDQSEQETSDADQHVTSNASDSESSYRGQEEYVLSYEPVNQQEVNYTRPVIILGPMKDRINDDLISEFPDKFGSCVPHTTRPKRDYEVDGRDYHFVTSREQMEKDIQEHKFIEAGQYNNHLYGTSVQSVREVAGKGKHCILDVSGNAIKRLQIAQLYPISIFIKPKSMENIMEMNKRLTEEQARKTFERAMKLEQEFTEHFTAIVQGDTLEDIYNQVKQIIEEQSGSYIWVPAKEKL

SEQ ID NO: 809500 - protein, 926 aa, Homo sapiens; identical to SEQ ID NO: 809491

SEQ ID NO: 809501 - protein, 926 aa, Homo sapiens; identical to SEQ ID NO: 809491

SEQ ID NO: 809502 - protein, 893 aa, Homo sapiens; identical to SEQ ID NO: 809499

SEQ ID NO: 809503 - protein, 926 aa, Homo sapiens; identical to SEQ ID NO: 809491

SEQ ID NO: 809504 - protein, 926 aa, Homo sapiens; identical to SEQ ID NO: 809491

SEQ ID NO: 809505 - protein, 932 aa, Homo sapiens
RSLDPPHVGRKQDTQRALHLLEEYRSKLSQTEDRQLRSSIERVINIFQSNLFQALIDIQEFYEVTLLDNPKCIDRSKPSEPIQPVNTWEISSLPSSTVTSETLPSSLSPSVEKYRYQDEDTPPQEHISPQITNEVIGPELVHVSEKNLSEIENVHGFVSHSHISPIKPTEAVLPSPPTVPVIPVLPVPAENTVILPTIPQANPPPVLVNTDSLETPTYVNGTDADYEYEEITLERGNSGLGFSIAGGTDNPHIGDDSSIFITKIITGGAAAQDGRLRVNDCILRVNEVDVRDVTHSKAVEALKEAGSIVRLYVKRRKPVSEKIMEIKLIKGPKGLGFSIAGGVGNQHIPGDNSIYVTKIIEGGAAHKDGKLQIGDKLLAVNNVCLEEVTHEEAVTALKNTSDFVYLKVAKPTSMYMNDGYAPPDITNSSSQPVDNHVSPSSFLGQTPASPARYSPVSKAVLGDDEITREPRKVVLHRGSTGLGFNIVGGEDGEGIFISFILAGGPADLSGELRKGDRIISVNSVDLRAASHEQAAAALKNAGQAVTIVAQYRPEEYSRFEAKIHDLREQMMNSSISSGSGSLRTSQKRSLYVRALFDYDKTKDSGLPSQGLNFKFGDILHVINASDDEWWQARQVTPDGESDEVGVIPSKRRVEKKERARLKTVKFNSKTRDKGQSFNDKRKKNLFSRKFPFYKNKDQSEQETSDADQHVTSNASDSESSYRGQEEYVLSYEPVNQQEVNYTRPVIILGPMKDRINDDLISEFPDKFGSCVPHTTRPKRDYEVDGRDYHFVTSREQMEKDIQEHKFIEAGQYNNHLYGTSVQSVREVAGKGKHCILDVSGNAIKRLQIAQLYPISIFIKPKSMENIMEMNKRLTEEQARKTFERAMKLEQEFTEHFTAIVQGDTLEDIYNQVKQIIEEQSGSYIWVPAKEKL

SEQ ID NO: 809506 - protein, 908 aa, Homo sapiens
MPVRKQDTQRALHLLEEYRSKLSQTEDRQLRSSIERVINIFQSNLFQALIDIQEFYEVTLLDNPEISSLPSSTVTSETLPSSLSPSVEKYRYQDEDTPPQEHISPQITNEVIGPELVHVSEKNLSEIENVHGFVSHSHISPIKPTEAVLPSPPTVPVIPVLPVPAENTVILPTIPQANPPPVLVNTDSLETPTYVNGTDADYEYEEITLERGNSGLGFSIAGGTDNPHIGDDSSIFITKIITGGAAAQDGRLRVNDCILRVNEVDVRDVTHSKAVEALKEAGSIVRLYVKRRKPVSEKIMEIKLIKGPKGLGFSIAGGVGNQHIPGDNSIYVTKIIEGGAAHKDGKLQIGDKLLAVNNVCLEEVTHEEAVTALKNTSDFVYLKVAKPTSMYMNDGYAPPDITNSSSQPVDNHVSPSSFLGQTPASPARYSPVSKAVLGDDEITREPRKVVLHRGSTGLGFNIVGGEDGEGIFISFILAGGPADLSGELRKGDRIISVNSVDLRAASHEQAAAALKNAGQAVTIVAQYRPEEYSRFEAKIHDLREQMMNSSISSGSGSLRTSQKRSLYVRALFDYDKTKDSGLPSQGLNFKFGDILHVINASDDEWWQARQVTPDGESDEVGVIPSKRRVEKKERARLKTVKFNSKTRDKGQSFNDKRKKNLFSRKFPFYKNKDQSEQETSDADQHVTSNASDSESSYRGQEEYVLSYEPVNQQEVNYTRPVIILGPMKDRINDDLISEFPDKFGSCVPHTTRPKRDYEVDGRDYHFVTSREQMEKDIQEHKFIEAGQYNNHLYGTSVQSVREVAGKGKHCILDVSGNAIKRLQIAQLYPISIFIKPKSMENIMEMNKRLTEEQARKTFERAMKLEQEFTEHFTAIVQGDTLEDIYNQVKQIIEEQSGSYIWVPAKEKL

SEQ ID NO: 809507 - protein, 552 aa, Homo sapiens
SCASCPWRRRRRARGGGWEQLAPGRTLAATAPWPWLAARARCAEVAELAGPRRKRGEAGPRQEVALPGPSASGSGGGAPRAADSKLGRGPRAEAAAVAATLGVRWRRPRPGWVPTALGGAMDEAVGDLKQALPCVAESPTVHVEVHQRGSSTAKKEDINLSVRKLLNRHNIVFGDYTWTEFDEPFLTRNVQSVSIIDTELKVKDSQPIDLSACTVALHIFQLNEDGPSSENLEEETENIIAANHWVLPAAEFHGLWDSLVYDVEVKSHLLDYVMTTLLFSDKNVNSNLITWNRVVLLHGPPGTGKTSLCKALAQKLTIRLSSRYRYGQLIEINSHSLFSKWFSESGKLVTKMFQKIQDLIDDKDALVFVLIDEVESLTAARNACRAGTEPSDAIRVVNAVLTQIDQIKRHSNVVILTTSNITEKIDVAFVDRADIKQYIGPPSAAAIFKIYLSCLEELMKCQIIYPRQQLLTLRELEMIGFIENNVSKLSLLLNDISRKSEGLSGRVLRKLPFLAHALYVQAPTVTIEGFLQALSLAVDKQFEERKKLAAYI

SEQ ID NO: 809508 - protein, 474 aa, Homo sapiens
RERLRLGTSAGVGAEAAAVAATLGVRWRRPRPGWVPTALGGAMDEAVGDLKQALPCVAESPTVHVEVHQRGSSTAKKEDINLSVRKLLNRHNIVFGDYTWTEFDEPFLTRNVQSVSIIDTELKVKDSQPIDLSACTVALHIFQLNEDGPSSENLEEETENIIAANHWVLPAAEFHGLWDSLVYDVEVKSHLLDYVMTTLLFSDKNVNSNLITWNRVVLLHGPPGTGKTSLCKALAQKLTIRLSSRYRYGQLIEINSHSLFSKWFSESGKLVTKMFQKIQDLIDDKDALVFVLIDEVESLTAARNACRAGTEPSDAIRVVNAVLTQIDQIKRHSNVVILTTSNITEKIDVAFVDRADIKQYIGPPSAAAIFKIYLSCLEELMKCQIIYPRQQLLTLRELEMIGFIENNVSKLSLLLNDISRKSEGLSGRVLRKLPFLAHALYVQAPTVTIEGFLQALSLAVDKQFEERKKLAAYI

SEQ ID NO: 809509 - protein, 431 aa, Homo sapiens
VLLPGVGGTQRRGQTFTDPPYVHGGWIEVSTAKKEDINLSVRKLLNRHNIVFGDYTWTEFDEPFLTRNVQSVSIIDTELKVKDSQPIDLSACTVALHIFQLNEDGPSSENLEEETENIIAANHWVLPAAEFHGLWDSLVYDVEVKSHLLDYVMTTLLFSDKNVNSNLITWNRVVLLHGPPGTGKTSLCKALAQKLTIRLSSRYRYGQLIEINSHSLFSKWFSESGKLVTKMFQKIQDLIDDKDALVFVLIDEVESLTAARNACRAGTEPSDAIRVVNAVLTQIDQIKRHSNVVILTTSNITEKIDVAFVDRADIKQYIGPPSAAAIFKIYLSCLEELMKCQIIYPRQQLLTLRELEMIGFIENNVSKLSLLLNDISRKSEGLSGRVLRKLPFLAHALYVQAPTVTIEGFLQALSLAVDKQFEERKKLAAYI

SEQ ID NO: 809510 - protein, 279 aa, Homo sapiens
MTTLLFSDKNVNSNLITWNRVVLLHGPPGTGKTSLCKALAQKLTIRLSSRYRYGQLIEINSHSLFSKWFSESGKLVTKMFQKIQDLIDDKDALVFVLIDEVESLTAARNACRAGTEPSDAIRVVNAVLTQIDQIKRHSNVVILTTSNITEKIDVAFVDRADIKQYIGPPSAAAIFKIYLSCLEELMKCQIIYPRQQLLTLRELEMIGFIENNVSKLSLLLNDISRKSEGLSGRVLRKLPFLAHALYVQAPTVTIEGFLQALSLAVDKQFEERKKLAAYI

SEQ ID NO: 809511 - protein, 459 aa, Homo sapiens
RERLRLGTSAGVGAEAAAVAATLGVRWRRPRPGWVPTALGGAMDEAVGDLKQALPCVAESPTVHVEVHQRGSSTAKKEDINLSVRKLLNRHNIVFGDYTWTEFDEPFLTRNVQSVSIIDTELKVKDSQLNEDGPSSENLEEETENIIAANHWVLPAAEFHGLWDSLVYDVEVKSHLLDYVMTTLLFSDKNVNSNLITWNRVVLLHGPPGTGKTSLCKALAQKLTIRLSSRYRYGQLIEINSHSLFSKWFSESGKLVTKMFQKIQDLIDDKDALVFVLIDEVESLTAARNACRAGTEPSDAIRVVNAVLTQIDQIKRHSNVVILTTSNITEKIDVAFVDRADIKQYIGPPSAAAIFKIYLSCLEELMKCQIIYPRQQLLTLRELEMIGFIENNVSKLSLLLNDISRKSEGLSGRVLRKLPFLAHALYVQAPTVTIEGFLQALSLAVDKQFEERKKLAAYI

SEQ ID NO: 809512 - protein, 295 aa, Homo sapiens
SCASCPWRRRRRARGGGWEQLAPGRTLAATAPWPWLAARARCAEVAELAGPRRKRGEAGPRQEVALPGPSASGSGGGAPRAADSKLGRGPRAEAAAVAATLGVRWRRPRPGWVPTALGGAMDEAVGDLKQALPCVAESPTVHVEVHQRGSSTAKKEDINLSVRKLLNRHNIVFGDYTWTEFDEPFLTRNVQSVSIIDTELKVKDSQPIDLSACTVALHIFQLNEDGPSSENLEEETENIIAANHWVLPAAEFHGLWDSLVYDVEVKSHLLDYVMTTLLFSDKNVNSNLITPPPSP

SEQ ID NO: 809513 - protein, 552 aa, Homo sapiens; identical to SEQ ID NO: 809507

SEQ ID NO: 809514 - protein, 552 aa, Homo sapiens; identical to SEQ ID NO: 809507

SEQ ID NO: 809515 - protein, 81 aa, Homo sapiens
DTRSPVLNTYRYLNCERQSHEGHRLLFSEVSSILCCNTDVLCITVILSFSLFVKDNSDCLSPCEEPSKPVCSQPTPSGWDA

SEQ ID NO: 809516 - protein, 164 aa, Homo sapiens
RPRHPRQAPPLRAGSPAATTHGPVTSGVARRTSRPLARARAPLRPAVAEPAAGARPAQGSGSAPAQRPATPTHRPPPPPAGRRGDSQSWLRPGLGPAPAPAPGQPVLFRVRGAYAPGLSRACGSGQIPDIRVDPVKSFYLVSSYILDPPLSCIFQTTFPLEQLK

SEQ ID NO: 809517 - protein, 105 aa, Homo sapiens
QGRREPQAQGGAAPAEPAPPPQRGLSPRPQLLLGFFVHSGSTPFMHIPDHISTGAVEMREMGMGLTRTRGIFITDPLTEVSKSQEQGCAPQKHRAQWKISLLLFV

SEQ ID NO: 809518 - protein, 148 aa, Homo sapiens
RPRHPRQAPPLRAGSPAATTHGPVTSGVARRTSRPLARARAPLRPAVAEPAAGARPAQGSGSAPAQRPATPTHRPPPPPAGRRGDSQSWLRPGLGPAPAPAPGQPVLFRVRGAYAPGLSRACGSGQIPDIRVDPVKRSPTWAVDRAQG

SEQ ID NO: 809519 - protein, 223 aa, Homo sapiens
MPKKFQGENTKSAAARARRAEAKAAADAKKQKELEDAYWKDDDKHVMRKEQRKEEKEKRRLDQLERKKETQRLLEEEDSKLKGGKAPRVATSSKVTRAQIEDTLRRDHQLREAPDTAEKAKSHLEVPLEENVNRRVLEEGSVEARTIEDAIAVLSVAEEAADRHPERRMRAAFTAFEEAQLPRLKQENPNMRLSQLKQLLKKEWLRSPDNPMNQRAVPFNAPK

SEQ ID NO: 809520 - protein, 223 aa, Homo sapiens; identical to SEQ ID NO: 809519

SEQ ID NO: 809521 - protein, 223 aa, Homo sapiens; identical to SEQ ID NO: 809519

SEQ ID NO: 809522 - protein, 223 aa, Homo sapiens; identical to SEQ ID NO: 809519

SEQ ID NO: 809523 - protein, 223 aa, Homo sapiens; identical to SEQ ID NO: 809519

SEQ ID NO: 809524 - protein, 113 aa, Homo sapiens
MPKKFQGENTKSAAARARRAEAKAAADAKKQKELEDAYWKDDDKHVMRKEQRKEEKEKRRLDQLERKKETQRLLEQENPNMRLSQLKQLLKKEWLRSPDNPMNQRAVPFNAPK

SEQ ID NO: 809525 - protein, 106 aa, Homo sapiens
FGCGRMACCGAGGRRGRYCCDWHPHPADVDGTKVQKLRVTLALQPNMQDSSNPRNDGIALQILKRVLTKSWLTLTSPLQPSSSLSPKPCHGGLWHLSQPLSSPALP

SEQ ID NO: 809526 - protein, 106 aa, Homo sapiens; identical to SEQ ID NO: 809525

SEQ ID NO: 809527 - protein, 106 aa, Homo sapiens; identical to SEQ ID NO: 809525

SEQ ID NO: 809528 - protein, 106 aa, Homo sapiens; identical to SEQ ID NO: 809525

SEQ ID NO: 809529 - protein, 105 aa, Homo sapiens
FGCGRMACCGAGGRRGRYCCDWHPHPADVDGTKVQKLRVTLALQPNMQDSSNPRNDGIALQILKRVLTEKGKCYIVKVPKPFSLKPGTIVQSFFGTSRKEIQILL

SEQ ID NO: 809530 - protein, 117 aa, Homo sapiens
MKFQYKEDHPFEYRKKEGEKIRKKYPDRVPVIVEKAPKARVPDLDKRKYLVPSDLTVGQFYFLIRKRIHLRPEDALFFFVNNTIPPTSATMGQLYEDNHEEDYFLYVAYSDESVYGK

SEQ ID NO: 809531 - protein, 117 aa, Homo sapiens; identical to SEQ ID NO: 809530

SEQ ID NO: 809532 - protein, 120 aa, Homo sapiens
WTHNAWAGWADARGGDVTARRRHPAVFVLPALAKSRRYFSIWLSSTSRQAHPRSPPRTPPAHSAQRCCPRSGRFCSYSEHTLTSAEGAGQGQRRRRQAPRGDLGSPAVHHEVPVQGGPSL

SEQ ID NO: 809533 - protein, 97 aa, Homo sapiens
GSPQVEFWVKVIVEKAPKARVPDLDKRKYLVPSDLTVGQFYFLIRKRIHLRPEDALFFFVNNTIPPTSATMGQLYEDNHEEDYFLYVAYSDESVYGK

SEQ ID NO: 809534 - protein, 95 aa, Homo sapiens
NAGTLGCAVIVEKAPKARVPDLDKRKYLVPSDLTVGQFYFLIRKRIHLRPEDALFFFVNNTIPPTSATMGQLYEDNHEEDYFLYVAYSDESVYGK

SEQ ID NO: 809535 - protein, 117 aa, Homo sapiens; identical to SEQ ID NO: 809530

SEQ ID NO: 809536 - protein, 117 aa, Homo sapiens; identical to SEQ ID NO: 809530

SEQ ID NO: 809537 - protein, 117 aa, Homo sapiens; identical to SEQ ID NO: 809530

SEQ ID NO: 809538 - protein, 117 aa, Homo sapiens; identical to SEQ ID NO: 809530

SEQ ID NO: 809539 - protein, 120 aa, Homo sapiens; identical to SEQ ID NO: 809532

SEQ ID NO: 809540 - protein, 82 aa, Homo sapiens
KVQKLFSNFLALQGVRGAQDSPGLENKVTFSAQQPSCLIVLGSGACVGTASLLVLISDHLVPGRDKAGLRRFFSVLDTGLSS

SEQ ID NO: 809541 - protein, 117 aa, Homo sapiens; identical to SEQ ID NO: 809530

SEQ ID NO: 809542 - protein, 106 aa, Homo sapiens
RWEREPPPPPELTSGTEMQVIVEKAPKARVPDLDKRKYLVPSDLTVGQFYFLIRKRIHLRPEDALFFFVNNTIPPTSATMGQLYEDNHEEDYFLYVAYSDESVYGK

SEQ ID NO: 809543 - protein, 72 aa, Homo sapiens
WTHNAWAGWADARGGDVTARRRHPAVFVLPALAKSRRYFSIWLSSTSRQAHPRSPPRTPPAHSRKETEGEDI

SEQ ID NO: 809544 - protein, 117 aa, Homo sapiens; identical to SEQ ID NO: 809530

SEQ ID NO: 809545 - protein, 117 aa, Homo sapiens; identical to SEQ ID NO: 809530

SEQ ID NO: 809546 - protein, 146 aa, Homo sapiens
MKFQYKEDHPFEYRKKEGEKIRKKYPDRVPVIVEKAPKARVPDLDKRKYLVPSDLTVGQFYFLIRKRIHLRPEDALFFFVNNTIPPTSATMGQLYEVMVLVAQYWMPSSAVWHPLALVLDALITHLRSGAEGVIYPDPLTYGSVRL

SEQ ID NO: 809547 - protein, 78 aa, Homo sapiens
LGLYLAVSNKVGSNSLNKLSVSITYYANQGRALQKLQKGTARGQGHHVLHPHARHLTCSSERNPRNNTRSLSLQPDQF

SEQ ID NO: 809548 - protein, 115 aa, Homo sapiens
HPYRHFRSTGPKKKTFSVTGKHWSTLMKWLHDVINIPGSSFCKQLLLPGSLSVTRLSVSITYYANQGRALQKLQKGTARGQGHHVLHPHARHLTCSSERNPRNNTRSLSLQPDQF

SEQ ID NO: 809549 - protein, 112 aa, Homo sapiens
DIACHQMECTRPWLSKLQTAWSLPVGSGRPMTPEWLLPAPELQGRLGAGKNARSRALFQPLSSLNLGRLRPVKMLHKMFHMVSGARALCEMAREAISTTIPHILTFFCGENI

SEQ ID NO: 809550 - protein, 221 aa, Homo sapiens
MSTADALDDENTFKILVATDIHLGFMEKDAVRGNDTFVTLDEILRLAQENEVDFILLGGDLFHENKPSRKTLHTCLELLRKYCMGDRPVQFEILSDQSVNFGFSKFPWVNYQDGNLNISIPVFSIHGNHDDPTGADALCALDILSCAGFVNHFGRSMSVEKIDISPVLLQKGSTKIALYGLGSIPDERLYRMFVNKKVTMLRPKEDENSWFNLFVIHQNRV

SEQ ID NO: 809551 - protein, 680 aa, Homo sapiens
MSTADALDDENTFKILVATDIHLGFMEKDAVRGNDTFVTLDEILRLAQENEVDFILLGGDLFHENKPSRKTLHTCLELLRKYCMGDRPVQFEILSDQSVNFGFSKFPWVNYQDGNLNISIPVFSIHGNHDDPTGADALCALDILSCAGFVNHFGRSMSVEKIDISPVLLQKGSTKIALYGLGSIPDERLYRMFVNKKVTMLRPKEDENSWFNLFVIHQNRSKHGSTNFIPEQFLDDFIDLVIWGHEHECKIAPTKNEQQLFYISQPGSSVVTSLSPGEAVKKHVGLLRIKGRKMNMHKIPLHTVRQFFMEDIVLANHPDIFNPDNPKVTQAIQSFCLEKIEEMLENAERERLGNSHQPEKPLVRLRVDYSGGFEPFSVLRFSQKFVDRVANPKDIIHFFRHREQKEKTGEEINFGKLITKPSEGTTLRVEDLVKQYFQTAEKNVQLSLLTERGMGEAVQEFVDKEEKDAIEELVKYQLEKTQRFLKERHIDALEDKIDEEVRRFRETRQKNTNEEDDEVREAMTRARALRSQSEESASAFSADDLMSIDLAEQMANDSDDSISAATNKGRGRGRGRRGGRGQNSASRGGSQRGRAFKSTRQQPSRNVTTKNYSEVIEVDESDVEEDIFPTTSKTDQRWSSTSSSKIMSQSQVSKGVDFESSEDDDDDPFMNTSSLRRNRR

SEQ ID NO: 809552 - protein, 632 aa, Homo sapiens
MSTADALDDENTFKILVATDIHLGFMEKDAVRGNDTFVTLDEILRLAQENEVDFILLGGDLFHENKPSRKTLHTCLELLRKYCMGDRPVQFEILSDQSVNFGFSKFPWVNYQDGNLNISIPVFSIHGNHDDPTGADALCALDILSCAGFVNHFGRSMSVEKIDISPVLLQKGSTKIALYGLGSIPDERLYRMFVNKKVTMLRPKEDENSWFNLFVIHQNRSKHGSTNFIPEQFLDDFIDLVIWGHEHECKIAPTKNEQQLFYISQPGSSVVTSLSPGEAVKKHVGLLRIKGRKMNMHKIPLHTVRQFFMEDIVLANHPDIFNPDNPKVTQAIQSFCLEKIEEMLENAERERLGNSHQPEKPLVRLRVDYSGGFEPFSVLRFSQKFVDRVANPKDIIHFFRHREQKEKTGEEINFGKLITKPSEGTTLRVEDLVKQYFQTAEKNVQLSLLTERGMGEAVQEFVDKEEKDAIEELVKYQLEKTQRFLKERHIDALEDKIDEEVRRFRETRQKNTNEEDDEVREAMTRARALRSQSEESASAFSADDLMSIDLAEQMANDSDDSISAATNKGRGRGRGRRGGRGQNSASRGGSQRGRADTGLETSTRSRNSKTAVSASRNMSIIDGEYRLQVIIY

SEQ ID NO: 809553 - protein, 708 aa, Homo sapiens
MSTADALDDENTFKILVATDIHLGFMEKDAVRGNDTFVTLDEILRLAQENEVDFILLGGDLFHENKPSRKTLHTCLELLRKYCMGDRPVQFEILSDQSVNFGFSKFPWVNYQDGNLNISIPVFSIHGNHDDPTGADALCALDILSCAGFVNHFGRSMSVEKIDISPVLLQKGSTKIALYGLGSIPDERLYRMFVNKKVTMLRPKEDENSWFNLFVIHQNRSKHGSTNFIPEQFLDDFIDLVIWGHEHECKIAPTKNEQQLFYISQPGSSVVTSLSPGEAVKKHVGLLRIKGRKMNMHKIPLHTVRQFFMEDIVLANHPDIFNPDNPKVTQAIQSFCLEKIEEMLENAERERLGNSHQPEKPLVRLRVDYSGGFEPFSVLRFSQKFVDRVANPKDIIHFFRHREQKEKTGEEINFGKLITKPSEGTTLRVEDLVKQYFQTAEKNVQLSLLTERGMGEAVQEFVDKEEKDAIEELVKYQLEKTQRFLKERHIDALEDKIDEEVRRFRETRQKNTNEEDDEVREAMTRARALRSQSEESASAFSADDLMSIDLAEQMANDSDDSISAATNKGRGRGRGRRGGRGQNSASRGGSQRGRADTGLETSTRSRNSKTAVSASRNMSIIDAFKSTRQQPSRNVTTKNYSEVIEVDESDVEEDIFPTTSKTDQRWSSTSSSKIMSQSQVSKGVDFESSEDDDDDPFMNTSSLRRNRR

SEQ ID NO: 809554 - protein, 708 aa, Homo sapiens; identical to SEQ ID NO: 809553

SEQ ID NO: 809555 - protein, 1029 aa, Homo sapiens
SQVVEGLKVRGGGQLHRLHPAGRPGNLQGALFPPSLSPTGRLPRARGGEGQRTWARAMCLLSVQTGGEARSRPAGTAGAEARVLGPESRGILDPREALGRGTSGVGSRALDRRGREAALVPRASGSREGAPDPALRRRFPGSFKFESPGGGSAASGTGVAERRAPSGRSGAMEEGAPRQPGPSQWPPEDEKEVIRRAIQKELKIKEGVENLRRVATDRRHLGHVQQLLRSSNRRLEQLHGELRELHARILLPGPGPGPAEPVASGPRPWAEQLRARHLEALRRQLHVELKVKQGAENMTHTCASGTPKERKLLAAAQQMLRDSQLKVALLRMKISSLEASGSPEPGPELLAEELQHRLHVEAAVAEGAKNVVKLLSSRRTQDRKALAEAQAQLQESSQKLDLLRLALEQLLEQLPPAHPLRSRVTRELRAAVPGYPQPSGTPVKPTALTGTLQVRLLGCEQLLTAVPGRSPAAALASSPSEGWLRTKAKHQRGRGELASEVLAVLKVDNRVVGQTGWGQVAEQSWDQTFVIPLERARELEIGVHWRDWRQLCGVAFLRLEDFLDNACHQLSLSLVPQGLLFAQVTFCDPVIERRPRLQRQERIFSKRRGQDFLRASQMNLGMAAWGRLVMNLLPPCSSPSTISPPKGCPRTPTTLREASDPATPSNFLPKKTPLGEEMTPPPKPPRLYLPQEPTSEETPRTKRPHMEPRTRRGPSPPASPTRKPPRLQDFRCLAVLGRGHFGKPVLREADPGGCGLHRAPFPALPPCCFQTSSHACFVTEFVPGGDLMMQIHEDVFPEPQARFYVACVVLGLQFLHEKKIIYRDLKLDNLLLDAQGFLKIADFGLCKEGIGFGDRTSTFCGTPEFLAPEVLTQEAYTRAVDWWGLGVLLYEMLVGECPFPGDTEEEVFDCIVNMDAPYPGFLSVQGLEFIQKLLQKCPEKRLGAGEQDAEEIKVQPFFRTTNWQALLARTIQPPFVPTLCGPADLRYFEGEFTGLPPALTPPAPHSLLTARQQAAFRDFDFVSERFLEP

SEQ ID NO: 809556 - protein, 1086 aa, Homo sapiens
SQVVEGLKVRGGGQLHRLHPAGRPGNLQGALFPPSLSPTGRLPRARGGEGQRTWARAMCLLSVQTGGEARSRPAGTAGAEARVLGPESRGILDPREALGRGTSGVGSRALDRRGREAALVPRASGSREGAPDPALRRRFPGSFKFESPGGGSAASGTGVAERRAPSGRSGAMEEGAPRQPGPSQWPPEDEKEVIRRAIQKELKIKEGVENLRRVATDRRHLGHVQQLLRSSNRRLEQLHGELRELHARILLPGPGPGPAEPVASGPRPWAEQLRARHLEALRRQLHVELKVKQGAENMTHTCASGTPKERKLLAAAQQMLRDSQLKVALLRMKISSLEASGSPEPGPELLAEELQHRLHVEAAVAEGAKNVVKLLSSRRTQDRKALAEAQAQLQESSQKLDLLRLALEQLLEQLPPAHPLRSRVTRELRAAVPGYPQPSGTPVKPTALTGTLQVRLLGCEQLLTAVPGRSPAAALASSPSEGWLRTKAKHQRGRGELASEREGASGGAGDPCFRPALSPGSGPAGEVLAVLKVDNRVVGQTGWGQVAEQSWDQTFVIPLERARELEIGVHWRDWRQLCGVAFLRLEDFLDNACHQLSLSLVPQGLLFAQVTFCDPVIERRPRLQRQERIFSKRRGQDFLRASQMNLGMAAWGRLVMNLLPPCSSPSTISPPKGCPRTPTTLREASDPATPSNFLPKKTPLGEEMTPPPKPPRLYLPQEPTSEETPRTKRPHMEPRTRRGPSPPASPTRKPPRLQDFRCLAVLGRGHFGKVLLVQFKGTGKYYAIKALKKQEVLSRDEIESLYCEKRILEAVGCTGHPFLLSLLACFQTSSHACFVTEFVPGGDLMMQIHEDVFPEPQARFYVACVVLGLQFLHEKKIIYRDLKLDNLLLDAQGFLKIADFGLCKEGIGFGDRTSTFCGTPEFLAPEVLTQEAYTRAVDWWGLGVLLYEMLVGECPFPGDTEEEVFDCIVNMDAPYPGFLSVQGLEFIQKLLQKCPEKRLGAGEQDAEEIKVQPFFRTTNWQALLARTIQPPFVPTLCGPADLRYFEGEFTGLPPALTPPAPHSLLTARQQAAFRDFDFVSERFLEP

SEQ ID NO: 809557 - protein, 354 aa, Homo sapiens
MGQDWGPHHMSREDLICGGGKGSLVWPTWSTTSLWPQVLLVQFKGTGKYYAIKALKKQEVLSRDEIESLYCEKRILEAVGCTGHPFLLSLLACFQTSSHACFVTEFVPGGDLMMQIHEDVFPEPQARFYVACVVLGLQFLHEKKIIYRDLKLDNLLLDAQGFLKIADFGLCKEGIGFGDRTSTFCGTPEFLAPEVLTQEAYTRAVDWWGLGVLLYEMLVGECPFPGDTEEEVFDCIVNMDAPYPGFLSVQGLEFIQKLLQKCPEKRLGAGEQDAEEIKVQPFFRTTNWQALLARTIQPPFVPTLCGPADLRYFEGEFTGLPPALTPPAPHSLLTARQQAAFRDFDFVSERFLEP

SEQ ID NO: 809558 - protein, 660 aa, Homo sapiens
SQVVEGLKVRGGGQLHRLHPAGRPGNLQGALFPPSLSPTGRLPRARGGEGQRTWARAMCLLSVQTGGEARSRPAGTAGAEARVLGPESRGILDPREALGRGTSGVGSRALDRRGREAALVPRASGSREGAPDPALRRRFPGSFKFESPGGGSAASGTGVAERRAPSGRSGAMEEGAPRQPGPSQWPPEDEKEVIRRAIQKELKIKEGVENLRRVATDRRHLGHVQQLLRSSNRRLEQLHGELRELHARILLPGPGPGPAEPVASGPRPWAEQLRARHLEALRRQLHVELKVKQGAENMTHTCASGTPKERKLLAAAQQMLRDSQLKVALLRMKISSLEASGSPEPGPELLAEELQHRLHVEAAVAEGAKNVVKLLSSRRTQDRKALAEAQAQLQESSQKLDLLRLALEQLLEQLPPAHPLRSRVTRELRAAVPGYPQPSGTPVKPTALTGTLQVRLLGCEQLLTAVPGRSPAAALASSPSEGWLRTKAKHQRGRGELASEVLAVLKVDNRVVGQTGWGQVAEQSWDQTFVIPLERARELEIGVHWRDWRQLCGVAFLRLEDFLDNACHQLSLSLVPQGLLFAQVTFCDPVIERRPRLQRQERIFSKRRGRLPGLRLCVRAIPGTLRASPGTSVPFPHRLLEPLLVHPCALPGGPGLAGYF

SEQ ID NO: 809559 - protein, 592 aa, Homo sapiens
SQVVEGLKVRGGGQLHRLHPAGRPGNLQGALFPPSLSPTGRLPRARGGEGQRTWARAMCLLSVQTGGEARSRPAGTAGAEARVLGPESRGILDPREALGRGTSGVGSRALDRRGREAALVPRASGSREGAPDPALRRRFPGSFKFESPGGGSAASGTGVAERRAPSGRSGAMEEGAPRQPGPSQWPPEDEKEVIRRAIQKELKIKEGVENLRRVATDRRHLGHVQQLLRSSNRRLEQLHGELRELHARILLPGPGPGPAEPVASGPRPWAEQLRARHLEALRRQLHVELKVKQGAENMTHTCASGTPKERKLLAAAQQMLRDSQLKVALLRMKISSLEASGSPEPGPELLAEELQHRLHVEAAVAEGAKNVVKLLSSRRTQDRKALAEAQAQLQESSQKLDLLRLALEQLLEQLPPAHPLRSRVTRELRAAVPGYPQPSGTPVKPTALTGTLQVRLLGCEQLLTAVPGRSPAAALASSPSEGWLRTKAKHQRGRGELASEVLAVLKVDNRVVGQTGWGQVAEQSWDQTFVIPLERARELEIGVHWRDWRQLCGVAFLRLEDFLDNACHQLSLSLVPQGLLFAQSVCLGVPGS

SEQ ID NO: 809560 - protein, 286 aa, Homo sapiens
VEAGCKIETRKAGCAQAQLQESSQKLDLLRLALEQLLEQLPPAHPLRSRVTRELRAAVPGYPQPSGTPVKPTALTGTLQVRLLGCEQLLTAVPGRSPAAALASSPSEGWLRTKAKHQRGRGELASEVLAVLKVDNRVVGQTGWGQVAEQSWDQTFVIPLERARELEIGVHWRDWRQLCGVAFLRLEDFLDNACHQLSLSLVPQGLLFAQVTFCDPVIERRPRLQRQERIFSKRRGRLPGLRLCVRAIPGTLRASPGTSVPFPHRLLEPLLVHPCALPGGPGLAGYF

SEQ ID NO: 809561 - protein, 1060 aa, Homo sapiens
SQVVEGLKVRGGGQLHRLHPAGRPGNLQGALFPPSLSPTGRLPRARGGEGQRTWARAMCLLSVQTGGEARSRPAGTAGAEARVLGPESRGILDPREALGRGTSGVGSRALDRRGREAALVPRASGSREGAPDPALRRRFPGSFKFESPGGGSAASGTGVAERRAPSGRSGAMEEGAPRQPGPSQWPPEDEKEVIRRAIQKELKIKEGVENLRRVATDRRHLGHVQQLLRSSNRRLEQLHGELRELHARILLPGPGPGPAEPVASGPRPWAEQLRARHLEALRRQLHVELKVKQGAENMTHTCASGTPKERKLLAAAQQMLRDSQLKVALLRMKISSLEASGSPEPGPELLAEELQHRLHVEAAVAEGAKNVVKLLSSRRTQDRKALAEAQAQLQESSQKLDLLRLALEQLLEQLPPAHPLRSRVTRELRAAVPGYPQPSGTPVKPTALTGTLQVRLLGCEQLLTAVPGRSPAAALASSPSEGWLRTKAKHQRGRGELASEVLAVLKVDNRVVGQTGWGQVAEQSWDQTFVIPLERARELEIGVHWRDWRQLCGVAFLRLEDFLDNACHQLSLSLVPQGLLFAQVTFCDPVIERRPRLQRQERIFSKRRGQDFLRASQMNLGMAAWGRLVMNLLPPCSSPSTISPPKGCPRTPTTLREASDPATPSNFLPKKTPLGEEMTPPPKPPRLYLPQEPTSEETPRTKRPHMEPRTRRGPSPPASPTRKPPRLQDFRCLAVLGRGHFGKVLLVQFKGTGKYYAIKALKKQEVLSRDEIESLYCEKRILEAVGCTGHPFLLSLLACFQTSSHACFVTEFVPGGDLMMQIHEDVFPEPQARFYVACVVLGLQFLHEKKIIYRDLKLDNLLLDAQGFLKIADFGLCKEGIGFGDRTSTFCGTPEFLAPEVLTQEAYTRAVDWWGLGVLLYEMLVGECPFPGDTEEEVFDCIVNMDAPYPGFLSVQGLEFIQKLLQKCPEKRLGAGEQDAEEIKVQPFFRTTNWQALLARTIQPPFVPTLCGPADLRYFEGEFTGLPPALTPPAPHSLLTARQQAAFRDFDFVSERFLEP

SEQ ID NO: 809562 - protein, 1104 aa, Homo sapiens
SQVVEGLKVRGGGQLHRLHPAGRPGNLQGALFPPSLSPTGRLPRARGGEGQRTWARAMCLLSVQTGGEARSRPAGTAGAEARVLGPESRGILDPREALGRGTSGVGSRALDRRGREAALVPRASGSREGAPDPALRRRFPGSFKFESPGGGSAASGTGVAERRAPSGRSGAMEEGAPRQPGPSQWPPEDEKEVIRRAIQKELKIKEGVENLRRVATDRRHLGHVQQLLRSSNRRLEQLHGELRELHARILLPGPGPGPAEPVASGPRPWAEQLRARHLEALRRQLHVELKVKQGAENMTHTCASGTPKERKLLAAAQQMLRDSQLKVALLRMKISSLEASGSPEPGPELLAEELQHRLHVEAAVAEGAKNVVKLLSSRRTQDRKALAEAQAQLQESSQKLDLLRLALEQLLEQLPPAHPLRSRVTRELRAAVPGYPQPSGTPVKPTALTGTLQVRLLGCEQLLTAVPGRSPAAALASSPSEGWLRTKAKHQRGRGELASEVLAVLKVDNRVVGQTGWGQVAEQSWDQTFVIPLERARELEIGVHWRDWRQLCGVAFLRLEDFLDNACHQLSLSLVPQGLLFAQVTFCDPVIERRPRLQRQERIFSKRRGQDFLRASQMNLGMAAWGRLVMNLLPPCSSPSTISPPKGCPRTPTTLREASDPATPSNFLPKKTPLGEEMTPPPKPPRLYLPQEPTSEETPRTKRPHMEPRTRRGPSPPASPTRKPPRLQDFRCLAVLGRGHFGKEWAEEGGMGQDWGPHHMSREDLICGGGKGSLVWPTWSTTSLWPQVLLVQFKGTGKYYAIKALKKQEVLSRDEIESLYCEKRILEAVGCTGHPFLLSLLACFQTSSHACFVTEFVPGGDLMMQIHEDVFPEPQARFYVACVVLGLQFLHEKKIIYRDLKLDNLLLDAQGFLKIADFGLCKEGIGFGDRTSTFCGTPEFLAPEVLTQEAYTRAVDWWGLGVLLYEMLVGECPFPGDTEEEVFDCIVNMDAPYPGFLSVQGLEFIQKLLQKCPEKRLGAGEQDAEEIKVQPFFRTTNWQALLARTIQPPFVPTLCGPADLRYFEGEFTGLPPALTPPAPHSLLTARQQAAFRDFDFVSERFLEP

SEQ ID NO: 809563 - protein, 1028 aa, Homo sapiens
SQVVEGLKVRGGGQLHRLHPAGRPGNLQGALFPPSLSPTGRLPRARGGEGQRTWARAMCLLSVQTGGEARSRPAGTAGAEARVLGPESRGILDPREALGRGTSGVGSRALDRRGREAALVPRASGSREGAPDPALRRRFPGSFKFESPGGGSAASGTGVAERRAPSGRSGAMEEGAPRQPGPSQWPPEDEKEVIRRAIQKELKIKEGVENLRRVATDRRHLGHVQQLLRSSNRRLEQLHGELRELHARILLPGPGPGPAEPVASGPRPWAEQLRARHLEALRRQLHVELKVKQGAENMTHTCASGTPKERKLLAAAQQMLRDSQLKVALLRMKISSLEASGSPEPGPELLAEELQHRLHVEAAVAEGAKNVVKLLSSRRTQDRKALAEAQAQLQESSQKLDLLRLALEQLLEQLPPAHPLRSRVTRELRAAVPGYPQPSGTPVKPTALTGTLQVRLLGCEQLLTAVPGRSPAAALASSPSEGWLRTKAKHQRGRGELASEVLAVLKVDNRVVGQTGWGQVAEQSWDQTFVIPLERARELEIGVHWRDWRQLCGVAFLRLEDFLDNACHQLSLSLVPQGLLFAQVTFCDPVIERRPRLQRQERIFSKRRGQDFLRASQMNLGMAAWGRLVMNLLPPCSSPSTISPPKGCPRTPTTLREASDPATPSNFLPKKTPLGEEMTPPPKPPRLYLPQEPTSEETPRTKRPHMEPRTRRGPSPPASPTRKPPRLQDFRCLAVLGRGHFGKVLLVQFKGTGKYYAIKALKKQEVLSRDEIESLYCEKRILEAVGCTGHPFLLSLLACFQTSSHACFVTEFVPGGDLMMQIHEDVFPEPQARFYVACVVLGLQFLHEKKIIYRDLKLDNLLLDAQGFLKIADFGLCKEGIGFGDRTSTFCGTPEFLAPEVLTQEAYTRAVDWWGLGVLLYEMLVGELCPLPPQTVRASARSPVRPAWRSRPCWVLLSPWDSKWQPWGHCCGLCSVSLGKVCPFPLQLALFYLPARPGPERVPQQGVIWFVFLRLDLLYIKFVKVKKK

SEQ ID NO: 809564 - protein, 364 aa, Homo sapiens
LESWVRIGRGEPRTRRGPSPPASPTRKPPRLQDFRCLAVLGRGHFGKVLLVQFKGTGKYYAIKALKKQEVLSRDEIESLYCEKRILEAVGCTGHPFLLSLLACFQTSSHACFVTEFVPGGDLMMQIHEDVFPEPQARFYVACVVLGLQFLHEKKIIYRDLKLDNLLLDAQGFLKIADFGLCKEGIGFGDRTSTFCGTPEFLAPEVLTQEAYTRAVDWWGLGVLLYEMLVGECPFPGDTEEEVFDCIVNMDAPYPGFLSVQGLEFIQKLLQKCPEKRLGAGEQDAEEIKVQPFFRTTNWQALLARTIQPPFVPTLCGPADLRYFEGEFTGLPPALTPPAPHSLLTARQQAAFRDFDFVSERFLEP

SEQ ID NO: 809565 - protein, 235 aa, Homo sapiens
FSHNHPCSFYVACVVLGLQFLHEKKIIYRDLKLDNLLLDAQGFLKIADFGLCKEGIGFGDRTSTFCGTPEFLAPEVLTQEAYTRAVDWWGLGVLLYEMLVGECPFPGDTEEEVFDCIVNMDAPYPGFLSVQGLEFIQKLLQKCPEKRLGAGEQDAEEIKVQPFFRTTNWQALLARTIQPPFVPTLCGPADLRYFEGEFTGLPPALTPPAPHSLLTARQQAAFRDFDFVSERFLEP

SEQ ID NO: 809566 - protein, 168 aa, Homo sapiens
LQPHLLRLCSGGEEASRSDGGAGAGAEPGSGSSRDPPEAGPVGPLWAWRSRPSPPETEGHSPRRAKRVWCTTQECSKMGRSLIHPETETNLSSSELANRKSSKVLKRVQPSWVLFLLSPSAPIPARMSLGQRAKLTCTPDVAYGATGHPGVIPPNATLIFDVELLNLE

SEQ ID NO: 809567 - protein, 108 aa, Homo sapiens
MGVEIETISPGDGRTFPKKGQTCVVHYTGMLQNGKKFDSSRDRNKPFKFRIGKQEVIKGFEEGAAQMSLGQRAKLTCTPDVAYGATGHPGVIPPNATLIFDVELLNLE

SEQ ID NO: 809568 - protein, 113 aa, Homo sapiens
DSSRTSSGSAVAARRRAGRTFPKKGQTCVVHYTGMLQNGKKFDSSRDRNKPFKFRIGKQEVIKGFEEGAAQMSLGQRAKLTCTPDVAYGATGHPGVIPPNATLIFDVELLNLE

SEQ ID NO: 809569 - protein, 125 aa, Homo sapiens
TPAAPPPALQWRRGGEPERRRGWGRSRAGVGQQQGPPRGGACGTAMGVEIETISPGDGRTFPKKGQTCVVHYTGMLQNGKKFDSSRDRNKPFKFRIGKQEVIKGFEEGAAQLGPLSPLPICPHPC

SEQ ID NO: 809570 - protein, 102 aa, Homo sapiens
TPAAPPPALQWRRGGEPERRRGWGRSRAGVGQQQGPPRGGACGTAMGVEIETISPGDGRTFPKKGQTCVVHYTASLVGMIKEAWKANSFPLLPARAIHGASF

SEQ ID NO: 809571 - protein, 155 aa, Homo sapiens
DSSRTSSGSAVAARRRAGATAGLGPEPSRGRAAAGTPQRRGLWDRYGRGDRDHLPRRRKDIPQEGPNVCGALHSQSSGNDKGGLEGQLFPSSTSKGHPWCQLLGMLQNGKKFDSSRDRNKPFKFRIGKQEVIKGFEEGAAQLGPLSPLPICPHPC

SEQ ID NO: 809572 - protein, 77 aa, Homo sapiens
TPAAPPPALQWRRGGEPERRRGWGRSRAGVGQQQGPPRGGACGTAMGVEIETISPGDGRTFPKKGQTCVVHYTGEVE

SEQ ID NO: 809573 - protein, 109 aa, Homo sapiens
MSSKRTKTKTKKRPQRATSNVFAMFDQSQIQEFKEAFNMIDQNRDGFIDKEDLHDMLASLGKNPTDEYLDAMMNEAPGPINFTMFLTMFGEKLNGTDPEDVIRNALCLL

SEQ ID NO: 809574 - protein, 109 aa, Homo sapiens; identical to SEQ ID NO: 809573

SEQ ID NO: 809575 - protein, 135 aa, Homo sapiens
MSSEMPCACFDEEATGTIQEDYLRELLTTMGDRFTDEEVDELYREAPIDKVDHTPQGNFNYIEFTRILKTMEPKTKMTEITSKFQPNVPCCHFGYSEIFLLHALSFTAFAFPVVFILSHFGHMYLYNQTGNGTFY

SEQ ID NO: 809576 - protein, 109 aa, Homo sapiens; identical to SEQ ID NO: 809573

SEQ ID NO: 809577 - protein, 122 aa, Homo sapiens
GRVGDPRVRLRELLTTMGDRFTDEEVDELYREAPIDKVDHTPQGNFNYIEFTRILKTMEPKTKMTEITSKFQPNVPCCHFGYSEIFLLHALSFTAFAFPVVFILSHFGHMYLYNQTGNGTFY

SEQ ID NO: 809578 - protein, 109 aa, Homo sapiens; identical to SEQ ID NO: 809573

SEQ ID NO: 809579 - protein, 109 aa, Homo sapiens; identical to SEQ ID NO: 809573

SEQ ID NO: 809580 - protein, 109 aa, Homo sapiens; identical to SEQ ID NO: 809573

SEQ ID NO: 809581 - protein, 109 aa, Homo sapiens; identical to SEQ ID NO: 809573

SEQ ID NO: 809582 - protein, 109 aa, Homo sapiens; identical to SEQ ID NO: 809573

SEQ ID NO: 809583 - protein, 109 aa, Homo sapiens; identical to SEQ ID NO: 809573

SEQ ID NO: 809584 - protein, 109 aa, Homo sapiens; identical to SEQ ID NO: 809573

SEQ ID NO: 809585 - protein, 109 aa, Homo sapiens; identical to SEQ ID NO: 809573

SEQ ID NO: 809586 - protein, 149 aa, Homo sapiens
ALRRALECAARQSHRTDATICGKDRGEEDLTLQQQDLTTTMSSKRTKTKTKKRPQRATSNVFAMFDQSQIQEFKEAFNMIDQNRDGFIDKEDLHDMLASLGKNPTDEYLDAMMNEAPGPINFTMFLTMFGEKLNGTDPEDVIRNALCLL

SEQ ID NO: 809587 - protein, 140 aa, Homo sapiens
RVGSLVRSQLCWNFVLTGEVQLRESEDLTTTMSSKRTKTKTKKRPQRATSNVFAMFDQSQIQEFKEAFNMIDQNRDGFIDKEDLHDMLASLGKNPTDEYLDAMMNEAPGPINFTMFLTMFGEKLNGTDPEDVIRNALCLL

SEQ ID NO: 809588 - protein, 109 aa, Homo sapiens; identical to SEQ ID NO: 809573

SEQ ID NO: 809589 - protein, 109 aa, Homo sapiens; identical to SEQ ID NO: 809573

SEQ ID NO: 809590 - protein, 109 aa, Homo sapiens; identical to SEQ ID NO: 809573

SEQ ID NO: 809591 - protein, 109 aa, Homo sapiens; identical to SEQ ID NO: 809573

SEQ ID NO: 809592 - protein, 145 aa, Homo sapiens
KERLMSLKDCRWVLLVLEAAPGLNEGYVYLMDLTTTMSSKRTKTKTKKRPQRATSNVFAMFDQSQIQEFKEAFNMIDQNRDGFIDKEDLHDMLASLGKNPTDEYLDAMMNEAPGPINFTMFLTMFGEKLNGTDPEDVIRNALCLL

SEQ ID NO: 809593 - protein, 141 aa, Homo sapiens
MAQILKMSSEMPCACFDEEATGTIQEDYLRELLTTMGDRFTDEEVDELYREAPIDKVDHTPQGNFNYIEFTRILKTMEPKTKMTEITSKFQPNVPCCHFGYSEIFLLHALSFTAFAFPVVFILSHFGHMYLYNQTGNGTFY

SEQ ID NO: 809594 - protein, 117 aa, Homo sapiens
TSRFTSTVAVVLELSCLRVRYSYENPSNVFAMFDQSQIQEFKEAFNMIDQNRDGFIDKEDLHDMLASLGKNPTDEYLDAMMNEAPGPINFTMFLTMFGEKLNGTDPEDVIRNALCLL

SEQ ID NO: 809595 - protein, 147 aa, Homo sapiens
YCAARTLIWILKMSSEMPCACFDEEATGTIQEDYLRELLTTMGDRFTDEEVDELYREAPIDKVDHTPQGNFNYIEFTRILKTMEPKTKMTEITSKFQPNVPCCHFGYSEIFLLHALSFTAFAFPVVFILSHFGHMYLYNQTGNGTFY

SEQ ID NO: 809596 - protein, 172 aa, Homo sapiens
SWTRHLLSESKPRSEVWFPALSLMHIFRIQIMIWILKMSSEMPCACFDEEATGTIQEDYLRELLTTMGDRFTDEEVDELYREAPIDKVDHTPQGNFNYIEFTRILKTMEPKTKMTEITSKFQPNVPCCHFGYSEIFLLHALSFTAFAFPVVFILSHFGHMYLYNQTGNGTFY

SEQ ID NO: 809597 - protein, 109 aa, Homo sapiens; identical to SEQ ID NO: 809573

SEQ ID NO: 809598 - protein, 109 aa, Homo sapiens; identical to SEQ ID NO: 809573

SEQ ID NO: 809599 - protein, 109 aa, Homo sapiens; identical to SEQ ID NO: 809573

SEQ ID NO: 809600 - protein, 109 aa, Homo sapiens; identical to SEQ ID NO: 809573

SEQ ID NO: 809601 - protein, 109 aa, Homo sapiens; identical to SEQ ID NO: 809573

SEQ ID NO: 809602 - protein, 109 aa, Homo sapiens; identical to SEQ ID NO: 809573

SEQ ID NO: 809603 - protein, 109 aa, Homo sapiens; identical to SEQ ID NO: 809573

SEQ ID NO: 809604 - protein, 109 aa, Homo sapiens; identical to SEQ ID NO: 809573

SEQ ID NO: 809605 - protein, 109 aa, Homo sapiens; identical to SEQ ID NO: 809573

SEQ ID NO: 809606 - protein, 109 aa, Homo sapiens; identical to SEQ ID NO: 809573

SEQ ID NO: 809607 - protein, 135 aa, Homo sapiens; identical to SEQ ID NO: 809575

SEQ ID NO: 809608 - protein, 109 aa, Homo sapiens; identical to SEQ ID NO: 809573

SEQ ID NO: 809609 - protein, 109 aa, Homo sapiens; identical to SEQ ID NO: 809573

SEQ ID NO: 809610 - protein, 109 aa, Homo sapiens; identical to SEQ ID NO: 809573

SEQ ID NO: 809611 - protein, 148 aa, Homo sapiens
ISLSSGSEPSMPPRSCATSGSWGRSQRARGPLSRAWPATATQASVLASPPSGDAQLRMGPRVDADLGTPPFRGHHRDASRMPLCQPDTRTFVKNSNRQERQRVTRLCPVIGWHMLTSCQTTSTRVIHVHLQQPARYSLCDFSVCVCVS

SEQ ID NO: 809612 - protein, 429 aa, Homo sapiens
RGAGGGLGAAATARHDAAAPAPDMLLLKKHTEDISSVYEIRERLGSGAFSEVVLAQERGSAHLVALKCIPKKALRGKEALVENEIAVLRRISHPNIVALEDVHESPSHLYLAMELVTGGELFDRIMERGSYTEKDASHLVGQVLGAVSYLHSLGIVHRDLKPENLLYATPFEDSKIMVSDFGLSKIQAGNMLGTACGTPGYVGEGRHPEACWEWGGLGDPRQPGRLLCPLPLCGPFLGLSEAEPVTLSGMAACVPVRASVCLWPPAPELLEQKPYGKAVDVWALGVISYILLCGYPPFYDESDPELFSQILRASYEFDSPFWDDISESAKDFIRHLLERDPQKRFTCQQALRHLWISGDTAFDRDILGSVSEQIRKNFARTHWKRAFNATSFLRHIRKLGQIPEGEGASEQGMARHSHSGLRAGQPPKW

SEQ ID NO: 809613 - protein, 372 aa, Homo sapiens
RGAGGGLGAAATARHDAAAPAPDMLLLKKHTEDISSVYEIRERLGSGAFSEVVLAQERGSAHLVALKCIPKKALRGKEALVENEIAVLRRISHPNIVALEDVHESPSHLYLAMELVTGGELFDRIMERGSYTEKDASHLVGQVLGAVSYLHSLGIVHRDLKPENLLYATPFEDSKIMVSDFGLSKIQAGNMLGTACGTPGYVAPELLEQKPYGKAVDVWALGVISYILLCGYPPFYDESDPELFSQILRASYEFDSPFWDDISESAKDFIRHLLERDPQKRFTCQQALRHLWISGDTAFDRDILGSVSEQIRKNFARTHWKRAFNATSFLRHIRKLGQIPEGEGASEQGMARHSHSGGPQGLSFLHGCCVLR

SEQ ID NO: 809614 - protein, 180 aa, Homo sapiens [sequence omitted]

SEQ ID NO: 809615 - protein, 421 aa, Homo sapiens
RGGGAPDPARGRRSLARPQHTCHAWRAPCPHALGPRSSGRGRPRLPGPPAPRRRGLGCVCGRVGGRGLGRWLRAGVADMLLLKKHTEDISSVYEIRERLGSGAFSEVVLAQERGSAHLVALKCIPKKALRGKEALVENEIAVLRRISHPNIVALEDVHESPSHLYLAMELVTGGELFDRIMERGSYTEKDASHLVGQVLGAVSYLHSLGIVHRDLKPENLLYATPFEDSKIMVSDFGLSKIQAGNMLGTACGTPGYVAPELLEQKPYGKAVDVWALGVISYILLCGYPPFYDESDPELFSQILRASYEFDSPFWDDISESAKDFIRHLLERDPQKRFTCQQALRHLWISGDTAFDRDILGSVSEQIRKNFARTHWKRAFNATSFLRHIRKLGQIPEGEGASEQGMARHSHSGLRAGQPPKW

SEQ ID NO: 809616 - protein, 433 aa, Homo sapiens
MEAAFGQVAGSACPRRGGEGRDWKAESLADLWPKSSPGDSHRWCKGPGAGPAGPQLREAARASSGLGGGGRHPSRIPAIALQDMLLLKKHTEDISSVYEIRERLGSGAFSEVVLAQERGSAHLVALKCIPKKALRGKEALVENEIAVLRRRFLAIDRISHPNIVALEDVHESPSHLYLAMELVTGGELFDRIMERGSYTEKDASHLVGQVLGAVSYLHSLGIVHRDLKPENLLYATPFEDSKIMVSDFGLSKIQAGNMLGTACGTPGYVAPELLEQKPYGKAVDVWALGVISYILLCGYPPFYDESDPELFSQILRASYEFDSPFWDDISESAKDFIRHLLERDPQKRFTCQQALRHLWISGDTAFDRDILGSVSEQIRKNFARTHWKRAFNATSFLRHIRKLGQIPEGEGASEQGMARHSHSGLRAGQPPKW

SEQ ID NO: 809617 - protein, 180 aa, Homo sapiens [sequence omitted]

SEQ ID NO: 809618 - protein, 180 aa, Homo sapiens [sequence omitted]

SEQ ID NO: 809619 - protein, 304 aa, Homo sapiens
MERGSYTEKDASHLVGQVLGAVSYLHSLGIVHRDLKPENLLYATPFEDSKIMVSDFGLSKIQAGNMLGTACGTPGYVGEGRHPEACWEWGGLGDPRQPGRLLCPLPLCGPFLGLSEAEPVTLSGMAACVPVRASVCLWPPAPELLEQKPYGKAVDVWALGVISYILLCGYPPFYDESDPELFSQILRASYEFDSPFWDDISESAKDFIRHLLERDPQKRFTCQQALRHLWISGDTAFDRDILGSVSEQIRKNFARTHWKRAFNATSFLRHIRKLGQIPEGEGASEQGMARHSHSGLRAGQPPKW

SEQ ID NO: 809620 - protein, 366 aa, Homo sapiens
RGAGGGLGAAATARHDAAAPAPDMLLLKKHTEDISSVYEIRERLGSGAFSEVVLAQERGSAHLVALKCIPKKALRGKEALVENEIAVLRRISHPNIVALEDVHESPSHLYLAMELVTGGELFDRIMERGSYTEKDASHLVGQVLGAVSYLHSLGIVHRDLKPENLLYATPFEDSKIMVSDFGLSKIQAGNMLGTACGTPGYVAPELLEQKPYGKAVDVWALGVISYILLCGYPPFYDESDPELFSQILRASYEFDSPFWDDISESAKDFIRHLLERDPQKRFTCQQALRHLWISGDTAFDRDILGSVSEQIRKNFARTHWKRAFNATSFLRHIRKLGQIPEGEGASEQGMARHSHSGLRAGQPPKW

SEQ ID NO: 809621 - protein, 460 aa, Homo sapiens
RGAGGGLGAAATARHDAAAPAPDMLLLKKHTEDISSVYEIRERLGSGAFSEVVLAQERGSAHLVALKCIPKKALRGKEALVENEIAVLRRISHPNIVALEDVHESPSHLYLAMELVTGGELFDRIMERGSYTEKDASHLVGQVLGAVSYLHSLGIVHRDLKPENLLYATPFEDSKIMVSDFGLSKIQAGNMLGTACGTPGYVGEGRHPEACWEWGGLGDPRQPGRLLCPLPLCGPFLGLSGRASDTERHGCVCACACVCLSLAPSPRALGAETLREGRRCVGPGRHLLHPVSDRWEGLSPACLPLLGVGRVGQLDDSSVGARLCGYPPFYDESDPELFSQILRASYEFDSPFWDDISESAKDFIRHLLERDPQKRFTCQQALRHLWISGDTAFDRDILGSVSEQIRKNFARTHWKRAFNATSFLRHIRKLGQIPEGEGASEQGMARHSHSGLRAGQPPKW

SEQ ID NO: 809622 - protein, 369 aa, Homo sapiens
GAFWKAAGCVEAERQHPGAGRLRGADMLLLKKHTEDISSVYEIRERLGSGAFSEVVLAQERGSAHLVALKCIPKKALRGKEALVENEIAVLRRISHPNIVALEDVHESPSHLYLAMELVTGGELFDRIMERGSYTEKDASHLVGQVLGAVSYLHSLGIVHRDLKPENLLYATPFEDSKIMVSDFGLSKIQAGNMLGTACGTPGYVAPELLEQKPYGKAVDVWALGVISYILLCGYPPFYDESDPELFSQILRASYEFDSPFWDDISESAKDFIRHLLERDPQKRFTCQQALRHLWISGDTAFDRDILGSVSEQIRKNFARTHWKRAFNATSFLRHIRKLGQIPEGEGASEQGMARHSHSGLRAGQPPKW

SEQ ID NO: 809623 - protein, 426 aa, Homo sapiens
MEAAFGQVAGSACPRRGGEGRDWKAESLADLWPKSSPGDSHRWCKGPGAGPAGPQLREAARASSGLGGGGRHPSRIPAIALQDMLLLKKHTEDISSVYEIRERLGSGAFSEVVLAQERGSAHLVALKCIPKKALRGKEALVENEIAVLRRISHPNIVALEDVHESPSHLYLAMELVTGGELFDRIMERGSYTEKDASHLVGQVLGAVSYLHSLGIVHRDLKPENLLYATPFEDSKIMVSDFGLSKIQAGNMLGTACGTPGYVAPELLEQKPYGKAVDVWALGVISYILLCGYPPFYDESDPELFSQILRASYEFDSPFWDDISESAKDFIRHLLERDPQKRFTCQQALRHLWISGDTAFDRDILGSVSEQIRKNFARTHWKRAFNATSFLRHIRKLGQIPEGEGASEQGMARHSHSGLRAGQPPKW

SEQ ID NO: 809624 - protein, 180 aa, Homo sapiens [sequence omitted]

SEQ ID NO: 809625 - protein, 375 aa, Homo sapiens
LRPAWQGVEEEAALAPGGAGRDPHHLSPAPADMLLLKKHTEDISSVYEIRERLGSGAFSEVVLAQERGSAHLVALKCIPKKALRGKEALVENEIAVLRRISHPNIVALEDVHESPSHLYLAMELVTGGELFDRIMERGSYTEKDASHLVGQVLGAVSYLHSLGIVHRDLKPENLLYATPFEDSKIMVSDFGLSKIQAGNMLGTACGTPGYVAPELLEQKPYGKAVDVWALGVISYILLCGYPPFYDESDPELFSQILRASYEFDSPFWDDISESAKDFIRHLLERDPQKRFTCQQALRHLWISGDTAFDRDILGSVSEQIRKNFARTHWKRAFNATSFLRHIRKLGQIPEGEGASEQGMARHSHSGLRAGQPPKW

SEQ ID NO: 809626 - protein, 180 aa, Homo sapiens [sequence omitted]

SEQ ID NO: 809627 - protein, 176 aa, Homo sapiens
SNSLRGGHSVSTATNEARRCKSRSRKSSTGVGTTRPDASAAKTQSPRCSSRSPFRSPLHRRTVAFPGKQPPARTANAAQKGVGVAPENNGLLVRIWGAPCRVATRGKGHNVPRPRRKEGMPLFPSLGRRKASGQKQKELFLPWTGFPNKVTWKTMAINQRKSVPLPLPPPPHSIHN

SEQ ID NO: 809628 - protein, 377 aa, Homo sapiens
NSGDLPAPSPPRCSPQFPSIGQEPPEMNLYYENFFHPQGVPSPQRPSFEGGGEYGATPNPYLWFNGPTMTPPPYLPGPNASPFLPQAYGVQRPLLPSVSGLGGSDLGWLPIPSQEELMKLVRPPYSYSALIAMAIHGAPDKRLTLSQIYQYVADNFPFYNKSKAGWQNSIRHNLSLNDCFKKVPRDEDDPGKGNYWTLDPNCEKMFDNGNFRRKRKRKSDVSSSTASLALEKTESSLPVDSPKTTEPQDILDGASPGGTTSSPEKRPSPPPSGAPCLNSFLSSMTAYVSGGSPTSHPLVTPGLSPEPSDKTGQNSLTFNSFSPLTNLSNHSGGGDWANPMPTNMLSYGGSVLSQFSPHFYNSVNTSGVLYPREGTEV

SEQ ID NO: 809629 - protein, 108 aa, Homo sapiens
MGFTGMLQSRTVVFYVPCMVILVAICCKILEAKCLQYRFLATVYAVISLCLSWAVLENTLVFTIWFTNTIIILPGLKCRIWHIDACNGKKKNLLKFVNVQLNLRYTVG

SEQ ID NO: 809630 - protein, 108 aa, Homo sapiens; identical to SEQ ID NO: 809629

SEQ ID NO: 809631 - protein, 122 aa, Homo sapiens
IDCPHPATVLAQPIFIDACSVLGAYQGAQNWIRRRPCLPSGCLKMNREIGPLHEARLLIIPDIFSCYTQNKHSKYEQDGEPDLSNHGGVDVNFLQSISKEIPVPHVYLVSHLSSDPHQIRGR

SEQ ID NO: 809632 - protein, 406 aa, Homo sapiens
MSGAPTAGAALMLCAATAVLLSAQGGPVQSKSPRFASWDEMNVLAHGLLQLGQGLREHAERTRSQLSALERRLSACGSACQGTEGSTDLPLAPESRVDPEVLHSLQTQLKAQNSRIQQLFHKVAQQQRHLEKQHLRIQHLQSQFGLLDHKHLDHEVAKPARRKRLPEMAQPVDPAHNVSRLHRLPRDCQELFQVGERQSGLFEIQPQGSPPFLVNCKMTSDGGWTVIQRRHDGSVDFNRPWEAYKAGFGDPHGEFWLGLEKVHSITGDRNSRLAVQLRDWDGNAELLQFSVHLGGEDTAYSLQLTAPVAGQLGATTVPPSGLSVPFSTWDQDHDLRRDKNCAKSLSGGWWFGTCSHSNLNGQYFRSIPQQRQKLKKGIFWKTWRGRYYPLQATTMLIQPMAAEAAS

SEQ ID NO: 809633 - protein, 406 aa, Homo sapiens; identical to SEQ ID NO: 809632

SEQ ID NO: 809634 - protein, 171 aa, Homo sapiens
MSGAPTAGAALMLCAATAVLLSAQGGPVQSKSPRFASWDEMNVLAHGLLQLGQGLREHAERTRSQLSALERRLSACGSACQGTEGSTDLPLAPESRVDPEVLHSLQTQLKAQNSRIQQLFHKVAQQQRHLEKQHLRIQHLQSQFGLLDHKHLDHLETCGQRRRPRLEKPPF

SEQ ID NO: 809635 - protein, 154 aa, Homo sapiens
MSGAPTAGAALMLCAATAVLLSAQGGPVQSKSPRFASWDEMNVLAHGLLQLGQGLREHAERTRSQLSALERRLSACGSACQGTEGSTDLPLAPESRVDPEVLHSLQTQLKAQNSRIQQLFHKVAQQQRHLEKQHLRIQHLQSQTGLNGGLSHID

SEQ ID NO: 809636 - protein, 163 aa, Homo sapiens
MAIAEAQEMGTGEYDYILKVVLIGDSGVGKSNLLSRFTRNEFNLESKSTIGVEFATRSIQVDGKTIKAQIWDTAGQERYRAITSAYYRGAVGALLVYDIAKHLTYENVERWLKELRDHADSNIVIMLVGNKSDLRHLRAVPTDEARAFAERTIVFIETQLDHK

SEQ ID NO: 809637 - protein, 218 aa, Homo sapiens
MGTRDDEYDYLFKVVLIGDSGVGKSNLLSRFTRNEFNLESKSTIGVEFATRSIQVDGKTIKAQIWDTAGQERYRAITSAYYRGAVGALLVYDIAKHLTYENVERWLKELRDHADSNIVIMLVGNKSDLRHLRAVPTDEARAFAEKNNLSFIETSALDSTNVEEAFKNILTEIYRIVSQKQIADRAAHDESPGNNVVDISVPPTTDGQKPNKLQCCQNL

SEQ ID NO: 809638 - protein, 241 aa, Homo sapiens
GNYQATRVRLCGGVADPAGSARTMGTRDDEYDYLFKVVLIGDSGVGKSNLLSRFTRNEFNLESKSTIGVEFATRSIQVDGKTIKAQIWDTAGQERYRAITSAYYRGAVGALLVYDIAKHLTYENVERWLKELRDHADSNIVIMLVGNKSDLRHLRAVPTDEARAFAEKNNLSFIETSALDSTNVEEAFKNILTEIYRIVSQKQIADRAAHDESPGNNVVDISVPPTTDGQKPNKLQCCQNL

SEQ ID NO: 809639 - protein, 245 aa, Homo sapiens
NPHPNRVTLTVTLPRGGVADPAGSARTMGTRDDEYDYLFKVVLIGDSGVGKSNLLSRFTRNEFNLESKSTIGVEFATRSIQVDGKTIKAQIWDTAGQERYRAITSAYYRGAVGALLVYDIAKHLTYENVERWLKELRDHADSNIVIMLVGNKSDLRHLRAVPTDEARAFAEKNNLSFIETSALDSTNVEEAFKNILTEIYRIVSQKQIADRAAHDESPGNNVVDISVPPTTDGQKPNKLQCCQNL

SEQ ID NO: 809640 - protein, 218 aa, Homo sapiens; identical to SEQ ID NO: 809637

SEQ ID NO: 809641 - protein, 218 aa, Homo sapiens; identical to SEQ ID NO: 809637

SEQ ID NO: 809642 - protein, 179 aa, Homo sapiens
MGTRDDEYDYLFKVVLIGDSGVGKSNLLSRFTRNEFNLESKSTIGVEFATRSIQVDGKTIKAQIWDTAGQERYRAITSAYYRGAVGALLVYDIAKHLTYENVERWLKELRDHADSNIVIMLVGNKSDLRHLRAVPTDEARAFAEKNNLSFIETSALDSTNVEEAFKNILTGGRGPDGCG

SEQ ID NO: 809643 - protein, 178 aa, Homo sapiens
LGTRGSRFATRSIQVDGKTIKAQIWDTAGQERYRAITSAYYRGAVGALLVYDIAKHLTYENVERWLKELRDHADSNIVIMLVGNKSDLRHLRAVPTDEARAFAEKNNLSFIETSALDSTNVEEAFKNILTEIYRIVSQKQIADRAAHDESPGNNVVDISVPPTTDGQKPNKLQCCQNL

SEQ ID NO: 809644 - protein, 139 aa, Homo sapiens
LGTRGSRFATRSIQVDGKTIKAQIWDTAGQERYRAITSAYYRGAVGALLVYDIAKHLTYENVERWLKELRDHADSNIVIMLVGNKSDLRHLRAVPTDEARAFAEKNNLSFIETSALDSTNVEEAFKNILTGGRGPDGCG

SEQ ID NO: 809645 - protein, 406 aa, Homo sapiens; identical to SEQ ID NO: 809632

SEQ ID NO: 809646 - protein, 368 aa, Homo sapiens
MSGAPTAGAALMLCAATAVLLSAQGGPVQSKSPRFASWDEMNVLAHGLLQLGQGLREHAERTRSQLSALERRLSACGSACQGTEGSTDLPLAPESRVDPEVLHSLQTQLKAQNSRIQQLFHKVAQQQRHLEKQHLRIQHLQSQFGLLDHKHLDHEVAKPARRKRLPEMAQPVDPAHNVSRLHHGGWTVIQRRHDGSVDFNRPWEAYKAGFGDPHGEFWLGLEKVHSITGDRNSRLAVQLRDWDGNAELLQFSVHLGGEDTAYSLQLTAPVAGQLGATTVPPSGLSVPFSTWDQDHDLRRDKNCAKSLSGGWWFGTCSHSNLNGQYFRSIPQQRQKLKKGIFWKTWRGRYYPLQATTMLIQPMAAEAAS

SEQ ID NO: 809647 - protein, 187 aa, Homo sapiens
MTGLVTEADNGTQQDRNRSPVILGVASLQEVQTACVSGYTDCDWPPKNISKPLDSWDEMSILNQRATSPRSLKNFPFLLVWGNQRLGPRKPDKCWPQYGAPGAWVLQGKNQRFPIRLEDQCAQRRGHIQTLEQGRLPRTEWAREHALKHQENRDGRDAGTNRKFSVNPNTNVDTVFDPGPGPRRTKR

SEQ ID NO: 809648 - protein, 406 aa, Homo sapiens; identical to SEQ ID NO: 809632

SEQ ID NO: 809649 - protein, 179 aa, Homo sapiens; identical to SEQ ID NO: 809642

SEQ ID NO: 809650 - protein, 377 aa, Homo sapiens
MSGAPTAGAALMLCAATAVLLSAQGGPVQSKSPRFASWDEMNVLAHGLLQLGQGLREHAERTRSQLSALERRLSACGSACQGTEGSTDLPLAPESRVDPEVLHSLQTQLKAQNSRIQQLFHKVAQQQRHLEKQHLRIQHLQSQFGLLDHKHLDHEVAKPARRKRLPEMAQPVDPAHNVSRLHRLPRDCQELFQVGERQSGLFEIQPQGSPPFLVNCKMTSDGGWTVIQRRHDGSVDFNRPWEAYKAGFGDPHGEVFLVGTEAGEEEGPSEVALPHGVASPTPGEFWLGLEKVHSITGDRNSRLAVQLRDWDGNAELLQFSVHLGGEDTAYSLQLTAPVAGQLGATTVPPSGLSVPFSTWDQDHDLCQGTLRVGSLPE

SEQ ID NO: 809651 - protein, 144 aa, Homo sapiens
MGTRDDEYDYLFKVVLIGDSGVGKSNLLSRFTRNEFNLESKSTIGVEFATRSIQVDGKTIKAQIWDTAGQERYRAITSAYYRGAVGALLVYDIAKHLTYENVERWLKEGGEGERRGRRGGGKKREGGEGGGGGGRRGGGGEKRR

SEQ ID NO: 809652 - protein, 156 aa, Homo sapiens
MGTRDDEYDYLFKVVLIGDSGVGKSNLLSRFTRNEFNLESKSTIGVEFATRSIQVDGKTIKAQIWDTAGQERYRAITSACVSAAWAGTLRFGGVGLQRVGLEGCVGVGQEKGRVCSQDQGVRLEEHFSHAPWDPQADQRPAFATPGYLWVPSAVRT

SEQ ID NO: 809653 - protein, 559 aa, Homo sapiens
MAASEDGSGCLVSRGRSQSDPSVLTDSSATSSADAGENPDEMDQTPPARPEYLVSGIRTPPVRRNSKLATLGRIFKPWKWRKKKNEKLKQTTSALEKKMAGRQGREELIKKGLLEMMEQDAESKTCNPDGGPRSVQSEPPTPKSETLTSEDAQPGSPLATGTDQVSLDKPLSSAAHLDDAAKMPSASSGEEADAGSLLPTTNELSQALAGADSLDSPPRPLERSVGQLPSPPLLPTPPPKASSKTTKNVTGQATLFQASSMKSADPSLRGQLSTPTGSPHLTTVHRPLPPSRVIEELHRALATKHRQDSFQGRESKGSPKKRLDVRLSRTSSVERGKEREEAWSFDGALENKRTAAKESEENKENLIINSELKDDLLLYQDEEALNDSIISGTLPRKCKKELLAVKLRNRPSKQELEDRNIFPRRTDEERQEIRQQIEMKLSKRLSQRPAVEELERRNILKQRNDQTEQEERREIKQRLTRKLNQRPTVDELRDRKILIRFSDYVEVAKAQDYDRRADKPWTRLSAADKAAIRKELNEYKSNEMEVHASSKHLTRFHRP

SEQ ID NO: 809654 - protein, 183 aa, Homo sapiens
MVQNVILVFFRRRLSQRPAVEELERRNILKQRNDQTEQEERREIKQRLTRKLNQRPTVDELRDRKILIRFSDYVEVAKAQDYDRRADKPWTRLSAADKAAIRKELNEYKSNEMEVHASSKHLTSITPWSHCSNNHQFRLRSSWSIEHAACCLCSSHFPFFLIDLELCASTPRLPAYCKHYSTW

SEQ ID NO: 809655 - protein, 128 aa, Homo sapiens
MVQNVILVFFRRRLSQRPAVEELERRNILKQRNDQTEQEERREIKQRLTRKLNQRPTVDELRDRKILIRFSDYVEVAKAQDYDRRADKPWTRLSAADKAAIRKELNEYKSNEMEVHASSKHLTRFHRP

SEQ ID NO: 809656 - protein, 128 aa, Homo sapiens; identical to SEQ ID NO: 809655

SEQ ID NO: 809657 - protein, 550 aa, Homo sapiens
MAFSKLLEQAGGVGLFQTLQVLTFILPCLMIPSQMLLENFSAAIPGHRCWTHMLDNGSAVSTNMTPKALLTISIPPGPNQGPHQCRRFRQPQWQLLDPNATATSWSEADTEPCVDGWVYDRSVFTSTIVAKWDLVCSSQGLKPLSQSIFMSGILVGSFIWGLLSYRFGRKPMLSWCCLQLAVAGTSTIFAPTFVIYCGLRFVAAFGMAGIFLSSLTLMVEWTTTSRRAVTMTVVGCAFSAGQAALGGLAFALRDWRTLQLAASVPFFAISLISWWLPESARWLIIKGKPDQALQELRKVARINGHKEAKNLTIEVLMSSVKEEVASAKEPRSVLDLFCVPVLRWRSCAMLVVNFSLLISYYGLVFDLQSLGRDIFLLQALFGAVDFLGRATTALLLSFLGRRTIQAGSQAMAGLAILANMLVPQDLQTLRVVFAVLGKGCFGISLTCLTIYKAELFPTPVRMTADGILHTVGRLGAMMGPLILMSRQALPLLPPLLYGVISIASSLVVLFFLPETQGLPLPDTIQDLESQKSTAAQGNRQEAVTVESTSL

SEQ ID NO: 809658 - protein, 547 aa, Homo sapiens
MAFSKLLEQAGGVGLFQTLQVLTFILPCLMIPSQMLLENFSAAIPGHRCWTHMLDNGSAVSTNMTPKALLTISIPPGPNQGPHQCRRFRQPQWQLLDPNATATSWSEADTEPCVDGWVYDRSVFTSTIVAKWDLVCSSQGLKPLSQSIFMSGILVGSFIWGLLSYRFGRKPMLSWCCLQLAVAGTSTIFAPTFVIYCGLRFVAAFGMAGIFLSSLTLMVEWTTTSRRAVTMTVVGCAFSAGQAALGGLAFALRDWRTLQLAASVPFFAISLISWWLPESARWLIIKGKPDQALQELRKVARINGHKEAKNLTIEVLMSSVKEEVASAKEPRSVLDLFCVPVLRWRSCAMLVVNFSLLISYYGLVFDLSPNPSPGQPRTKPAGPGTCREPRVPSAPGWLAATLTSPWVPSRANPTLTPFLYPDLQTLRVVFAVLGKGCFGISLTCLTIYKAELFPTPVRMTADGILHTVGRLGAMMGPLILMSRQALPLLPPLLYGVISIASSLVVLFFLPETQGLPLPDTIQDLESQKSTAAQGNRQEAVTVESTSL

SEQ ID NO: 809659 - protein, 401 aa, Homo sapiens
MSGILVGSFIWGLLSYRFGRKPMLSWCCLQLAVAGTSTIFAPTFVIYCGLRFVAAFGMAGIFLSSLTLMVEWTTTSRRAVTMTVVGCAFSAGQAALGGLAFALRDWRTLQLAASVPFFAISLISWWLPESARWLIIKGKPDQALQELRKVARINGHKEAKNLTIEVLMSSVKEEVASAKEPRSVLDLFCVPVLRWRSCAMLVVNFSLLISYYGLVFDLQSLGRDIFLLQALFGAVDFLGRATTALLLSFLGRRTIQAGSQAMAGLAILANMLVPQDLQTLRVVFAVLGKGCFGISLTCLTIYKAELFPTPVRMTADGILHTVGRLGAMMGPLILMSRQALPLLPPLLYGVISIASSLVVLFFLPETQGLPLPDTIQDLESQKSTAAQGNRQEAVTVESTSL

SEQ ID NO: 809660 - protein, 140 aa, Homo sapiens
MAGLAILANMLVPQDLQTLRVVFAVLGKGCFGISLTCLTIYKAELFPTPVRMTADGILHTVGRLGAMMGPLILMSRQALPLLPPLLYGVISIASSLVVLFFLPETQGLPLPDTIQDLESQKSTAAQGNRQEAVTVESTSL

SEQ ID NO: 809661 - protein, 390 aa, Homo sapiens
MAFSKLLEQAGGVGLFQTLQVLTFILPCLMIPSQMLLENFSAAIPGHRCWTHMLDNGSAVSTNMTPKALLTISIPPGPNQGPHQCRRFRQPQWQLLDPNATATSWSEADTEPCVDGWVYDRSVFTSTIVAKWDLVCSSQGLKPLSQSIFMSGILVGSFIWGLLSYRFGRKPMLSWCCLQLAVAGTSTIFAPTFVIYCGLRFVAAFGMAGIFLSSLTLMVEWTTTSRRAVTMTVVGCAFSAGQAALGGLAFALRDWRTLQLAASVPFFAISLISWWLPESARWLIIKGKPDQALQELRKVARINGHKEAKNLTIEVRCCCLRDLTWDRTCTEGSSVWPPTAPPTPAPPPPAPPPASPQTPPTPPSPPPHRHHHHHHQSRYHHQQHHHCPHP

SEQ ID NO: 809662 - protein, 96 aa, Homo sapiens
GGVDHDQQEGGHHDGGGMCLQRRPGGAGRPGLCPAGLEDSPAGSISALLCHLPDILVSMMWDLFLRRPRVGGGLFTFTSLAGSRSRDLECHRRAMA

SEQ ID NO: 809663 - protein, 410 aa, Homo sapiens [sequence omitted]

SEQ ID NO: 809664 - protein, 98 aa, Homo sapiens
LPRYPRVGQEVGFQIPSIPGRVCFCSLGKGGGRPITQPTLNALVLPVPSPQWVNKHTPALDSTDSKTTSTQKSCFFPISLNFPTSTYRSFFPPRPTQA

SEQ ID NO: 809665 - protein, 457 aa, Homo sapiens
MYKYDAAFNSRGRVAGWQVDRRARTAPRAPYNSFPSVHLRRAATGGAMDLTGLLLDEEGTFSLAGFQDFTFLPGHQKLSARIRRRLYYGWDWEADCSLEELSSPVADIAVELLQKAAPSPIRRLQKKYVAHVSREACISPCAMMLALVYIERLRHRNPDYLQHVSSSDLFLISMMVASKYLYDEGEEEEVFNDEWGAAGGVAVPTLNALERGFLSAMDWHLYTDPREIFEVLSWLESCVAEQQGRWRGWYTYTDLCVLLEQPTWQLALGSLCQRLVKLSCLLAVAYVSSVALAVASVAVIHQSLGLSCIPTPGPPDLGLTSRCLLEPCIPSVPQCLPSPANVSSCLEGSMGLRSLWGSLLASLTPPPLPPPDPPAPPTLLHNCHLCQKLQRDSPTCHACLHPNRTVPTALSSPWYHTYGLAPPWPWSPVPLSLPQPQQCSLFSVMELARLKSFVFPG

SEQ ID NO: 809666 - protein, 410 aa, Homo sapiens [sequence omitted]

SEQ ID NO: 809667 - protein, 410 aa, Homo sapiens [sequence omitted]

SEQ ID NO: 809668 - protein, 410 aa, Homo sapiens [sequence omitted]

SEQ ID NO: 809669 - protein, 410 aa, Homo sapiens [sequence omitted]

SEQ ID NO: 809670 - protein, 410 aa, Homo sapiens [sequence omitted]

SEQ ID NO: 809671 - protein, 337 aa, Homo sapiens
GRVGDHASVAHVSREACISPCAMMLALVYIERLRHRNPDYLQHVSSSDLFLISMMVASKYLYDEGEEEEVFNDEWGAAGGVAVPTLNALERGFLSAMDWHLYTDPREIFEVLSWLESCVAEQQGRWRGWYTYTDLCVLLEQPTWQLALGSLCQRLVKLSCLLAVAYVSSVALAVASVAVIHQSLGLSCIPTPGPPDLGLTSRCLLEPCIPSVPQCLPSPANVSSCLEGSMGLRSLWGSLLASLTPPPLPPPDPPAPPTLLHNCHLCQKLQRDSPTCHACLHPNRTVPTALSSPWYHTYGLAPPWPWSPVPLSLPQPQQCSLFSVMELARLKSFVFPG

SEQ ID NO: 809672 - protein, 410 aa, Homo sapiens [sequence omitted]

SEQ ID NO: 809673 - protein, 410 aa, Homo sapiens [sequence omitted]

SEQ ID NO: 809674 - protein, 308 aa, Homo sapiens
MSDRDGSQVSLSKHVSSSDLFLISMMVASKYLYDEGEEEEVFNDEWGAAGGVAVPTLNALERGFLSAMDWHLYTDPREIFEVLSWLESCVAEQQGRWRGWYTYTDLCVLLEQPTWQLALGSLCQRLVKLSCLLAVAYVSSVALAVASVAVIHQSLGLSCIPTPGPPDLGLTSRCLLEPCIPSVPQCLPSPANVSSCLEGSMGLRSLWGSLLASLTPPPLPPPDPPAPPTLLHNCHLCQKLQRDSPTCHACLHPNRTVPTALSSPWYHTYGLAPPWPWSPVPLSLPQPQQCSLFSVMELARLKSFVFPG

SEQ ID NO: 809675 - protein, 410 aa, Homo sapiens [sequence omitted]

SEQ ID NO: 809676 - protein, 172 aa, Homo sapiens
MDLTGLLLDEEGTFSLAGFQDFTFLPGHQKLSARIRRRLYYGWDWEADCSLEELSSPVADIAVELLQKAAPSPIRRLQKKYVAHVSREACISPCAMMLALVYIERLRHRNPDYLQHVSSSDLFLISMMVASKYLYDEGEEEEVFNDEWGAAGGVAVPTLNALERGFLSAMCG

SEQ ID NO: 809677 - protein, 410 aa, Homo sapiens [sequence omitted]

SEQ ID NO: 809678 - protein, 410 aa, Homo sapiens [sequence omitted]

SEQ ID NO: 809679 - protein, 410 aa, Homo sapiens [sequence omitted]

SEQ ID NO: 809680 - protein, 108 aa, Homo sapiens
MGLRSLWGSLLASLTPPPLPPPDPPAPPTLLHNCHLCQKLQRDSPTCHACLHPNRTVPTALSSPWYHTYGLAPPWPWSPVPLSLPQPQQCSLFSVMELARLKSFVFPG

SEQ ID NO: 809681 - protein, 180 aa, Homo sapiens
TLEDLCFGTAGKDSSASPLQLVSFRSPSQGGDWRRDGPDLGLTSRCLLEPCIPSVPQCLPSPANVSSCLEGSMGLRSLWGSLLASLTPPPLPPPDPPAPPTLLHNCHLCQKLQRDSPTCHACLHPNRTVPTALSSPWYHTYGLAPPWPWSPVPLSLPQPQQCSLFSVMELARLKSFVFPG

SEQ ID NO: 809682 - protein, 190 aa, Homo sapiens
AGVLEDPFLCWRVFSGVAEQQGRWRGWYTYTDLCVLLEQPTWQLALGSLCQRLVKLSCLLAVAYVSKCLPSPANVSSCLEGSMGLRSLWGSLLASLTPPPLPPPDPPAPPTLLHNCHLCQKLQRDSPTCHACLHPNRTVPTALSSPWYHTYGLAPPWPWSPVPLSLPQPQQCSLFSVMELARLKSFVFPG

SEQ ID NO: 809683 - protein, 135 aa, Homo sapiens
MDLTGLLLDEEGTFSLAGFQDFTFLPGHQKLSARIRRRLYYGWDWEADCSLEELSSPVADIAVELLQKAAPSPIRRLQKKYVAHVSREACISPCAMMLALVYIERLRHRNPDYLQHVSSSDLFLISMIVPLSATR

SEQ ID NO: 809684 - protein, 691 aa, Homo sapiens
ARGSPEAAERGAGSAGSAGRRRRGRTGAQTAGARRGYHGRAVSSRSGRLPRLRGARAELPGRRCVPTVTMKDDFAEEEEVQSFGYKRFGIQEGTQCTKCKNNWALKFSIILLYILCALLTITVAILGYKVVEKMDNVTGGMETSRQTYDDKLTAVESDLKKLGDQTGKKAISTNSELSTFRSDILDLRQQLREITEKTSKNKDTLEKLQASGDALVDRQSQLKETLENNSFLITTVNKTLQAYNGYVTNLQQDTSVLQGNLQNQMYSHNVVIMNLNNLNLTQVQQRNLITNLQRSVDDTSQAIQRIKNDFQNLQQVFLQAKKDTDWLKEKVQSLQTLAANNSALAKANNDTLEDMNSQLNSFTGQMENITTISQANEQNLKDLQDLHKDAENRTAIKFNQLEERFQLFETDIVNIISNISYTAHHLRTLTSNLNEVRTTCTDTLTKHTDDLTSLNNTLANIRLDSVSLRMQQDLMRSRLDTEVANLSVIMEEMKLVDSKHGQLIKNFTILQGPPGPRGPRGDRGSQGPPGPTGNKGQKGEKGEPGPPGPAGERGPIGPAGPPGERGGKGSKGSQGPKGSRGSPGKPGPQGPSGDPGPPGPPGKEGLPGPQGPPGFQGLQGTVGEPGVPGPRGLPGLPGVPGMPGPKGPPGPPGPSGAVVPLALQNEPTPAPEDNGKSKPSLQPGGQGSACA

SEQ ID NO: 809685 - protein, 143 aa, Homo sapiens
KSWKRSSSWLNLMAVLFSASLCKSCRSFRFYYFSVEKEIFEDAKLFCEDKSSHLVFINTREEQQWIKKQMVGRESHWIGLTDSERENEWKWLDGTSPDYKNWKAGQPDNWNLQNEPTPAPEDNSCPPHLEELHRQMLLFFSET

SEQ ID NO: 809686 - protein, 811 aa, Homo sapiens
ARGSPEAAERGAGSAGSAGRRRRGRTGAQTAGARRGYHGRAVSSRSGRLPRLRGARAELPGRRCVPTVTMKDDFAEEEEVQSFGYKRFGIQEGTQCTKCKNNWALKFSIILLYILCALLTITVAILGYKVVEKMDNVTGGMETSRQTYDDKLTAVESDLKKLGDQTGKKAISTNSELSTFRSDILDLRQQLREITEKTSKNKDTLEKLQASGDALVDRQSQLKETLENNSFLITTVNKTLQAYNGYVTNLQQDTSVLQGNLQNQMYSHNVVIMNLNNLNLTQVQQRNLITNLQRSVDDTSQAIQRIKNDFQNLQQVFLQAKKDTDWLKEKVQSLQTLAANNSALAKANNDTLEDMNSQLNSFTGQMENITTISQANEQNLKDLQDLHKDAENRTAIKFNQLEERFQLFETDIVNIISNISYTAHHLRTLTSNLNEVRTTCTDTLTKHTDDLTSLNNTLANIRLDSVSLRMQQDLMRSRLDTEVANLSVIMEEMKLVDSKHGQLIKNFTILQGPPGPRGPRGDRGSQGPPGPTGNKGQKGEKGEPGPPGPAGERGPIGPAGPPGERGGKGSKGSQGPKGSRGSPGKPGPQGPSGDPGPPGPPGKEGLPGPQGPPGFQGLQGTVGEPGVPGPRGLPGLPGVPGMPGPKGPPGPPGPSGAVVPLALQNEPTPAPEDNGCPPHWKNFTDKCYYFSVEKEIFEDAKLFCEDKSSHLVFINTREEQQWIKKQMVGRESHWIGLTDSERENEWKWLDGTSPDYKNWKAGQPDNWGHGHGPGEDCAGLIYAGQWNDFQCEDVNNFICEKDRETVLSSAL

SEQ ID NO: 809687 - protein, 811 aa, Homo sapiens; identical to SEQ ID NO: 809686

SEQ ID NO: 809688 - protein, 811 aa, Homo sapiens; identical to SEQ ID NO: 809686

SEQ ID NO: 809689 - protein, 742 aa, Homo sapiens
MKDDFAEEEEVQSFGYKRFGIQEGTQCTKCKNNWALKFSIILLYILCALLTITVAILGYKVVEKMDNVTGGMETSRQTYDDKLTAVESDLKKLGDQTGKKAISTNSELSTFRSDILDLRQQLREITEKTSKNKDTLEKLQASGDALVDRQSQLKETLENNSFLITTVNKTLQAYNGYVTNLQQDTSVLQGNLQNQMYSHNVVIMNLNNLNLTQVQQRNLITNLQRSVDDTSQAIQRIKNDFQNLQQVFLQAKKDTDWLKEKVQSLQTLAANNSALAKANNDTLEDMNSQLNSFTGQMENITTISQANEQNLKDLQDLHKDAENRTAIKFNQLEERFQLFETDIVNIISNISYTAHHLRTLTSNLNEVRTTCTDTLTKHTDDLTSLNNTLANIRLDSVSLRMQQDLMRSRLDTEVANLSVIMEEMKLVDSKHGQLIKNFTILQGPPGPRGPRGDRGSQGPPGPTGNKGQKGEKGEPGPPGPAGERGPIGPAGPPGERGGKGSKGSQGPKGSRGSPGKPGPQGPSGDPGPPGPPGKEGLPGPQGPPGFQGLQGTVGEPGVPGPRGLPGLPGVPGMPGPKGPPGPPGPSGAVVPLALQNEPTPAPEDNGCPPHWKNFTDKCYYFSVEKEIFEDAKLFCEDKSSHLVFINTREEQQWIKKQMVGRESHWIGLTDSERENEWKWLDGTSPDYKNWKAGQPDNWGHGHGPGEDCAGLIYAGQWNDFQCEDVNNFICEKDRETVLSSAL

SEQ ID NO: 809690 - protein, 178 aa, Homo sapiens
MPKYSIILGSKGDRQKQGQIKRGNSLIMTDSLASNILRKAVHSVKSSTCRGLQFECLSVTMKDDFAEEEEVQSFGYKRFGIQEGTQCTKCKNNWALKFSIILLYILCALLTITVAILGYKVVEKMDNVTGGMETSRQTYDDKLTAVESDLKKLGDQTGKKAISTNSELSTFRSDILDI

SEQ ID NO: 809691 - protein, 1224 aa, Homo sapiens
MEPLLLGRGLIVYLMFLLLKFSKAIEIPSSVQQVPTIIKQSKVQVAFPFDEYFQIECEAKGNPEPTFSWTKDGNPFYFTDHRIIPSNNSGTFRIPNEGHISHFQGKYRCFASNKLGIAMSEEIEFIVPSVPKFPKEKIDPLEVEEGDPIVLPCNPPKGLPPLHIYWMNIELEHIEQDERVYMSQKGDLYFANVEEKDSRNDYCCFAAFPRLRTIVQKMPMKLTVNSLKHANDSSSSTEIGSKANSIKQRKPKLLLPPTESGSESSITILKGEILLLECFAEGLPTPQVDWNKIGGDLPKGREAKENYGKTLKIENVSYQDKGNYRCTASNFLGTATHDFHVIVEEPPRWTKKPQSAVYSTGSNGILLCEAEGEPQPTIKWRVNGSPVDNHPFAGDVVFPREISFTNLQPNHTAVYQCEASNVHGTILANANIDVVDVRPLIQTKDGENYATVVGYSAFLHCEFFASPEAVVSWQKVEEVKPLEGRRYHIYENGTLQINRTTEEDAGSYSCWVENAIGKTAVTANLDIRNATKLRVSPKNPRIPKLHMLELHCESKCDSHLKHSLKLSWSKDGEAFEINGTEDGRIIIDGANLTISNVTLEDQGIYCCSAHTALDSAADITQVTVLDVPDPPENLHLSERQNRSVRLTWEAGADHNSNISEYIVEFEGNKEEPGRWEELTRVQGKKTTVILPLAPFVRYQFRVIAVNEVGRSQPSQPSDHHETPPAAPDRNPQNIRVQASQPKEMIIKWEPLKSMEQNGPGLEYRVTWKPQGAPVEWEEETVTNHTLRVMTPAVYAPYDVKVQAINQLGSGPDPQSVTLYSGEDYPDTAPVIHGVDVINSTLVKVTWSTVPKDRVHGRLKGYQINWWKTKSLLDGRTHPKEVNILRFSGQRNSGMVPSLDAFSEFHLTVLAYNSKGAGPESEPYIFQTPEGVPEQPTFLKVIKVDKDTATLSWGLPKKLNGNLTGYLLQYQIINDTYEIGELNDINITTPSKPSWHLSNLNATTKYKFYLRACTSQGCGKPITEESSTLGEGSKGIGKISGVNLTQKTHPVEVFEPGAEHIVRLMTKNWGDNDSIFQDVIETRGREYAGLYDDISTQGWFIGLMCAIALLTLLLLTVCFVKRNRGGKYSVKEKEDLHPDPEIQSVKDETFGEYSDSDEKPLKGSLRSLNRDMQPTESADSLVEYGEGDHGLFSEDGSFIGAYAGSKEKGSVESNGSSTATFPLRA

SEQ ID NO: 809692 - protein, 104 aa, Homo sapiens
RKGAEARASLRQEGVDPGASQNGSSLPAAREPAAGGDGRDLRGQPRVRTSGQRPARPSLDPPRAYRTLRAPVPAPGRLGGEGARGEAPDRSRFGGGAGAVNCKP

SEQ ID NO: 809693 - protein, 864 aa, Homo sapiens
MEPLLLGRGLIVYLMFLLLKFSKAIEIPSSVQQVPTIIKQSKVQVAFPFDEYFQIECEAKGNPEPTFSWTKDGNPFYFTDHRIIPSNNSGTFRIPNEGHISHFQGKYRCFASNKLGIAMSEEIEFIVPSVPKFPKEKIDPLEVEEGDPIVLPCNPPKGLPPLHIYWMNIELEHIEQDERVYMSQKGDLYFANVEEKDSRNDYCCFAAFPRLRTIVQKMPMKLTVNSLKHANDSSSSTEIGSKANSIKQRKPKLLLPPTESGSESSITILKGEILLLECFAEGLPTPQVDWNKIGGDLPKGREAKENYGKTLKIENVSYQDKGNYRCTASNFLGTATHDFHVIVEEPPRWTKKPQSAVYSTGSNGILLCEAEGEPQPTIKWRVNGSPVDNHPFAGDVVFPREISFTNLQPNHTAVYQCEASNVHGTILANANIDVVDVRPLIQTKDGENYATVVGYSAFLHCEFFASPEAVVSWQKVEEVKPLEGRRYHIYENGTLQINRTTEEDAGSYSCWVENAIGKTAVTANLDIRNATKLRVSPKNPRIPKLHMLELHCESKCDSHLKHSLKLSWSKDGEAFEINGTEDGRIIIDGANLTISNVTLEDQGIYCCSAHTALDSAADITQVTVLDVPDPPENLHLSERQNRSVRLTWEAGADHNSNISEYIVEFEGNKEEPGRWEELTRVQGKKTTVILPLAPFVRYQFRVIAVNEVGRSQPSQPSDHHETPPAAPDRNPQNIRVQASQPKEMIIKWEPLKSMEQNGPGLEYRVTWKPQGAPVEWEEETVTNHTLRVMTPAVYAPYDVKVQAINQLGSGPDPQSVTLYSGEDYPDTAPVIHGVDVINNNICKQRYWFTPTFHIYLFKGARTFI

SEQ ID NO: 809694 - protein, 662 aa, Homo sapiens
LKWLRKQAAAAVGLAAPPPGARIIIDGANLTISNVTLEDQGIYCCSAHTALDSAADITQVTVLDVPDPPENLHLSERQNRSVRLTWEAGADHNSNISEYIVEFEGNKEEPGRWEELTRVQGKKTTVILPLAPFVRYQFRVIAVNEVGRSQPSQPSDHHETPPAAPDRNPQNIRVQASQPKEMIIKWEPLKSMEQNGPGLEYRVTWKPQGAPVEWEEETVTNHTLRVMTPAVYAPYDVKVQAINQLGSGPDPQSVTLYSGEDYPDTAPVIHGVDVINSTLVKVTWSTVPKDRVHGRLKGYQINWWKTKSLLDGRTHPKEVNILRFSGQRNSGMVPSLDAFSEFHLTVLAYNSKGAGPESEPYIFQTPEGVPEQPTFLKVIKVDKDTATLSWGLPKKLNGNLTGYLLQYQIINDTYEIGELNDINITTPSKPSWHLSNLNATTKYKFYLRACTSQGCGKPITEESSTLGEGSKGIGKISGVNLTQKTHPVEVFEPGAEHIVRLMTKNWGDNDSIFQDVIETRGREYAGLYDDISTQGWFIGLMCAIALLTLLLLTVCFVKRNRGGKYSVKEKEDLHPDPEIQSVKDETFGEYSDSDEKPLKGSLRSLNRDMQPTESADSLVEYGEGDHGLFSEDGSFIGAYAGSKEKGSVESNGSSTATFPLRA

SEQ ID NO: 809695 - protein, 143 aa, Homo sapiens
RCGRLYTDPPTVFTQGWFIGLMCAIALLTLLLLTVCFVKRNRGGKYSVKEKEDLHPDPEIQSVKDETFGEYSDSDEKPLKGSLRSLNRDMQPTESADSLVEYGEGDHGLFSEDGSFIGAYAGSKEKGSVESNGSSTATFPLRA

SEQ ID NO: 809696 - protein, 1112 aa, Homo sapiens
MEPLLLGRGLIVYLMFLLLKFSKAIEIPSSVQQVPTIIKQSKVQVAFPFDEYFQIECEAKGNPEPTFSWTKDGNPFYFTDHRIIPSNNSGTFRIPNEGHISHFQGKYRCFASNKLGIAMSEEIEFIVPSVPKFPKEKIDPLEVEEGDPIVLPCNPPKGLPPLHIYWMNIELEHIEQDERVYMSQKGDLYFANVEEKDSRNDYCCFAAFPRLRTIVQKMPMKLTVNSLKHANDSSSSTEIGSKANSIKQRKPKLLLPPTESGSESSITILKGEILLLECFAEGLPTPQVDWNKIGGDLPKGREAKENYGKTLKIENVSYQDKGNYRCTASNFLGTATHDFHVIVEEPPRWTKKPQSAVYSTGSNGILLCEAEGEPQPTIKWRVNGSPVDNHPFAGDVVFPREISFTNLQPNHTAVYQCEASNVHGTILANANIDVVDVRPLIQTKDGENYATVVGYSAFLHCEFFASPEAVVSWQKVEEVKPLEGRRYHIYENGTLQINRTTEEDAGSYSCWVENAIGKTAVTANLDIRNATKLRVSPKNPRIPKLHMLELHCESKCDSHLKHSLKLSWSKDGEAFEINGTEDGRIIIDGANLTISNVTLEDQGIYCCSAHTALDSAADITQVTVLDVPDPPENLHLSERQNRSVRLTWEAGADHNSNISEYIVEFEGNKEEPGRWEELTRVQGKKTTVILPLAPFVRYQFRVIAVNEVGRSQPSQPSDHHETPPAAPDRNPQNIRVQASQPKEMIIKWEPLKSMEQNGPGLEYRVTWKPQGAPVEWEEETVTNHTLRVMTPAVYAPYDVKVQAINQLGSGPDPQSVTLYSGEDYPDTAPVIHGVDVINSTLVKVTWSTVPKDRVHGRLKGYQINWWKTKSLLDGRTHPKEVNILRFSGQRNSGMVPSLDAFSEFHLTVLAYNSKGAGPESEPYIFQTPEGVPEQPTFLKVIKVDKDTATLSWGLPKKLNGNLTGYLLQYQIINDTYEIGELNDINITTPSKPSWHLSNLNATTKYKFYLRACTSQGCGKPITEESSTLGEGKYAGLYDDISTQGWFIGLMCAIALLTLLLLTVCFVKRNRGGKYSVKEKEDLHPDPEIQSVKDETFGEYRIKNNKEKERKRE

SEQ ID NO: 809697 - protein, 1036 aa, Homo sapiens
MEPLLLGRGLIVYLMFLLLKFSKAIEIPSSVQQVPTIIKQSKVQVAFPFDEYFQIECEAKGNPEPTFSWTKDGNPFYFTDHRIIPSNNSGTFRIPNEGHISHFQGKYRCFASNKLGIAMSEEIEFIVPSVPKFPKEKIDPLEVEEGDPIVLPCNPPKGLPPLHIYWMNIELEHIEQDERVYMSQKGDLYFANVEEKDSRNDYCCFAAFPRLRTIVQKMPMKLTVNSLKHANDSSSSTEIGSKANSIKQRKPKLLLPPTESGSESSITILKGEILLLECFAEGLPTPQVDWNKIGGDLPKGREAKENYGKTLKIENVSYQDKGNYRCTASNFLGTATHDFHVIVEEPPRWTKKPQSAVYSTGSNGILLCEAEGEPQPTIKWRVNGSPVDNHPFAGDVVFPREISFTNLQPNHTAVYQCEASNVHGTILANANIDVVDVRPLIQTKDGENYATVVGYSAFLHCEFFASPEAVVSWQKVEEVKPLEGRRYHIYENGTLQINRTTEEDAGSYSCWVENAIGKTAVTANLDIRNATKLRVSPKNPRIPKLHMLELHCESKCDSHLKHSLKLSWSKDGEAFEINGTEDGRIIIDGANLTISNVTLEDQGIYCCSAHTALDSAADITQVTVLDVPDPPENLHLSERQNRSVRLTWEAGADHNSNISEYIVEFEGNKEEPGRWEELTRVQGKKTTVILPLAPFVRYQFRVIAVNEVGRSQPSQPSDHHETPPAAPDRNPQNIRVQASQPKEMIIKWEPLKSMEQNGPGLEYRVTWKPQGAPVEWEEETVTNHTLRVMTPAVYAPYDVKVQAINQLGSGPDPQSVTLYSGEDYPDTAPVIHGVDVINSTLVKVTWSTVPKDRVHGRLKGYQINWWKTKSLLDGRTHPKEVNILRFSGQRNSGMVPSLDAFSEFHLTVLAYNSKGAGPESEPYIFQTPEGVPEQPTFLKVIKVDKDTATLSWGLPKKLNGNLTGYLLQYQIINDTYEIGELNDINITTPSKPSWHLSNLNATTKYKFYLRACTSQGCGKPITEESSTLGEGSKYMR

SEQ ID NO: 809698 - protein, 556 aa, Homo sapiens
MEPLLLGRGLIVYLMFLLLKFSKAIEIPSSVQQVPTIIKQSKVQVAFPFDEYFQIECEAKGNPEPTFSWTKDGNPFYFTDHRIIPSNNSGTFRIPNEGHISHFQGKYRCFASNKLGIAMSEEIEFIVPSVPKFPKEKIDPLEVEEGDPIVLPCNPPKGLPPLHIYWMNIELEHIEQDERVYMSQKGDLYFANVEEKDSRNDYCCFAAFPRLRTIVQKMPMKLTVNSLKHANDSSSSTEIGSKANSIKQRKPKLLLPPTESGSESSITILKGEILLLECFAEGLPTPQVDWNKIGGDLPKGREAKENYGKTLKIENVSYQDKGNYRCTASNFLGTATHDFHVIVEEPPRWTKKPQSAVYSTGSNGILLCEAEGEPQPTIKWRVNGSPVDNHPFAGDVVFPREISFTNLQPNHTAVYQCEASNVHGTILANANIDVVDVRPLIQTKDGENYATVVGYSAFLHCEFFASPEAVVSWQKVEEVKPLEGRRYHIYENGTLQINRTTEEDAGSYSCWVENAIGKTAVTANLDIRSIFISLLLCMNCHMGSVCLHLPKWNNTI

SEQ ID NO: 809699 - protein, 749 aa, Homo sapiens
MEPLLLGRGLIVYLMFLLLKFSKAIEIPSSVQQVPTIIKQSKVQVAFPFDEYFQIECEAKGNPEPTFSWTKDGNPFYFTDHRIIPSNNSGTFRIPNEGHISHFQGKYRCFASNKLGIAMSEEIEFIVPSVPKFPKEKIDPLEVEEGDPIVLPCNPPKGLPPLHIYWMNIELEHIEQDERVYMSQKGDLYFANVEEKDSRNDYCCFAAFPRLRTIVQKMPMKLTVNSLKHANDSSSSTEIGSKANSIKQRKPKLLLPPTESGSESSITILKGEILLLECFAEGLPTPQVDWNKIGGDLPKGREAKENYGKTLKIENVSYQDKGNYRCTASNFLGTATHDFHVIVEEPPRWTKKPQSAVYSTGSNGILLCEAEGEPQPTIKWRVNGSPVDNHPFAGDVVFPREISFTNLQPNHTAVYQCEASNVHGTILANANIDVVDVRPLIQTKDGENYATVVGYSAFLHCEFFASPEAVVSWQKVEEVKPLEGRRYHIYENGTLQINRTTEEDAGSYSCWVENAIGKTAVTANLDIRNATKLRVSPKNPRIPKLHMLELHCESKCDSHLKHSLKLSWSKDGEAFEINGTEDGRIIIDGANLTISNVTLEDQGIYCCSAHTALDSAADITQVTVLDVPDPPENLHLSERQNRSVRLTWEAGADHNSNISEYIVEFEGNKEEPGRWEELTRVQGKKTTVILPLAPFVRYQFRVIAVNEVGRSQPSQPSDHHETPPAAPDRNPQNIRVQASQPKEMIIKWE

SEQ ID NO: 809700 - protein, 141 aa, Homo sapiens [sequence omitted]

SEQ ID NO: 809701 - protein, 82 aa, Homo sapiens
WPRPHARDADQGAGARSAPNRPYLKVISIREETEVQAPQTHWASTFPGSRTSDEETDAWGSQKYLQIVGVSAGNKCFGRGCL

SEQ ID NO: 809702 - protein, 120 aa, Homo sapiens [sequence omitted]

SEQ ID NO: 809703 - protein, 120 aa, Homo sapiens [sequence omitted]

SEQ ID NO: 809704 - protein, 518 aa, Homo sapiens
MPTVVVMDVSLSMTRPVSIEGSEEYQRKHLAAHGLTMLFEHMATNYKLEFTALVVFSSLWELMVPFTRDYNTLQEALSNMDDYDKTCLESALVGVCNIVQQEWGGAIPCQVVLVTDGCLGIGRGSLRHSLATQNQRSESNRFPLPFPFPSKLYIMCMANLEELQSTDSLECLERLIDLNNGEGQIFTIDGPLCLKNVQSMFGKLIDLAYTPFHAVLKCGHLTADVQVFPRPEPFVVDEEIDPIPKVINTDLEIVGFIDIADISSPPVLSRHLVLPIALNKEGDEVGTGITDDNEDENSANQIAGKIPNFCVLLHGSLKVEGMVAIVQLGPEWHGMLYSQADSKKKSNLMMSLFEPGPEPLPWLGKMAQLGPISDAKENPYGEDDNKSPFPLQPKNKRSYAQNVTVWIKPSGLQTDVQKILRNARKLPEKTQTFYKELNRLRKAALAFGFLDLLKGVADMLERECTLLPETAHPDAAFQLTHAAQQLKLASTGTSEYAAYDQNITPLHTDFSGSSTERI

SEQ ID NO: 809705 - protein, 518 aa, Homo sapiens; identical to SEQ ID NO: 809704

SEQ ID NO: 809706 - protein, 518 aa, Homo sapiens; identical to SEQ ID NO: 809704

SEQ ID NO: 809707 - protein, 518 aa, Homo sapiens; identical to SEQ ID NO: 809704

SEQ ID NO: 809708 - protein, 439 aa, Homo sapiens
MDDYDKTCLESALVGVCNIVQQEWGGAIPCQVVLVTDGCLGIGRGSLRHSLATQNQRSESNRFPLPFPFPSKLYIMCMANLEELQSTDSLECLERLIDLNNGEGQIFTIDGPLCLKNVQSMFGKLIDLAYTPFHAVLKCGHLTADVQVFPRPEPFVVDEEIDPIPKVINTDLEIVGFIDIADISSPPVLSRHLVLPIALNKEGDEVGTGITDDNEDENSANQIAGKIPNFCVLLHGSLKVEGMVAIVQLGPEWHGMLYSQADSKKKSNLMMSLFEPGPEPLPWLGKMAQLGPISDAKENPYGEDDNKSPFPLQPKNKRSYAQNVTVWIKPSGLQTDVQKILRNARKLPEKTQTFYKELNRLRKAALAFGFLDLLKGVADMLERECTLLPETAHPDAAFQLTHAAQQLKLASTGTSEYAAYDQNITPLHTDFSGSSTERI

SEQ ID NO: 809709 - protein, 439 aa, Homo sapiens; identical to SEQ ID NO: 809708

SEQ ID NO: 809710 - protein, 461 aa, Homo sapiens
MPTESLCRRTVSGDGHGEALSNMDDYDKTCLESALVGVCNIVQQEWGGAIPCQVVLVTDGCLGIGRGSLRHSLATQNQRSESNRFPLPFPFPSKLYIMCMANLEELQSTDSLECLERLIDLNNGEGQIFTIDGPLCLKNVQSMFGKLIDLAYTPFHAVLKCGHLTADVQVFPRPEPFVVDEEIDPIPKVINTDLEIVGFIDIADISSPPVLSRHLVLPIALNKEGDEVGTGITDDNEDENSANQIAGKIPNFCVLLHGSLKVEGMVAIVQLGPEWHGMLYSQADSKKKSNLMMSLFEPGPEPLPWLGKMAQLGPISDAKENPYGEDDNKSPFPLQPKNKRSYAQNVTVWIKPSGLQTDVQKILRNARKLPEKTQTFYKELNRLRKAALAFGFLDLLKGVADMLERECTLLPETAHPDAAFQLTHAAQQLKLASTGTSEYAAYDQNITPLHTDFSGSSTERI

SEQ ID NO: 809711 - protein, 518 aa, Homo sapiens; identical to SEQ ID NO: 809704

SEQ ID NO: 809712 - protein, 157 aa, Homo sapiens
MWKRSEQMKIKSDAKENPYGEDDNKSPFPLQPKNKRSYAQNVTVWIKPSGLQTDVQKILRNARKLPEKTQTFYKELNRLRKAALAFGFLDLLKGVADMLERECTLLPETAHPDAAFQLTHAAQQLKLASTGTSEYAAYDQNITPLHTDFSGSSTERI

SEQ ID NO: 809713 - protein, 518 aa, Homo sapiens; identical to SEQ ID NO: 809704

SEQ ID NO: 809714 - protein, 80 aa, Homo sapiens
LLSRGLIVPAVARGRKVYADGKFMPTDCVRRWARGEWGGRGPGTAFRCLLGLQVKGLWVKNNPGPALGLPATVAAAPRCL

SEQ ID NO: 809715 - protein, 431 aa, Homo sapiens
MGSPGATTGWGLLDYKTEKYVMTRNWRVGALQRLLQFGIVVYVVGWALLAKKGYQERDLEPQFSIITKLKGVSVTQIKELGNRLWDVADFVKPPQGENVFFLVTNFLVTPAQVQGRCPEHPSVPLANCWVDEDCPEGEGGTHSHGVKTGQCVVFNGTHRTCEIWSWCPVESGVVPSRPLLAQAQNFTLFIKNTVTFSKFNFSKSNALETWDPTYFKHCRYEPQFSPYCPVFRIGDLVAKAGGTFEDLALLGGSVGIRVHWDCDLDTGDSGCWPHYSFQLQEKSYNFRTATHWWEQPGVEARTLLKLYGIRFDILVTGQAGKFGLIPTAVTLGTGAAWLGVVTFFCDLLLLYVDREAHFYWRTKYEEAKAPKATANSVWRELALASQARLAECLRRSSAPAPTATAAGSQTQTPGWPCPSSDTHLPTHSGSL

SEQ ID NO: 809716 - protein, 382 aa, Homo sapiens
MGSPGATTGWGLLDYKTEKYVMTRNWRVGALQRLLQFGIVVYVVGWALLAKKGYQERDLEPQFSIITKLKGVSVTQIKELGNRLWDVADFVKPPQVYKTGQCVVFNGTHRTCEIWSWCPVESGVVPSRPLLAQAQNFTLFIKNTVTFSKFNFSKSNALETWDPTYFKHCRYEPQFSPYCPVFRIGDLVAKAGGTFEDLALLGGSVGIRVHWDCDLDTGDSGCWPHYSFQLQEKSYNFRTATHWWEQPGVEARTLLKLYGIRFDILVTGQAGKFGLIPTAVTLGTGAAWLGVVTFFCDLLLLYVDREAHFYWRTKYEEAKAPKATANSVWRELALASQARLAECLRRSSAPAPTATAAGSQTQTPGWPCPSSDTHLPTHSGSL

SEQ ID NO: 809717 - protein, 356 aa, Homo sapiens
MGSPGATTGWGLLDYKTEKWALLAKKGYQERDLEPQFSIITKLKGVSVTQIKELGNRLWDVADFVKPPQVYKTGQCVVFNGTHRTCEIWSWCPVESGVVPSRPLLAQAQNFTLFIKNTVTFSKFNFSKSNALETWDPTYFKHCRYEPQFSPYCPVFRIGDLVAKAGGTFEDLALLGGSVGIRVHWDCDLDTGDSGCWPHYSFQLQEKSYNFRTATHWWEQPGVEARTLLKLYGIRFDILVTGQAGKFGLIPTAVTLGTGAAWLGVVTFFCDLLLLYVDREAHFYWRTKYEEAKAPKATANSVWRELALASQARLAECLRRSSAPAPTATAAGSQTQTPGWPCPSSDTHLPTHSGSL

SEQ ID NO: 809718 - protein, 82 aa, Homo sapiens
PLPLPPARSLARRALSSSYKLSGSAVDKKPGRPSASLPRAGWGELKGTGRRRGFSMLARMVLNSRPPVICLPRPSKVLGLHA

SEQ ID NO: 809719 - protein, 115 aa, Homo sapiens
PLPLPPARSLARRALSSSYKLSGSAVDKKPGRPSASLPRAGWGELKGTGRVSRPRGQDREGSGLRGPASARGGKRGCGSGNPCKDPETGKSARAKVSAPSPGSHKVATTKRRGEE

SEQ ID NO: 809720 - protein, 1200 aa, Homo sapiens
MGDQQLYKTNHVAHGSENLFYQQPPLGVHSGLNHNYGNAVTGGGMDAPQASPISPHFPQDTRDGLGLPVGSKNLGQMDTSRQGGWGSHAGPGNHVQLRGNLANSNMMWGAPAQAEPTDGYQYTYSQASEIRTQKLTSGVLHKLDSFTQVFANQNLRIQVNNMAQVLHTQSAVMDGAPDSALRQLLSQKPMEPPAPAIPSRYQQVPQQPHPGFTGGLSKPALQVGQHPTQGHLYYDYQQPLAQVPVQGGQPLQAPQMLSQHMQQMQQHQYYPPQQQQQAGQQRISMQEIQTQPQQIRPSQPQPPPQQQQPQQLQLQQRQGSMQIPQYYQPQPMMQHLQEQQQQQMHLQPPSYHRDPHQYTPEQAHTVQLIPLGSMSQYYYQEPQQPYSHPLYQQSHLSQHQQREDSQLKTYSSDRQAQAMLSSHGDLGPPDTGMGDPASSDLTRVSSTLPHRPLLSPSGIHLNNMGPQHQQLSPSAMWPQMHLPDGRAQPGSPESSGQPKGAFGEQFDAKNKLTCSICLKEFKNLPALNGHMRSHGGMRASPNLKQEEGEKVLPPQPQPPLPPPPPPPPPPQLPPEAESLTPMVMPVSVPVKLLPPKPSSQGFTNSTVAAPSARDKPASSMSDDEMPVLEIPRKHQPSVPKAEEPLKTVQEKKKFRHRPEPLFIPPPPSYNPNPAASYSGATLYQSQLRSPRVLGDHLLLDPTHELPPYTPPPMLSPVRQGSGLFSNVLISGHGPGAHPQLPLTPLTPTPRVLLCRSNSIDGSNVTVTPGPGEQTVDVEPRINIGLRFQAEIPELQDISALAQDTHKATLVWKPWPELENHDLQQRVENLLNLCCSSALPGGGTNSEFALHSLFEAKGDVMVALEMLLLRKPVRLKCHPLANYHYAGSDKWTSLERKLFNKALATYSKDFIFVQKMVKSKTVAQCVEYYYTWKKIMRLGRKHRTRLAEIIDDCVTSEEEEELEEEEEEDPEEDRKSTKEEESEVPKSPEPPPVPVLAPTEGPPLQALGQPSGSFICEMPNCGAVFSSRQALNGHARIHGGTNQVTKARGAIPSGKQKPGGTQSGYCSVKSSPSHSTTSGETDPTTIFPCKECGKVFFKIKSRNAHMKTHRQQEEQQRQKAQKAAFAAEMAATIERTTGPVGAPGLLPLDQLSLIKPIKDVDILDDDVVQQLGGVMEEAEVVDTDLLLDDQDSVLLQGDAEL

SEQ ID NO: 809721 - protein, 956 aa, Homo sapiens
MAQVLHTQSAVMDGAPDSALRQLLSQKPMEPPAPAIPSRYQQVPQQPHPGFTGGLSKPALQVGQHPTQGHLYYDYQQPLAQVPVQGGQPLQAPQMLSQHMQQMQQHQYYPPQQQQQAGQQRISMQEIQTQPQQIRPSQPQPPPQQQQPQQLQLQQRQGSMQIPQYYQPQPMMQHLQEQQQQQMHLQPPSYHRDPHQYTPEQAHTVQLIPLGSMSQYYYQEPQQPYSHPLYQQSHLSQHQQREDSQLKTYSSDRQAQAMLSSHGDLGPPDTGMGDPASSDLTRVSSTLPHRPLLSPSGIHLNNMGPQHQQLSPSAMWPQMHLPDGRAQPGSPESSGQPKGAFGEQFDAKNKLTCSICLKEFKNLPALNGHMRSHGGMRASPNLKQEIPRKHQPSVPKAEEPLKTVQEKKKFRHRPEPLFIPPPPSYNPNPAASYSGATLYQSQLRSPRVLGDHLLLDPTHELPPYTPPPMLSPVRQGSGLFSNVLISGHGPGAHPQLPLTPLTPTPRVLLCRSNSIDGSNVTVTPGPGEQTVDVEPRINIGLRFQAEIPELQDISALAQDTHKATLVWKPWPELENHDLQQRVENLLNLCCSSALPGGGTNSEFALHSLFEAKGDVMVALEMLLLRKPVRLKCHPLANYHYAGSDKWTSLERKLFNKALATYSKDFIFVQKMVKSKTVAQCVEYYYTWKKIMRLGRKHRTRLAEIIDDCVTSEEEEELEEEEEEDPEEDRKSTKEEESEVPKSPEPPPVPVLAPTEGPPLQALGQPSGSFICEMPNCGAVFSSRQALNGHARIHGGTNQVTKARGAIPSGKQKPGGTQSGYCSVKSSPSHSTTSGETDPTTIFPCKECGKVFFKIKSRNAHMKTHRQQEEQQRQKAQKAAFAAEMAATIERTTGPVGAPGLLPLDQLSLIKPIKDVDILDDDVVQQLGGVMEEAEVVDTDLLLDDQDSVLLQGDAEL

SEQ ID NO: 809722 - protein, 968 aa, Homo sapiens
MAQVLHTQSAVMDGAPDSALRQLLSQKPMEPPAPAIPSRYQQVPQQPHPGFTGGLSKPALQVGQHPTQGHLYYDYQQPLAQVPVQGGQPLQAPQMLSQHMQQMQQHQYYPPQQQQQAGQQRISMQEIQTQPQQIRPSQPQPPPQQQQPQQLQLQQRQGSMQIPQYYQPQPMMQHLQEQQQQQMHLQPPSYHRDPHQYTPEQAHTVQLIPLGSMSQYYYQEPQQPYSHPLYQQSHLSQHQQREDSQLKTYSSDRQAQAMLSSHGDLGPPDTGMGDPASSDLTRVSSTLPHRPLLSPSGIHLNNMGPQHQQLSPSAMWPQMHLPDGRAQPGSPESSGQPKGAFGEQFDAKNKLTCSICLKEFKNLPALNGHMRSHGGMRASPNLKQEIPRKHQPSVPKAEEPLKTVQEKKKFRHRPEPLFIPPPPSYNPNPAASYSGATLYQSQLRSPRVLGDHLLLDPTHELPPYTPPPMLSPVRQGSGLFSNVLISGHGPGAHPQLPLTPLTPTPRVLLCRSNSIDGSNVTVTPGPGEQTVDVEPRINIGLRFQAEIPELQDISALAQDTHKATLVWKPWPELENHDLQQRVENLLNLCCSSALPGGGTNSEFALHSLFEAKGDVMVALEMLLLRKPVRLKCHPLANYHYAGSDKWTSLERKLFNKALATYSKDFIFVQKMVKSKTVAQCVEYYYTWKKIMRLGRKHRTRLAEIIDDCVTSEEEEELEEEEEEDPEEDRKSTKEEESEVPKSPEPPPVPVLAPTEGPPLQALGQPSGSFICEMPNCGADCRCHVTPFLPQVFSSRQALNGHARIHGGTNQVTKARGAIPSGKQKPGGTQSGYCSVKSSPSHSTTSGETDPTTIFPCKECGKVFFKIKSRNAHMKTHRQQEEQQRQKAQKAAFAAEMAATIERTTGPVGAPGLLPLDQLSLIKPIKDVDILDDDVVQQLGGVMEEAEVVDTDLLLDDQDSVLLQGDAEL

SEQ ID NO: 809723 - protein, 184 aa, Homo sapiens
MPNCGAVFSSRQALNGHARIHGGTNQVTKARGAIPSGKQKPGGTQSGYCSVKSSPSHSTTSGETDPTTIFPCKECGKVFFKIKSRNAHMKTHRQQEEQQRQKAQKAAFAAEMAATIERTTGPVGAPGLLPLDQLSLIKPIKDVDILDDDVVQQLGGVMEEAEVVDTDLLLDDQDSVLLQGDAEL

SEQ ID NO: 809724 - protein, 109 aa, Homo sapiens
PVPPPLTSTVLTAFPLWVDDLHRTHRPVADSCLFSPLGLQVALEMLLLRKPVRLKCHPLANYHYAGRLARSPVSCCLLTTGCLHVRLCHFLAMDNTGSVLITTCDLKAS

SEQ ID NO: 809725 - protein, 273 aa, Homo sapiens
AAAAVPPAAAANHHHHHHHALHEAPKFTVETLEHTVNNDSEIWGLLQPYQHLICGKNASGVLCLPDSLNLHRDPQRSNKPGELPMFSQSELRTIEQSLLATRVGSIAELSDLVSRAMHHLQPLNAKHHGNGTPLHHKQGALYWEPEALYTLCYFMHCPQMEWENPNVEPSKVNLQVEKRPFLVLPPLMEWIRVAVAHAGHRRSFSMDSDDVRQAARLLLPGVDCEPRQLRADDCFCASRKLDAVAIEAKFKQDLGFRMLNCGRTDLVKQAVSL

SEQ ID NO: 809726 - protein, 170 aa, Homo sapiens
AAAAVPPAAAANHHHHHHHALHEAPKFTVETLEHTVNNDSEIWGLLQPYQHLICGKNASGDLVSRAMHHLQPLNARPFLVLPPLMEWIRVAVAHAGHRRSFSMDSDDVRQAARLLLPGVDCEPRQLRADDCFCASRKLDAVAIEAKFKQDLGFRMLNCGRTDLVKQAVSL

SEQ ID NO: 809727 - protein, 92 aa, Homo sapiens
PAAAANHHHHHHHALHEAPKFTVETLEHTVNNDSEIWGLLQPYQHLICGKNASGKCLRGCHSLSPNLANSWRKFASRPPPASSQPRAAVPSR

SEQ ID NO: 809728 - protein, 449 aa, Homo sapiens
MSPESKKLFNIIILGVAFMFMFTAFQTCGNVAQTVIRSLNRTDFHGSGYTSMAIIYGVFSASNLITPSVVAIVGPQLSMFASGLFYSMYIAVFIQPFPWSFYTASVFIGIAAAVLWTAQGNCLTINSDEHSIGRNSGIFWALLQSSLFFGNLYIYFAWQGKTQISESDRRTVFIALTVISLVGTVLFFLIRKPDSENVLGEDESSDDQDMEVNESAQNNLTKAVDAFKKSFKLCVTKEMLLLSITTAYTGLELTFFSGVYGTCIGATNKFGAEEKSLIGLSGSFIGIGEILGGSLFGLLSKNNRFGRNPVVLLGILVHFIAFYLIFLNMPGDAPIAPVKGTDSSAYIKSSKEVAILCSFLLGLGDSCFNTQLLSILGFLYSEDSAPAFAIFKFVQSICAAVAFFYSNYLLLHWQLLVMVIFGFFGTISFFTVEWEAAAFVARGSDYRSI

SEQ ID NO: 809729 - protein, 449 aa, Homo sapiens; identical to SEQ ID NO: 809728

SEQ ID NO: 809730 - protein, 449 aa, Homo sapiens; identical to SEQ ID NO: 809728

SEQ ID NO: 809731 - protein, 449 aa, Homo sapiens; identical to SEQ ID NO: 809728

SEQ ID NO: 809732 - protein, 449 aa, Homo sapiens; identical to SEQ ID NO: 809728

SEQ ID NO: 809733 - protein, 449 aa, Homo sapiens; identical to SEQ ID NO: 809728

SEQ ID NO: 809734 - protein, 283 aa, Homo sapiens
MSPESKKLFNIIILGVAFMFMFTAFQTCGNVAQTVIRSLNRTDFHGSGYTSMAIIYGVFSASNLITPSVVAIVGPQLSMFASGLFYSMYIAVFIQPFPWSFYTASVFIGIAAAVLWTAQGNCLTINSDEHSIGRNSGIFWALLQSSLFFGNLYIYFAWQGKTQISESDRRTVFIALTVISLVGTVLFFLIRKPDSENVLGEDESSDDQDMEVNESAQNNLTKAVDAFKKSFKLCVTKEMLLLSITTAYTGLELTFFSGVYGTCIGATNKFGAEEKSVEASSAC

SEQ ID NO: 809735 - protein, 302 aa, Homo sapiens
MSTALGETVGFSGHFCSLESDRRTVFIALTVISLVGTVLFFLIRKPDSENVLGEDESSDDQDMEVNESAQNNLTKAVDAFKKSFKLCVTKEMLLLSITTAYTGLELTFFSGVYGTCIGATNKFGAEEKSLIGLSGSFIGIGEILGGSLFGLLSKNNRFGRNPVVLLGILVHFIAFYLIFLNMPGDAPIAPVKGTDSSAYIKSSKEVAILCSFLLGLGDSCFNTQLLSILGFLYSEDSAPAFAIFKFVQSICAAVAFFYSNYLLLHWQLLVMVIFGFFGTISFFTVEWEAAAFVARGSDYRSI

SEQ ID NO: 809736 - protein, 235 aa, Homo sapiens
MSPESKKLFNIIILGVAFMFMFTAFQTCGNVAQTVIRSLNRTDFHGSGYTSMAIIYGVFSASNLITPSVVAIVGPQLSMFASGLFYSMYIAVFIQPFPWSFYTASVFIGIAAAVLWTAQGNCLTINSDEHSIGRNSGIFWALLQSSLFFGNLYIYFAWQGKTQISESDRRTVFIALTVISLVGTVLFFLIRKPDSENVLGEDESSDDQDMEVNEHWVFYKLKACGNPASSLPRTI

SEQ ID NO: 809737 - protein, 397 aa, Homo sapiens
MSPESKKLFNIIILGVAFMFMFTAFQTCGNVAQTVIRSLNRTDFHGSGYTSMAIIYGVFSASNLITPSVVAIVGPQLSMFASGLFYSMYIAVFIQPFPWSFYTASVFIGIAAAESDRRTVFIALTVISLVGTVLFFLIRKPDSENVLGEDESSDDQDMEVNESAQNNLTKAVDAFKKSFKLCVTKEMLLLSITTAYTGLELTFFSGVYGTCIGATNKFGAEEKSLIGLSGSFIGIGEILGGSLFGLLSKNNRFGRNPVVLLGILVHFIAFYLIFLNMPGDAPIAPVKGTDSSAYIKSSKEVAILCSFLLGLGDSCFNTQLLSILGFLYSEDSAPAFAIFKFVQSICAAVAFFYSNYLLLHWQLLVMVIFGFFGTISFFTVEWEAAAFVARGSDYRSI

SEQ ID NO: 809738 - protein, 270 aa, Homo sapiens
MSPESKKLFNIIILGVAFMFMFTAFQTCGNVAQTVIRSLNRTDFHGSGYTSMAIIYGVFSASNLITPSVVAIVGPQLSMFASGLFYSMYIAVFIQPFPWSFYTASVFIGIAAAVLWTAQGNCLTINSDEHSIGRNSGIFWALLQSSLFFGNLYIYFAWQGKTQISESDRRTVFIALTVISLVGTVLFFLIRKPDSENVLGEDESSDDQDMEVNESAQNNLTKAVDAFKKSFKLCVTKEMLLLSITTAYTVSELLSISTTPSIRSPCDLAG

SEQ ID NO: 809739 - protein, 318 aa, Homo sapiens
QLCEIRRKGALLQSSLFFGNLYIYFAWQGKTQISESDRRTVFIALTVISLVGTVLFFLIRKPDSENVLGEDESSDDQDMEVNESAQNNLTKAVDAFKKSFKLCVTKEMLLLSITTAYTGLELTFFSGVYGTCIGATNKFGAEEKSLIGLSGSFIGIGEILGGSLFGLLSKNNRFGRNPVVLLGILVHFIAFYLIFLNMPGDAPIAPVKGTDSSAYIKSSKEVAILCSFLLGLGDSCFNTQLLSILGFLYSEDSAPAFAIFKFVQSICAAVAFFYSNYLLLHWQLLVMVIFGFFGTISFFTVEWEAAAFVARGSDYRSI

SEQ ID NO: 809740 - protein, 116 aa, Homo sapiens [sequence omitted]

SEQ ID NO: 809741 - protein, 211 aa, Homo sapiens
MLLLSITTAYTGLELTFFSGVYGTCIGATNKFGAEEKSLIGLSGSFIGIGEILGGSLFGLLSKNNRFGRNPVVLLGILVHFIAFYLIFLNMPGDAPIAPVKGTDSSAYIKSSKEVAILCSFLLGLGDSCFNTQLLSILGFLYSEDSAPAFAIFKFVQSICAAVAFFYSNYLLLHWQLLVMVIFGFFGTISFFTVEWEAAAFVARGSDYRSI

SEQ ID NO: 809742 - protein, 116 aa, Homo sapiens
MSPESKKLFNIIILGVAFMFMFTAFQTCGNVAQTVIRSLNRTDFHGSGYTSMAIIYGVFLCFQILDLTNTVPKDLAFGPVTWGFNSVPPFKLSSIRFAQVSLILQHVHCRFHPAFP

SEQ ID NO: 809743 - protein, 69 aa, Homo sapiens
VILILELFGRYYLVSSFFSVESDRRTVFIALTVISLVGTVLFFLIRKPDSENVLGEDESSDDQDMEVNE

SEQ ID NO: 809744 - protein, 96 aa, Homo sapiens
PLLPLQETWGDSSIATWIWIPSWTLGEDSWTETGTWTANEIWRPTRTWTWTFVRIWTWRSTEIENECGTETSSGCSEIGCETWNGSDSGIGCGDAA

SEQ ID NO: 809745 - protein, 763 aa, Homo sapiens
MVACRAIGILSRFSAFRILRSRGYICRNFTGSSALLTRTHINYGVKGDVAVVRINSPNSKVNTLSKELHSEFSEVMNEIWASDQIRSAVLISSKPGCFIAGADINMLAACKTLQEVTQLSQEAQRIVEKLEKSTKPIVAAINGSCLGGGLEVAISCQYRIATKDRKTVLGTPEVLLGALPGAGGTQRLPKMVGVPAALDMMLTGRSIRADRAKKMGLVDQLVEPLGPGLKPPEERTIEYLEEVAITFAKGLADKKISPKRDKGLVEKLTAYAMTIPFVRQQVYKKVEEKVRKQTKGLYPAPLKIIDVVKTGIEQGSDAGYLCESQKFGELVMTKESKALMGLYHGQVLCKKNKFGAPQKDVKHLAILGAGLMGAGIAQVSVDKGLKTILKDATLTALDRGQQQVFKGLNDKVKKKALTSFERDSIFSNLTGQLDYQGFEKADMVIEAVFEDLSLKHRVLKEVEAVIPDHCIFASNTSALPISEIAAVSKRPEKVIGMHYFSPVDKMQLLEIITTEKTSKDTSASAVAVGLKQGKVIIVVKDGPGFYTTRCLAPMMSEVIRILQEGVDPKKLDSLTTSFGFPVGAATLVDEVGVDVAKHVAEDLGKVFGERFGGGNPELLTQMVSKGFLGRKSGKGFYIYQEGVKRKDLNSDMDSILASLKLPPKSEVSSDEDIQFRLVTRFVNEAVMCLQEGISATPAEGDIGAVFGLGFPPCLGGPFRFVDLYGAQKIVDRLKKYEAAYGKQFTPCQLLADHANSPNKKFYQ

SEQ ID NO: 809746 - protein, 763 aa, Homo sapiens
MVACRAIGILSRFSAFRILRSRGYICRNFTGSSALLTRTHINYGVKGDVAVVRINSPNSKVNTLSKELHSEFSEVMNEIWASDQIRSAVLISSKPGCFIAGADINMLAACKTLQEVTQLSQEAQRIVEKLEKSTKPIVAAINGSCLGGGLEVAISCQYRIATKDRKTVLGTPEVLLGALPGAGGTQRLPKMVGVPAALDMMLTGRSIRADRAKKMGLVDQLVEPLGPGLKPPEERTIEYLEEVAITFAKGLADKKISPKRDKGLVEKLTAYAMTIPFVRQQVYKKVEEKVRKQTKGLYPAPLKIIDVVKTGIEQGSDAGYLCESQKFGELVMTKESKALMGLYHGQVLCKKNKFGAPQKDVKHLAILGAGLMGAGIAQVSVDKGLKTILKDATLTALDRGQQQVFKGLNDKVKKKALTSFERDSIFSNLTGQLDYQGFEKADMVIEAVFEDLSLKHRVLKEVEAVIPDHCIFASNTSALPISEIAAVSKRPEKVIGMHYFSPVDKMQLLEIITTEKTSKDTSASAVAVGLKQGKVIIVVKDGPGFYTTRCLAPMMSEVIRILQEGVDPKKLDSLTTSFGFPVGAATLVDEVGVDVAKHVAEDLGKVFGERFGGGNPELLTQMVSKGFLGRKSGKGFYIYQEGVKRKDLNSDMDSILASLKLPPKSEVSSDEDIQFRLVTRFVNEAVMCLQEGILATPAEGDIGAVFGLGFPPCLGGPFRFVDLYGAQKIVDRLKKYEAAYGKQFTPCQLLADHANSPNKKFYQ

SEQ ID NO: 809747 - protein, 778 aa, Homo sapiens
AKKMALVFGRGLQLKMVACRAIGILSRFSAFRILRSRGYICRNFTGSSALLTRTHINYGVKGDVAVVRINSPNSKVNTLSKELHSEFSEVMNEIWASDQIRSAVLISSKPGCFIAGADINMLAACKTLQEVTQLSQEAQRIVEKLEKSTKPIVAAINGSCLGGGLEVAISCQYRIATKDRKTVLGTPEVLLGALPGAGGTQRLPKMVGVPAALDMMLTGRSIRADRAKKMGLVDQLVEPLGPGLKPPEERTIEYLEEVAITFAKGLADKKISPKRDKGLVEKLTAYAMTIPFVRQQVYKKVEEKVRKQTKGLYPAPLKIIDVVKTGIEQGSDAGYLCESQKFGELVMTKESKALMGLYHGQVLCKKNKFGAPQKDVKHLAILGAGLMGAGIAQVSVDKGLKTILKDATLTALDRGQQQVFKGLNDKVKKKALTSFERDSIFSNLTGQLDYQGFEKADMVIEAVFEDLSLKHRVLKEVEAVIPDHCIFASNTSALPISEIAAVSKRPEKVIGMHYFSPVDKMQLLEIITTEKTSKDTSASAVAVGLKQGKVIIVVKDGPGFYTTRCLAPMMSEVIRILQEGVDPKKLDSLTTSFGFPVGAATLVDEVGVDVAKHVAEDLGKVFGERFGGGNPELLTQMVSKGFLGRKSGKGFYIYQEGVKRKDLNSDMDSILASLKLPPKSEVSSDEDIQFRLVTRFVNEAVMCLQEGILATPAEGDIGAVFGLGFPPCLGGPFRFVDLYGAQKIVDRLKKYEAAYGKQFTPCQLLADHANSPNKKFYQ

SEQ ID NO: 809748 - protein, 763 aa, Homo sapiens; identical to SEQ ID NO: 809746

SEQ ID NO: 809749 - protein, 772 aa, Homo sapiens
GLQLVITWTVGLTISIGILSRFSAFRILRSRGYICRNFTGSSALLTRTHINYGVKGDVAVVRINSPNSKVNTLSKELHSEFSEVMNEIWASDQIRSAVLISSKPGCFIAGADINMLAACKTLQEVTQLSQEAQRIVEKLEKSTKPIVAAINGSCLGGGLEVAISCQYRIATKDRKTVLGTPEVLLGALPGAGGTQRLPKMVGVPAALDMMLTGRSIRADRAKKMGLVDQLVEPLGPGLKPPEERTIEYLEEVAITFAKGLADKKISPKRDKGLVEKLTAYAMTIPFVRQQVYKKVEEKVRKQTKGLYPAPLKIIDVVKTGIEQGSDAGYLCESQKFGELVMTKESKALMGLYHGQVLCKKNKFGAPQKDVKHLAILGAGLMGAGIAQVSVDKGLKTILKDATLTALDRGQQQVFKGLNDKVKKKALTSFERDSIFSNLTGQLDYQGFEKADMVIEAVFEDLSLKHRVLKEVEAVIPDHCIFASNTSALPISEIAAVSKRPEKVIGMHYFSPVDKMQLLEIITTEKTSKDTSASAVAVGLKQGKVIIVVKDGPGFYTTRCLAPMMSEVIRILQEGVDPKKLDSLTTSFGFPVGAATLVDEVGVDVAKHVAEDLGKVFGERFGGGNPELLTQMVSKGFLGRKSGKGFYIYQEGVKRKDLNSDMDSILASLKLPPKSEVSSDEDIQFRLVTRFVNEAVMCLQEGILATPAEGDIGAVFGLGFPPCLGGPFRFVDLYGAQKIVDRLKKYEAAYGKQFTPCQLLADHANSPNKKFYQ

SEQ ID NO: 809750 - protein, 774 aa, Homo sapiens
QLRQKQRSAAAASEKCAWVRTQPHSAFRILRSRGYICRNFTGSSALLTRTHINYGVKGDVAVVRINSPNSKVNTLSKELHSEFSEVMNEIWASDQIRSAVLISSKPGCFIAGADINMLAACKTLQEVTQLSQEAQRIVEKLEKSTKPIVAAINGSCLGGGLEVAISCQYRIATKDRKTVLGTPEVLLGALPGAGGTQRLPKMVGVPAALDMMLTGRSIRADRAKKMGLVDQLVEPLGPGLKPPEERTIEYLEEVAITFAKGLADKKISPKRDKGLVEKLTAYAMTIPFVRQQVYKKVEEKVRKQTKGLYPAPLKIIDVVKTGIEQGSDAGYLCESQKFGELVMTKESKALMGLYHGQVLCKKNKFGAPQKDVKHLAILGAGLMGAGIAQVSVDKGLKTILKDATLTALDRGQQQVFKGLNDKVKKKALTSFERDSIFSNLTGQLDYQGFEKADMVIEAVFEDLSLKHRVLKEVEAVIPDHCIFASNTSALPISEIAAVSKRPEKVIGMHYFSPVDKMQLLEIITTEKTSKDTSASAVAVGLKQGKVIIVVKDGPGFYTTRCLAPMMSEVIRILQEGVDPKKLDSLTTSFGFPVGAATLVDEVGVDVAKHVAEDLGKVFGERFGGGNPELLTQMVSKGFLGRKSGKGFYIYQEGVKRKDLNSDMDSILASLKLPPKSEVSSDEDIQFRLVTRFVNEAVMCLQEGILATPAEGDIGAVFGLGFPPCLGGPFRFVDLYGAQKIVDRLKKYEAAYGKQFTPCQLLADHANSPNKKFYQ

SEQ ID NO: 809751 - protein, 762 aa, Homo sapiens
MAVADNQMDPQPHFCLQDPPLPRYICRNNRVSALLTRTHINYGVKGDVAVVRINSPNSKVNTLSKELHSEFSEVMNEIWASDQIRSAVLISSKPGCFIAGADINMLAACKTLQEVTQLSQEAQRIVEKLEKSTKPIVAAINGSCLGGGLEVAISCQYRIATKDRKTVLGTPEVLLGALPGAGGTQRLPKMVGVPAALDMMLTGRSIRADRAKKMGLVDQLVEPLGPGLKPPEERTIEYLEEVAITFAKGLADKKISPKRDKGLVEKLTAYAMTIPFVRQQVYKKVEEKVRKQTKGLYPAPLKIIDVVKTGIEQGSDAGYLCESQKFGELVMTKESKALMGLYHGQVLCKKNKFGAPQKDVKHLAILGAGLMGAGIAQVSVDKGLKTILKDATLTALDRGQQQVFKGLNDKVKKKALTSFERDSIFSNLTGQLDYQGFEKADMVIEAVFEDLSLKHRVLKEVEAVIPDHCIFASNTSALPISEIAAVSKRPEKVIGMHYFSPVDKMQLLEIITTEKTSKDTSASAVAVGLKQGKVIIVVKDGPGFYTTRCLAPMMSEVIRILQEGVDPKKLDSLTTSFGFPVGAATLVDEVGVDVAKHVAEDLGKVFGERFGGGNPELLTQMVSKGFLGRKSGKGFYIYQEGVKRKDLNSDMDSILASLKLPPKSEVSSDEDIQFRLVTRFVNEAVMCLQEGILATPAEGDIGAVFGLGFPPCLGGPFRFVDLYGAQKIVDRLKKYEAAYGKQFTPCQLLADHANSPNKKFYQ

SEQ ID NO: 809752 - protein, 253 aa, Homo sapiens
MVACRAIGILSRFSAFRILRSRGYICRNFTGSSALLTRTHINYGVKGDVAVVRINSPNSKVNTLSKELHSEFSEVMNEIWASDQIRSAVLISSKPGCFIAGADINMLAACKTLQEVTQLSQEAQRIVEKLEKSTKPIVAAINGSCLGGGLEVAISCQYRIATKDRKTVLGTPEVLLGALPGAGGTQRLPKMVGVPAALDMMLTGRSIRADRAKKMGLVDQLVEPLGFARMQVAVDIMHSFCVCYILHSTQKEA

SEQ ID NO: 809753 - protein, 658 aa, Homo sapiens
MLAACKTLQEVTQLSQEAQRIVEKLEKSTKPIVAAINGSCLGGGLEVAISCQYRIATKDRKTVLGTPEVLLGALPGAGGTQRLPKMVGVPAALDMMLTGRSIRADRAKKMGLVDQLVEPLGPGLKPPEERTIEYLEEVAITFAKGLADKKISPKRDKGLVEKLTAYAMTIPFVRQQVYKKVEEKVRKQTKGLYPAPLKIIDVVKTGIEQGSDAGYLCESQKFGELVMTKESKALMGLYHGQVLCKKNKFGAPQKDVKHLAILGAGLMGAGIAQVSVDKGLKTILKDATLTALDRGQQQVFKGLNDKVKKKALTSFERDSIFSNLTGQLDYQGFEKADMVIEAVFEDLSLKHRVLKEVEAVIPDHCIFASNTSALPISEIAAVSKRPEKVIGMHYFSPVDKMQLLEIITTEKTSKDTSASAVAVGLKQGKVIIVVKDGPGFYTTRCLAPMMSEVIRILQEGVDPKKLDSLTTSFGFPVGAATLVDEVGVDVAKHVAEDLGKVFGERFGGGNPELLTQMVSKGFLGRKSGKGFYIYQEGVKRKDLNSDMDSILASLKLPPKSEVSSDEDIQFRLVTRFVNEAVMCLQEGISATPAEGDIGAVFGLGFPPCLGGPFRFVDLYGAQKIVDRLKKYEAAYGKQFTPCQLLADHANSPNKKFYQ

SEQ ID NO: 809754 - protein, 745 aa, Homo sapiens
MVACRAIGILSRFSAFRILRSRGYICRNFTGSSALLTRTHINYGVKGDVAVVRINSPNSKVNTLSKELHSEFSEVMNEIWASDQIRSAVLISSKPGCFIAGADINMLAACKTLQEVTQLSQEAQRIVEKLEKSTKPIVAAINGSCLGGGLEVAISCQYRIATKDRKTVLGTPEVLLGALPGAGGTQRLPKMEGVPAALDMMLTGRQHSSRQGKAQERTIEYLEEVAITFAKGLADKKISPKRDKGLVEKLTAYAMTIPFVRQQVYKKVEEKVRKQTKGLYPAPLKIIDVVKTGIEQGSDAGYLCESQKFGELVMTKESKALMGLYHGQVLCKKNKFGAPQKDVKHLAILGAGLMGAGIAQVSVDKGLKTILKDATLTALDRGQQQVFKGLNDKVKKKALTSFERDSIFSNLTGQLDYQGFEKADMVIEAVFEDLSLKHRVLKEVEAVIPDHCIFASNTSALPISEIAAVSKRPEKVIGMHYFSPVDKMQLLEIITTEKTSKDTSASAVAVGLKQGKVIIVVKDGPGFYTTRCLAPMMSEVIRILQEGVDPKKLDSLTTSFGFPVGAATLVDEVGVDVAKHVAEDLGKVFGERFGGGNPELLTQMVSKGFLGRKSGKGFYIYQEGVKRKDLNSDMDSILASLKLPPKSEVSSDEDIQFRLVTRFVNEAVMCLQEGISATPAEGDIGAVFGLGFPPCLGGPFRFVDLYGAQKIVDRLKKYEAAYGKQFTPCQLLADHANSPNKKFYQ

SEQ ID NO: 809755 - protein, 637 aa, Homo sapiens
GRVGRPTRRPIVAAINGSCLGGGLEVAISCQYRIATKDRKTVLGTPEVLLGALPGAGGTQRLPKMVGVPAALDMMLTGRSIRADRAKKMGLVDQLVEPLGPGLKPPEERTIEYLEEVAITFAKGLADKKISPKRDKGLVEKLTAYAMTIPFVRQQVYKKVEEKVRKQTKGLYPAPLKIIDVVKTGIEQGSDAGYLCESQKFGELVMTKESKALMGLYHGQVLCKKNKFGAPQKDVKHLAILGAGLMGAGIAQVSVDKGLKTILKDATLTALDRGQQQVFKGLNDKVKKKALTSFERDSIFSNLTGQLDYQGFEKADMVIEAVFEDLSLKHRVLKEVEAVIPDHCIFASNTSALPISEIAAVSKRPEKVIGMHYFSPVDKMQLLEIITTEKTSKDTSASAVAVGLKQGKVIIVVKDGPGFYTTRCLAPMMSEVIRILQEGVDPKKLDSLTTSFGFPVGAATLVDEVGVDVAKHVAEDLGKVFGERFGGGNPELLTQMVSKGFLGRKSGKGFYIYQEGVKRKDLNSDMDSILASLKLPPKSEVSSDEDIQFRLVTRFVNEAVMCLQEGISATPAEGDIGAVFGLGFPPCLGGPFRFVDLYGAQKIVDRLKKYEAAYGKQFTPCQLLADHANSPNKKFYQ

SEQ ID NO: 809756 - protein, 415 aa, Homo sapiens
MPIQNSNKRQKDVKHLAILGAGLMGAGIAQVSVDKGLKTILKDATLTALDRGQQQVFKGLNDKVKKKALTSFERDSIFSNLTGQLDYQGFEKADMVIEAVFEDLSLKHRVLKEVEAVIPDHCIFASNTSALPISEIAAVSKRPEKVIGMHYFSPVDKMQLLEIITTEKTSKDTSASAVAVGLKQGKVIIVVKDGPGFYTTRCLAPMMSEVIRILQEGVDPKKLDSLTTSFGFPVGAATLVDEVGVDVAKHVAEDLGKVFGERFGGGNPELLTQMVSKGFLGRKSGKGFYIYQEGVKRKDLNSDMDSILASLKLPPKSEVSSDEDIQFRLVTRFVNEAVMCLQEGISATPAEGDIGAVFGLGFPPCLGGPFRFVDLYGAQKIVDRLKKYEAAYGKQFTPCQLLADHANSPNKKFYQ

SEQ ID NO: 809757 - protein, 77 aa, Homo sapiens
RDAGSGIESHGPAGPRTLKGPGGSSSRGARGAVSPRRFRDCTRASEQPRQQLASRPPSSRSRSPPSKRTKARGRRSQ

SEQ ID NO: 809758 - protein, 279 aa, Homo sapiens
QTWLKRCRCRYCRCRENAEPSRAGWAAAARAATGTRFPSAAAAAMARLADYFIVVGYDHEKPGSGEGLGKIIQRFPQKDWDDTPFPQGIELFCQPGGWQLSRERKQPTFFVVVLTDIDSDRHYCSCLTFYEAEINLQGTKKEEIEGEAKVSGLIQPAEVFAPKSLVLVSRLYYPEIFRACLGLIYTVYVDSLNVSLESLIANLCACLVPAAGGSQKLFSLGAGDRQLIQTPLHDSLPITGTSVALLFQQLGTVAHACNLSTLGGRGGQLTRSGDRDHPG

SEQ ID NO: 809759 - protein, 1196 aa, Homo sapiens
QTWLKRCRCRYCRCRENAEPSRAGWAAAARAATGTRFPSAAAAAMARLADYFIVVGYDHEKPGSGEGLGKIIQRFPQKDWDDTPFPQGIELFCQPGGWQLSRERKQPTFFVVVLTDIDSDRHYCSCLTFYEAEINLQGTKKEEIEGEAKVSGLIQPAEVFAPKSLVLVSRLYYPEIFRACLGLIYTVYVDSLNVSLESLIANLCACLVPAAGGSQKLFSLGAGDRQLIQTPLHDSLPITGTSVALLFQQLGIQNVLSLFCAVLTENKVLFHSASFQRLSDACRALESLMFPLKYSYPYIPILPAQLLEVLSSPTPFIIGVHSVFKTDVHELLDVIIADLDGGTIKIPECIHLSSLPEPLLHQTQSALSLILHPDLEVADHAFPPPRTALSHSKMLDKEVRAVFLRLFAQLFQGYRSCLQLIRIHAEPVIHFHKTAFLGQRGLVENDFLTKVLSGMAFAGFVSERGPPYRSCDLFDELVAFEVERIKVEENNPVKMIKHVRELAEQLFKNENPNPHMAFQKVPRPTEGSHLRVHILPFPEINEARVQELIQENVAKNQNAPPATRIEKKCVVPAGPPVVSIMDKVTTVFNSAQRLEVVRNCISFIFENKILETEKTLPAALRALKGKAARQCLTDELGLHVQQNRAILDHQQFDYIIRMMNCTLQDCSSLEEYNIAAALLPLTSAFYRKLAPGVSQFAYTCVQDHPIWTNQQFWETTFYNAVQEQVRSLYLSAKEDNHAPHLKQKDKLPDDHYQEKTAMDLAAEQLRLWPTLSKSTQQELVQHEESTVFSQAIHFANLMVNLLVPLDTSKNKLLRTSAPGDWESGSNSIVTNSIAGSVAESYDTESGFEDSENTDIANSVVRFITRFIDKVCTESGVTQDHIKSLHCMIPGIVAMHIETLEAVHRESRRLPPIQKPKILRPALLPGEEIVCEGLRVLLDPDGREEATGGLLGGPQLLPAEGALFLTTYRILFRGTPHDQLVGEQTVVRSFPIASITKEKKITMQNQLQQNMQEGLQITSASFQLIKVAFDEEVSPEVVEIFKKQLMKFRYPQSIFSTFAFAAGQTTPQIILPKQKEKNTSFRTFSKTIVKGAKRAGKMTIGRQYLLKKKTGTIVEERVNRPGWNEDDDVSVSDESELPTSTTLKASEKSTMEQLVEKACFRDYQRLGLGTISGSSSRSRPEYFRITASNRMYSLCRR

SEQ ID NO: 809760 - protein, 170 aa, Homo sapiens
QTWLKRCRCRYCRCRENAEPSRAGWAAAARAATGTRFPSAAAAAMARLADYFIVVGYDHEKPGSGEGLGKIIQRFPQKDWDDTPFPQGIELFCQPGGWQLSRERKQPTFFVVVLTDIDSDRHYCSCLTFYEAEINLQGTKKEEIEGEAKVSGLIQPAEVFAPKSLVLAWV

SEQ ID NO: 809761 - protein, 54 aa, Homo sapiens
DPRNTRLLQPAIYTRGEARPSGARRQEGSAKVNAHQVHVLMQQHLINAASVEGD

SEQ ID NO: 809762 - protein, 71 aa, Homo sapiens
PRRRASPRLRKLALPASGPDCTGSAAALAQAASAGQRPGNPVLRGAAEGRAWPGEYRGFGPLPCASRVLHR

SEQ ID NO: 809763 - protein, 117 aa, Homo sapiens
MKWMFKEDHSLEHRCVESAKIRAKYPDRVPVIVEKVSGSQIVDIDKRKYLVPSDITVAQFMWIIRKRIQLPSEKAIFLFVDKTVPQSSLTMGQLYEKEKDEDGFLYVAYSGENTFGF

SEQ ID NO: 809764 - protein, 117 aa, Homo sapiens; identical to SEQ ID NO: 809763

SEQ ID NO: 809765 - protein, 91 aa, Homo sapiens
LLGSDSRKSRLPCSRRRRCRCRCRRRCCCARCAELRGSASRFRPLPAAAMKWMFKEDHSLEHRCVESAKIRAKYPDRVPPNYGTALREGKR

SEQ ID NO: 809766 - protein, 117 aa, Homo sapiens; identical to SEQ ID NO: 809763

SEQ ID NO: 809767 - protein, 152 aa, Homo sapiens
GDQRFIRYIQRRCCCARCAELRGSASRFRPLPAAAMKWMFKEDHSLEHRCVESAKIRAKYPDRVPVIVEKVSGSQIVDIDKRKYLVPSDITVAQFMWIIRKRIQLPSEKAIFLFVDKTVPQSSLTMGQLYEKEKDEDGFLYVAYSGENTFGF

SEQ ID NO: 809768 - protein, 82 aa, Homo sapiens
PQRFLSITIDKRKYLVPSDITVAQFMWIIRKRIQLPSEKAIFLFVDKTVPQSSLTMGQLYEKEKDEDGFLYVAYSGENTFGF

SEQ ID NO: 809769 - protein, 141 aa, Homo sapiens
MKWMFKEDHSLEHRCVESAKIRAKYPDRVPVIVEKVSGSQIVDIDKRKYLVPSDITVAQFMWIIRKRIQLPSEKAIFLFVDKTVPQSRIISTQQVLTPEVLLNSCPQAILFLLKPGLQFSMTFLFFSFKPNYGTALREGKR

SEQ ID NO: 809770 - protein, 148 aa, Homo sapiens
LLGSDSRKSRLPCSRRRRCRCRCRRRCCCARCAELRGSASRFRPLPAAAMKWMFKEDHSLEHRCVESAKIRAKYPDRVPVIVEKVSGSQIVDIDKRKYLVPSDITVAQFMWIIRKRIQLPSEKAIFLFVDKTVPQSSLTMGQLYEKDF

SEQ ID NO: 809771 - protein, 837 aa, Homo sapiens
QCAGAAADASVYVRARRWRRRGKQREQPEDRGVPMKRAAMALHSPQYIFGDFSPDEFNQFFVTPRSSVELPPYSGTVLCGTQAVDKLPDGQEYQRIEFGVDEVIEPSDTLPRTPSYSISSTLNPQAPEFILGCTASKITPDGITKEASYGSIDCQYPGSALALDGSSNVEAEVLENDGVSGGLGQRERKKKKKRPPGYYSYLKDGGDDSISTEALVNGHANSAVPNSVSAEDAEFMGDMPPSVTPRTCNSPQNSTDSVSDIVPDSPFPGALGSDTRTAGQPEGGPGADFGQSCFPAEAGRDTLSRTAGAQPCVGTDTTENLGVANGQILESSGEGTATNGVELHTTESIDLDPTKPESASPPADGTGSASGTLPVSQPKSWASLFHDSKPSSSSPVAYVETKYSPPAISPLVSEKQVEVKEGLVPVSEDPVAIKIAELLENVTLIHKPVSLQPRGLINKGNWCYINATLQALVACPPMYHLMKFIPLYSKVQRPCTSTPMIDSFVRLMNEFTNMPVPPKPRQALGDKIVRDIRPGAAFEPTYIYRLLTVNKSSLSEKGRQEDAEEYLGFILNGLHEEMLNLKKLLSPSNEKLTISNGPKNHSVNEEEQEEQGEGSEDEWEQVGPRNKTSVTRQADFVQTPITGIFGGHIRSVVYQQSSKESATLQPFFTLQLDIQSDKIRTVQDALESLVARESVQGYTTKTKQEVEISRRVTLEKLPPVLVLHLKRFVYEKTGGCQKLIKNIEYPVDLEISKELLSPGVKNKNFKCHRTYRLFAVVYHHGNSATGGHYTTDVFQIGLNGWLRIDDQTVKVINQYQVVKPTAERTAYLLYYRRVDLL

SEQ ID NO: 809772 - protein, 837 aa, Homo sapiens; identical to SEQ ID NO: 809771

SEQ ID NO: 809773 - protein, 837 aa, Homo sapiens; identical to SEQ ID NO: 809771

SEQ ID NO: 809774 - protein, 808 aa, Homo sapiens
MFGRESGNGGSGMSQQKYIFGDFSPDEFNQFFVTPRSSVELPPYSGTVLCGTQAVDKLPDGQEYQRIEFGVDEVIEPSDTLPRTPSYSISSTLNPQAPEFILGCTASKITPDGITKEASYGSIDCQYPGSALALDGSSNVEAEVLENDGVSGGLGQRERKKKKKRPPGYYSYLKDGGDDSISTEALVNGHANSAVPNSVSAEDAEFMGDMPPSVTPRTCNSPQNSTDSVSDIVPDSPFPGALGSDTRTAGQPEGGPGADFGQSCFPAEAGRDTLSRTAGAQPCVGTDTTENLGVANGQILESSGEGTATNGVELHTTESIDLDPTKPESASPPADGTGSASGTLPVSQPKSWASLFHDSKPSSSSPVAYVETKYSPPAISPLVSEKQVEVKEGLVPVSEDPVAIKIAELLENVTLIHKPVSLQPRGLINKGNWCYINATLQALVACPPMYHLMKFIPLYSKVQRPCTSTPMIDSFVRLMNEFTNMPVPPKPRQALGDKIVRDIRPGAAFEPTYIYRLLTVNKSSLSEKGRQEDAEEYLGFILNGLHEEMLNLKKLLSPSNEKLTISNGPKNHSVNEEEQEEQGEGSEDEWEQVGPRNKTSVTRQADFVQTPITGIFGGHIRSVVYQQSSKESATLQPFFTLQLDIQSDKIRTVQDALESLVARESVQGYTTKTKQEVEISRRVTLEKLPPVLVLHLKRFVYEKTGGCQKLIKNIEYPVDLEISKELLSPGVKNKNFKCHRTYRLFAVVYHHGNSATGGHYTTDVFQIGLNGWLRIDDQTVKVINQYQVVKPTAERTAYLLYYRRVDLL

SEQ ID NO: 809775 - protein, 845 aa, Homo sapiens
RYSSAPRSLFIGTLPVSQPKSWASLFHDSKPSSSSPVAYVETKYSPPAISPLVSEKQVEVKEGLVPVSEDPVAKRFQLPPYSGTVLCGTQAVDKLPDGQEYQRIEFGVDEVIEPSDTLPRTPSYSISSTLNPQAPEFILGCTASKITPDGITKEASYGSIDCQYPGSALALDGSSNVEAEVLENDGVSGGLGQRERKKKKKRPPGYYSYLKDGGDDSISTEALVNGHANSAVPNSVSAEDAEFMGDMPPSVTPRTCNSPQNSTDSVSDIVPDSPFPGALGSDTRTAGQPEGGPGADFGQSCFPAEAGRDTLSRTAGAQPCVGTDTTENLGVANGQILESSGEGTATNGVELHTTESIDLDPTKPESASPPADGTGSASGTLPVSQPKSWASLFHDSKPSSSSPVAYVETKYSPPAISPLVSEKQVEVKEGLVPVSEDPVAIKIAELLENVTLIHKPVSLQPRGLINKGNWCYINATLQALVACPPMYHLMKFIPLYSKVQRPCTSTPMIDSFVRLMNEFTNMPVPPKPRQALGDKIVRDIRPGAAFEPTYIYRLLTVNKSSLSEKGRQEDAEEYLGFILNGLHEEMLNLKKLLSPSNEKLTISNGPKNHSVNEEEQEEQGEGSEDEWEQVGPRNKTSVTRQADFVQTPITGIFGGHIRSVVYQQSSKESATLQPFFTLQLDIQSDKIRTVQDALESLVARESVQGYTTKTKQEVEISRRVTLEKLPPVLVLHLKRFVYEKTGGCQKLIKNIEYPVDLEISKELLSPGVKNKNFKCHRTYRLFAVVYHHGNSATGGHYTTDVFQIGLNGWLRIDDQTVKVINQYQVVKPTAERTAYLLYYRRVDLL

SEQ ID NO: 809776 - protein, 481 aa, Homo sapiens
QCAGAAADASVYVRARRWRRRGKQREHLFHDSKPSSSSPVAYVETKYSPPAISPLVSEKQVEVKEGLVPVSEDPVAIKIAELLENVTLIHKPVSLQPRGLINKGNWCYINATLQALVACPPMYHLMKFIPLYSKVQRPCTSTPMIDSFVRLMNEFTNMPVPPKPRQALGDKIVRDIRPGAAFEPTYIYRLLTVNKSSLSEKGRQEDAEEYLGFILNGLHEEMLNLKKLLSPSNEKLTISNGPKNHSVNEEEQEEQGEGSEDEWEQVGPRNKTSVTRQADFVQTPITGIFGGHIRSVVYQQSSKESATLQPFFTLQLDIQSDKIRTVQDALESLVARESVQGYTTKTKQEVEISRRVTLEKLPPVLVLHLKRFVYEKTGGCQKLIKNIEYPVDLEISKELLSPGVKNKNFKCHRTYRLFAVVYHHGNSATGGHYTTDVFQIGLNGWLRIDDQTVKVINQYQVVKPTAERTAYLLYYRRVDLL

SEQ ID NO: 809777 - protein, 360 aa, Homo sapiens
MYHLMKFIPLYSKVQRPCTSTPMIDSFVRLMNEFTNMPVPPKPRQALGDKIVRDIRPGAAFEPTYIYRLLTVNKSSLSEKGRQEDAEEYLGFILNGLHEEMLNLKKLLSPSNEKLTISNGPKNHSVNEEEQEEQGEGSEDEWEQVGPRNKTSVTRQADFVQTPITGIFGGHIRSVVYQQSSKESATLQPFFTLQLDIQSDKIRTVQDALESLVARESVQGYTTKTKQEVEISRRVTLEKLPPVLVLHLKRFVYEKTGGCQKLIKNIEYPVDLEISKELLSPGVKNKNFKCHRTYRLFAVVYHHGNSATGGHYTTDVFQIGLNGWLRIDDQTVKVINQYQVVKPTAERTAYLLYYRRVDLL

SEQ ID NO: 809778 - protein, 490 aa, Homo sapiens
QCAGAAADASVYVRARRWRRRGKQREQPEDRGVPMKRAAMALHSPQYIFGDFSPDEFNQFFVTPRSSVELPPYSGTVLCGTQAVDKLPDELLENVTLIHKPVSLQPRGLINKGNWCYINATLQALVACPPMYHLMKFIPLYSKVQRPCTSTPMIDSFVRLMNEFTNMPVPPKPRQALGDKIVRDIRPGAAFEPTYIYRLLTVNKSSLSEKGRQEDAEEYLGFILNGLHEEMLNLKKLLSPSNEKLTISNGPKNHSVNEEEQEEQGEGSEDEWEQVGPRNKTSVTRQADFVQTPITGIFGGHIRSVVYQQSSKESATLQPFFTLQLDIQSDKIRTVQDALESLVARESVQGYTTKTKQEVEISRRVTLEKLPPVLVLHLKRFVYEKTGGCQKLIKNIEYPVDLEISKELLSPGVKNKNFKCHRTYRLFAVVYHHGNSATGGHYTTDVFQIGLNGWLRIDDQTVKVINQYQVVKPTAERTAYLLYYRRVDLL

SEQ ID NO: 809779 - protein, 360 aa, Homo sapiens; identical to SEQ ID NO: 809777

SEQ ID NO: 809780 - protein, 349 aa, Homo sapiens
QCAGAAADASVYVRARRWRRRGKQREQPEDRGVPMKRAAMALHSPQYIFGDFSPDEFNQFFVTPRSSVEGRQEDAEEYLGFILNGLHEEMLNLKKLLSPSNEKLTISNGPKNHSVNEEEQEEQGEGSEDEWEQVGPRNKTSVTRQADFVQTPITGIFGGHIRSVVYQQSSKESATLQPFFTLQLDIQSDKIRTVQDALESLVARESVQGYTTKTKQEVEISRRVTLEKLPPVLVLHLKRFVYEKTGGCQKLIKNIEYPVDLEISKELLSPGVKNKNFKCHRTYRLFAVVYHHGNSATGGHYTTDVFQIGLNGWLRIDDQTVKVINQYQVVKPTAERTAYLLYYRRVDLL

SEQ ID NO: 809781 - protein, 252 aa, Homo sapiens
MLSFSELTISNGPKNHSVNEEEQEEQGEGSEDEWEQVGPRNKTSVTRQADFVQTPITGIFGGHIRSVVYQQSSKESATLQPFFTLQLDIQSDKIRTVQDALESLVARESVQGYTTKTKQEVEISRRVTLEKLPPVLVLHLKRFVYEKTGGCQKLIKNIEYPVDLEISKELLSPGVKNKNFKCHRTYRLFAVVYHHGNSATGGHYTTDVFQIGLNGWLRIDDQTVKVINQYQVVKPTAERTAYLLYYRRVDLL

SEQ ID NO: 809782 - protein, 189 aa, Homo sapiens
RDYFSLSLSSKESATLQPFFTLQLDIQSDKIRTVQDALESLVARESVQGYTTKTKQEVEISRRVTLEKLPPVLVLHLKRFVYEKTGGCQKLIKNIEYPVDLEISKELLSPGVKNKNFKCHRTYRLFAVVYHHGNSATGGHYTTDVFQIGLNGWLRIDDQTVKVINQYQVVKPTAERTAYLLYYRRVDLL

SEQ ID NO: 809783 - protein, 201 aa, Homo sapiens
QCAGAAADASVYVRARRWRRRGKQREQPEDRGVPMKRAAMALHSPQYIFGDFSPDEFNQFFVTPRSSVELPPYSGTVLCGTQAVDKLPDERFVYEKTGGCQKLIKNIEYPVDLEISKELLSPGVKNKNFKCHRTYRLFAVVYHHGNSATGGHYTTDVFQIGLNGWLRIDDQTVKVINQYQVVKPTAERTAYLLYYRRVDLL

SEQ ID NO: 809784 - protein, 202 aa, Homo sapiens
MPMLTLLHAVEYPRSGAKSTASGPWNAPGYERRLAKRYPVQGSHSLQQTQTHNHAGSAGIMTRQAVHVMGKDNFHLLVFSLTADHAHTYLDYHEQQHCGGCQKLIKNIEYPVDLEISKELLSPGVKNKNFKCHRTYRLFAVVYHHGNSATGGHYTTDVFQIGLNGWLRIDDQTVKVINQYQVVKPTAERTAYLLYYRRVDLL

SEQ ID NO: 809785 - protein, 259 aa, Homo sapiens
RYSSAPRSLFIGTLPVSQPKSWASLFHDSKPSSSSPVAYVETKYSPPAISPLVSEKQVEVKEGLVPVSEDPVAKRFQLPPYSGTVLCGTQAVDKLPDGQEYQRIEFGVDEVIEPSDTLPRTPSYSISSTLNPQAPEFILGCTASKITPDGITKEASYGSIDCQYPGSALALDGSSNVEAEVLENDGVSGGLGQRERKKKKKRPPGYYSYLKDGGDDSISTEAWLRIDDQTVKVINQYQVVKPTAERTAYLLYYRRVDLL

SEQ ID NO: 809786 - protein, 777 aa, Homo sapiens
QCAGAAADASVYVRARRWRRRGKQREQPEDRGVPMKRAAMALHSPQYIFGDFSPDEFNQFFVTPRSSVELPPYSGTVLCGTQAVDKLPDGQEYQRIEFGVDEVIEPSDTLPRTPSYSISSTLNPQAPEFILGCTASKITPDGITKEASYGSIDCQYPGSALALDGSSNVEAEVLENDGVSGGLGQRERKKKKKRPPGYYSYLKDGGDDSISTEALVNGHANSAVPNSVSAEDAEFMGDMPPSVTPRTCNSPQNSTDSVSDIVPDSPFPGALGSDTRTAGQPEGGPGADFGQSCFPAEAGRDTLSRTAGAQPCVGTDTTENLGVANGQILESSGEGTATNGVELHTTESIDLDPTKPESASPPADGTGSASGTLPVSQPKSWASLFHDSKPSSSSPVAYVETKYSPPAISPLVSEKQVEVKEGLVPVSEDPVAIKIAELLENVTLIHKPVSLQPRGLINKGNWCYINATLQALVACPPMYHLMKFIPLYSKVQRPCTSTPMIDSFVRLMNEFTNMPVPPKPRQALGDKIVRDIRPGAAFEPTYIYRLLTVNKSSLSEKGRQEDAEEYLGFILNGLHEEMLNLKKLLSPSNEKLTISNGPKNHSVNEEEQEEQGEGSEDEWEQVGPRNKTSVTRQADFVQTPITGIFGGHIRSVVYQQSSKESATLQPFFTLQLDIQSDKIRTVQDALESLVARESVQGYTTKTKQEVEISRRVTLEKLPPVLVLHLKRFVYEKTGGCQKLIKNIEYPVDLEISKELLCPGLLTTPDNYPGQDLPYKYT

SEQ ID NO: 809787 - protein, 720 aa, Homo sapiens
QCAGAAADASVYVRARRWRRRGKQREQPEDRGVPMKRAAMALHSPQYIFGDFSPDEFNQFFVTPRSSVELPPYSGTVLCGTQAVDKLPDGQEYQRIEFGVDEVIEPSDTLPRTPSYSISSTLNPQAPEFILGCTASKITPDGITKEASYGSIDCQYPGSALALDGSSNVEAEVLENDGVSGGLGQRERKKKKKRPPGYYSYLKDGGDDSISTEALVNGHANSAVPNSVSAEDAEFMGDMPPSVTPRTCNSPQNSTDSVSDIVPDSPFPGALGSDTRTAGQPEGGPGADFGQSCFPAEAGRDTLSRTAGAQPCVGTDTTENLGVANGQILESSGEGTATNGVELHTTESIDLDPTKPESASPPADGTGSASGTLPVSQPKSWASLFHDSKPSSSSPVAYVETKYSPPAISPLVSEKQVEVKEGLVPVSEDPVAIKIAELLENVTLIHKPVSLQPRGLINKGNWCYINATLQALVACPPMYHLMKFIPLYSKVQRPCTSTPMIDSFVRLMNEFTNMPVPPKPRQALGDKIVRDIRPGAAFEPTYIYRLLTVNKSSLSEKGRQEDAEEYLGFILNGLHEEMLNLKKLLSPSNEKLTISNGPKNHSVNEEEQEEQGEGSEDEWEQVGPRNKTSVTRQADFVQTPITGIFGGHIRSVVYQQSSKESATLQPFFTLQLDIQSDKIRTVQDALESLVARESVQGYTTKTKQELRKLESDSGGVGYRA

SEQ ID NO: 809788 - protein, 444 aa, Homo sapiens
QCAGAAADASVYVRARRWRRRGKQREQPEDRGVPMKRAAMALHSPQYIFGDFSPDEFNQFFVTPRSSVELPPYSGTVLCGTQAVDKLPDGQEYQRIEFGVDEVIEPSDTLPRTPSYSISSTLNPQAPEFILGCTASKITPDGITKEASYGSIDCQYPGSALALDGSSNVEAEVLENDGVSGGLGQRERKKKKKRPPGYYSYLKDGGDDSISTEALVNGHANSAVPNSVSAEDAEFMGDMPPSVTPRTCNSPQNSTDSVSDIVPDSPFPGALGSDTRTAGQPEGGPGADFGQSCFPAEAGRDTLSRTAGAQPCVGTDTTENLGVANGQILESSGEGTATNGVELHTTESIDLDPTKPESASPPADGTGSASGTLPVSQPKSWASLFHDSKPSSSSPVAYVETKYSPPAISPLVSEKQVEVKEGLVPVSEDPVAIKIAGIVEKIQI

SEQ ID NO: 809789 - protein, 263 aa, Homo sapiens
LESLRRFAFPGLPFAPPRTRRPCASRGNHPRAPGREDAEQGVLRAGTGAATSRRCRMAAEPQPSSLSYRTTGSTYLHPLSELLGIPLDQVNFVVCQLVALFAAFWFRIYLRPGTTSSDVRHAVATIFGIYFVIFCFGWYSVHLFVLVLMCYAIMVTASVSNIHRYSFFVAMGYLTICHISRIYIFHYGILTTDFSGPLMIVTQKITTLAFQVHDGLGRRAEDLSAEQHRLAIKVKPSFLEYLSYLLNFMSVIAGPCNNFKDYI

SEQ ID NO: 809790 - protein, 3981 aa, Homo sapiens
EDGGGGGGDGASRAAEDDPPVSAETASTSGGGAPDRIGSLGRGACRPTSVQIDLSFLSPTTPQPLFSPAFLAEAMEDEERQKKLEAGKAKLAQFRQRKAQSDGQSPSKKQKKKRKTSSSKHDVSAHHDLNIDQSQCNEMYINSSQRVESTVIPESTIMRTLHSGEITSHEQGFSVELESEISTTADDCSSEVNGCSFVMRTGKPTNLLREEEFGVDDSYSEQGAQDSPTHLEMMESELAGKQHEIEELNRELEEMRVTYGTEGLQQLQEFEAAIKQRDGIITQLTANLQQARREKDETMREFLELTEQSQKLQIQFQQLQASETLRNSTHSSTAADLLQAKQQILTHQQQLEEQDHLLEDYQKKKEDFTMQISFLQEKIKVYEMEQDKKVENSNKEEIQEKETIIEELNTKIIEEEKKTLELKDKLTTADKLLGELQEQIVQKNQEIKNMKLELTNSKQKERQSSEEIKQLMGTVEELQKRNHKDSQFETDIVQRMEQETQRKLEQLRAELDEMYGQQIVQMKQELIRQHMAQMEEIKTRHKGEMENALRSYSNITVNEDQIKLMNVAINELNIKLQDTNSQKEKLKEELGLILEEKCALQRQLEDLVEELSFSREQIQRARQTIAEQESKLNEAHKSLSTVEDLKAEIVSASESRKELELKHEAEVTNYKIKLEMLEKEKNAVLDRMAESQEAELERLRTQLLFSHEEELSKLKEDLEIEHRINIEKLKDNLGIHYKQQIDGLQNEMSQKIETMQFEKDNLITKQNQLILEISKLKDLQQSLVNSKSEEMTLQINELQKEIEILRQEEKEKGTLEQEVQELQLKTELLEKQMKEKENDLQEKFAQLEAENSILKDEKKTLEDMLKIHTPVSQEERLIFLDSIKSKSKDSVWEKEIEILIEENEDLKQQCIQLNEEIEKQRNTFSFAEKNFEVNYQELQEEYACLLKVKDDLEDSKNKQELEYKSKLKALNEELHLQRINPTTVKMKSSVFDEDKTFVAETLEMGEVVEKDTTELMEKLEVTKREKLELSQRLSDLSEQLKQKHGEISFLNEEVKSLKQEKEQVSLRCRELEIIINHNRAENVQSCDTQVSSLLDGVVTMTSRGAEGSVSKVNKSFGEESKIMVEDKVSFENMTVGEESKQEQLILDHLPSVTKESSLRATQPSENDKLQKELNVLKSEQNDLRLQMEAQRICLSLVYSTHVDQVREYMENEKDKALCSLKEELIFAQEEKIKELQKIHQLELQTMKTQETGDEGKPLHLLIGKLQKAVSEECSYFLQTLCSVLGEYYTPALKCEVNAEDKENSGDYISENEDPELQDYRYEVQDFQENMHTLLNKVTEEYNKLLVLQTRLSKIWGQQTDGMKLEFGEENLPKEETEFLSIHSQMTNLEDIDVNHKSKLSSLQDLEKTKLEEQVQELESLISSLQQQLKETEQNYEAEIHCLQKRLQAVSESTVPPSLPVDSVVITESDAQRTMYPGSCVKKNIDGTIEFSGEFGVKEETNIVKLLEKQYQEQLEEEVAKVIVSMSIAFAQQTELSRISGGKENTASSKQAHAVCQQEQHYFNEMKLSQDQIGFQTFETVDVKFKEEFKPLSKELGEHGKEILLSNSDPHDIPESKDCVLTISEEMFSKDKTFIVRQSIHDEISVSSMDASRQLMLNEEQLEDMRQELVRQYQEHQQATELLRQAHMRQMERQREDQEQLQEEIKRLNRQLAQRSSIDNENLVSERERVLLEELEALKQLSLAGREKLCCELRNSSTQTQNGNENQGEVEEQTFKEKELDRKPEDVPPEILSNERYALQKANNRLLKILLEVVKTTAAVEETIGRHVLGILDRSSKSQSSASLIWRSEAEASVKSCVHEEHTRVTDESIPSYSGSDMPRNDINMWSKVTEEGTELSQRLVRSGFAGTEIDPENEELMLNISSRLQAAVEKLLEAISETSSQLEHAKVTQTELMRESFRQKQEATESLKCQEELRERLHEESRAREQLAVELSKAEGVIDGYADEKTLFERQIQEKTDIIDRLEQELLCASNRLQELEAEQQQIQEERELLSRQKEAMKAEAGPVEQQLLQETEKLMKEKLEVQCQAEKVRDDLQKQVKALEIDVEEQVSRFIELEQEKNTELMDLRQQNQALEKQLEKMRKFLDEQAIDREHERDVFQQEIQKLEQQLKVVPRFQPISEHQTREVEQLANHLKEKTDKCSELLLSKEQLQRDIQERNEEIEKLEFRVRELEQALLVSADTFQKVEDRKHFGAVEAKPELSLEVQLQAERDAIDRKEKEITNLEEQLEQFREELENKNEEVQQLHMQLEIQKKESTTRLQELEQENKLFKDDMEKLGLAIKESDAMSTQDQHVLFGKFAQIIQEKEVEIDQLNEQVTKLQQQLKITTDNKVIEEKNELIRDLETQIECLMSDQECVKRNREEEIEQLNEVIEKLQQELANIGQKTSMNAHSLSEEADSLKHQLDVVIAEKLALEQQVETANEEMTFMKNVLKETNFKMNQLTQELFSLKRERESVEKIQSIPENSVNVAIDHLSKDKPELEVVLTEDALKSLENQTYFKSFEENGKGSIINLETRLLQLESTVSAKDLELTQCYKQIKDMQEQGQFETEMLQKKIVNLQKIVEEKVAAALVSQIQLEAVQEYAKFCQDNQTISSEPERTNIQNLNQLREDELGSDISALTLRISELESQVVEMHTSLILEKEQVEIAEKNVLEKEKKLLELQKLLEGNEKKQREKEKKRSPQDVEVLKTTTELFHSNEESGFFNELEALRAESVATKAELASYKEKAEKLQEELLVKETNMTSLQKDLSQVRDHLAEAKEKLSILEKEDETEVQESKKACMFEPLPIKLSKSIASQTDGTLKISSSNQTPQILVKNAGIQINLQSECSSEEVTEIISQFTEKIEKMQELHAAEILDMESRHISETETLKREHYVAVQLLKEECGTLKAVIQCLRSKEGSSIPELAHSDAYQTREICSSDSGSDWGQGIYLTHSQGFDIASEGRGEESESATDSFPKKIKGLLRAVHNEGMQVLSLTESPYSDGEDHSIQQVSESWLEERKAYINTISSLKDLITKMQLQREAEVYDSSQSHESFSDWRGELLLALQQVFLEERSVLLAAFRTELTALGTTDAVGLLNCLEQRIQEQGVEYQAAMECLQKADRRSLLSEIQALHAQMNGRKITLKREQESEKPSQELLEYNIQQKQSQMLEMQVELSSMKDRATELQEQLSSEKMVVAELKSELAQTKLELETTLKAQHKHLKELEAFRLEVKDKTDEVHLLNDTLASEQKKSRELQWALEKEKAKLGRSEERDKEELEDLKFSLESQKQRNLQLNLLLEQQKQLLNESQQKIESQRMLYDAQLSEEQGRNLELQVLLESEKVRIREMSSTLDRERELHAQLQSSDGTGQSRPPLPSEDLLKELQKQLEEKHSRIVELLNETEKYKLDSLQTRQQMEKDRQVHRKTLQTEQEANTEGQKKMHELQSKVEDLQRQLEEKRQQVYKLDLEGQRLQGIMQEFQKQELEREEKRESRRILYQNLNEPTTWSLTSDRTRNWVLQQKIEGETKESNYAKLIEMNGGGTGCNHELEMIRQKLQCVASKLQVLPQKASERLQFETADDEDFIWVQENIDEIILQLQKLTGQQGEEPSLVSPSTSCGSLTERLLRQNAELTGHISQLTEEKNDLRNMVMKLEEQIRWYRQTGAGRDNSSRFSLNGGANIEAIIASEKEVWNREKLTLQKSLKRAEAEVYKLKAELRNDSLLQTLSPDSEHVTLKRIYGKYLRAESFRKALIYQKKYLLLLLGGFQECEDATLALLARMGGQPAFTDLEVITNRPKGFTRFRSAVRVSIAISRMKFLVRRWHRVTGSVSININRDGFGLNQGAEKTDSFYHSSGGLELYGEPRHTTYRSRSDLDYIRSPLPFQNRYPGTPADFNPGSLACSQLQNYDPDRALTDYITRLEALQRRLGTIQSGSTTQFHAGMRR

SEQ ID NO: 809791 - protein, 3973 aa, Homo sapiens
EDGGGGGGDGASRAAEDDPPVSAETASTSGGGAPDRIGSLGRGACRPTSVQIDLSFLSPTTPQPLFSPAFLAEAMEDEERQKKLEAGKAKLAQFRQRKAQSDGQSPSKKQKKKRKTSSSKHDVSAHHDLNIDQSQCNEMYINSSQRVESTVIPESTIMRTLHSGEITSHEQGFSVELESEISTTADDCSSEVNGCSFVMRTGKPTNLLREEEFGVDDSYSEQGAQDSPTHLEMMESELAGKQHEIEELNRELEEMRVTYGTEGLQQLQEFEAAIKQRDGIITQLTANLQQARREKDETMREFLELTEQSQKLQIQFQQLQASETLRNSTHSSTAADLLQAKQQILTHQQQLEEQDHLLEDYQKKKEDFTMQISFLQEKIKVYEMEQDKKVENSNKEEIQEKETIIEELNTKIIEEEKKTLELKDKLTTADKLLGELQEQIVQKNQEIKNMKLELTNSKQKERQSSEEIKQLMGTVEELQKRNHKDSQFETDIVQRMEQETQRKLEQLRAELDEMYGQQIVQMKQELIRQHMAQMEEIKTRHKGEMENALRSYSNITVNEDQIKLMNVAINELNIKLQDTNSQKEKLKEELGLILEEKCALQRQLEDLVEELSFSREQIQRARQTIAEQESKLNEAHKSLSTVEDLKAEIVSASESRKELELKHEAEVTNYKIKLEMLEKEKNAVLDRMAESQEAELERLRTQLLFSHEEELSKLKEDLEIEHRINIEKLKDNLGIHYKQQIDGLQNEMSQKIETMQFEKDNLITKQNQLILEISKLKDLQQSLVNSKSEEMTLQINELQKEIEILRQEEKEKGTLEQEVQELQLKTELLEKQMKEKENDLQEKFAQLEAENSILKDEKKTLEDMLKIHTPVSQEERLIFLDSIKSKSKDSVWEKEIEILIEENEDLKQQCIQLNEEIEKQRNTFSFAEKNFEVNYQELQEEYACLLKVKDDLEDSKNKQELEYKSKLKALNEELHLQRINPTTVKMKSSVFDEDKTFVAETLEMGEVVEKDTTELMEKLEVTKREKLELSQRLSDLSEQLKQKHGEISFLNEEVKSLKQEKEQVSLRCRELEIIINHNRAENVQSCDTQVSSLLDGVVTMTSRGAEGSVSKVNKSFGEESKIMVEDKVSFENMTVGEESKQEQLILDHLPSVTKESSLRATQPSENDKLQKELNVLKSEQNDLRLQMEAQRICLSLVYSTHVDQVREYMENEKDKALCSLKEELIFAQEEKIKELQKIHQLELQTMKTQETGDEGKPLHLLIGKLQKAVSEECSYFLQTLCSVLGEYYTPALKCEVNAEDKENSGDYISENEDPELQDYRYEVQDFQENMHTLLNKVTEEYNKLLVLQTRLSKIWGQQTDGMKLEFGEENLPKEETEFLSIHSQMTNLEDIDVNHKSKLSSLQDLEKTKLEEQVQELESLISSLQQQLKETEQNYEAEIHCLQKRLQAVSESTVPPSLPVDSVVITESDAQRTMYPGSCVKKNIDGTIEFSGEFGVKEETNIVKLLEKQYQEQLEEEVAKVIVSMSIAFAQQTELSRISGGKENTASSKQAHAVCQQEQHYFNEMKLSQDQIGFQTFETVDVKFKEEFKPLSKELGEHGKEILLSNSDPHDIPESKDCVLTISEEMFSKDKTFIVRQSIHDEISVSSMDASRQLMLNEEQLEDMRQELVRQYQEHQQATELLRQAHMRQMERQREDQEQLQEEIKRLNRQLAQRSSIDNENLVSERERVLLEELEALKQLSLAGREKLCCELRNSSTQTQNGNENQGEVEEQTFKEKELDRKPEDVPPEILSNERYALQKANNRLLKILLEVVKTTAAVEETIGRHVLGILDRSSKSQSSASLIWRSEAEASVKSCVHEEHTRVTDESIPSYSGSDMPRNDINMWSKVTEEGTELSQRLVRSGFAGTEIDPENEELMLNISSRLQAAVEKLLEAISETSSQLEHAKVTQTELMRESFRQKQEATESLKCQEELRERLHEESRAREQLAVELSKAEGVIDGYADEKTLFERQIQEKTDIIDRLEQELLCASNRLQELEAEQQQIQEERELLSRQKEAMKAEAGPVEQQLLQETEKLMKEKLEVQCQAEKVRDDLQKQVKALEIDVEEQVSRFIELEQEKNTELMDLRQQNQALEKQLEKMRKFLDEQAIDREHERDVFQQEIQKLEQQLKVVPRFQPISEHQTREVEQLANHLKEKTDKCSELLLSKEQLQRDIQERNEEIEKLEFRVRELEQALLVEDRKHFGAVEAKPELSLEVQLQAERDAIDRKEKEITNLEEQLEQFREELENKNEEVQQLHMQLEIQKKESTTRLQELEQENKLFKDDMEKLGLAIKESDAMSTQDQHVLFGKFAQIIQEKEVEIDQLNEQVTKLQQQLKITTDNKVIEEKNELIRDLETQIECLMSDQECVKRNREEEIEQLNEVIEKLQQELANIGQKTSMNAHSLSEEADSLKHQLDVVIAEKLALEQQVETANEEMTFMKNVLKETNFKMNQLTQELFSLKRERESVEKIQSIPENSVNVAIDHLSKDKPELEVVLTEDALKSLENQTYFKSFEENGKGSIINLETRLLQLESTVSAKDLELTQCYKQIKDMQEQGQFETEMLQKKIVNLQKIVEEKVAAALVSQIQLEAVQEYAKFCQDNQTISSEPERTNIQNLNQLREDELGSDISALTLRISELESQVVEMHTSLILEKEQVEIAEKNVLEKEKKLLELQKLLEGNEKKQREKEKKRSPQDVEVLKTTTELFHSNEESGFFNELEALRAESVATKAELASYKEKAEKLQEELLVKETNMTSLQKDLSQVRDHLAEAKEKLSILEKEDETEVQESKKACMFEPLPIKLSKSIASQTDGTLKISSSNQTPQILVKNAGIQINLQSECSSEEVTEIISQFTEKIEKMQELHAAEILDMESRHISETETLKREHYVAVQLLKEECGTLKAVIQCLRSKEGSSIPELAHSDAYQTREICSSDSGSDWGQGIYLTHSQGFDIASEGRGEESESATDSFPKKIKGLLRAVHNEGMQVLSLTESPYSDGEDHSIQQVSESWLEERKAYINTISSLKDLITKMQLQREAEVYDSSQSHESFSDWRGELLLALQQVFLEERSVLLAAFRTELTALGTTDAVGLLNCLEQRIQEQGVEYQAAMECLQKADRRSLLSEIQALHAQMNGRKITLKREQESEKPSQELLEYNIQQKQSQMLEMQVELSSMKDRATELQEQLSSEKMVVAELKSELAQTKLELETTLKAQHKHLKELEAFRLEVKDKTDEVHLLNDTLASEQKKSRELQWALEKEKAKLGRSEERDKEELEDLKFSLESQKQRNLQLNLLLEQQKQLLNESQQKIESQRMLYDAQLSEEQGRNLELQVLLESEKVRIREMSSTLDRERELHAQLQSSDGTGQSRPPLPSEDLLKELQKQLEEKHSRIVELLNETEKYKLDSLQTRQQMEKDRQVHRKTLQTEQEANTEGQKKMHELQSKVEDLQRQLEEKRQQVYKLDLEGQRLQGIMQEFQKQELEREEKRESRRILYQNLNEPTTWSLTSDRTRNWVLQQKIEGETKESNYAKLIEMNGGGTGCNHELEMIRQKLQCVASKLQVLPQKASERLQFETADDEDFIWVQENIDEIILQLQKLTGQQGEEPSLVSPSTSCGSLTERLLRQNAELTGHISQLTEEKNDLRNMVMKLEEQIRWYRQTGAGRDNSSRFSLNGGANIEAIIASEKEVWNREKLTLQKSLKRAEAEVYKLKAELRNDSLLQTLSPDSEHVTLKRIYGKYLRAESFRKALIYQKKYLLLLLGGFQECEDATLALLARMGGQPAFTDLEVITNRPKGFTRFRSAVRVSIAISRMKFLVRRWHRVTGSVSININRDGFGLNQGAEKTDSFYHSSGGLELYGEPRHTTYRSRSDLDYIRSPLPFQNRYPGTPADFNPGSLACSQLQNYDPDRALTDYITRLEALQRRLGTIQSGSTTQFHAGMRR

SEQ ID NO: 809792 - protein, 803 aa, Homo sapiens
MSCLIMFQILIMFCVELLEYNIQQKQSQMLEMQVELSSMKDRATELQEQLSSEKMVVAELKSELAQTKLELETTLKAQHKHLKELEAFRLEVKDKTDEVHLLNDTLASEQKKSRELQWALEKEKAKLGRSEERDKEELEDLKFSLESQKQRNLQLNLLLEQQKQLLNESQQKIESQRMLYDAQLSEEQGRNLELQVLLESEKVRIREMSSTLDRERELHAQLQSSDGTGQSRPPLPSEDLLKELQKQLEEKHSRIVELLNETEKYKLDSLQTRQQMEKDRQVHRKTLQTEQEANTEGQKKMHELQSKVEDLQRQLEEKRQQVYKLDLEGQRLQGIMQEFQKQELEREEKRESRRILYQNLNEPTTWSLTSDRTRNWVLQQKIEGETKESNYAKLIEMNGGGTGCNHELEMIRQKLQCVASKLQVLPQKASERLQFETADDEDFIWVQENIDEIILQLQKLTGQQGEEPSLVSPSTSCGSLTERLLRQNAELTGHISQLTEEKNDLRNMVMKLEEQIRWYRQTGAGRDNSSRFSLNGGANIEAIIASEKEVWNREKLTLQKSLKRAEAEVYKLKAELRNDSLLQTLSPDSEHVTLKRIYGKYLRAESFRKALIYQKKYLLLLLGGFQECEDATLALLARMGGQPAFTDLEVITNRPKGFTRFRSAVRVSIAISRMKFLVRRWHRVTGSVSININRDGFGLNQGAEKTDSFYHSSGGLELYGEPRHTTYRSRSDLDYIRSPLPFQNRYPGTPADFNPGSLACSQLQNYDPDRALTDYITRLEALQRRLGTIQSGSTTQFHAGMRR

SEQ ID NO: 809793 - protein, 388 aa, Homo sapiens
EDGGGGGGDGASRAAEDDPPVSAETASTSGGGAPDRIGSLGRGACRPTSVQIDLSFLSPTTPQPLFSPAFLAEAMEDEERQKKLEAGKAKLAQFRQRKAQSDGQSPSKKQKKKRKTSSSKHDVSAHHDLNIDQSQCNEMYINSSQRVESTVIPESTIMRTLHSGEITSHEQGFSVELESEISTTADDCSSEVNGCSFVMRTGKPTNLLREEEFGVDDSYSEQGAQDSPTHLEMMESELAGKQHEIEELNRELEEMRVTYGTEGLQQLQEFEAAIKQRDGIITQLTANLQQARREKDETMREFLELTEQSQKLQIQFQQLQASETLRNSTHSSTAADLLQAKQQILTHQQQLEEQDHLLEDYQKKKEDFTMQISFLQEKIKVYEMVCLF

SEQ ID NO: 809794 - protein, 3843 aa, Homo sapiens
MYINSSQRVESTVIPESTIMRTLHSGEITSHEQGFSVELESEISTTADDCSSEVNGCSFVMRTGKPTNLLREEEFGVDDSYSEQGAQDSPTHLEMMESELAGKQHEIEELNRELEEMRVTYGTEGLQQLQEFEAAIKQRDGIITQLTANLQQARREKDETMREFLELTEQSQKLQIQFQQLQASETLRNSTHSSTAADLLQAKQQILTHQQQLEEQDHLLEDYQKKKEDFTMQISFLQEKIKVYEMEQDKKVENSNKEEIQEKETIIEELNTKIIEEEKKTLELKDKLTTADKLLGELQEQIVQKNQEIKNMKLELTNSKQKERQSSEEIKQLMGTVEELQKRNHKDSQFETDIVQRMEQETQRKLEQLRAELDEMYGQQIVQMKQELIRQHMAQMEEIKTRHKGEMENALRSYSNITVNEDQIKLMNVAINELNIKLQDTNSQKEKLKEELGLILEEKCALQRQLEDLVEELSFSREQIQRARQTIAEQESKLNEAHKSLSTVEDLKAEIVSASESRKELELKHEAEVTNYKIKLEMLEKEKNAVLDRMAESQEAELERLRTQLLFSHEEELSKLKEDLEIEHRINIEKLKDNLGIHYKQQIDGLQNEMSQKIETMQFEKDNLITKQNQLILEISKLKDLQQSLVNSKSEEMTLQINELQKEIEILRQEEKEKGTLEQEVQELQLKTELLEKQMKEKENDLQEKFAQLEAENSILKDEKKTLEDMLKIHTPVSQEERLIFLDSIKSKSKDSVWEKEIEILIEENEDLKQQCIQLNEEIEKQRNTFSFAEKNFEVNYQELQEEYACLLKVKDDLEDSKNKQELEYKSKLKALNEELHLQRINPTTVKMKSSVFDEDKTFVAETLEMGEVVEKDTTELMEKLEVTKREKLELSQRLSDLSEQLKQKHGEISFLNEEVKSLKQEKEQVSLRCRELEIIINHNRAENVQSCDTQVSSLLDGVVTMTSRGAEGSVSKVNKSFGEESKIMVEDKVSFENMTVGEESKQEQLILDHLPSVTKESSLRATQPSENDKLQKELNVLKSEQNDLRLQMEAQRICLSLVYSTHVDQVREYMENEKDKALCSLKEELIFAQEEKIKELQKIHQLELQTMKTQETGDEGKPLHLLIGKLQKAVSEECSYFLQTLCSVLGEYYTPALKCEVNAEDKENSGDYISENEDPELQDYRYEVQDFQENMHTLLNKVTEEYNKLLVLQTRLSKIWGQQTDGMKLEFGEENLPKEETEFLSIHSQMTNLEDIDVNHKSKLSSLQDLEKTKLEEQVQELESLISSLQQQLKETEQNYEAEIHCLQKRLQAVSESTVPPSLPVDSVVITESDAQRTMYPGSCVKKNIDGTIEFSGEFGVKEETNIVKLLEKQYQEQLEEEVAKVIVSMSIAFAQQTELSRISGGKENTASSKQAHAVCQQEQHYFNEMKLSQDQIGFQTFETVDVKFKEEFKPLSKELGEHGKEILLSNSDPHDIPESKDCVLTISEEMFSKDKTFIVRQSIHDEISVSSMDASRQLMLNEEQLEDMRQELVRQYQEHQQATELLRQAHMRQMERQREDQEQLQEEIKRLNRQLAQRSSIDNENLVSERERVLLEELEALKQLSLAGREKLCCELRNSSTQTQNGNENQGEVEEQTFKEKELDRKPEDVPPEILSNERYALQKANNRLLKILLEVVKTTAAVEETIGRHVLGILDRSSKSQSSASLIWRSEAEASVKSCVHEEHTRVTDESIPSYSGSDMPRNDINMWSKVTEEGTELSQRLVRSGFAGTEIDPENEELMLNISSRLQAAVEKLLEAISETSSQLEHAKVTQTELMRESFRQKQEATESLKCQEELRERLHEESRAREQLAVELSKAEGVIDGYADEKTLFERQIQEKTDIIDRLEQELLCASNRLQELEAEQQQIQEERELLSRQKEAMKAEAGPVEQQLLQETEKLMKEKLEVQCQAEKVRDDLQKQVKALEIDVEEQVSRFIELEQEKNTELMDLRQQNQALEKQLEKMRKFLDEQAIDREHERDVFQQEIQKLEQQLKVVPRFQPISEHQTREVEQLANHLKEKTDKCSELLLSKEQLQRDIQERNEEIEKLEFRVRELEQALLVSADTFQKVEDRKHFGAVEAKPELSLEVQLQAERDAIDRKEKEITNLEEQLEQFREELENKNEEVQQLHMQLEIQKKESTTRLQELEQENKLFKDDMEKLGLAIKESDAMSTQDQHVLFGKFAQIIQEKEVEIDQLNEQVTKLQQQLKITTDNKVIEEKNELIRDLETQIECLMSDQECVKRNREEEIEQLNEVIEKLQQELANIGQKTSMNAHSLSEEADSLKHQLDVVIAEKLALEQQVETANEEMTFMKNVLKETNFKMNQLTQELFSLKRERESVEKIQSIPENSVNVAIDHLSKDKPELEVVLTEDALKSLENQTYFKSFEENGKGSIINLETRLLQLESTVSAKDLELTQCYKQIKDMQEQGQFETEMLQKKIVNLQKIVEEKVAAALVSQIQLEAVQEYAKFCQDNQTISSEPERTNIQNLNQLREDELGSDISALTLRISELESQVVEMHTSLILEKEQVEIAEKNVLEKEKKLLELQKLLEGNEKKQREKEKKRSPQDVEVLKTTTELFHSNEESGFFNELEALRAESVATKAELASYKEKAEKLQEELLVKETNMTSLQKDLSQVRDHLAEAKEKLSILEKEDETEVQESKKACMFEPLPIKLSKSIASQTDGTLKISSSNQTPQILVKNAGIQINLQSECSSEEVTEIISQFTEKIEKMQELHAAEILDMESRHISETETLKREHYVAVQLLKEECGTLKAVIQCLRSKEGSSIPELAHSDAYQTREICSSDSGSDWGQGIYLTHSQGFDIASEGRGEESESATDSFPKKIKGLLRAVHNEGMQVLSLTESPYSDGEDHSIQQVSESWLEERKAYINTISSLKDLITKMQLQREAEVYDSSQSHESFSDWRGELLLALQQVFLEERSVLLAAFRTELTALGTTDAVGLLNCLEQRIQEQGVEYQAAMECLQKADRRSLLSEIQALHAQMNGRKITLKREQESEKPSQELLEYNIQQKQSQMLEMQVELSSMKDRATELQEQLSSEKMVVAELKSELAQTKLELETTLKAQHKHLKELEAFRLEVKDKTDEVHLLNDTLASEQKKSRELQWALEKEKAKLGRSEERDKEELEDLKFSLESQKQRNLQLNLLLEQQKQLLNESQQKIESQRMLYDAQLSEEQGRNLELQVLLESEKVRIREMSSTLDRERELHAQLQSSDGTGQSRPPLPSEDLLKELQKQLEEKHSRIVELLNETEKYKLDSLQTRQQMEKDRQVHRKTLQTEQEANTEGQKKMHELQSKVEDLQRQLEEKRQQVYKLDLEGQRLQGIMQEFQKQELEREEKRESRRILYQNLNEPTTWSLTSDRTRNWVLQQKIEGETKESNYAKLIEMNGGGTGCNHELEMIRQKLQCVASKLQVLPQKASERLQFETADDEDFIWVQENIDEIILQLQKLTGQQGEEPSLVSPSTSCGSLTERLLRQNAELTGHISQLTEEKNDLRNMVMKLEEQIRWYRQTGAGRDNSSRFSLNGGANIEAIIASEKEVWNREKLTLQKSLKRAEAEVYKLKAELRNDSLLQTLSPDSEHVTLKRIYGKYLRAESFRKALIYQKKYLLLLLGGFQECEDATLALLARMGGQPAFTDLEVITNRPKGFTRFRSAVRVSIAISRMKFLVRRWHRVTGSVSININRDGFGLNQGAEKTDSFYHSSGGLELYGEPRHTTYRSRSDLDYIRSPLPFQNRYPGTPADFNPGSLACSQLQNYDPDRALTDYITRLEALQRRLGTIQSGSTTQFHAGMRR

SEQ ID NO: 809795 - protein, 3630 aa, Homo sapiens
KGPLSPIPSAQKKKEDFTMQISFLQEKIKVYEMEQDKKVENSNKEEIQEKETIIEELNTKIIEEEKKTLELKDKLTTADKLLGELQEQIVQKNQEIKNMKLELTNSKQKERQSSEEIKQLMGTVEELQKRNHKDSQFETDIVQRMEQETQRKLEQLRAELDEMYGQQIVQMKQELIRQHMAQMEEIKTRHKGEMENALRSYSNITVNEDQIKLMNVAINELNIKLQDTNSQKEKLKEELGLILEEKCALQRQLEDLVEELSFSREQIQRARQTIAEQESKLNEAHKSLSTVEDLKAEIVSASESRKELELKHEAEVTNYKIKLEMLEKEKNAVLDRMAESQEAELERLRTQLLFSHEEELSKLKEDLEIEHRINIEKLKDNLGIHYKQQIDGLQNEMSQKIETMQFEKDNLITKQNQLILEISKLKDLQQSLVNSKSEEMTLQINELQKEIEILRQEEKEKGTLEQEVQELQLKTELLEKQMKEKENDLQEKFAQLEAENSILKDEKKTLEDMLKIHTPVSQEERLIFLDSIKSKSKDSVWEKEIEILIEENEDLKQQCIQLNEEIEKQRNTFSFAEKNFEVNYQELQEEYACLLKVKDDLEDSKNKQELEYKSKLKALNEELHLQRINPTTVKMKSSVFDEDKTFVAETLEMGEVVEKDTTELMEKLEVTKREKLELSQRLSDLSEQLKQKHGEISFLNEEVKSLKQEKEQVSLRCRELEIIINHNRAENVQSCDTQVSSLLDGVVTMTSRGAEGSVSKVNKSFGEESKIMVEDKVSFENMTVGEESKQEQLILDHLPSVTKESSLRATQPSENDKLQKELNVLKSEQNDLRLQMEAQRICLSLVYSTHVDQVREYMENEKDKALCSLKEELIFAQEEKIKELQKIHQLELQTMKTQETGDEGKPLHLLIGKLQKAVSEECSYFLQTLCSVLGEYYTPALKCEVNAEDKENSGDYISENEDPELQDYRYEVQDFQENMHTLLNKVTEEYNKLLVLQTRLSKIWGQQTDGMKLEFGEENLPKEETEFLSIHSQMTNLEDIDVNHKSKLSSLQDLEKTKLEEQVQELESLISSLQQQLKETEQNYEAEIHCLQKRLQAVSESTVPPSLPVDSVVITESDAQRTMYPGSCVKKNIDGTIEFSGEFGVKEETNIVKLLEKQYQEQLEEEVAKVIVSMSIAFAQQTELSRISGGKENTASSKQAHAVCQQEQHYFNEMKLSQDQIGFQTFETVDVKFKEEFKPLSKELGEHGKEILLSNSDPHDIPESKDCVLTISEEMFSKDKTFIVRQSIHDEISVSSMDASRQLMLNEEQLEDMRQELVRQYQEHQQATELLRQAHMRQMERQREDQEQLQEEIKRLNRQLAQRSSIDNENLVSERERVLLEELEALKQLSLAGREKLCCELRNSSTQTQNGNENQGEVEEQTFKEKELDRKPEDVPPEILSNERYALQKANNRLLKILLEVVKTTAAVEETIGRHVLGILDRSSKSQSSASLIWRSEAEASVKSCVHEEHTRVTDESIPSYSGSDMPRNDINMWSKVTEEGTELSQRLVRSGFAGTEIDPENEELMLNISSRLQAAVEKLLEAISETSSQLEHAKVTQTELMRESFRQKQEATESLKCQEELRERLHEESRAREQLAVELSKAEGVIDGYADEKTLFERQIQEKTDIIDRLEQELLCASNRLQELEAEQQQIQEERELLSRQKEAMKAEAGPVEQQLLQETEKLMKEKLEVQCQAEKVRDDLQKQVKALEIDVEEQVSRFIELEQEKNTELMDLRQQNQALEKQLEKMRKFLDEQAIDREHERDVFQQEIQKLEQQLKVVPRFQPISEHQTREVEQLANHLKEKTDKCSELLLSKEQLQRDIQERNEEIEKLEFRVRELEQALLVSADTFQKVEDRKHFGAVEAKPELSLEVQLQAERDAIDRKEKEITNLEEQLEQFREELENKNEEVQQLHMQLEIQKKESTTRLQELEQENKLFKDDMEKLGLAIKESDAMSTQDQHVLFGKFAQIIQEKEVEIDQLNEQVTKLQQQLKITTDNKVIEEKNELIRDLETQIECLMSDQECVKRNREEEIEQLNEVIEKLQQELANIGQKTSMNAHSLSEEADSLKHQLDVVIAEKLALEQQVETANEEMTFMKNVLKETNFKMNQLTQELFSLKRERESVEKIQSIPENSVNVAIDHLSKDKPELEVVLTEDALKSLENQTYFKSFEENGKGSIINLETRLLQLESTVSAKDLELTQCYKQIKDMQEQGQFETEMLQKKIVNLQKIVEEKVAAALVSQIQLEAVQEYAKFCQDNQTISSEPERTNIQNLNQLREDELGSDISALTLRISELESQVVEMHTSLILEKEQVEIAEKNVLEKEKKLLELQKLLEGNEKKQREKEKKRSPQDVEVLKTTTELFHSNEESGFFNELEALRAESVATKAELASYKEKAEKLQEELLVKETNMTSLQKDLSQVRDHLAEAKEKLSILEKEDETEVQESKKACMFEPLPIKLSKSIASQTDGTLKISSSNQTPQILVKNAGIQINLQSECSSEEVTEIISQFTEKIEKMQELHAAEILDMESRHISETETLKREHYVAVQLLKEECGTLKAVIQCLRSKEGSSIPELAHSDAYQTREICSSDSGSDWGQGIYLTHSQGFDIASEGRGEESESATDSFPKKIKGLLRAVHNEGMQVLSLTESPYSDGEDHSIQQVSESWLEERKAYINTISSLKDLITKMQLQREAEVYDSSQSHESFSDWRGELLLALQQVFLEERSVLLAAFRTELTALGTTDAVGLLNCLEQRIQEQGVEYQAAMECLQKADRRSLLSEIQALHAQMNGRKITLKREQESEKPSQELLEYNIQQKQSQMLEMQVELSSMKDRATELQEQLSSEKMVVAELKSELAQTKLELETTLKAQHKHLKELEAFRLEVKDKTDEVHLLNDTLASEQKKSRELQWALEKEKAKLGRSEERDKEELEDLKFSLESQKQRNLQLNLLLEQQKQLLNESQQKIESQRMLYDAQLSEEQGRNLELQVLLESEKVRIREMSSTLDRERELHAQLQSSDGTGQSRPPLPSEDLLKELQKQLEEKHSRIVELLNETEKYKLDSLQTRQQMEKDRQVHRKTLQTEQEANTEGQKKMHELQSKVEDLQRQLEEKRQQVYKLDLEGQRLQGIMQEFQKQELEREEKRESRRILYQNLNEPTTWSLTSDRTRNWVLQQKIEGETKESNYAKLIEMNGGGTGCNHELEMIRQKLQCVASKLQVLPQKASERLQFETADDEDFIWVQENIDEIILQLQKLTGQQGEEPSLVSPSTSCGSLTERLLRQNAELTGHISQLTEEKNDLRNMVMKLEEQIRWYRQTGAGRDNSSRFSLNGGANIEAIIASEKEVWNREKLTLQKSLKRAEAEVYKLKAELRNDSLLQTLSPDSEHVTLKRIYGKYLRAESFRKALIYQKKYLLLLLGGFQECEDATLALLARMGGQPAFTDLEVITNRPKGFTRFRSAVRVSIAISRMKFLVRRWHRVTGSVSININRDGFGLNQGAEKTDSFYHSSGGLELYGEPRHTTYRSRSDLDYIRSPLPFQNRYPGTPADFNPGSLACSQLQNYDPDRALTDYITRLEALQRRLGTIQSGSTTQFHAGMRR

SEQ ID NO: 809796 - protein, 2122 aa, Homo sapiens [sequence omitted]

SEQ ID NO: 809797 - protein, 3989 aa, Homo sapiens
EDGGGGGGDGASRAAEDDPPVSAETASTSGGGAPDRIGSLGRGACRPTSVQIDLSFLSPTTPQPLFSPAFLAEAMEDEERQKKLEAGKAKLAQFRQRKAQSDGQSPSKKQKKKRKTSSSKHDVSAHHDLNIDQSQCNEMYINSSQRVESTVIPESTIMRTLHSGEITSHEQGFSVELESEISTTADDCSSEVNGCSFVMRTGKPTNLLREEEFGVDDSYSEQGAQDSPTHLEMMESELAGKQHEIEELNRELEEMRVTYGTEGLQQLQEFEAAIKQRDGIITQLTANLQQARREKDETMREFLELTEQSQKLQIQFQQLQASETLRNSTHSSTAADLLQAKQQILTHQQQLEEQDHLLEDYQKKKEDFTMQISFLQEKIKVYEMEQDKKVENSNKEEIQEKETIIEELNTKIIEEEKKTLELKDKLTTADKLLGELQEQIVQKNQEIKNMKLELTNSKQKERQSSEEIKQLMGTVEELQKRNHKDSQFETDIVQRMEQETQRKLEQLRAELDEMYGQQIVQMKQELIRQHMAQMEEIKTRHKGEMENALRSYSNITVNEDQIKLMNVAINELNIKLQDTNSQKEKLKEELGLILEEKCALQRQLEDLVEELSFSREQIQRARQTIAEQESKLNEAHKSLSTVEDLKAEIVSASESRKELELKHEAEVTNYKIKLEMLEKEKNAVLDRMAESQEAELERLRTQLLFSHEEELSKLKEDLEIEHRINIEKLKDNLGIHYKQQIDGLQNEMSQKIETMQFEKDNLITKQNQLILEISKLKDLQQSLVNSKSEEMTLQINELQKEIEILRQEEKEKGTLEQEVQELQLKTELLEKQMKEKENDLQEKFAQLEAENSILKDEKKTLEDMLKIHTPVSQEERLIFLDSIKSKSKDSVWEKEIEILIEENEDLKQQCIQLNEEIEKQRNTFSFAEKNFEVNYQELQEEYACLLKVKDDLEDSKNKQELEYKSKLKALNEELHLQRINPTTVKMKSSVFDEDKTFVAETLEMGEVVEKDTTELMEKLEVTKREKLELSQRLSDLSEQLKQKHGEISFLNEEVKSLKQEKEQVSLRCRELEIIINHNRAENVQSCDTQVSSLLDGVVTMTSRGAEGSVSKVNKSFGEESKIMVEDKVSFENMTVGEESKQEQLILDHLPSVTKESSLRATQPSENDKLQKELNVLKSEQNDLRLQMEAQRICLSLVYSTHVDQVREYMENEKDKALCSLKEELIFAQEEKIKELQKIHQLELQTMKTQETGDEGKPLHLLIGKLQKAVSEECSYFLQTLCSVLGEYYTPALKCEVNAEDKENSGDYISENEDPELQDYRYEVQDFQENMHTLLNKVTEEYNKLLVLQTRLSKIWGQQTDGMKLEFGEENLPKEETEFLSIHSQMTNLEDIDVNHKSKLSSLQDLEKTKLEEQVQELESLISSLQQQLKETEQNYEAEIHCLQKRLQAVSESTVPPSLPVDSVVITESDAQRTMYPGSCVKKNIDGTIEFSGEFGVKEETNIVKLLEKQYQEQLEEEVAKVIVSMSIAFAQQTELSRISGGKENTASSKQAHAVCQQEQHYFNEMKLSQDQIGFQTFETVDVKFKEEFKPLSKELGEHGKEILLSNSDPHDIPESKDCVLTISEEMFSKDKTFIVRQSIHDEISVSSMDASRQLMLNEEQLEDMRQELVRQYQEHQQATELLRQAHMRQMERQREDQEQLQEEIKRLNRQLAQRSSIDNENLVSERERVLLEELEALKQLSLAGREKLCCELRNSSTQTQNGNENQGEVEEQTFKEKELDRKPEDVPPEILSNERYALQKANNRLLKILLEVVKTTAAVEETIGRHVLGILDRSSKSQSSASLIWRSEAEASVKSCVHEEHTRVTDESIPSYSGSDMPRNDINMWSKVTEEGTELSQRLVRSGFAGTEIDPENEELMLNISSRLQAAVEKLLEAISETSSQLEHAKVTQTELMRESFRQKQEATESLKCQEELRERLHEESRAREQLAVELSKAEGVIDGYADEKTLFERQIQEKTDIIDRLEQELLCASNRLQELEAEQQQIQEERELLSRQKEAMKAEAGPVEQQLLQETEKLMKEKLEVQCQAEKVRDDLQKQVKALEIDVEEQVSRFIELEQEKNTELMDLRQQNQALEKQLEKMRKFLDEQAIDREHERDVFQQEIQKLEQQLKVVPRFQPISEHQTREVEQLANHLKEKTDKCSELLLSKEQLQRDIQERNEEIEKLEFRVRELEQALLVEDRKHFGAVEAKPELSLEVQLQAERDAIDRKEKEITNLEEQLEQFREELENKNEEVQQLHMQLEIQKKESTTRLQELEQENKLFKDDMEKLGLAIKESDAMSTQDQHVLFGKFAQIIQEKEVEIDQLNEQVTKLQQQLKITTDNKVIEEKNELIRDLETQIECLMSDQECVKRNREEEIEQLNEVIEKLQQELANIGQKTSMNAHSLSEEADSLKHQLDVVIAEKLALEQQVETANEEMTFMKNVLKETNFKMNQLTQELFSLKRERESVEKIQSIPENSVNVAIDHLSKDKPELEVVLTEDALKSLENQTYFKSFEENGKGSIINLETRLLQLESTVSAKDLELTQCYKQIKDMQEQGQFETEMLQKKIVNLQKIVEEKVAAALVSQIQLEAVQEYAKFCQDNQTISSEPERTNIQNLNQLREDELGSDISALTLRISELESQVVEMHTSLILEKEQVEIAEKNVLEKEKKLLELQKLLEGNEKKQREKEKKRSPQDVEVLKTTTELFHSNEESGFFNELEALRAESVATKAELASYKEKAEKLQEELLVKETNMTSLQKDLSQVRDHLAEAKEKLSILEKEDETEVQESKKACMFEPLPIKLSKSIASQTDGTLKISSSNQTPQILVKNAGIQINLQSECSSEEVTEIISQFTEKIEKMQELHAAEILDMESRHISETETLKREHYVAVQLLKEECGTLKAVIQCLRSKEGSSIPELAHSDAYQTREICSSDSGSDWGQGIYLTHSQGFDIASEGRGEESESATDSFPKKIKGLLRAVHNEGMQVLSLTESPYSDGEDHSIQQVSESWLEERKAYINTISSLKDLITKMQLQREAEVYDSSQSHESFSDWRGELLLALQQVFLEERSVLLAAFRTELTALGTTDAVGLLNCLEQRIQEQGVEYQAAMECLQKADRRSLLSEIQALHAQMNGRKITLKREQESEKPSQELLEYNIQQKQSQMLEMQVELSSMKDRATELQEQLSSEKMVVAELKSELAQTKLELETTLKAQHKHLKELEAFRLEVKDKTDEVHLLNDTLASEQKKSRELQWALEKEKAKLGRSEERDKEELEDLKFSLESQKQRNLQLNLLLEQQKQLLNESQQKIESQRMLYDAQLSEEQGRNLELQVLLESEKVRIREMSSTLDRERELHAQLQSSDGTGQSRPPLPSEDLLKELQKQLEEKHSRIVELLNETEKYKLDSLQTRQQMEKDRQVHRKTLQTEQEANTEGQKKMHELQSKVEDLQRQLEEKRQQVYKLDLEGQRLQGIMQEFQKQELEREEKRESRRILYQNLNEPTTWSLTSDRTRNWVLQQKIEGETKESNYAKLIEMNGGGTGCNHELEMIRQKLQCVASKLQVLPQKASERLQFETADDEDFIWVQENIDEIILQLQKLTGQQGEEPSLVSPSTSCGSLTERLLRQNAELTGHISQLTEEKNDLRNMVMKLEEQIRWYRQTGAGRDNSSRFSLNGGANIEAIIASEKEVWNREKLTLQKSLKRAEAEVYKLKAELRNDSLLQTLSPDSEHVTLKRIYGKYLRAESFRKALIYQKKYLLLLLGGFQECEDATLALLARMGGQPAFTDLEVITNRPKGFTRFRSAVRVSIAISRMKFLVRRWHRVTGSVSININRDGFGLNQGAEKTDSFYHSSGGLELYGEPRHTTYRSRSDLDYIRSPLPFQNRYPGTPADFNPGSLACSQLQNYDPDRALTDYITRLEALQRRLGTIQSGALSLTTSWQHHSARPTAPLSLKFFHTH

SEQ ID NO: 809798 - protein, 2652 aa, Homo sapiens
MHTLLNKVTEEYNKLLVLQTRLSKIWGQQTDGMKLEFGEENLPKEETEFLSIHSQMTNLEDIDVNHKSKLSSLQDLEKTKLEEQVQELESLISSLQQQLKETEQNYEAEIHCLQKRLQAVSESTVPPSLPVDSVVITESDAQRTMYPGSCVKKNIDGTIEFSGEFGVKEETNIVKLLEKQYQEQLEEEVAKVIVSMSIAFAQQTELSRISGGKENTASSKQAHAVCQQEQHYFNEMKLSQDQIGFQTFETVDVKFKEEFKPLSKELGEHGKEILLSNSDPHDIPESKDCVLTISEEMFSKDKTFIVRQSIHDEISVSSMDASRQLMLNEEQLEDMRQELVRQYQEHQQATELLRQAHMRQMERQREDQEQLQEEIKRLNRQLAQRSSIDNENLVSERERVLLEELEALKQLSLAGREKLCCELRNSSTQTQNGNENQGEVEEQTFKEKELDRKPEDVPPEILSNERYALQKANNRLLKILLEVVKTTAAVEETIGRHVLGILDRSSKSQSSASLIWRSEAEASVKSCVHEEHTRVTDESIPSYSGSDMPRNDINMWSKVTEEGTELSQRLVRSGFAGTEIDPENEELMLNISSRLQAAVEKLLEAISETSSQLEHAKVTQTELMRESFRQKQEATESLKCQEELRERLHEESRAREQLAVELSKAEGVIDGYADEKTLFERQIQEKTDIIDRLEQELLCASNRLQELEAEQQQIQEERELLSRQKEAMKAEAGPVEQQLLQETEKLMKEKLEVQCQAEKVRDDLQKQVKALEIDVEEQVSRFIELEQEKNTELMDLRQQNQALEKQLEKMRKFLDEQAIDREHERDVFQQEIQKLEQQLKVVPRFQPISEHQTREVEQLANHLKEKTDKCSELLLSKEQLQRDIQERNEEIEKLEFRVRELEQALLVSADTFQKVEDRKHFGAVEAKPELSLEVQLQAERDAIDRKEKEITNLEEQLEQFREELENKNEEVQQLHMQLEIQKKESTTRLQELEQENKLFKDDMEKLGLAIKESDAMSTQDQHVLFGKFAQIIQEKEVEIDQLNEQVTKLQQQLKITTDNKVIEEKNELIRDLETQIECLMSDQECVKRNREEEIEQLNEVIEKLQQELANIGQKTSMNAHSLSEEADSLKHQLDVVIAEKLALEQQVETANEEMTFMKNVLKETNFKMNQLTQELFSLKRERESVEKIQSIPENSVNVAIDHLSKDKPELEVVLTEDALKSLENQTYFKSFEENGKGSIINLETRLLQLESTVSAKDLELTQCYKQIKDMQEQGQFETEMLQKKIVNLQKIVEEKVAAALVSQIQLEAVQEYAKFCQDNQTISSEPERTNIQNLNQLREDELGSDISALTLRISELESQVVEMHTSLILEKEQVEIAEKNVLEKEKKLLELQKLLEGNEKKQREKEKKRSPQDVEVLKTTTELFHSNEESGFFNELEALRAESVATKAELASYKEKAEKLQEELLVKETNMTSLQKDLSQVRDHLAEAKEKLSILEKEDETEVQESKKACMFEPLPIKLSKSIASQTDGTLKISSSNQTPQILVKNAGIQINLQSECSSEEVTEIISQFTEKIEKMQELHAAEILDMESRHISETETLKREHYVAVQLLKEECGTLKAVIQCLRSKEGSSIPELAHSDAYQTREICSSDSGSDWGQGIYLTHSQGFDIASEGRGEESESATDSFPKKIKGLLRAVHNEGMQVLSLTESPYSDGEDHSIQQVSESWLEERKAYINTISSLKDLITKMQLQREAEVYDSSQSHESFSDWRGELLLALQQVFLEERSVLLAAFRTELTALGTTDAVGLLNCLEQRIQEQGVEYQAAMECLQKADRRSLLSEIQALHAQMNGRKITLKREQESEKPSQELLEYNIQQKQSQMLEMQVELSSMKDRATELQEQLSSEKMVVAELKSELAQTKLELETTLKAQHKHLKELEAFRLEVKDKTDEVHLLNDTLASEQKKSRELQWALEKEKAKLGRSEERDKEELEDLKFSLESQKQRNLQLNLLLEQQKQLLNESQQKIESQRMLYDAQLSEEQGRNLELQVLLESEKVRIREMSSTLDRERELHAQLQSSDGTGQSRPPLPSEDLLKELQKQLEEKHSRIVELLNETEKYKLDSLQTRQQMEKDRQVHRKTLQTEQEANTEGQKKMHELQSKVEDLQRQLEEKRQQVYKLDLEGQRLQGIMQEFQKQELEREEKRESRRILYQNLNEPTTWSLTSDRTRNWVLQQKIEGETKESNYAKLIEMNGGGTGCNHELEMIRQKLQCVASKLQVLPQKASERLQFETADDEDFIWVQENIDEIILQLQKLTGQQGEEPSLVSPSTSCGSLTERLLRQNAELTGHISQLTEEKNDLRNMVMKLEEQIRWYRQTGAGRDNSSRFSLNGGANIEAIIASEKEVWNREKLTLQKSLKRAEAEVYKLKAELRNDSLLQTLSPDSEHVTLKRIYGKYLRAESFRKALIYQKKYLLLLLGGFQECEDATLALLARMGGQPAFTDLEVITNRPKGFTRFRSAVRVSIAISRMKFLVRRWHRVTGSVSININRDGFGLNQGAEKTDSFYHSSGGLELYGEPRHTTYRSRSDLDYIRSPLPFQNRYPGTPADFNPGSLACSQLQNYDPDRALTDYITRLEALQRRLGTIQSGSTTQFHAGMRR

SEQ ID NO: 809799 - protein, 2795 aa, Homo sapiens
MEAQRICLSLVYSTHVDQVREYMENEKDKALCSLKEELIFAQEEKIKELQKIHQLELQTMKTQETGDEGKPLHLLIGKLQKAVSEECSYFLQTLCSVLGEYYTPALKCEVNAEDKENSGDYISENEDPELQDYRYEVQDFQENMHTLLNKVTEEYNKLLVLQTRLSKIWGQQTDGMKLEFGEENLPKEETEFLSIHSQMTNLEDIDVNHKSKLSSLQDLEKTKLEEQVQELESLISSLQQQLKETEQNYEAEIHCLQKRLQAVSESTVPPSLPVDSVVITESDAQRTMYPGSCVKKNIDGTIEFSGEFGVKEETNIVKLLEKQYQEQLEEEVAKVIVSMSIAFAQQTELSRISGGKENTASSKQAHAVCQQEQHYFNEMKLSQDQIGFQTFETVDVKFKEEFKPLSKELGEHGKEILLSNSDPHDIPESKDCVLTISEEMFSKDKTFIVRQSIHDEISVSSMDASRQLMLNEEQLEDMRQELVRQYQEHQQATELLRQAHMRQMERQREDQEQLQEEIKRLNRQLAQRSSIDNENLVSERERVLLEELEALKQLSLAGREKLCCELRNSSTQTQNGNENQGEVEEQTFKEKELDRKPEDVPPEILSNERYALQKANNRLLKILLEVVKTTAAVEETIGRHVLGILDRSSKSQSSASLIWRSEAEASVKSCVHEEHTRVTDESIPSYSGSDMPRNDINMWSKVTEEGTELSQRLVRSGFAGTEIDPENEELMLNISSRLQAAVEKLLEAISETSSQLEHAKVTQTELMRESFRQKQEATESLKCQEELRERLHEESRAREQLAVELSKAEGVIDGYADEKTLFERQIQEKTDIIDRLEQELLCASNRLQELEAEQQQIQEERELLSRQKEAMKAEAGPVEQQLLQETEKLMKEKLEVQCQAEKVRDDLQKQVKALEIDVEEQVSRFIELEQEKNTELMDLRQQNQALEKQLEKMRKFLDEQAIDREHERDVFQQEIQKLEQQLKVVPRFQPISEHQTREVEQLANHLKEKTDKCSELLLSKEQLQRDIQERNEEIEKLEFRVRELEQALLVSADTFQKVEDRKHFGAVEAKPELSLEVQLQAERDAIDRKEKEITNLEEQLEQFREELENKNEEVQQLHMQLEIQKKESTTRLQELEQENKLFKDDMEKLGLAIKESDAMSTQDQHVLFGKFAQIIQEKEVEIDQLNEQVTKLQQQLKITTDNKVIEEKNELIRDLETQIECLMSDQECVKRNREEEIEQLNEVIEKLQQELANIGQKTSMNAHSLSEEADSLKHQLDVVIAEKLALEQQVETANEEMTFMKNVLKETNFKMNQLTQELFSLKRERESVEKIQSIPENSVNVAIDHLSKDKPELEVVLTEDALKSLENQTYFKSFEENGKGSIINLETRLLQLESTVSAKDLELTQCYKQIKDMQEQGQFETEMLQKKIVNLQKIVEEKVAAALVSQIQLEAVQEYAKFCQDNQTISSEPERTNIQNLNQLREDELGSDISALTLRISELESQVVEMHTSLILEKEQVEIAEKNVLEKEKKLLELQKLLEGNEKKQREKEKKRSPQDVEVLKTTTELFHSNEESGFFNELEALRAESVATKAELASYKEKAEKLQEELLVKETNMTSLQKDLSQVRDHLAEAKEKLSILEKEDETEVQESKKACMFEPLPIKLSKSIASQTDGTLKISSSNQTPQILVKNAGIQINLQSECSSEEVTEIISQFTEKIEKMQELHAAEILDMESRHISETETLKREHYVAVQLLKEECGTLKAVIQCLRSKEGSSIPELAHSDAYQTREICSSDSGSDWGQGIYLTHSQGFDIASEGRGEESESATDSFPKKIKGLLRAVHNEGMQVLSLTESPYSDGEDHSIQQVSESWLEERKAYINTISSLKDLITKMQLQREAEVYDSSQSHESFSDWRGELLLALQQVFLEERSVLLAAFRTELTALGTTDAVGLLNCLEQRIQEQGVEYQAAMECLQKADRRSLLSEIQALHAQMNGRKITLKREQESEKPSQELLEYNIQQKQSQMLEMQVELSSMKDRATELQEQLSSEKMVVAELKSELAQTKLELETTLKAQHKHLKELEAFRLEVKDKTDEVHLLNDTLASEQKKSRELQWALEKEKAKLGRSEERDKEELEDLKFSLESQKQRNLQLNLLLEQQKQLLNESQQKIESQRMLYDAQLSEEQGRNLELQVLLESEKVRIREMSSTLDRERELHAQLQSSDGTGQSRPPLPSEDLLKELQKQLEEKHSRIVELLNETEKYKLDSLQTRQQMEKDRQVHRKTLQTEQEANTEGQKKMHELQSKVEDLQRQLEEKRQQVYKLDLEGQRLQGIMQEFQKQELEREEKRESRRILYQNLNEPTTWSLTSDRTRNWVLQQKIEGETKESNYAKLIEMNGGGTGCNHELEMIRQKLQCVASKLQVLPQKASERLQFETADDEDFIWVQENIDEIILQLQKLTGQQGEEPSLVSPSTSCGSLTERLLRQNAELTGHISQLTEEKNDLRNMVMKLEEQIRWYRQTGAGRDNSSRFSLNGGANIEAIIASEKEVWNREKLTLQKSLKRAEAEVYKLKAELRNDSLLQTLSPDSEHVTLKRIYGKYLRAESFRKALIYQKKYLLLLLGGFQECEDATLALLARMGGQPAFTDLEVITNRPKGFTRFRSAVRVSIAISRMKFLVRRWHRVTGSVSININRDGFGLNQGAEKTDSFYHSSGGLELYGEPRHTTYRSRSDLDYIRSPLPFQNRYPGTPADFNPGSLACSQLQNYDPDRALTDYITRLEALQRRLGTIQSGSTTQFHAGMRR

SEQ ID NO: 809800 - protein, 3981 aa, Homo sapiens; identical to SEQ ID NO: 809790

SEQ ID NO: 809801 - protein, 3247 aa, Homo sapiens
EDGGGGGGDGASRAAEDDPPVSAETASTSGGGAPDRIGSLGRGACRPTSVQIDLSFLSPTTPQPLFSPAFLAEAMEDEERQKKLEAGKAKLAQFRQRKAQSDGQSPSKKQKKKRKTSSSKHDVSAHHDLNIDQSQCNEMYINSSQRVESTVIPESTIMRTLHSGEITSHEQGFSVELESEISTTADDCSSEVNGCSFVMRTGKPTNLLREEEFGVDDSYSEQGAQDSPTHLEMMESELAGKQHEIEELNRELEEMRVTYGTEGLQQLQEFEAAIKQRDGIITQLTANLQQARREKDETMREFLELTEQSQKLQIQFQQLQASETLRNSTHSSTAADLLQAKQQILTHQQQLEEQDHLLEDYQKKKEDFTMQISFLQEKIKVYEMEQDKKVENSNKEEIQEKETIIEELNTKIIEEEKKTLELKDKLTTADKLLGELQEQIVQKNQEIKNMKLELTNSKQKERQSSEEIKQLMGTVEELQKRNHKDSQFETDIVQRMEQETQRKLEQLRAELDEMYGQQIVQMKQELIRQHMAQMEEIKTRHKGEMENALRSYSNITVNEDQIKLMNVAINELNIKLQDTNSQKEKLKEELGLILEEKCALQRQLEDLVEELSFSREQIQRARQTIAEQESKLNEAHKSLSTVEDLKAEIVSASESRKELELKHEAEVTNYKIKLEMLEKEKNAVLDRMAESQEAELERLRTQLLFSHEEELSKLKEDLEIEHRINIEKLKDNLGIHYKQQIDGLQNEMSQKIETMQFEKDNLITKQNQLILEISKLKDLQQSLVNSKSEEMTLQINELQKEIEILRQEEKEKGTLEQEVQELQLKTELLEKQMKEKENDLQEKFAQLEAENSILKDEKKTLEDMLKIHTPVSQEERLIFLDSIKSKSKDSVWEKEIEILIEENEDLKQQCIQLNEEIEKQRNTFSFAEKNFEVNYQELQEEYACLLKVKDDLEDSKNKQELEYKSKLKALNEELHLQRINPTTVKMKSSVFDEDKTFVAETLEMGEVVEKDTTELMEKLEVTKREKLELSQRLSDLSEQLKQKHGEISFLNEEVKSLKQEKEQVSLRCRELEIIINHNRAENVQSCDTQVSSLLDGVVTMTSRGAEGSVSKVNKSFGEESKIMVEDKVSFENMTVGEESKQEQLILDHLPSVTKESSLRATQPSENDKLQKELNVLKSEQNDLRLQMEAQRICLSLVYSTHVDQVREYMENEKDKALCSLKEELIFAQEEKIKELQKIHQLELQTMKTQETGDEGKPLHLLIGKLQKAVSEECSYFLQTLCSVLGEYYTPALKCEVNAEDKENSGDYISENEDPELQDYRYEVQDFQENMHTLLNKVTEEYNKLLVLQTRLSKIWGQQTDGMKLEFGEENLPKEETEFLSIHSQMTNLEDIDVNHKSKLSSLQDLEKTKLEEQVQELESLISSLQQQLKETEQNYEAEIHCLQKRLQAVSESTVPPSLPVDSVVITESDAQRTMYPGSCVKKNIDGTIEFSGEFGVKEETNIVKLLEKQYQEQLEEEVAKVIVSMSIAFAQQTELSRISGGKENTASSKQAHAVCQQEQHYFNEMKLSQDQIGFQTFETVDVKFKEEFKPLSKELGEHGKEILLSNSDPHDIPESKDCVLTISEEMFSKDKTFIVRQSIHDEISVSSMDASRQLMLNEEQLEDMRQELVRQYQEHQQATELLRQAHMRQMERQREDQEQLQEEIKRLNRQLAQRSSIDNENLVSERERVLLEELEALKQLSLAGREKLCCELRNSSTQTQNGNENQGEVEEQTFKEKELDRKPEDVPPEILSNERYALQKANNRLLKILLEVVKTTAAVEETIGRHVLGILDRSSKSQSSASLIWRSEAEASVKSCVHEEHTRVTDESIPSYSGSDMPRNDINMWSKVTEEGTELSQRLVRSGFAGTEIDPENEELMLNISSRLQAAVEKLLEAISETSSQLEHAKVTQTELMRESFRQKQEATESLKCQEELRERLHEESRAREQLAVELSKAEGVIDGYADEKTLFERQIQEKTDIIDRLEQELLCASNRLQELEAEQQQIQEERELLSRQKEAMKAEAGPVEQQLLQETEKLMKEKLEVQCQAEKVRDDLQKQVKALEIDVEEQVSRFIELEQEKNTELMDLRQQNQALEKQLEKMRKFLDEQAIDREHERDVFQQEIQKLEQQLKVVPRFQPISEHQTREVEQLANHLKEKTDKCSELLLSKEQLQRDIQERNEEIEKLEFRVRELEQALLVSADTFQKVEDRKHFGAVEAKPELSLEVQLQAERDAIDRKEKEITNLEEQLEQFREELENKNEEVQQLHMQLEIQKKESTTRLQELEQENKLFKDDMEKLGLAIKESDAMSTQDQHVLFGKFAQIIQEKEVEIDQLNEQVTKLQQQLKITTDNKVIEEKNELIRDLETQIECLMSDQECVKRNREEEIEQLNEVIEKLQQELANIGQKTSMNAHSLSEEADSLKHQLDVVIAEKLALEQQVETANEEMTFMKNVLKETNFKMNQLTQELFSLKRERESVEKIQSIPENSVNVAIDHLSKDKPELEVVLTEDALKSLENQTYFKSFEENGKGSIINLETRLLQLESTVSAKDLELTQCYKQIKDMQEQGQFETEMLQKKIVNLQKIVEEKVAAALVSQIQLEAVQEYAKFCQDNQTISSEPERTNIQNLNQLREDELGSDISALTLRISELESQVVEMHTSLILEKEQVEIAEKNVLEKEKKLLELQKLLEGNEKKQREKEKKRSPQDVEVLKTTTELFHSNEESGFFNELEALRAESVATKAELASYKEKAEKLQEELLVKETNMTSLQKDLSQVRDHLAEAKEKLSILEKEDETEVQESKKACMFEPLPIKLSKSIASQTDGTLKISSSNQTPQILVKNAGIQINLQSECSSEEVTEIISQFTEKIEKMQELHAAEILDMESRHISETETLKREHYVAVQLLKEECGTLKAVIQCLRSKEGSSIPELAHSDAYQTREICSSDSGSDWGQGIYLTHSQGFDIASEGRGEESESATDSFPKKIKGLLRAVHNEGMQVLSLTESPYSDGEDHSIQQVSESWLEERKAYINTISSLKDLITKMQLQREAEVYDSSQSHESFSDWRGELLLALQQVFLEERSVLLAAFRTELTALGTTDAVGLLNCLEQRIQEQGVEYQAAMECLQKADRRSLLSEIQALHAQMNGRKITLKREQESEKPSQGMLYDKLIWLHKQVKRFHFVFFLIIIKLKHIFLVTFSSHSHNVKDTIYINYSRG

SEQ ID NO: 809802 - protein, 3981 aa, Homo sapiens; identical to SEQ ID NO: 809790

SEQ ID NO: 809803 - protein, 803 aa, Homo sapiens; identical to SEQ ID NO: 809792

SEQ ID NO: 809804 - protein, 3923 aa, Homo sapiens
EDGGGGGGDGASRAAEDDPPVSAETASTSGGGAPDRIGSLGRGACRPTSVQIDLSFLSPTTPQPLFSPAFLAEAMEDEERQKKLEAGKAKLAQFRQRKAQSDGQSPSKKQKKKRKTSSSKHDVSAHHDLNIDQSQCNEMYINSSQRVESTVIPESTIMRTLHSGEITSHEQGFSVELESEISTTADDCSSEVNGCSFVMRTGKPTNLLREEEFGVDDSYSEQGAQDSPTHLEMMESELAGKQHEIEELNRELEEMRVTYGTEGLQQLQEFEAAIKQRDGIITQLTANLQQARREKDETMREFLELTEQSQKLQIQFQQLQASETLRNSTHSSTAADLLQAKQQILTHQQQLEEQDHLLEDYQKKKEDFTMQISFLQEKIKVYEMEQDKKVENSNKEEIQEKETIIEELNTKIIEEEKKTLELKDKLTTADKLLGELQEQIVQKNQEIKNMKLELTNSKQKERQSSEEIKQLMGTVEELQKRNHKDSQFETDIVQRMEQETQRKLEQLRAELDEMYGQQIVQMKQELIRQHMAQMEEIKTRHKGEMENALRSYSNITVNEDQIKLMNVAINELNIKLQDTNSQKEKLKEELGLILEEKCALQRQLEDLVEELSFSREQIQRARQTIAEQESKLNEAHKSLSTVEDLKAEIVSASESRKELELKHEAEVTNYKIKLEMLEKEKNAVLDRMAESQEAELERLRTQLLFSHEEELSKLKEDLEIEHRINIEKLKDNLGIHYKQQIDGLQNEMSQKIETMQFEKDNLITKQNQLILEISKLKDLQQSLVNSKSEEMTLQINELQKEIEILRQEEKEKGTLEQEVQELQLKTELLEKQMKEKENDLQEKFAQLEAENSILKDEKKTLEDMLKIHTPVSQEERLIFLDSIKSKSKDSVWEKEIEILIEENEDLKQQCIQLNEEIEKQRNTFSFAEKNFEVNYQELQEEYACLLKVKDDLEDSKNKQELEYKSKLKALNEELHLQRINPTTVKMKSSVFDEDKTFVAETLEMGEVVEKDTTELMEKLEVTKREKLELSQRLSDLSEQLKQKHGEISFLNEEVKSLKQEKEQVSLRCRELEIIINHNRAENVQSCDTQVSSLLDGVVTMTSRGAEGSVSKVNKSFGEESKIMVEDKVSFENMTVGEESKQEQLILDHLPSVTKESSLRATQPSENDKLQKELNVLKSEQNDLRLQMEAQRICLSLVYSTHVDQVREYMENEKDKALCSLKEELIFAQEEKIKELQKIHQLELQTMKTQETGDEGKPLHLLIGKLQKAVSEECSYFLQTLCSVLGEYYTPALKCEVNAEDKENSGDYISENEDPELQDYRYEVQDFQENMHTLLNKVTEEYNKLLVLQTRLSKIWGQQTDGMKLEFGEENLPKEETEFLSIHSQMTNLEDIDVNHKSKLSSLQDLEKTKLEEQVQELESLISSLQQQLKETEQNYEAEIHCLQKRLQAVSESTVPPSLPVDSVVITESDAQRTMYPGSCVKKNIDGTIEFSGEFGVKEETNIVKLLEKQYQEQLEEEVAKVIVSMSIAFAQQTELSRISGGKENTASSKQAHAVCQQEQHYFNEMKLSQDQIGFQTFETVDVKFKEEFKPLSKELGEHGKEILLSNSDPHDIPESKDCVLTISEEMFSKDKTFIVRQSIHDEISVSSMDASRQLMLNEEQLEDMRQELVRQYQEHQQATELLRQAHMRQMERQREDQEQLQEEIKRLNRQLAQRSSIDNENLVSERERVLLEELEALKQLSLAGREKLCCELRNSSTQTQNGNENQGEVEEQTFKEKELDRKPEDVPPEILSNERYALQKANNRLLKILLEVVKTTAAVEETIGRHVLGILDRSSKSQSSASLIWRSEAEASVKSCVHEEHTRVTDESIPSYSGSDMPRNDINMWSKVTEEGTELSQRLVRSGFAGTEIDPENEELMLNISSRLQAAVEKLLEAISETSSQLEHAKVTQTELMRESFRQKQEATESLKCQEELRERLHEESRAREQLAVELSKAEGVIDGYADEKTLFERQIQEKTDIIDRLEQELLCASNRLQELEAEQQQIQEERELLSRQKEAMKAEAGPVEQQLLQETEKLMKEKLEVQCQAEKVRDDLQKQVKALEIDVEEQVSRFIELEQEKNTELMDLRQQNQALEKQLEKMRKFLDEQAIDREHERDVFQQEIQKLEQQLKVVPRFQPISEHQTREVEQLANHLKEKTDKCSELLLSKEQLQRDIQERNEEIEKLEFRVRELEQALLVSADTFQKVEDRKHFGAVEAKPELSLEVQLQAERDAIDRKEKEITNLEEQLEQFREELENKNEEVQQLHMQLEIQKKESTTRLQELEQENKLFKDDMEKLGLAIKESDAMSTQDQHVLFGKFAQIIQEKEVEIDQLNEQVTKLQQQLKITTDNKVIEEKNELIRDLETQIECLMSDQECVKRNREEEIEQLNEVIEKLQQELANIGQKTSMNAHSLSEEADSLKHQLDVVIAEKLALEQQVETANEEMTFMKNVLKETNFKMNQLTQELFSLKRERESVEKIQSIPENSVNVAIDHLSKDKPELEVVLTEDALKSLENQTYFKSFEENGKGSIINLETRLLQLESTVSAKDLELTQCYKQIKDMQEQGQFETEMLQKKIVNLQKIVEEKVAAALVSQIQLEAVQEYAKFCQDNQTISSEPERTNIQNLNQLREDELGSDISALTLRISELESQVVEMHTSLILEKEQVEIAEKNVLEKEKKLLELQKLLEGNEKKQREKEKKRSPQDVEVLKTTTELFHSNEESGFFNELEALRAESVATKAELASYKEKAEKLQEELLVKETNMTSLQKDLSQVRDHLAEAKEKLSILEKEDETEVQESKKACMFEPLPIKLSKSIASQTDGTLKISSSNQTPQILVKNAGIQINLQSECSSEEVTEIISQFTEKIEKMQELHAAEILDMESRHISETETLKREHYVAVQLLKEECGTLKAVIQCLRSKEGSSIPELAHSDAYQTREICSSDSGSDWGQGIYLTHSQGFDIASEGRGEESESATDSFPKKIKGLLRAVHNEGMQVLSLTESPYSDGEDHSIQQVSESWLEERKAYINTISSLKDLITKMQLQREAEVYDSSQSHESFSDWRGELLLALQQVFLEERSVLLAAFRTELTALGTTDAVGLLNCLEQRIQEQGVEYQAAMECLQKADRRSLLSEIQALHAQMNGRKITLKREQESEKPSQELLEYNIQQKQSQMLEMQVELSSMKDRATELQEQLSSEKMVVAELKSELAQTKLELETTLKAQHKHLKELEAFRLEVKDKTDEVHLLNDTLASEQKKSRELQWALEKEKAKLGRSEERDKEELEDLKFSLESQKQRNLQLNLLLEQQKQLLNESQQKIESQRMLYDAQLSEEQGRNLELQVLLESEKVRIREMSSTLDRERELHAQLQSSDGTGQSRPPLPSEDLLKELQKQLEEKHSRIVELLNETEKYKLDSLQTRQQMEKDRQVHRKTLQTEQEANTEGQKKMHELQSKVEDLQRQLEEKRQQVYKLDLEGQRLQGIMQEFQKQELEREEKRESRRILYQNLNEPTTWSLTSDRTRNWVLQQKIEGETKESNYAKLIEMNGGGTGCNHELEMIRQKLQCVASKLQVLPQKASERLQFETADDEDFIWVQENIDEIILQLQKLTGQQGEEPSLVSPSTSCGSLTERLLRQNAELTGHISQLTEEKNDLRNMVMKLEEQIRWYRQTGAGRDNSSRFSLNGGANIEAIIASEKEVWNREKLTLQKSLKRAEAEVYKLKAELRNDSLLQTLSPDSEHVTLKRIYGKYLRAESFRKALIYQKKYLLLLLGGFQECEDATLALLARMGGQPAFTDLEVITNRPKGFTRFRSAVRVSIAISRMKFLVRRWHRVTGSVSININRDGFGLNQGAEKTDSFYHSSGGLELYGEPRHTTYRSRSDLDYIRSPLPFQNR

SEQ ID NO: 809805 - protein, 2294 aa, Homo sapiens
EDGGGGGGDGASRAAEDDPPVSAETASTSGGGAPDRIGSLGRGACRPTSVQIDLSFLSPTTPQPLFSPAFLAEAMEDEERQKKLEAGKAKLAQFRQRKAQSDGQSPSKKQKKKRKTSSSKHDVSAHHDLNIDQSQCNEMYINSSQRVESTVIPESTIMRTLHSGEITSHEQGFSVELESEISTTADDCSSEVNGCSFVMRTGKPTNLLREEEFGVDDSYSEQGAQDSPTHLEMMESELAGKQHEIEELNRELEEMRVTYGTEGLQQLQEFEAAIKQRDGIITQLTANLQQARREKDETMREFLELTEQSQKLQIQFQQLQASETLRNSTHSSTAADLLQAKQQILTHQQQLEEQDHLLEDYQKKKEDFTMQISFLQEKIKVYEMEQDKKVENSNKEEIQEKETIIEELNTKIIEEEKKTLELKDKLTTADKLLGELQEQIVQKNQEIKNMKLELTNSKQKERQSSEEIKQLMGTVEELQKRNHKDSQFETDIVQRMEQETQRKLEQLRAELDEMYGQQIVQMKQELIRQHMAQMEEIKTRHKGEMENALRSYSNITVNEDQIKLMNVAINELNIKLQDTNSQKEKLKEELGLILEEKCALQRQLEDLVEELSFSREQIQRARQTIAEQESKLNEAHKSLSTVEDLKAEIVSASESRKELELKHEAEVTNYKIKLEMLEKEKNAVLDRMAESQEAELERLRTQLLFSHEEELSKLKEDLEIEHRINIEKLKDNLGIHYKQQIDGLQNEMSQKIETMQFEKDNLITKQNQLILEISKLKDLQQSLVNSKSEEMTLQINELQKEIEILRQEEKEKGTLEQEVQELQLKTELLEKQMKEKENDLQEKFAQLEAENSILKDEKKTLEDMLKIHTPVSQEERLIFLDSIKSKSKDSVWEKEIEILIEENEDLKQQCIQLNEEIEKQRNTFSFAEKNFEVNYQELQEEYACLLKVKDDLEDSKNKQELEYKSKLKALNEELHLQRINPTTVKMKSSVFDEDKTFVAETLEMGEVVEKDTTELMEKLEVTKREKLELSQRLSDLSEQLKQKHGEISFLNEEVKSLKQEKEQVSLRCRELEIIINHNRAENVQSCDTQVSSLLDGVVTMTSRGAEGSVSKVNKSFGEESKIMVEDKVSFENMTVGEESKQEQLILDHLPSVTKESSLRATQPSENDKLQKELNVLKSEQNDLRLQMEAQRICLSLVYSTHVDQVREYMENEKDKALCSLKEELIFAQEEKIKELQKIHQLELQTMKTQETGDEGKPLHLLIGKLQKAVSEECSYFLQTLCSVLGEYYTPALKCEVNAEDKENSGDYISENEDPELQDYRYEVQDFQENMHTLLNKVTEEYNKLLVLQTRLSKIWGQQTDGMKLEFGEENLPKEETEFLSIHSQMTNLEDIDVNHKSKLSSLQDLEKTKLEEQVQELESLISSLQQQLKETEQNYEAEIHCLQKRLQAVSESTVPPSLPVDSVVITESDAQRTMYPGSCVKKNIDGTIEFSGEFGVKEETNIVKLLEKQYQEQLEEEVAKVIVSMSIAFAQQTELSRISGGKENTASSKQAHAVCQQEQHYFNEMKLSQDQIGFQTFETVDVKFKEEFKPLSKELGEHGKEILLSNSDPHDIPESKDCVLTISEEMFSKDKTFIVRQSIHDEISVSSMDASRQLMLNEEQLEDMRQELVRQYQEHQQATELLRQAHMRQMERQREDQEQLQEEIKRLNRQLAQRSSIDNENLVSERERVLLEELEALKQLSLAGREKLCCELRNSSTQTQNGNENQGEVEEQTFKEKELDRKPEDVPPEILSNERYALQKANNRLLKILLEVVKTTAAVEETIGRHVLGILDRSSKSQSSASLIWRSEAEASVKSCVHEEHTRVTDESIPSYSGSDMPRNDINMWSKVTEEGTELSQRLVRSGFAGTEIDPENEELMLNISSRLQAAVEKLLEAISETSSQLEHAKVTQTELMRESFRQKQEATESLKCQEELRERLHEESRAREQLAVELSKAEGVIDGYADEKTLFERQIQEKTDIIDRLEQELLCASNRLQELEAEQQQIQEERELLSRQKEAMKAEAGPVEQQLLQETEKLMKEKLEVQCQAEKVRDDLQKQVKALEIDVEEQVSRFIELEQEKNTELMDLRQQNQALEKQLEKMRKFLDEQAIDREHERDVFQQEIQKLEQQLKVVPRFQPISEHQTREVEQQQMIEKIDMTGREGRTKVQARIAQLSDIHAVKELNLQEYRQHPCAQDNGGCSHICLVKGDGTTRCSCPMHLVLLQDELSCGEPPTCSPQQLTCFTGEIDCILCLTKG

SEQ ID NO: 809806 - protein, 1760 aa, Homo sapiens
EDGGGGGGDGASRAAEDDPPVSAETASTSGGGAPDRIGSLGRGACRPTSVQIDLSFLSPTTPQPLFSPAFLAEAMEDEERQKKLEAGKAKLAQFRQRKAQSDGQSPSKKQKKKRKTSSSKHDVSAHHDLNIDQSQCNEMYINSSQRVESTVIPESTIMRTLHSGEITSHEQGFSVELESEISTTADDCSSEVNGCSFVMRTGKPTNLLREEEFGVDDSYSEQGAQDSPTHLEMMESELAGKQHEIEELNRELEEMRVTYGTEGLQQLQEFEAAIKQRDGIITQLTANLQQARREKDETMREFLELTEQSQKLQIQFQQLQASETLRNSTHSSTAADLLQAKQQILTHQQQLEEQDHLLEDYQKKKEDFTMQISFLQEKIKVYEMEQDKKVENSNKEEIQEKETIIEELNTKIIEEEKKTLELKDKLTTADKLLGELQEQIVQKNQEIKNMKLELTNSKQKERQSSEEIKQLMGTVEELQKRNHKDSQFETDIVQRMEQETQRKLEQLRAELDEMYGQQIVQMKQELIRQHMAQMEEIKTRHKGEMENALRSYSNITVNEDQIKLMNVAINELNIKLQDTNSQKEKLKEELGLILEEKCALQRQLEDLVEELSFSREQIQRARQTIAEQESKLNEAHKSLSTVEDLKAEIVSASESRKELELKHEAEVTNYKIKLEMLEKEKNAVLDRMAESQEAELERLRTQLLFSHEEELSKLKEDLEIEHRINIEKLKDNLGIHYKQQIDGLQNEMSQKIETMQFEKDNLITKQNQLILEISKLKDLQQSLVNSKSEEMTLQINELQKEIEILRQEEKEKGTLEQEVQELQLKTELLEKQMKEKENDLQEKFAQLEAENSILKDEKKTLEDMLKIHTPVSQEERLIFLDSIKSKSKDSVWEKEIEILIEENEDLKQQCIQLNEEIEKQRNTFSFAEKNFEVNYQELQEEYACLLKVKDDLEDSKNKQELEYKSKLKALNEELHLQRINPTTVKMKSSVFDEDKTFVAETLEMGEVVEKDTTELMEKLEVTKREKLELSQRLSDLSEQLKQKHGEISFLNEEVKSLKQEKEQVSLRCRELEIIINHNRAENVQSCDTQVSSLLDGVVTMTSRGAEGSVSKVNKSFGEESKIMVEDKVSFENMTVGEESKQEQLILDHLPSVTKESSLRATQPSENDKLQKELNVLKSEQNDLRLQMEAQRICLSLVYSTHVDQVREYMENEKDKALCSLKEELIFAQEEKIKELQKIHQLELQTMKTQETGDEGKPLHLLIGKLQKAVSEECSYFLQTLCSVLGEYYTPALKCEVNAEDKENSGDYISENEDPELQDYRYEVQDFQENMHTLLNKVTEEYNKLLVLQTRLSKIWGQQTDGMKLEFGEENLPKEETEFLSIHSQMTNLEDIDVNHKSKLSSLQDLEKTKLEEQVQELESLISSLQQQLKETEQNYEAEIHCLQKRLQAVSESTVPPSLPVDSVVITESDAQRTMYPGSCVKKNIDGTIEFSGEFGVKEETNIVKLLEKQYQEQLEEEVAKVIVSMSIAFAQQTELSRISGGKENTASSKQAHAVCQQEQHYFNEMKLSQDQIGFQTFETVDVKFKEEFKPLSKELGEHGKEILLSNSDPHDIPESKDCVLTISEEMFSKDKTFIVRQSIHDEISVSSMDASRQLMLNEEQLEDMRQELVRQYQEHQQATELLRQAHMRQMERQREDQEQLQEEIKRLNRQLAQNGNENQGEVEEQTFKEKELDRKPEDVPPEILSNERYTKCVLFQCKVN

SEQ ID NO: 809807 - protein, 385 aa, Homo sapiens
EDGGGGGGDGASRAAEDDPPVSAETASTSGGGAPDRIGSLGRGACRPTSVQIDLSFLSPTTPQPLFSPAFLAEAMEDEERQKKLEAGKAKLAQFRQRKAQSDGQSPSKKQKKKRKTSSSKHDVSAHHDLNIDQSQCNEMYINSSQRVESTVIPESTIMRTLHSGEITSHEQGFSVELESEISTTADDCSSEVNGCSFVMRTGKPTNLLREEEFGVDDSYSEQGAQDSPTHLEMMESELAGKQHEIEELNRELEEMRVTYGTEGLQQLQEFEAAIKQRDGIITQLTANLQQARREKDETMREFLELTEQSQKLQIQFQQLQASETLRNSTHSSTAADLLQAKQQILTHQQQLEEQDHLLEDYQKKKEDFTMQISFLQEKIKVYEMD

SEQ ID NO: 809808 - protein, 688 aa, Homo sapiens
MGSENSALKSYTLREPPFTLPSGLAVYPAVLQDGKFASVFVYKRENEDKVNKAAKHLKTLRHPCLLRFLSCTVEADGIHLVTERVQPLEVALETLSSAEVCAGIYDILLALIFLHDRGHLTHNNVCLSSVFVSEDGHWKLGGMETVCKVSQATPEFLRSIQSIRDPASIPPEEMSPEFTTLPECHGHARDAFSFGTLVESLLTILNEQVSADVLSSFQQTLHSTLLNPIPKCRPALCTLLSHDFFRNDFLEVVNFLKSLTLKSEEEKTEFFKFLLDRVSCLSEELIASRLVPLLLNQLVFAEPVAVKSFLPYLLGPKKDHAQGETPCLLSPALFQSRVIPVLLQLFEVHEEHVRMVLLSHIEAYVEHFTQEQLKKVILPQVLLGLRDTSDSIVAITLHSLAVLVSLLGPEVVVGGERTKIFKRTAPSFTKNTDLSLEGDPFSQPIKFPINGLSDVKNTSEDSENFPSSSKKSEEWPDWSEPEEPENQTVNIQIWPREPCDDVKSQCTTLDVEESSWDDCEPSSLDTKVNPGGGITATKPVTSGEQKPIPALLSLTEESMPWKSSLPQKISLVQRGDDADQIEPPKVSSQERPLKVPSELGLGEEFTIQVKKKPVKDPEMDWFADMIPEIKPSAAFLILPELRTEMVPKKDDVSPVMQFSSKFAAAEITEGEAEGWEEEGELNWEDNNW

SEQ ID NO: 809809 - protein, 291 aa, Homo sapiens
MHGYFQVIRPILLHFLNAILPISVVLTFNQYFMRIIIFPTGDPFSQPIKFPINGLSDVKNTSEDSENFPSSSKKSEEWPDWSEPEEPENQTVNIQIWPREPCDDVKSQCTTLDVEESSWDDCEPSSLDTKVNPGGGITATKPVTSGEQKPIPALLSLTEESMPWKSSLPQKISLVQRGDDADQIEPPKVSSQERPLKVPSELGLGEEFTIQVKKKPVKDPEMDWFADMIPEIKPSAAFLILPELRTEMVPKKDDVSPVMQFSSKFAAAEITEGEAEGWEEEGELNWEDNNW

SEQ ID NO: 809810 - protein, 88 aa, Homo sapiens
AAASVSLAVKRGRWRSMPRETPGSAGPSGTGSSFRFGHPAASTRGERGDGIGPCCAQPRFRYPSAPGAAKSADEPPARLRPTHCGRNS

SEQ ID NO: 809811 - protein, 86 aa, Homo sapiens
ASVSLAVKRGRWRSMPRETPGSAGPSGTGSSFRFGHPAASTRGERGDGIGPCCAQPRFRYPSAPGAAKSADEPPARLRPTHCGRNS

SEQ ID NO: 809812 - protein, 357 aa, Homo sapiens
MAPPPPLPLGTRKFLPDAGSPTALPPQIPLSPPRRGENLLLDPGGCRLGSPCLPERWPGSTVLPDASARSSDRGCTGRAPIWVRGRCGAMNGTANPLLDREEHCLRLGESFEKRPRASFHTIRYDFKPASIDTSCEGELQVGKGDEVTITLPHIPGSTPPMTVFKGNKRPYQKDCVLIINHDTGEYVLEKLSSSIQVKKTRAEGSSKIQARMEQQPTRPPQTSQPPPPPPPMPFRAPTKPPVGPKTSPLKDNPSPEPQLDDIKRELRAEVDIIEQMSSSSGSSSSDSESSSGSDDDSSSSGGEDNGPASPPQPSHQQPYNSRPAVANGTSRPQGSNQLMNTLRNDLQLSESGSDSDD

SEQ ID NO: 809813 - protein, 68 aa, Homo sapiens
FLFSAHFQYTLKSVCVSSGGVKLNEDTPITVAYLTVSAYISRPNGRQAISRVIPRMLGMAGLTSFKYN

SEQ ID NO: 809814 - protein, 377 aa, Homo sapiens
MAPPPPLPLGTRKFLPDAGSPTALPPQIPLSPPRRGENLLLDPGGCRLGSPCLPERWPGSTVLPDASARSSDRGCTGRAPIWVRGRCGAMNGTANPLLDREEHCLRLGESFEKRPRASFHTIRYDFKPASIDTSCEGELQVGKGDEVTITLPHIPGSTPPMTVFKGNKRPYQKDCVLIINHDTGEYVLEKLSSSIQVKKTRAEGSSKIQARMEQQPTRPPQTSQPPPPPPPMPFRAPTKPPVGPKTSPLKDNPSPEPQLDDIKRELRAEVDIIEQMSSSSGSSSSDSESSSGSDDDSSSSGGEDNGPASPPQPSHQQPYNSRPAVANGTSRPQGSNQLMNTLNVTSAMIVRLPQPRGTKPQCDGGSSMKTTSPQASQ

SEQ ID NO: 809815 - protein, 167 aa, Homo sapiens
MKSQLHCHISLAEGSSKIQARMEQQPTRPPQTSQPPPPPPPMPFRAPTKPPVGPKTSPLKDNPSPEPQLDDIKRELRAEVDIIEQMSSSSGSSSSDSESSSGSDDDSSSSGGEDNGPASPPQPSHQQPYNSRPAVANGTSRPQGSNQLMNTLRNDLQLSESGSDSDD

SEQ ID NO: 809816 - protein, 163 aa, Homo sapiens [sequence omitted]

SEQ ID NO: 809817 - protein, 151 aa, Homo sapiens
AAAIGTDFWYIIDTERLERTGPGAQDLLGSINRSQPEPLSSHSGLWRTCRVQSPCTPLMNPFRLENVTVSESSRQLLKIASCCVAQAGLKFLASSDPLASASQSAGITGCTRSTAASASGEPSGNLQSWRKVKARTLILIAIQNKYWLYQN

SEQ ID NO: 809818 - protein, 120 aa, Homo sapiens
AAAIGTDFWYIIDTERLERTGPGAQDLLGSINRSQPEPLSSHSGLWRTCRVQSPCTPLMNPFRLENVTVSESSRQLLSCTRSTAASASGEPSGNLQSWRKVKARTLILIAIQNKYWLYQN

SEQ ID NO: 809819 - protein, 124 aa, Homo sapiens
MRQAGRAALLAALLLLVQLCPGSSQRSPEAAGVQDPSLRWSPGARNQGGGARALLLLLAERFPRRAGPGRLGLGTAGERPRRDNPSLSIDLTFHLLRTLLELARTQSQRERAEQNRIIFDSVGK

SEQ ID NO: 809820 - protein, 124 aa, Homo sapiens; identical to SEQ ID NO: 809819

SEQ ID NO: 809821 - protein, 227 aa, Homo sapiens
AKNGGGSSSRSSPVSGPPAVCETLAVASASPMAAAAEGPQQSAEGSASGGGMQAAAPPSSQPHPQQLQEQEEMQEEMEKLREENETLKNEIDELRTEMDEMRDTFFEEDACQLQEMRHELERANKNCRILQYRLRKAERKRLRYAQTGEIDGELLRSLEQDLKVAKDVSVRLHHELENVEEKRTTTEDENEKLRQQLIEVEIAKQALQNELEKMKELSLKRKGSKDL

SEQ ID NO: 809822 - protein, 164 aa, Homo sapiens
MGCVRCVSEGLEASLILTRGLSPPQNEIDELRTEMDEMRDTFFEEDACQLQEMRHELERANKNCRILQYRLRKAERKRLRYAQTGEIDGELLRSLEQDLKVAKDVSVRLHHELENVEEKRTTTEDENEKLRQQLIEVEIAKQALQNELEKMKELSLKRKGSKDL

SEQ ID NO: 809823 - protein, 502 aa, Homo sapiens
AGFPSAASRRVPGDCRRLHRPVACRYCEIYREDAGTPKSWEMGLLAFRDVALEFSPEEWECLDPAQRSLYRDVMLENYRNLISLGEDSFNMQFLFHSLAMSKPELIICLEARKEPWNVNTEKTAKHSALSSYLTEDILPEQGLQVSFQKVMLRRYERCCLEKLRLRNDWEIVGEWKGQKASYNGLDLCSATTHSKNFQCNKCVKGFSKFANLNKCKISHTGEKPFKCKECGNVSCMSLIMTQQQRIHIGENPYQCKKCGKAFNECSCFTDCKRIHVGEKHCKCEECNNIFKSCSSLAVVEKNHTEKKTYRCEECGKAFNLCSVLTKHKKIHTGEKPYKCEECGKSFKLFPYLTQHKRIHSREKPYKCEECGKVFKLLSYLTQHRRIHTGEKTFRCEECGKAFNQSSHLTEHRRIHTGEKPYKCEECGKAFTWFSYLIQHKRIHTGQKPYKCEECGKAFTWFSYLTQHKRIHTGEKPYKCDECGKAFNWFSYLTNHKRIHTGE

SEQ ID NO: 809824 - protein, 180 aa, Homo sapiens
VRLRCSFPLSLGGPSGPAAASVALGPAGPGRSLGRTPDTGDWEMGLLAFRDVALEFSPEEWECLDPAQRSLYRDVMLENYRNLISLGLAMSKPELIICLEARKEPWNVNTEKTAKHSALSSYLTEDILPEQGLQVSFQKVMLRRYERCCLEKLRLRNDWEIVVETGFHRVSQDGLDLLTS

SEQ ID NO: 809825 - protein, 174 aa, Homo sapiens
AGFPSAASRRVPGDCRRLHRPVACRYCEIYREDAGTPKSWEMGLLAFRDVALEFSPEEWECLDPAQRSLYRDVMLENYRNLISLGEDSFNMQFLFHSLAMSKPELIICLEARKEPWNVNTEKTAKHSALSSYLTEDILPEQGLQVSFQKVMLRRYERCCLEKLRLRNDWEIVAM

SEQ ID NO: 809826 - protein, 162 aa, Homo sapiens
AGFPSAASRRVPGDCRRLHRPVACRYCEIYREDAGTPKSWEMGLLAFRDVALEFSPEEWECLDPAQRSLYRDVMLENYRNLISLGLAMSKPELIICLEARKEPWNVNTEKTAKHSALSSYLTEDILPEQGLQVSFQKVMLRRYERCCLEKLRLRNDWEIVAM

SEQ ID NO: 809827 - protein, 129 aa, Homo sapiens
AGFPSAASRRVPGDCRRLHRPVACRYCEIYREDAGTPKSWEMGLLAFRDVALEFSPEEWECLDPAQRSLYRDVMLENYRNLISLGEDSFNMQFLFHSLAMSKPELIICLEARKEPWNVNTEKTAKHSAM

SEQ ID NO: 809828 - protein, 162 aa, Homo sapiens
VRLRCSFPLSLGGPSGPAAASVALGPAGPGRSLGRTPDTGDWEMGLLAFRDVALEFSPEEWECLDPAQRSLYRDVMLENYRNLISLGEDSFNMQFLFHSLAMSKPELIICLEARKEPWNVNTEKTAKHSESQLCHPGWNAMVRSRLTANCVPGSGHSPASAS

SEQ ID NO: 809829 - protein, 164 aa, Homo sapiens
VRLRCSFPLSLGGPSGPAAASVALGPAGPGRSLGRTPDTGDWEMGLLAFRDVALEFSPEEWECLDPAQRSLYRDVMLENYRNLISLGLAMSKPELIICLEARKEPWNVNTEKTAKHSALSSYLTEDILPEQGLQVSFQKVMLRRYERCCLEKLRLRNDWEIVAM

SEQ ID NO: 809830 - protein, 109 aa, Homo sapiens
PYKCEECGKAFTWFSYLTQHKRIHTGEKPYKCDECGKAFNWFSYLTNHKRIHTGEKPYKCEECGKAFGQSSHLSKHKTIHTREKPYKCEECGKAFNHSAQLAVHEKTHT

SEQ ID NO: 809831 - protein, 114 aa, Homo sapiens
STLPFPDKVPHSLYNSGQNATSPVKPLLISTEELWGHVLPSPPQTTPACSTVTRWLSACLSASIWLSVLSSHQEQESNLTSLSIPSSQESVWTMMIGVCICWIKQKSNSFIPVI

SEQ ID NO: 809832 - protein, 50 aa, Homo sapiens
MSQRPPSMYWCVGPEESAVCPERAMETLNGAGDTGGKPSTRGGDPAARSR

SEQ ID NO: 809833 - protein, 104 aa, Homo sapiens
AAAEGTPRDGSWESWRRPCSARSSRRPPRPPASGLRKCVWARPRRGGQTAVGRPGPGPASVSARPRVPERPHPAPPPPQSKKAFCSAMATSPRLNAPHSQRQWQ

SEQ ID NO: 809834 - protein, 189 aa, Homo sapiens
MALLSRPALTLLLLLMAAVVRCQEQAQTTDWRATLKTIRNGVHKIDTYLNAALDLLGGEDGLCQYKCSDGSKPFPRYGYKPSPPNGCGSPLFGVHLNIGIPSLTKCCNQHDRCYETCGKSKNDCDEEFQYCLSKICRDVQKTLGLTQHVQACETTVELLFDSVIHLGCKPYLDSQRAACRCHYEEKTDL

SEQ ID NO: 809835 - protein, 189 aa, Homo sapiens; identical to SEQ ID NO: 809834

SEQ ID NO: 809836 - protein, 189 aa, Homo sapiens; identical to SEQ ID NO: 809834

SEQ ID NO: 809837 - protein, 189 aa, Homo sapiens; identical to SEQ ID NO: 809834

SEQ ID NO: 809838 - protein, 222 aa, Homo sapiens
QLGGPSRPRQRWGISGSSFLTSSLFSTSLNSRLIRCTAMLAMSPPAADSYPPPPPPLQTTATAATSSSTASSLGDSDLSTRTLPLPPRPPRSPQCGITSAPGHQNGAGSAHAHDVDPAGRRSRSCWSPHTPEPRARVSAGAAAAWLRPAGVWGREGAASKLAGPSRPPRPFPAPPLLFKPGCCGLGFQRWPLTEGSGATERVSDAALGWNAALTQLDPEPGG

SEQ ID NO: 809839 - protein, 1066 aa, Homo sapiens
MPVFHTRTIESILEPVAQQISHLVIMHEEGEVDGKAIPDLTAPVAAVQAAVSNLVRVGKETVQTTEDQILKRDMPPAFIKVENACTKLVQAAQMLQSDPYSVPARDYLIDGSRGILSGTSDLLLTFDEAEVRKIIRVCKGILEYLTVAEVVETMEDLVTYTKNLGPGMTKMAKMIDERQQELTHQEHRVMLVNSMNTVKELLPVLISAMKIFVTTKNSKNQGIEEALKNRNFTVEKMSAEINEIIRVLQLTSWDEDAWASKDTEAMKRALASIDSKLNQAKGWLRDPSASPGDAGEQAIRQILDEAGKVGELCAGKERREILGTCKMLGQMTDQVADLRARGQGSSPVAMQKAQQVSQGLDVLTAKVENAARKLEAMTNSKQSIAKKIDAAQNWLADPNGGPEGEEQIRGALAEARKIAELCDDPKERDDILRSLGEISALTSKLADLRRQGKGDSPEARALAKQVATALQNLQTKTNRAVANSRPAKAAVHLEGKIEQAQRWIDNPTVDDRGVGQAAIRGLVAEGHRLANVMMGPYRQDLLAKCDRVDQLTAQLADLAARGEGESPQARALASQLQDSLKDLKARMQEAMTQEVSDVFSDTTTPIKLLAVAATAPPDAPNREEVFDERAANFENHSGKLGATAEKAAAVGTANKSTVEGIQASVKTARELTPQVVSAARILLRNPGNQAAYEHFETMKNQWIDNVEKMTGLVDEAIDTKSLLDASEEAIKKDLDKCKVAMANIQPQMLVAGATSIARRANRILLVAKREVENSEDPKFREAVKAASDELSKTISPMVMDAKAVAGNISDPGLQKSFLDSGYRILGAVAKVREAFQPQEPDFPPPPPDLEQLRLTDELAPPKPPLPEGEVPPPRPPPPEEKDEEFPEQKAGEVINQPMMMAARQLHDEARKWSSKGNDIIAAAKRMALLMAEMSRLVRGGSGTKRALIQCAKDIAKASDEVTRLAKEVAKQCTDKRIRTNLLQVCERIPTISTQLKILSTVKATMLGRTNISDEESEQATEMLVHNAQNLMQSVKETVREAEAASIKIRTDAGFTLRWVRKTPWYQ

SEQ ID NO: 809840 - protein, 1134 aa, Homo sapiens
MPVFHTRTIESILEPVAQQISHLVIMHEEGEVDGKAIPDLTAPVAAVQAAVSNLVRVGKETVQTTEDQILKRDMPPAFIKVENACTKLVQAAQMLQSDPYSVPARDYLIDGSRGILSGTSDLLLTFDEAEVRKIIRVCKGILEYLTVAEVVETMEDLVTYTKNLGPGMTKMAKMIDERQQELTHQEHRVMLVNSMNTVKELLPVLISAMKIFVTTKNSKNQGIEEALKNRNFTVEKMSAEINEIIRVLQLTSWDEDAWASKDTEAMKRALASIDSKLNQAKGWLRDPSASPGDAGEQAIRQILDEAGKVGELCAGKERREILGTCKMLGQMTDQVADLRARGQGSSPVAMQKAQQVSQGLDVLTAKVENAARKLEAMTNSKQSIAKKIDAAQNWLADPNGGPEGEEQIRGALAEARKIAELCDDPKERDDILRSLGEISALTSKLADLRRQGKGDSPEARALAKQVATALQNLQTKTNRAVANSRPAKAAVHLEGKIEQAQRWIDNPTVDDRGVGQAAIRGLVAEGHRLANVMMGPYRQDLLAKCDRVDQLTAQLADLAARGEGESPQARALASQLQDSLKDLKARMQEAMTQEVSDVFSDTTTPIKLLAVAATAPPDAPNREEVFDERAANFENHSGKLGATAEKAAAVGTANKSTVEGIQASVKTARELTPQVVSAARILLRNPGNQAAYEHFETMKNQWIDNVEKMTGLVDEAIDTKSLLDASEEAIKKDLDKCKVAMANIQPQMLVAGATSIARRANRILLVAKREVENSEDPKFREAVKAASDELSKTISPMVMDAKAVAGNISDPGLQKSFLDSGYRILGAVAKVREAFQPQEPDFPPPPPDLEQLRLTDELAPPKPPLPEGEVPPPRPPPPEEKDEEFPEQKAGEVINQPMMMAARQLHDEARKWSSKPGIPAAEVGIGVVAEADAADAAGFPVPPDMEDDYEPELLLMPSNQPVNQPILAAAQSLHREATKWSSKGNDIIAAAKRMALLMAEMSRLVRGGSGTKRALIQCAKDIAKASDEVTRLAKEVAKQCTDKRIRTNLLQVCERIPTISTQLKILSTVKATMLGRTNISDEESEQATEMLVHNAQNLMQSVKETVREAEAASIKIRTDAGFTLRWVRKTPWYQ

SEQ ID NO: 809841 - protein, 79 aa, Homo sapiens
HASRTAWVTQRRTCRCLFICNSKRSFLNSVLRKRSACPLRVFNGKAALSEGHFLPKGEWYLQTRILVLLKMNQWEILLL

SEQ ID NO: 809842 - protein, 103 aa, Homo sapiens
MPVFHTRTIESILEPVAQQISHLVIMHEEGEVDGKAIPDLTAPVAAVQAAVSNLVRVGKETVQTTEDQILKRDMPPAFIKHSGLSEDGPRTHTPGGLGCSYLT

SEQ ID NO: 809843 - protein, 123 aa, Homo sapiens
TVLSPLSSSQPFPTYSFMILKCPLSLIPDFPPPPPDLEQLRLTDELAPPKPPLPEGEVPPPRPPPPEEKDEEFPEQKAGEVINQPMMMAARQLHDEARKWSSKVSSEAFLVEKGCLLGKDEGP

SEQ ID NO: 809844 - protein, 1037 aa, Homo sapiens
ATIFAMLCFELVMASSLRAAFSTFAVSNPDPEIPAELSAWPPVRILVLWHGGQPLDQSSALHFASSQNLPYSVPARDYLIDGSRGILSGTSDLLLTFDEAEVRKIIRVCKGILEYLTVAEVVETMEDLVTYTKNLGPGMTKMAKMIDERQQELTHQEHRVMLVNSMNTVKELLPVLISAMKIFVTTKNSKNQGIEEALKNRNFTVEKMSAEINEIIRVLQLTSWDEDAWASKDTEAMKRALASIDSKLNQAKGWLRDPSASPGDAGEQAIRQILDEAGKVGELCAGKERREILGTCKMLGQMTDQVADLRARGQGSSPVAMQKAQQVSQGLDVLTAKVENAARKLEAMTNSKQSIAKKIDAAQNWLADPNGGPEGEEQIRGALAEARKIAELCDDPKERDDILRSLGEISALTSKLADLRRQGKGDSPEARALAKQVATALQNLQTKTNRAVANSRPAKAAVHLEGKIEQAQRWIDNPTVDDRGVGQAAIRGLVAEGHRLANVMMGPYRQDLLAKCDRVDQLTAQLADLAARGEGESPQARALASQLQDSLKDLKARMQEAMTQEVSDVFSDTTTPIKLLAVAATAPPDAPNREEVFDERAANFENHSGKLGATAEKAAAVGTANKSTVEGIQASVKTARELTPQVVSAARILLRNPGNQAAYEHFETMKNQWIDNVEKMTGLVDEAIDTKSLLDASEEAIKKDLDKCKVAMANIQPQMLVAGATSIARRANRILLVAKREVENSEDPKFREAVKAASDELSKTISPMVMDAKAVAGNISDPGLQKSFLDSGYRILGAVAKVREAFQPQEPDFPPPPPDLEQLRLTDELAPPKPPLPEGEVPPPRPPPPEEKDEEFPEQKAGEVINQPMMMAARQLHDEARKWSSKGNDIIAAAKRMALLMAEMSRLVRGGSGTKRALIQCAKDIAKASDEVTRLAKEVAKQCTDKRIRTNLLQVCERIPTISTQLKILSTVKATMLGRTNISDEESEQATEMLVHNAQNLMQSVKETVREAEAASIKIRTDAGFTLRWVRKTPWYQ

SEQ ID NO: 809845 - protein, 717 aa, Homo sapiens
MQKAQQVSQGLDVLTAKVENAARKLEAMTNSKQSIAKKIDAAQNWLADPNGGPEGEEQIRGALAEARKIAELCDDPKERDDILRSLGEISALTSKLADLRRQGKGDSPEARALAKQVATALQNLQTKTNRAVANSRPAKAAVHLEGKIEQAQRWIDNPTVDDRGVGQAAIRGLVAEGHRLANVMMGPYRQDLLAKCDRVDQLTAQLADLAARGEGESPQARALASQLQDSLKDLKARMQEAMTQEVSDVFSDTTTPIKLLAVAATAPPDAPNREEVFDERAANFENHSGKLGATAEKAAAVGTANKSTVEGIQASVKTARELTPQVVSAARILLRNPGNQAAYEHFETMKNQWIDNVEKMTGLVDEAIDTKSLLDASEEAIKKDLDKCKVAMANIQPQMLVAGATSIARRANRILLVAKREVENSEDPKFREAVKAASDELSKTISPMVMDAKAVAGNISDPGLQKSFLDSGYRILGAVAKVREAFQPQEPDFPPPPPDLEQLRLTDELAPPKPPLPEGEVPPPRPPPPEEKDEEFPEQKAGEVINQPMMMAARQLHDEARKWSSKGNDIIAAAKRMALLMAEMSRLVRGGSGTKRALIQCAKDIAKASDEVTRLAKEVAKQCTDKRIRTNLLQVCERIPTISTQLKILSTVKATMLGRTNISDEESEQATEMLVHNAQNLMQSVKETVREAEAASIKIRTDAGFTLRWVRKTPWYQ

SEQ ID NO: 809846 - protein, 419 aa, Homo sapiens
IQASVEGRPENSHPRWSRAASVFFEPFKGGKNPPPFGAKIQQAAYEHFETMKNQWIDNVEKMTGLVDEAIDTKSLLDASEEAIKKDLDKCKVAMANIQPQMLVAGATSIARRANRILLVAKREVENSEDPKFREAVKAASDELSKTISPMVMDAKAVAGNISDPGLQKSFLDSGYRILGAVAKVREAFQPQEPDFPPPPPDLEQLRLTDELAPPKPPLPEGEVPPPRPPPPEEKDEEFPEQKAGEVINQPMMMAARQLHDEARKWSSKGNDIIAAAKRMALLMAEMSRLVRGGSGTKRALIQCAKDIAKASDEVTRLAKEVAKQCTDKRIRTNLLQVCERIPTISTQLKILSTVKATMLGRTNISDEESEQATEMLVHNAQNLMQSVKETVREAEAASIKIRTDAGFTLRWVRKTPWYQ

SEQ ID NO: 809847 - protein, 401 aa, Homo sapiens
MEEEFELKKRILDVILSHEKFEWITVFWSFCSSKLKLNSISVFLTGLVDEAIDTKSLLDASEEAIKKDLDKCKVAMANIQPQMLVAGATSIARRANRILLVAKREVENSEDPKFREAVKAASDELSKTISPMVMDAKAVAGNISDPGLQKSFLDSGYRILGAVAKVREAFQPQEPDFPPPPPDLEQLRLTDELAPPKPPLPEGEVPPPRPPPPEEKDEEFPEQKAGEVINQPMMMAARQLHDEARKWSSKGNDIIAAAKRMALLMAEMSRLVRGGSGTKRALIQCAKDIAKASDEVTRLAKEVAKQCTDKRIRTNLLQVCERIPTISTQLKILSTVKATMLGRTNISDEESEQATEMLVHNAQNLMQSVKETVREAEAASIKIRTDAGFTLRWVRKTPWYQ

SEQ ID NO: 809848 - protein, 1066 aa, Homo sapiens; identical to SEQ ID NO: 809839

SEQ ID NO: 809849 - protein, 1066 aa, Homo sapiens; identical to SEQ ID NO: 809839

SEQ ID NO: 809850 - protein, 141 aa, Homo sapiens
MALLMAEMSRLVRGGSGTKRALIQCAKDIAKASDEVTRLAKEVAKQCTDKRIRTNLLQVCERIPTISTQLKILSTVKATMLGRTNISDEESEQATEMLVHNAQNLMQSVKETVREAEAASIKIRTDAGFTLRWVRKTPWYQ

SEQ ID NO: 809851 - protein, 97 aa, Homo sapiens
LRFPWLADQGTVLQVCERIPTISTQLKILSTVKATMLGRTNISDEESEQATEMLVHNAQNLMQSVKETVREAEAASIKIRTDAGFTLRWVRKTPWYQ

SEQ ID NO: 809852 - protein, 918 aa, Homo sapiens
MPVFHTRTIESILEPVAQQISHLVIMHEEGEVDGKAIPDLTAPVAAVQAAVSNLVRVGKETVQTTEDQILKRDMPPAFIKVENACTKLVQAAQMLQSDPYSVPARDYLIDGSRGILSGTSDLLLTFDEAEVRKIIRVCKGILEYLTVAEVVETMEDLVTYTKNLGPGMTKMAKMIDERQQELTHQEHRVMLVNSMNTVKELLPVLISAMKIFVTTKNSKNQGIEEALKNRNFTVEKMSAEINEIIRVLQLTSWDEDAWASKDTEAMKRALASIDSKLNQAKGWLRDPSASPGDAGEQAIRQILDEAGKVGELCAGKERREILGTCKMLGQMTDQVADLRARGQGSSPVAMQKAQQVSQGLDVLTAKVENAARKLEAMTNSKQSIAKKIDAAQNWLADPNGGPEGEEQIRGALAEARKIAELCDDPKERDDILRSLGEISALTSKLADLRRQGKGDSPEARALAKQVATALQNLQTKTNRAVANSRPAKAAVHLEGKIEQAQRWIDNPTVDDRGVGQAAIRGLVAEGHRLANVMMGPYRQDLLAKCDRVDQLTAQLADLAARGEGESPQARALASQLQDSLKDLKARMQEAMTQEVSDVFSDTTTPIKLLAVAATAPPDAPNREEVFDERAANFENHSGKLGATAEKAAAVGTANKSTVEGIQASVKTARELTPQVVSAARILLRNPGNQAAYEHFETMKNQWIDNVEKMTGLVDEAIDTKSLLDASEEAIKKDLDKCKVAMANIQPQMLVAGATSIARRANRILLVAKREVENSEDPKFREAVKAASDELSKTISPMVMDAKAVAGNISDPGLQKSFLDSGYRILGAVAKVREAFQPQEPDFPPPPPDLEQLRLTDELAPPKPPLPEGEVPPPRPPPPEEKDEEFPEQKAGEVINQPMMLLPTIPSFPGLCYLGPFQK

SEQ ID NO: 809853 - protein, 1066 aa, Homo sapiens; identical to SEQ ID NO: 809839

SEQ ID NO: 809854 - protein, 1066 aa, Homo sapiens; identical to SEQ ID NO: 809839

SEQ ID NO: 809855 - protein, 1066 aa, Homo sapiens; identical to SEQ ID NO: 809839

SEQ ID NO: 809856 - protein, 1019 aa, Homo sapiens
MPVFHTRTIESILEPVAQQISHLVIMHEEGEVDGKAIPDLTAPVAAVQAAVSNLVRVGKETVQTTEDQILKRDMPPAFIKVENACTKLVQAAQMLQSDPYSVPARDYLIDGSRGILSGTSDLLLTFDEAEVRKIIRVCKGILEYLTVAEVVETMEDLVTYTKNLGPGMTKMAKMIDERQQELTHQEHRVMLVNSMNTVKELLPVLISAMKIFVTTKNSKNQGIEEALKNRNFTVEKMSAEINEIIRVLQLTSWDEDAWASKDTEAMKRALASIDSKLNQAKGWLRDPSASPGDAGEQAIRQILDEAGKVGELCAGKERREILGTCKMLGQMTDQVADLRARGQGSSPVAMQKAQQVSQGLDVLTAKVENAARKLEAMTNSKQSIAKKIDAAQNWLADPNGGPEGEEQIRGALAEARKIAELCDDPKERDDILRSLGEISALTSKLADLRRQGKGDSPEARALAKQVATALQNLQTKTNRAVANSRPAKAAVHLEGKIEQAQRWIDNPTVDDRGVGQAAIRGLVAEGHRLANVMMGPYRQDLLAKCDRVDQLTAQLADLAARGEGESPQARALASQLQDSLKDLKARMQEAMTQEVSDVFSDTTTPIKLLAVAATAPPDAPNREEVFDERAANFENHSGKLGATAEKAAAVGTANKSTVEGIQASVKTARELTPQVVSAARILLRNPGNQAAYEHFETMKNQWIDNVEKMTGLVDEAIDTKSLLDASEEAIKKDLDKCKVAMANIQPQMLVAGATSIARRANRILLVAKREVENSEDPKFREAVKAASDELSKTISPMVMDAKAVAGNISDPGLQKSFLDSGYRILGAVAKVREAFQPQEPDFPPPPPDLEQLRLTDELAPPKPPLPEGEVPPPRPPPPEEKDEEFPEQKAGEVINQPMMMAARQLHDEARKWSSKGNDIIAAAKRMALLMAEMSRLVRGGSGTKRALIQCAKDIAKASDEVTRLAKEVAKQCTDKRIRTNLLQVLGERGCVCVCVCVCACVCVCVGGEGMRGRKAGEKN

SEQ ID NO: 809857 - protein, 935 aa, Homo sapiens
MPVFHTRTIESILEPVAQQISHLVIMHEEGEVDGKAIPDLTAPVAAVQAAVSNLVRVGKETVQTTEDQILKRDMPPAFIKVENACTKLVQAAQMLQSDPYSVPARDYLIDGSRGILSGTSDLLLTFDEAEVRKIIRVCKGILEYLTVAEVVETMEDLVTYTKNLGPGMTKMAKMIDERQQELTHQEHRVMLVNSMNTVKELLPVLISAMKIFVTTKNSKNQGIEEALKNRNFTVEKMSAEINEIIRVLQLTSWDEDAWASKDTEAMKRALASIDSKLNQAKGWLRDPSASPGDAGEQAIRQILDEAGKVGELCAGKERREILGTCKMLGQMTDQVADLRARGQGSSPVAMQKAQQVSQGLDVLTAKVENAARKLEAMTNSKQSIAKKIDAAQNWLADPNGGPEGEEQIRGALAEARKIAELCDDPKERDDILRSLGEISALTSKLADLRRQGKGDSPEARALAKQVATALQNLQTKTNRAVANSRPAKAAVHLEGKIEQAQRWIDNPTVDDRGVGQAAIRGLVAEGHRLANVMMGPYRQDLLAKCDRVDQLTAQLADLAARGEGESPQARALASQLQDSLKDLKARMQEAMTQEVSDVFSDTTTPIKLLAVAATAPPDAPNREEVFDERAANFENHSGKLGATAEKAAAVGTANKSTVEGIQASVKTARELTPQVVSAARILLRNPGNQAAYEHFETMKNQWIDNVEKMTGLVDEAIDTKSLLDASEEAIKKDLDKCKVAMANIQPQMLVAGATSIARRANRILLVAKREVENSEDPKFREAVKAASDELSKTISPMVMDAKAVAGNISDPGLQKSFLDSGYRILGAVAKVREAFQPQEPDFPPPPPDLEQLRLTDELAPPKPPLPEGEVPPPRPPPPEEKDEEFPEQKAGEVINQPMMMAARQLHDEARKWSSKVSSEAFLVEKGCLLGKDEGP

SEQ ID NO: 809858 - protein, 627 aa, Homo sapiens
MPVFHTRTIESILEPVAQQISHLVIMHEEGEVDGKAIPDLTAPVAAVQAAVSNLVRVGKETVQTTEDQILKRDMPPAFIKVENACTKLVQAAQMLQSDPYSVPARDYLIDGSRGILSGTSDLLLTFDEAEVRKIIRVCKGILEYLTVAEVVETMEDLVTYTKNLGPGMTKMAKMIDERQQELTHQEHRVMLVNSMNTVKELLPVLISAMKIFVTTKNSKNQGIEEALKNRNFTVEKMSAEINEIIRVLQLTSWDEDAWASKDTEAMKRALASIDSKLNQAKGWLRDPSASPGDAGEQAIRQILDEAGKVGELCAGKERREILGTCKMLGQMTDQVADLRARGQGSSPVAMQKAQQVSQGLDVLTAKVENAARKLEAMTNSKQSIAKKIDAAQNWLADPNGGPEGEEQIRGALAEARKIAELCDDPKERDDILRSLGEISALTSKLADLRRQGKGDSPEARALAKQVATALQNLQTKTNRAVANSRPAKAAVHLEGKIEQAQRWIDNPTVDDRGVGQAAIRGLVAEGHRLANVMMGPYRQDLLAKCDRVDQLTAQLADLAARGEGESPQARALASQLQDSLKDLKARMQEAMTQEVSDVFSDTTTPIKLLAVAATAPPDAPNREEVGI

SEQ ID NO: 809859 - protein, 521 aa, Homo sapiens
MPVFHTRTIESILEPVAQQISHLVIMHEEGEVDGKAIPDLTAPVAAVQAAVSNLVRVGKETVQTTEDQILKRDMPPAFIKVENACTKLVQAAQMLQSDPYSVPARDYLIDGSRGILSGTSDLLLTFDEAEVRKIIRVCKGILEYLTVAEVVETMEDLVTYTKNLGPGMTKMAKMIDERQQELTHQEHRVMLVNSMNTVKELLPVLISAMKIFVTTKNSKNQGIEEALKNRNFTVEKMSAEINEIIRVLQLTSWDEDAWASKDTEAMKRALASIDSKLNQAKGWLRDPSASPGDAGEQAIRQILDEAGKVGELCAGKERREILGTCKMLGQMTDQVADLRARGQGSSPVAMQKAQQVSQGLDVLTAKVENAARKLEAMTNSKQSIAKKIDAAQNWLADPNGGPEGEEQIRGALAEARKIAELCDDPKERDDILRSLGEISALTSKLADLRRQGKGDSPEARALAKQVATALQNLQTKTNRAVANSRPAKAAVHLEGKIEQAQRWIDNPTVDDRGVGKGSSAL

SEQ ID NO: 809860 - protein, 341 aa, Homo sapiens
MPVFHTRTIESILEPVAQQISHLVIMHEEGEVDGKAIPDLTAPVAAVQAAVSNLVRVGKETVQTTEDQILKRDMPPAFIKVENACTKLVQAAQMLQSDPYSVPARDYLIDGSRGILSGTSDLLLTFDEAEVRKIIRVCKGILEYLTVAEVVETMEDLVTYTKNLGPGMTKMAKMIDERQQELTHQEHRVMLVNSMNTVKELLPVLISAMKIFVTTKNSKNQGIEEALKNRNFTVEKMSAEINEIIRVLQLTSWDEDAWASKDTEAMKRALASIDSKLNQAKGWLRDPSASPGDAGEQAIRQILDEAGKVGELCAGKERREILGTCKMLGQMTDQVADLRAR

SEQ ID NO: 809861 - protein, 107 aa, Homo sapiens
MPVFHTRTIESILEPVAQQISHLVIMHEEGEVDGKAIPDLTAPVAAVQAAVSNLVRVGKETVQTTEDQILKRDMPPAFIKLLLEEILKNVLQTSPLIPDVSLKYKRE

SEQ ID NO: 809862 - protein, 84 aa, Homo sapiens
MLVAGATSIARRANRILLVAKREVENSEDPKFREAVKAASDELSKTISPMVMDAKAVAGNISDPGKQCMALCLTSTERLTQERS

SEQ ID NO: 809863 - protein, 154 aa, Homo sapiens
MSPTLASGDFPFSPCDISPFGPCLSPPLDPRALQSPPLRPPDVPPPEQYWKEVADQNQRALGDALVENNQLHVTLTQKQEEIASLKERNVQLKELASRTRHLASVLDKLMITQSRDCGAAAEPFLLKAKAKRSLEELVSAAGQDCAEVDAILRE

SEQ ID NO: 809864 - protein, 335 aa, Homo sapiens
PSAPSRSRACPNLWLASEPAGTEGSAGCGSLPQPGPPPPSSRHPEAGGTMQACGGGAAGRRAFDSICPNRMLALPGRALLCKPGKPERKFAPPRKFFPGCTGGSPVSVYEDPPDAEPTALPALTTIDLQDLADCSSLLGSDAPPGGDLAASQNHSHQTEADFNLQDFRDTVDDLISDSSSMMSPTLASGDFPFSPCDISPFGPCLSPPLDPRALQSPPLRPPDVPPPEQYWKEVADQNQRALGDALVENNQLHVTLTQKQEEIASLKERNVQLKELASRTRHLASVLDKLMITQSRDCGAAAEPFLLKAKAKRSLEELVSAAGQDCAEVDAILRE

SEQ ID NO: 809865 - protein, 185 aa, Homo sapiens
PSAPSRSRACPNLWLASEPAGTEGSAGCGSLPQPGPPPPSSRHPEAGGTMQACGGGAAGRRAFDSICPNRMLALPGRALLCKPGKPERKFAPPRKFFPGCTGGSPVSVYEDPPDAEPTALPALTTIDLQDLADCSSLLGSDAPPGGDLAASQNHSHQTEADFNLQDFRDTVDDLISGKCSLLAVK

SEQ ID NO: 809866 - protein, 682 aa, Homo sapiens
SHGVRAQTPTRRRNRQCSPKPRSPRARVAMRPLRPRAALLALLASLLAAPPVAPAEAPHLVQVDAARALWPLRRFWRSTGFCPPLPHSQADQYVLSWDQQLNLAYVGAVPHRGIKQVRTHWLLELVTTRGSTGRGLSYNFTHLDGYLDLLRENQLLPGFELMGSASGHFTDFEDKQQVFEWKDLVSSLARRYIGRYGLAHVSKWNFETWNEPDHHDFDNVSMTMQGFLNYYDACSEGLRAASPALRLGGPGDSFHTPPRSPLSWGLLRHCHDGTNFFTGEAGVRLDYISLHRKGARSSISILEQEKVVAQQIRQLFPKFADTPIYNDEADPLVGWSLPQPWRADVTYAAMVVKVIAQHQNLLLANTTSAFPYALLSNDNAFLSYHPHPFAQRTLTARFQVNNTRPPHVQLLRKPVLTAMGLLALLDEEQLWAEVSQAGTVLDSNHTVGVLASAHRPQGPADAWRAAVLIYASDDTRAHPNRSVAVTLRLRGVPPGPGLVYVTRYLDNGLCSPDGEWRRLGRPVFPTAEQFRRMRAAEDPVAAAPRPLPAGGRLTLRPALRLPSLLLVHVCARPEKPPGQVTRLRALPLTQGQLVLVWSDEHVGSKCLWTYEIQFSQDGKAYTPVSRKPSTFNLFVFSPDTGAVSGSYRVRALDYWARPGPFSDPVPYLEVPVPRGPPSPGNP

SEQ ID NO: 809867 - protein, 162 aa, Homo sapiens
SHGVRAQTPTRRRNRQCSPKPRSPRARVAMRPLRPRAALLALLASLLAAPPVAPAEAPHLVQVDAARALWPLRRFWRSTGFCPPLPHSQADQYVLSWDQQLNLAYVGAVPHRGIKQVRTHWLLELVTTRAFALAMPSAAWMSSCWLVPLHGSLRCLLREVPR

SEQ ID NO: 809868 - protein, 185 aa, Homo sapiens
SHGVRAQTPTRRRNRQCSPKPRSPRARVAMRPLRPRAALLALLASLLAAPPVAPAEAPHLVQVDAARALWPLRRFWRSTGFCPPLPHSQADQYVLSWDQQLNLAYVGAVPHRGIKQVRTHWLLELVTTRGSTGRGLSYNFTHLDGYLDLLRENQLLPGELWALPSQPACTPLPWPPSPSPSPSES

SEQ ID NO: 809869 - protein, 167 aa, Homo sapiens
AGTVGSLRCVAMRPLRPRAALLALLASLLAAPPVAPAEAPHLVQVDAARALWPLRRFWRSTGFCPPLPHSQADQYVLSWDQQLNLAYVGAVPHRGIKQVRTHWLLELVTTRGSTGRGLSYNFTHLDGYLDLLRENQLLPGELWALPSQPACTPLPWPPSPSPSPSES

SEQ ID NO: 809870 - protein, 661 aa, Homo sapiens
SHGVRAQTPTRRRNRQCSPKPRSPRARVAMRPLRPRAALLALLASLLAAPPVAPAEAPHLVQVDAARALWPLRRFWRSTGFCPPLPHSQADQYVLSWDQQLNLAYVGAVPHRGIKQVRTHWLLELVTTRGSTGRGLSYNFTHLDGYLDLLRENQLLPGFELMGSASGHFTDFEDKQQVFEWKDLVSSLARRYIGRYGLAHVSKWNFETWNEPDHHDFDNVSMTMQGFLNYYDACSEGLRAASPALRLGGPGDSFHTPPRSPLSWGLLRHCHDGTNFFTGEAGVRLDYISLHRKGARSSISILEQEKVVAQQIRQLFPKFADTPIYNDEADPLVGWSLPQPWRADVTYAAMVVKVIAQHQNLLLANTTSAFPYALLSNDNAFLSYHPHPFAQRTLTARFQVNNTRPPHVQLLRKPVLTAMGLLALLDEEQLWAEVSQAGTVLDSNHTVGVLASAHRPQGPADAWRAAVLIYASDDTRAHPNRSVAVTLRLRGVPPGPGLVYVTRYLDNGLCSPDGEWRRLGRPVFPTAEQFRRMRAAEVGGPRRGEGPGRAGVPGGWGPGRGLRGGVGGRWSGGPGAFALRSGRASPAPLENPEDRPLRPGPGGRGAPPLTRRRPPDPAPRAAAAVAFAGARVCAPREAARAGHAAPRPAPDPRAAGSGLVG

SEQ ID NO: 809871 - protein, 688 aa, Homo sapiens
AAVHARQPRRSPEARSVPMRSRCLRPCCNVGIAVCCVHVRSASVCLPPSWCAPVPDVPLRPLVHGCDAGTALHVCPVLCASGVSTGFCPPLPHSQADQYVLSWDQQLNLAYVGAVPHRGIKQVRTHWLLELVTTRGSTGRGLSYNFTHLDGYLDLLRENQLLPGFELMGSASGHFTDFEDKQQVFEWKDLVSSLARRYIGRYGLAHVSKWNFETWNEPDHHDFDNVSMTMQGFLNYYDACSEGLRAASPALRLGGPGDSFHTPPRSPLSWGLLRHCHDGTNFFTGEAGVRLDYISLHRKGARSSISILEQEKVVAQQIRQLFPKFADTPIYNDEADPLVGWSLPQPWRADVTYAAMVVKVIAQHQNLLLANTTSAFPYALLSNDNAFLSYHPHPFAQRTLTARFQVNNTRPPHVQLLRKPVLTAMGLLALLDEEQLWAEVSQAGTVLDSNHTVGVLASAHRPQGPADAWRAAVLIYASDDTRAHPNRSVAVTLRLRGVPPGPGLVYVTRYLDNGLCSPDGEWRRLGRPVFPTAEQFRRMRAAEDPVAAAPRPLPAGGRLTLRPALRLPSLLLVHVCARPEKPPGQVTRLRALPLTQGQLVLVWSDEHVGSKCLWTYEIQFSQDGKAYTPVSRKPSTFNLFVFSPDTGAVSGSYRVRALDYWARPGPFSDPVPYLEVPVPRGPPSPGNP

SEQ ID NO: 809872 - protein, 584 aa, Homo sapiens
MCLPSECHSHWTQVQASLSPAAPCPPPWLPRGSTGRGLSYNFTHLDGYLDLLRENQLLPGFELMGSASGHFTDFEDKQQVFEWKDLVSSLARRYIGRYGLAHVSKWNFETWNEPDHHDFDNVSMTMQGFLNYYDACSEGLRAASPALRLGGPGDSFHTPPRSPLSWGLLRHCHDGTNFFTGEAGVRLDYISLHRKGARSSISILEQEKVVAQQIRQLFPKFADTPIYNDEADPLVGWSLPQPWRADVTYAAMVVKVIAQHQNLLLANTTSAFPYALLSNDNAFLSYHPHPFAQRTLTARFQVNNTRPPHVQLLRKPVLTAMGLLALLDEEQLWAEVSQAGTVLDSNHTVGVLASAHRPQGPADAWRAAVLIYASDDTRAHPNRSVAVTLRLRGVPPGPGLVYVTRYLDNGLCSPDGEWRRLGRPVFPTAEQFRRMRAAEDPVAAAPRPLPAGGRLTLRPALRLPSLLLVHVCARPEKPPGQVTRLRALPLTQGQLVLVWSDEHVGSKCLWTYEIQFSQDGKAYTPVSRKPSTFNLFVFSPDTGAVSGSYRVRALDYWARPGPFSDPVPYLEVPVPRGPPSPGNP

SEQ ID NO: 809873 - protein, 592 aa, Homo sapiens
LAHPGPGIGAGPSPGSAGPSPLPGMDGRWALLDPESIVRGSTGRGLSYNFTHLDGYLDLLRENQLLPGFELMGSASGHFTDFEDKQQVFEWKDLVSSLARRYIGRYGLAHVSKWNFETWNEPDHHDFDNVSMTMQGFLNYYDACSEGLRAASPALRLGGPGDSFHTPPRSPLSWGLLRHCHDGTNFFTGEAGVRLDYISLHRKGARSSISILEQEKVVAQQIRQLFPKFADTPIYNDEADPLVGWSLPQPWRADVTYAAMVVKVIAQHQNLLLANTTSAFPYALLSNDNAFLSYHPHPFAQRTLTARFQVNNTRPPHVQLLRKPVLTAMGLLALLDEEQLWAEVSQAGTVLDSNHTVGVLASAHRPQGPADAWRAAVLIYASDDTRAHPNRSVAVTLRLRGVPPGPGLVYVTRYLDNGLCSPDGEWRRLGRPVFPTAEQFRRMRAAEDPVAAAPRPLPAGGRLTLRPALRLPSLLLVHVCARPEKPPGQVTRLRALPLTQGQLVLVWSDEHVGSKCLWTYEIQFSQDGKAYTPVSRKPSTFNLFVFSPDTGAVSGSYRVRALDYWARPGPFSDPVPYLEVPVPRGPPSPGNP

SEQ ID NO: 809874 - protein, 501 aa, Homo sapiens
RFTCAGGTARLLCRYGLAHVSKWNFETWNEPDHHDFDNVSMTMQGFLNYYDACSEGLRAASPALRLGGPGDSFHTPPRSPLSWGLLRHCHDGTNFFTGEAGVRLDYISLHRKGARSSISILEQEKVVAQQIRQLFPKFADTPIYNDEADPLVGWSLPQPWRADVTYAAMVVKVIAQHQNLLLANTTSAFPYALLSNDNAFLSYHPHPFAQRTLTARFQVNNTRPPHVQLLRKPVLTAMGLLALLDEEQLWAEVSQAGTVLDSNHTVGVLASAHRPQGPADAWRAAVLIYASDDTRAHPNRSVAVTLRLRGVPPGPGLVYVTRYLDNGLCSPDGEWRRLGRPVFPTAEQFRRMRAAEDPVAAAPRPLPAGGRLTLRPALRLPSLLLVHVCARPEKPPGQVTRLRALPLTQGQLVLVWSDEHVGSKCLWTYEIQFSQDGKAYTPVSRKPSTFNLFVFSPDTGAVSGSYRVRALDYWARPGPFSDPVPYLEVPVPRGPPSPGNP

SEQ ID NO: 809875 - protein, 641 aa, Homo sapiens
PVEDLFIHRPRRAVLGLNVCVSRAASHAEARELSRPFVVPSPPLPHSQADQYVLSWDQQLNLAYVGAVPHRGIKQVRTHWLLELVTTRGSTGRGLSYNFTHLDGYLDLLRENQLLPGFELMGSASGHFTDFEDKQQVFEWKDLVSSLARRYIGRYGLAHVSKWNFETWNEPDHHDFDNVSMTMQGFLNYYDACSEGLRAASPALRLGGPGDSFHTPPRSPLSWGLLRHCHDGTNFFTGEAGVRLDYISLHRKGARSSISILEQEKVVAQQIRQLFPKFADTPIYNDEADPLVGWSLPQPWRADVTYAAMVVKVIAQHQNLLLANTTSAFPYALLSNDNAFLSYHPHPFAQRTLTARFQVNNTRPPHVQLLRKPVLTAMGLLALLDEEQLWAEVSQAGTVLDSNHTVGVLASAHRPQGPADAWRAAVLIYASDDTRAHPNRSVAVTLRLRGVPPGPGLVYVTRYLDNGLCSPDGEWRRLGRPVFPTAEQFRRMRAAEDPVAAAPRPLPAGGRLTLRPALRLPSLLLVHVCARPEKPPGQVTRLRALPLTQGQLVLVWSDEHVGSKCLWTYEIQFSQDGKAYTPVSRKPSTFNLFVFSPDTGAVSGSYRVRALDYWARPGPFSDPVPYLEVPVPRGPPSPGNP

SEQ ID NO: 809876 - protein, 409 aa, Homo sapiens
SIRARTRTVMRLDYISLHRKGARSSISILEQEKVVAQQIRQLFPKFADTPIYNDEADPLVGWSLPQPWRADVTYAAMVVKVIAQHQNLLLANTTSAFPYALLSNDNAFLSYHPHPFAQRTLTARFQVNNTRPPHVQLLRKPVLTAMGLLALLDEEQLWAEVSQAGTVLDSNHTVGVLASAHRPQGPADAWRAAVLIYASDDTRAHPNRSVAVTLRLRGVPPGPGLVYVTRYLDNGLCSPDGEWRRLGRPVFPTAEQFRRMRAAEDPVAAAPRPLPAGGRLTLRPALRLPSLLLVHVCARPEKPPGQVTRLRALPLTQGQLVLVWSDEHVGSKCLWTYEIQFSQDGKAYTPVSRKPSTFNLFVFSPDTGAVSGSYRVRALDYWARPGPFSDPVPYLEVPVPRGPPSPGNP

SEQ ID NO: 809877 - protein, 261 aa, Homo sapiens
RHEEFSQDGKAYTPVSRTVLDSNHTVGVLASAHRPQGPADAWRAAVLIYASDDTRAHPNRSVAVTLRLRGVPPGPGLVYVTRYLDNGLCSPDGEWRRLGRPVFPTAEQFRRMRAAEDPVAAAPRPLPAGGRLTLRPALRLPSLLLVHVCARPEKPPGQVTRLRALPLTQGQLVLVWSDEHVGSKCLWTYEIQFSQDGKAYTPVSRKPSTFNLFVFSPDTGAVSGSYRVRALDYWARPGPFSDPVPYLEVPVPRGPPSPGNP

SEQ ID NO: 809878 - protein, 273 aa, Homo sapiens
AGTVGSLRCVAMRPLRPRAALLALLASLLTVLDSNHTVGVLASAHRPQGPADAWRAAVLIYASDDTRAHPNRSVAVTLRLRGVPPGPGLVYVTRYLDNGLCSPDGEWRRLGRPVFPTAEQFRRMRAAEDPVAAAPRPLPAGGRLTLRPALRLPSLLLVHVCARPEKPPGQVTRLRALPLTQGQLVLVWSDEHVGSKCLWTYEIQFSQDGKAYTPVSRKPSTFNLFVFSPDTGAVSGSYRVRALDYWARPGPFSDPVPYLEVPVPRGPPSPGNP

SEQ ID NO: 809879 - protein, 617 aa, Homo sapiens
SHGVRAQTPTRRRNRQCSPKPRSPRARVAMRPLRPRAALLALLASLLAAPPVAPAEAPHLVQVDAARALWPLRRFWRSTGFCPPLPHSQADQYVLSWDQQLNLAYVGAVPHRGIKQVRTHWLLELVTTRGSTGRGLSYNFTHLDGYLDLLRENQLLPGFELMGSASGHFTDFEDKQQVFEWKDLVSSLARRYIGRYGLAHVSKWNFETWNEPDHHDFDNVSMTMQGFLNYYDACSEGLRAASPALRLGGPGDSFHTPPRSPLSWGLLRHCHDGTNFFTGEAGVRLDYISLHRKGARSSISILEQEKVVAQQIRQLFPKFADTPIYNDEADPLVGWSLPQPWRADVTYAAMVVKVIAQHQNLLLANTTSAFPYALLSNDNAFLSYHPHPFAQRTLTARFQVNNTRPPHVQLLRKPVLTAMGLLALLDEEQLWAEVSQAGTVLDSNHTVGVLASAHRPQGPADAWRAAVLIYASDDTRAHPNRSVAVTLRLRGVPPGPGLVYVTRYLDNGLCSPDGEWRRLGRPVFPTAEQFRRMRAAEDPVAAAPRPLPAGGRLTLRPALRLPSLLLVHVCARPEKPPGQVTRLRALPLTQGQLVLVWSDEHVGSKCVSGAAPPSAWS

SEQ ID NO: 809880 - protein, 242 aa, Homo sapiens
SHGVRAQTPTRRRNRQCSPKPRSPRARVAMRPLRPRAALLALLASLLAAPPVAPAEAPHLVQVDAARALWPLRRFWRSTGFCPPLPHSQADQYVLSWDQQLNLAYVGAVPHRGIKQVRTHWLLELVTTRGSTGRGLSYNFTHLDGYLDLLRENQLLPGFELMGSASGHFTDFEDKQQVFEWKDLVSSLARRYIGGRAQALGPWPGRGYSWAGCTPITQAAAWSGDTLVGRRRPLWGDGGDKG

SEQ ID NO: 809881 - protein, 259 aa, Homo sapiens
SHGVRAQTPTRRRNRQCSPKPRSPRARVAMRPLRPRAALLALLASLLAAPPVAPAEAPHLVQVDAARALWPLRRFWRSTGFCPPLPHSQADQYVLSWDQQLNLAYVGAVPHRGIKQVRTHWLLELVTTSHAPCVQPREAVEWLQEEVLVGIVQRPPKAEHPHAGLRDEALELCGILVEGRVPDAGQQGGAWALGAAGQAEQREDDASQQPGLCADQHTGGRGACPDQRVSRAHPPQPREVPHLAQGPPQADHDDAGQHA

SEQ ID NO: 809882 - protein, 220 aa, Homo sapiens
MVWDSVHRSRPSTYYELLGVHPGASTEEVKRAFFSKSKELHPDRDPGNPSLHSRFVELSEAYRVLSREQSRRSYDDQLRSGSPPKSPRTTVHDKSAHQTHSSWTPPNAQYWSQFHSVRPQGPQLRQQQHKQNKQVLGYCLLLMLAGMGLHYIAFRKVKQMHLNFMDEKDRIITAFYNEARARARANRGILQQERQRLGQRQPPPSEPTQGPEIVPRGAGP

SEQ ID NO: 809883 - protein, 135 aa, Homo sapiens
MGPGEGQAKGDKGSPAPPQLHPDRDPGNPSLHSRFVELSEAYRVLSREQSRRSYDDQLRSGSPPKSPRTTVHDKSAHQTHSSWTPPNAQYWSQFHSVRPQGPQLRQQQHKQNKQVLGYCLLLMLAGMGLHYIAFR

SEQ ID NO: 809884 - protein, 71 aa, Homo sapiens
SKGGMAAGGQLGKEATKSALDQVGLDFKHPGAEGRANRGILQQERQRLGQRQPPPSEPTQGPEIVPRGAGP

SEQ ID NO: 809885 - protein, 241 aa, Homo sapiens
MPPLLPLRLCRLWPRNPPSRLLGAAAGQRSRPSTYYELLGVHPGASTEEVKRAFFSKSKELHPDRDPGNPSLHSRFVELSEAYRVLSREQSRRSYDDQLRSGSPPKSPRTTVHDKSAHQTHSSWTPPNAQYWSQFHSVRPQGPQLRQQQHKQNKQVLGYCLLLMLAGMGLHYIAFRKVKQMHLNFMDEKDRIITAFYNEARARARANRGILQQERQRLGQRQPPPSEPTQGPEIVPRGAGP

SEQ ID NO: 809886 - protein, 241 aa, Homo sapiens; identical to SEQ ID NO: 809885

SEQ ID NO: 809887 - protein, 241 aa, Homo sapiens; identical to SEQ ID NO: 809885

SEQ ID NO: 809888 - protein, 248 aa, Homo sapiens
MPPLLPLRLCRLWPRNPPSRLLGAAAGQRSRPSTYYELLGVHPGASTEEVKRAFFSKSKELHPDRDPGNPSLHSRFVELSEAYRVLSREQSRRSYDDQLRSGSPPKSPRTTVHDKSAHQTHSSWTPPNAQYWSQFHSVRPQGPQLRQQQHKQNKQVLGYCLLLMLAGMGLHYIAFRKVKQMHLNFMDEKDRIITAFYNEARARARSVPALFCSLLPVQEPHFGIPIPTTQVPSPPGPTEASFSRSDNG

SEQ ID NO: 809889 - protein, 200 aa, Homo sapiens
MGPGEGQAKGDKGSPAPPQLHPDRDPGNPSLHSRFVELSEAYRVLSREQSRRSYDDQLRSGSPPKSPRTTVHDKSAHQTHSSWTPPNAQYWSQFHSVRPQGPQLRQQQHKQNKQVLGYCLLLMLAGMGLHYIAFRKVKQMHLNFMDEKDRIITAFYNEARARARANRGILQQERQRLGQRQPPPSEPTQGPEIVPRGAGP

SEQ ID NO: 809890 - protein, 179 aa, Homo sapiens
MNCWGCILVPALRKLNELSSPSPKSREQSRRSYDDQLRSGSPPKSPRTTVHDKSAHQTHSSWTPPNAQYWSQFHSVRPQGPQLRQQQHKQNKQVLGYCLLLMLAGMGLHYIAFRKVKQMHLNFMDEKDRIITAFYNEARARARANRGILQQERQRLGQRQPPPSEPTQGPEIVPRGAGP

SEQ ID NO: 809891 - protein, 234 aa, Homo sapiens
MIEKTPKVIHRFKRQRRKFESRSRPSTYYELLGVHPGASTEEVKRAFFSKSKELHPDRDPGNPSLHSRFVELSEAYRVLSREQSRRSYDDQLRSGSPPKSPRTTVHDKSAHQTHSSWTPPNAQYWSQFHSVRPQGPQLRQQQHKQNKQVLGYCLLLMLAGMGLHYIAFRKVKQMHLNFMDEKDRIITAFYNEARARARANRGILQQERQRLGQRQPPPSEPTQGPEIVPRGAGP

SEQ ID NO: 809892 - protein, 254 aa, Homo sapiens
MPPLLPLRLCRLWPRNPPSRLLGAAAGQRSRPSTYYELLGVHPGASTEEVKRAFFSKSKELHPDRDPGNPSLHSRFVELSEAYRVLSREQSRRSYDDQLRSGSPPKSPRTTVHDKSAHQTHSSWTPPNAQYWSQFHSVRPQGPQLRQQQHKQNKQVLGYCLLLMLAGMGLHYIAFRKVKQMHLNFMDEKDRIITAFYNEARARARPNTVRWPNTVRWPNTVRWPNTVRWPNTVRWPNTVRGANTVRGANMVRMT

SEQ ID NO: 809893 - protein, 176 aa, Homo sapiens
MPPLLPLRLCRLWPRNPPSRLLGAAAGQRSRPSTYYELLGVHPGASTEEVKRAFFSKSKELHPDRDPGNPSLHSRFVELSEAYRVLSREQSRRSYDDQLRSGSPPKSPRTTVHDKSAHQTHSSWTPPNAQYWSQFHSVRPQGPQLRQQQHKQNKQVLGYCLLLMLAGMGLHYIAFR

SEQ ID NO: 809894 - protein, 176 aa, Homo sapiens; identical to SEQ ID NO: 809893

SEQ ID NO: 809895 - protein, 223 aa, Homo sapiens
MPPLLPLRLCRLWPRNPPSRLLGAAAGQRSRPSTYYELLGVHPGASTEEVKRAFFSKSKELHPDRDPGNPSLHSRFVELSEAYRVLSREQSRRSYDDQLRSGSPPKSPRTTVHDKSAHQTHRQGPQLRQQQHKQNKQVLGYCLLLMLAGMGLHYIAFRKVKQMHLNFMDEKDRIITAFYNEARARARANRGILQQERQRLGQRQPPPSEPTQGPEIVPRGAGP

SEQ ID NO: 809896 - protein, 113 aa, Homo sapiens
MPPLLPLRLCRLWPRNPPSRLLGAAAGQRSRPSTYYELLGVHPGASTEEVKRAFFSKSKELHPDRDPGNPSLHSRFVELSEAYRVLSREQSRRSYDDQLRSGSPPKSPHRGPS

SEQ ID NO: 809897 - protein, 140 aa, Homo sapiens
MNCWGCILVPALRKLNELSSPSPKSCTQTGTLGTQACTAQGPQLRQQQHKQNKQVLGYCLLLMLAGMGLHYIAFRKVKQMHLNFMDEKDRIITAFYNEARARARANRGILQQERQRLGQRQPPPSEPTQGPEIVPRGAGP

SEQ ID NO: 809898 - protein, 67 aa, Homo sapiens
MPPLLPLRLCRLWPRNPPSRLLGAAAGQRSRPSTYYELLGVHPGASTEEVKRAFFSKSKEEGEADAP

SEQ ID NO: 809899 - protein, 180 aa, Homo sapiens
MPPLLPLRLCRLWPRNPPSRLLGAAAGQRSRPSTYYELLGVHPGASTEEVKRAFFSKSKEQAKGDKGSPAPPQLHPDRDPGNPSLHSQHKQNKQVLGYCLLLMLAGMGLHYIAFRKVKQMHLNFMDEKDRIITAFYNEARARARANRGILQQERQRLGQRQPPPSEPTQGPEIVPRGAGP

SEQ ID NO: 809900 - protein, 189 aa, Homo sapiens
MPPLLPLRLCRLWPRNPPSRLLGAAAGQRSRPSTYYELLGVHPGASTEEVKRAFFSKSKEQAKGDKGSPAPPQLHPDRDPGNPSLHSRFVELSEAYRVLSREQSRRSYDDQLRSGSPPKSPRTTVHDKSAHQTHSSWTPPNAQYWSQFHSVRPQGPQLRQQQHKQNKQVLGYCLLLMLAGMGLHYIAFR

SEQ ID NO: 809901 - protein, 189 aa, Homo sapiens; identical to SEQ ID NO: 809900

SEQ ID NO: 809902 - protein, 107 aa, Homo sapiens
MKPERRHLQSALDGRGALEPRMPGKPHVGGTSQLEIIVMQGQIREMAFPYIKMAPLTNEDILSIFANGIFPELDLPHDRLIQGTENKCPFQFTLFTHFARACVNIFR

SEQ ID NO: 809903 - protein, 342 aa, Homo sapiens
MALFAVFQTTFFLTLLSLRTYQSEVLAERLPLTPVSLKVSTNSTRQSLHLQWTVHNLPYHQELKMVFQIQISRIETSNVIWVGNYSTTVKWNQVLHWSWESELPLECATHFVRIKSLVDDAKFPEPNFWSNWSSWEEVSVQDSTGQDILFVFPKDKLVEEGTNVTICYVSRNIQNNVSCYLEGKQIHGEQLDPHVTAFNLNSVPFIRNKGTNIYCEASQGNVSEGMKGIVLFVSKVLEEPKDFSCETEDFKTLHCTWDPGTDTALGWSKQPSQSYTLFESFSGEKKLCTHKNWCNWQITQDSQETYNFTLIAENYLRKRSVNILFNLTHRGETRVVTAHRGH

SEQ ID NO: 809904 - protein, 231 aa, Homo sapiens
WDTDTHTTGILVPIADEVPCTWGVVLVLVFSSATGIQRAILSSFDRGPPQVQFISCISCIPFDGVRDEEIRSSSRDIDRSWSFDQSWPNLVTGIHSVILGLASASSCGLRPRPRPSCLVLIPGPRIAILPELSCGSHSRFPIPGPSRAPGPPPLHRCVIRSICWDIADKKELVSVAYCIWQPPARPRQGLPPRSADSGALDPTRCPRIPAAHAEARCMRPTGLTCFGIFFI

SEQ ID NO: 809905 - protein, 979 aa, Homo sapiens
MALFAVFQTTFFLTLLSLRTYQSEVLAERLPLTPVSLKVSTNSTRQSLHLQWTVHNLPYHQELKMVFQIQISRIETSNVIWVGNYSTTVKWNQVLHWSWESELPLECATHFVRIKSLVDDAKFPEPNFWSNWSSWEEVSVQDSTGQDILFVFPKDKLVEEGTNVTICYVSRNIQNNVSCYLEGKQIHGEQLDPHVTAFNLNSVPFIRNKGTNIYCEASQGNVSEGMKGIVLFVSKVLEEPKDFSCETEDFKTLHCTWDPGTDTALGWSKQPSQSYTLFESFSGEKKLCTHKNWCNWQITQDSQETYNFTLIAENYLRKRSVNILFNLTHRVYLMNPFSVNFENVNATNAIMTWKVHSIRNNFTYLCQIELHGEGKMMQYNVSIKVNGEYFLSELEPATEYMARVRCADASHFWKWSEWSGQNFTTLEAAPSEAPDVWRIVSLEPGNHTVTLFWKPLSKLHANGKILFYNVVVENLDKPSSSELHSIPAPANSTKLILDRCSYQICVIANNSVGASPASVIVISADPENKEVEEERIAGTEGGFSLSWKPQPGDVIGYVVDWCDHTQDVLGDFQWKNVGPNTTSTVISTDAFRPGVRYDFRIYGLSTKRIACLLEKKTGYSQELAPSDNPHVLVDTLTSHSFTLSWKDYSTESQPGFIQGYHVYLKSKARQCHPRFEKAVLSDGSECCKYKIDNPEEKALIVDNLKPESFYEFFITPFTSAGEGPSATFTKVTTPDEHSSMLIHILLPMVFCVLLIMVMCYLKSQWIKETCYPDIPDPYKSSILSLIKFKENPHLIIMNVSDCIPDAIEVVSKPEGTKIQFLGTRKSLTETELTKPNYLYLLPTEKNHSGPGPCICFENLTYNQAASDSGSCGHVPVSPKAPSMLGLMTSPENVLKALEKNYMNSLGEIPAGETSLNYVSQLASPMFGDKDSLPTNPVEAPHCSEYKMQMAVSLRLALPPPTENSSLSSITLLDPGEHYC

SEQ ID NO: 809906 - protein, 979 aa, Homo sapiens; identical to SEQ ID NO: 809905

SEQ ID NO: 809907 - protein, 498 aa, Homo sapiens
RQAPVTIEVEVCYLLDTVHVCIYFLPYTLKTIYSELNLEHCSICLYTEEVEEERIAGTEGGFSLSWKPQPGDVIGYVVDWCDHTQDVLGDFQWKNVGPNTTSTVISTDAFRPGVRYDFRIYGLSTKRIACLLEKKTGYSQELAPSDNPHVLVDTLTSHSFTLSWKDYSTESQPGFIQGYHVYLKSKARQCHPRFEKAVLSDGSECCKYKIDNPEEKALIVDNLKPESFYEFFITPFTSAGEGPSATFTKVTTPDEHSSMLIHILLPMVFCVLLIMVMCYLKSQWIKETCYPDIPDPYKSSILSLIKFKENPHLIIMNVSDCIPDAIEVVSKPEGTKIQFLGTRKSLTETELTKPNYLYLLPTEKNHSGPGPCICFENLTYNQAASDSGSCGHVPVSPKAPSMLGLMTSPENVLKALEKNYMNSLGEIPAGETSLNYVSQLASPMFGDKDSLPTNPVEAPHCSEYKMQMAVSLRLALPPPTENSSLSSITLLDPGEHYC

SEQ ID NO: 809908 - protein, 799 aa, Homo sapiens
MALFAVFQTTFFLTLLSLRTYQSEVLAERLPLTPVSLKVSTNSTRQSLHLQWTVHNLPYHQELKMVFQIQISRIETSNVIWVGNYSTTVKWNQVLHWSWESELPLECATHFVRIKSLVDDAKFPEPNFWSNWSSWEEVSVQDSTGQDILFVFPKDKLVEEGTNVTICYVSRNIQNNVSCYLEGKQIHGEQLDPHVTAFNLNSVPFIRNKGTNIYCEASQGNVSEGMKGIVLFVSKVLEEPKDFSCETEDFKTLHCTWDPGTDTALGWSKQPSQSYTLFESFSGEKKLCTHKNWCNWQITQDSQETYNFTLIAENYLRKRSVNILFNLTHRVYLMNPFSVNFENVNATNAIMTWKVHSIRNNFTYLCQIELHGEGKMMQYNVSIKVNGEYFLSELEPATEYMARVRCADASHFWKWSEWSGQNFTTLEAAPSEAPDVWRIVSLEPGNHTVTLFWKPLSKLHANGKILFYNVVVENLDKPSSSELHSIPAPANSTKLILDRCSYQICVIANNSVGASPASVIVISADPENKEVEEERIAGTEGGFSLSWKPQPGDVIGYVVDWCDHTQDVLGDFQWKNVGPNTTSTVISTDAFRPGVRYDFRIYGLSTKRIACLLEKKTGYSQELAPSDNPHVLVDTLTSHSFTLSWKDYSTESQPGFIQGYHVYLKSKARQCHPRFEKAVLSDGSECCKYKIDNPEEKALIVDNLKPESFYEFFITPFTSAGEGPSATFTKVTTPDEHSSMLIHILLPMVFCVLLIMVMCYLKSQWIKETCYPDIPDPYKSSILSLIKFKISSKVWLNRR

SEQ ID NO: 809909 - protein, 581 aa, Homo sapiens
MALFAVFQTTFFLTLLSLRTYQSEVLAERLPLTPVSLKVSTNSTRQSLHLQWTVHNLPYHQELKMVFQIQISRIETSNVIWVGNYSTTVKWNQVLHWSWESELPLECATHFVRIKSLVDDAKFPEPNFWSNWSSWEEVSVQDSTGQDILFVFPKDKLVEEGTNVTICYVSRNIQNNVSCYLEGKQIHGEQLDPHVTAFNLNSVPFIRNKGTNIYCEASQGNVSEGMKGIVLFVSKVLEEPKDFSCETEDFKTLHCTWDPGTDTALGWSKQPSQSYTLFESFSGEKKLCTHKNWCNWQITQDSQETYNFTLIAENYLRKRSVNILFNLTHRVYLMNPFSVNFENVNATNAIMTWKVHSIRNNFTYLCQIELHGEGKMMQYNVSIKVNGEYFLSELEPATEYMARVRCADASHFWKWSEWSGQNFTTLEAAPSEAPDVWRIVSLEPGNHTVTLFWKPLSKLHANGKILFYNVVVENLDKPSSSELHSIPAPANSTKLILDRCSYQICVIANNSVGASPASVIVISADPENSVSTCFSGTVPSVWGEGDFSHGSGHFCPGDSSTYMGNYLKFIQVTATLTNSHH

SEQ ID NO: 809910 - protein, 84 aa, Homo sapiens
QPGDVIGYVVDWCDHTQDVLGDFQWKNVGPNTTSTVISTGKKKLPYHRIAIFTLKKVQVGFLDYFTDFDCAKLVILKRQIQHGC

SEQ ID NO: 809911 - protein, 68 aa, Homo sapiens
IRGRVDREDDRTGPVVLLRGREDSRSRPGSSISEETEFPAFAAWESQAPTHRCWKGMRNKGRTRAPKA

SEQ ID NO: 809912 - protein, 104 aa, Homo sapiens [sequence omitted]

SEQ ID NO: 809913 - protein, 234 aa, Homo sapiens
RPAWAGLGPFWHLRRSRRQDGLCCPGPRPPSSTVASHCKKAWIRNLIRATLLCEARRLRTSGLVPKSLSRGQALWEHGLPATHPLTGLPHPCSSRHLSPSPSSGGPVVEKVPRPTDWRLTPHSRPEKRAGLGCRQEAMTLPRRCILAPGHKRLSALTLMLVWLPVLWHQNTRRWWRTLWPGLPHLIRSRLERPEDQKTRSLSERLEAGSSQQPRASASTRVTWVTRRLGSAPSR

SEQ ID NO: 809914 - protein, 104 aa, Homo sapiens [sequence omitted]

SEQ ID NO: 809915 - protein, 102 aa, Homo sapiens
LSGKACKVRPRARVGGRVVGTAWNRRAPTGTRASLTVRPLGSIDPSLPPRSGLIQLGGPEVVQSHLDVRMTQPVIKRNLQGIPCMLRNEGCEKEINCLPLSS

SEQ ID NO: 809916 - protein, 136 aa, Homo sapiens
MAGAGSAAVSGAGTPVAGPTGRDLFAEGLLEFLRPAVQQLDSHVHAVRESQVELREQIDNLATELCRINEDQKVALDLDPYVKKLLNARRRVVLVNNILQNAQERLRRLNHSVAKETARRRAMLDSGIYPPGSPGK

SEQ ID NO: 809917 - protein, 136 aa, Homo sapiens; identical to SEQ ID NO: 809916

SEQ ID NO: 809918 - protein, 136 aa, Homo sapiens; identical to SEQ ID NO: 809916

SEQ ID NO: 809919 - protein, 136 aa, Homo sapiens; identical to SEQ ID NO: 809916

SEQ ID NO: 809920 - protein, 94 aa, Homo sapiens
PGRLGWVRGLVSNRPRGAGQCGAAPVPGGPRGRFRASGQFVMAGAGSAAVSGAGTPVAGPTGRDLFAEGLLEFLRPAVQQLDSHVHAVRTVPHK

SEQ ID NO: 809921 - protein, 136 aa, Homo sapiens
MIFGGSSDSVEWCSNSGSQNLCLTREGLVEIFLRPAVQQLDSHVHAVRESQVELREQIDNLATELCRINEDQKVALDLDPYVKKLLNARRRVVLVNNILQNAQERLRRLNHSVAKETARRRAMLDSGIYPPGSPGK

SEQ ID NO: 809922 - protein, 110 aa, Homo sapiens [sequence omitted]

SEQ ID NO: 809923 - protein, 136 aa, Homo sapiens; identical to SEQ ID NO: 809916

SEQ ID NO: 809924 - protein, 104 aa, Homo sapiens
PGRLGWVRGLVSNRPRGAGQCGAAPVPGGPRGRFRASGQFVMAGAGSAAVSGAGTPVAGPTGRDLFAEGLLEFLRPAVQQLDSHVHAVRCPGGKLGAGPVSLAL

SEQ ID NO: 809925 - protein, 89 aa, Homo sapiens
QESIKASRVELDKLATELCRINEDQKVALDLDPYVKKLLNARRRVVLVNNILQNAQERLRRLNHSVAKETARRRAMLDSGIYPPGSPGK

SEQ ID NO: 809926 - protein, 143 aa, Homo sapiens
QNLQKTRFEVTGLMEDTQYQFRVYAVNKIGYSDPSDVPDKHYPKDILIPPEGELDADLRKTLILRAGVTMRLYVPVKGRPPPKITWSKPNVNLRDRIGLDIKSTDFDTFLRCENVNKYDAGKYILTLENSCGKKEYTIVVKVL

SEQ ID NO: 809927 - protein, 725 aa, Homo sapiens
MSFPKAPLKRFNDPSGCAPSPGAYDVKTLEVLKGPVSFQKSQRFKQQKESKQNLNVDKDTTLPASARKVKSSESKKESQKNDKDLKILEKEIRVLLQERGAQDRRIQDLETELEKMEARLNAALREKTSLSANNATLEKQLIELTRTNELLKSKFSENGNQKNLRILSLELMKLRNKRETKMRGMMAKQEGMEMKLQVTQRSLEESQGKIAQLEGKLVSIEKEKIDEKSETEKLLEYIEEISCASDQVEKYKLDIAQLEENLKEKNDEILSLKQSLEENIVILSKQVEDLNVKCQLLEKEKEDHVNRNREHNENLNAEMQNLKQKFILEQQEREKLQQKELQIDSLLQQEKELSSSLHQKLCSFQEEMVKEKNLFEEELKQTLDELDKLQQKEEQAERLVKQLEEEAKSRAEELKLLEEKLKGKEAELEKSSAAHTQATLLLQEKYDSMVQSLEDVTAQFESYKALTASEIEDLKLENSSLQEKAAKAGKNAEDVQHQILATESSNQEYVRMLLDLQTKSALKETEIKEITVSFLQKITDLQNQLKQQEEDFRKQLEDEEGRKAEKENTTAELTEEINKWRLLYEELYNKTKPFQLQLDAFEVEKQALLNEHGAAQEQLNKIRDSYAKLLGHQNLKQKIKHVVKLKDENSQLKSEVSKLRCQLAKKKQSETKLQEELNKVLGIKHFDPSKAFHHESKENFALKTPLKEGNTNCYRAPMECQESWK

SEQ ID NO: 809928 - protein, 709 aa, Homo sapiens
MSFPKAPLKRFNDPSGCAPSPGAYDVKTLEVLKGPVSFQKSQRFKQQKESKQNLNVDKDTTLPASARKVKSSESKIRVLLQERGAQDRRIQDLETELEKMEARLNAALREKTSLSANNATLEKQLIELTRTNELLKSKFSENGNQKNLRILSLELMKLRNKRETKMRGMMAKQEGMEMKLQVTQRSLEESQGKIAQLEGKLVSIEKEKIDEKSETEKLLEYIEEISCASDQVEKYKLDIAQLEENLKEKNDEILSLKQSLEENIVILSKQVEDLNVKCQLLEKEKEDHVNRNREHNENLNAEMQNLKQKFILEQQEREKLQQKELQIDSLLQQEKELSSSLHQKLCSFQEEMVKEKNLFEEELKQTLDELDKLQQKEEQAERLVKQLEEEAKSRAEELKLLEEKLKGKEAELEKSSAAHTQATLLLQEKYDSMVQSLEDVTAQFESYKALTASEIEDLKLENSSLQEKAAKAGKNAEDVQHQILATESSNQEYVRMLLDLQTKSALKETEIKEITVSFLQKITDLQNQLKQQEEDFRKQLEDEEGRKAEKENTTAELTEEINKWRLLYEELYNKTKPFQLQLDAFEVEKQALLNEHGAAQEQLNKIRDSYAKLLGHQNLKQKIKHVVKLKDENSQLKSEVSKLRCQLAKKKQSETKLQEELNKVLGIKHFDPSKAFHHESKENFALKTPLKEGNTNCYRAPMECQESWK

SEQ ID NO: 809929 - protein, 725 aa, Homo sapiens; identical to SEQ ID NO: 809927

SEQ ID NO: 809930 - protein, 610 aa, Homo sapiens [sequence omitted]

SEQ ID NO: 809931 - protein, 610 aa, Homo sapiens [sequence omitted]

SEQ ID NO: 809932 - protein, 427 aa, Homo sapiens
MSFPKAPLKRFNDPSGCAPSPGAYDVKTLEVLKGPVSFQKSQRFKQQKESKQNLNVDKDTTLPASARKVKSSESKKESQKNDKDLKILEKEIRVLLQERGAQDRRIQDLETELEKMEARLNAALREKTSLSANNATLEKQLIELTRTNELLKSKFSENGNQKNLRILSLELMKLRNKRETKMRGMMAKQEGMEMKLQVTQRSLEESQGKIAQLEGKLVSIEKEKIDEKSETEKLLEYIEEISCASDQVEKYKLDIAQLEENLKEKNDEILSLKQSLEENIVILSKQVEDLNVKCQLLEKEKEDHVNRNREHNENLNAEMQNLKQKFILEQQEREKLQQKELQIDSLLQQEKELSSSLHQKLCSFQEEMVKEKNLFEEELKQTLDELDKLQQKEEQAERLVKQLEEEAKSRAEELKLLEEKLKGNRTA

SEQ ID NO: 809933 - protein, 434 aa, Homo sapiens
MSFPKAPLKRFNDPSGCAPSPGAYDVKTLEVLKGPVSFQKSQRFKQQKESKQNLNVDKDTTLPASARKVKSSESKKESQKNDKDLKILEKEIRVLLQERGAQDRRIQDLETELEKMEARLNAALREKTSLSANNATLEKQLIELTRTNELLKSKFSENGNQKNLRILSLELMKLRNKRETKMRGMMAKQEGMEMKLQVTQRSLEESQGKIAQLEGKLVSIEKEKIDEKSETEKLLEYIEEISCASDQVEKYKLDIAQLEENLKEKNDEILSLKQSLEENIVILSKQVEDLNVKCQLLEKEKEDHVNRNREHNENLNAEMQNLKQKFILEQQEREKLQQKELQIDSLLQQEKELSSSLHQKLCSFQEEMVKEKNLFEEELKQTLDELDKLQQKEEQAERLVKQLEEEAKSRAEELKLLEEKLKGKQGGLGMDYVL

SEQ ID NO: 809934 - protein, 228 aa, Homo sapiens
MSMAVETFGFFMATVGLLMLGVTLPNSYWRVSTVHGNVITTNTIFENLWFSCATDSLGVYNCWEFPSMLALSGYIQACRALMITAILLGFLGLLLGIAGLRCTNIGGLELSRKAKLAATAGALHILAGICGMVAISWYAFNITRDFFDPLYPGTKYELGPALYLGWSASLISILGGLCLCSACCCGSDEDPAASARRPYQAPVSVMPVATSDQEGDSSFGKYGRNAYV

SEQ ID NO: 809935 - protein, 125 aa, Homo sapiens
AGITSASHHTRLALILNLTAYLLYPHLQPTTFSQNSTIIQFQMPTVNNSITVVKGESLEPGMVRGCWAGSVAEGRWERLTTVPTPRVYSGLPGTHDHRHPPGLPRPLARHSGPALHPPLNSYSPE

SEQ ID NO: 809936 - protein, 275 aa, Homo sapiens
MSMAVETFGFFMATVGLLMLGVTLPNSYWRVSTVHGNVITTNTIFENLWFSCATDSLGVYNCWEFPSMLALSGSTDSPASLSGGTGLLVRLMSIKGPCEGRRLASCRLSVRCKEAVLCAGYIQACRALMITAILLGFLGLLLGIAGLRCTNIGGLELSRKAKLAATAGALHILAGICGMVAISWYAFNITRDFFDPLYPGTKYELGPALYLGWSASLISILGGLCLCSACCCGSDEDPAASARRPYQAPVSVMPVATSDQEGDSSFGKYGRNAYV

SEQ ID NO: 809937 - protein, 275 aa, Homo sapiens; identical to SEQ ID NO: 809936

SEQ ID NO: 809938 - protein, 228 aa, Homo sapiens; identical to SEQ ID NO: 809934

SEQ ID NO: 809939 - protein, 258 aa, Homo sapiens
MSMAVETFGFFMATVGLLMLGVTLPNSYWRVSTVHGNVITTNTIFENLWFSCATDSLGVYNCWEFPSMLALSGSTDSPASLSGGTGLLVRLMSIKGPCEGRRLASCRLSVRCKEAVLCAGYIQACRALMITAILLGFLGLLLGIAGLRCTNIGGLELSRKAKLAATAGALHILAGNWGKVMGRGSPSTADFRLLCPHLISSPIPTPHAHLPYPAAWTPAHPCLICTPQISWLQISPSAVFLELPVGAGHGQVWEGLRR

SEQ ID NO: 809940 - protein, 258 aa, Homo sapiens; identical to SEQ ID NO: 809939

SEQ ID NO: 809941 - protein, 140 aa, Homo sapiens [sequence omitted]

SEQ ID NO: 809942 - protein, 534 aa, Homo sapiens
RPQVPHAPGRAAASWASWGQTQPFPAASARPGALGAVRAPLPRESLKREPASCLPGAMEAVELARKLQEEATCSICLDYFTDPVMTTCGHNFCRACIQLSWEKARGKKGRRKRKGSFPCPECREMSPQRNLLPNRLLTKVAEMAQQHPGLQKQDLCQEHHEPLKLFCQKDQSPICVVCRESREHRLHRVLPAEEAVQGYKLKLEEDMEYLREQITRTGNLQAREEQSLAEWQGKVKERRERIVLEFEKMNLYLVEEEQRLLQALETEEEETASRLRESVACLDRQGHSLELLLLQLEERSTQGPLQMLQDMKEPLSRKNNVSVQCPEVAPPTRPRTVCRVPGQIEVLRGFLEDVVPDATSAYPYLLLYESRQRRYLGSSPEGSGFCSKDRFVAYPCAVGQTAFSSGRHYWEVGMNITGDALWALGVCRDNVSRKDRVPKCPENGFWVVQLSKGTKYLSTFSALTPVMLMEPPSHMGIFLDFEAGEVSFYSVSDGSHLHTYSQATFPGPLQPFFCLGAPKSGQMVISTVTMWVKG

SEQ ID NO: 809943 - protein, 144 aa, Homo sapiens
VLRLSRGSRLGSSHGERHYWEVGMNITGDALWALGVCRDNVSRKDRVPKCPENGFWVVQLSKGTKYLSTFSALTPVMLMEPPSHMGIFLDFEAGEVSFYSVSDGSHLHTYSQATFPGPLQPFFCLGAPKSGQMVISTVTMWVKG

SEQ ID NO: 809944 - protein, 56 aa, Homo sapiens
MEAVELARKLQEEATCSICLDYFTDPVMTTCGHNFCRACIQLTVVQARQVNSEEDS

SEQ ID NO: 809945 - protein, 522 aa, Homo sapiens
RPQVPHAPGRAAASWASWGQTQPFPAASARPGALGAVRAPLPRGAMEAVELARKLQEEATCSICLDYFTDPVMTTCGHNFCRACIQLSWEKARGKKGRRKRKGSFPCPECREMSPQRNLLPNRLLTKVAEMAQQHPGLQKQDLCQEHHEPLKLFCQKDQSPICVVCRESREHRLHRVLPAEEAVQGYKLKLEEDMEYLREQITRTGNLQAREEQSLAEWQGKVKERRERIVLEFEKMNLYLVEEEQRLLQALETEEEETASRLRESVACLDRQGHSLELLLLQLEERSTQGPLQMLQDMKEPLSRKNNVSVQCPEVAPPTRPRTVCRVPGQIEVLRGFLEDVVPDATSAYPYLLLYESRQRRYLGSSPEGSGFCSKDRFVAYPCAVGQTAFSSGRHYWEVGMNITGDALWALGVCRDNVSRKDRVPKCPENGFWVVQLSKGTKYLSTFSALTPVMLMEPPSHMGIFLDFEAGEVSFYSVSDGSHLHTYSQATFPGPLQPFFCLGAPKSGQMVISTVTMWVKG

SEQ ID NO: 809946 - protein, 496 aa, Homo sapiens
RPQVPHAPGRAAASWASWGQTQPFPAASARPGALGAVRAPLPRDPVMTTCGHNFCRACIQLSWEKARGKKGRRKRKGSFPCPECREMSPQRNLLPNRLLTKVAEMAQQHPGLQKQDLCQEHHEPLKLFCQKDQSPICVVCRESREHRLHRVLPAEEAVQGYKLKLEEDMEYLREQITRTGNLQAREEQSLAEWQGKVKERRERIVLEFEKMNLYLVEEEQRLLQALETEEEETASRLRESVACLDRQGHSLELLLLQLEERSTQGPLQMLQDMKEPLSRKNNVSVQCPEVAPPTRPRTVCRVPGQIEVLRGFLEDVVPDATSAYPYLLLYESRQRRYLGSSPEGSGFCSKDRFVAYPCAVGQTAFSSGRHYWEVGMNITGDALWALGVCRDNVSRKDRVPKCPENGFWVVQLSKGTKYLSTFSALTPVMLMEPPSHMGIFLDFEAGEVSFYSVSDGSHLHTYSQATFPGPLQPFFCLGAPKSGQMVISTVTMWVKG

SEQ ID NO: 809947 - protein, 272 aa, Homo sapiens
MKGKKGIVAASGSETEDEDSMDIPLDLSSSAGSGKRRRRGNLPKESVQILRDWLYEHRYNAYPSEQEKALLSQQTHLSTLQVCNWFINARRRLLPDMLRKDGKDPNQFTISRRGAKISETSSVESVMGIKNFMPALEETPFHSCTAGPNPTLGRPLSPKPSSPGSVLARPSVICHTTVTALKDVPFSLCQSVGVGQNTDIQQIAAKNFTDTSLMYPEDTCKSGPSTNTQSGLFNTPPPTPPDLNQDFSGFQLLVDVALKRAAEMELQAKLTA

SEQ ID NO: 809948 - protein, 228 aa, Homo sapiens
MDIPLDLSSSAGSGKRRRRGNLPKESVQILRDWLYEHRYNAYPSEQEKALLSQQTHLSTLQVCNWFINARRRLLPDMLRKDGKDPNQFTISRRGAKISETSSVESVMGIKNFMPALEETPFHSCTAGPNPTLGRPLSPKPSSPGSVLARPSVICHTTVTALKDVPFSLCQSVGVGQNTDIQQIAAKNFTDTSLMYPEDTCKSGPSTNTQSGLSNSPLIHGLPDSVGSV

SEQ ID NO: 809949 - protein, 167 aa, Homo sapiens
MDIPLDLSSSAGSGKRRRRGNLPKESVQILRDWLYEHRYNAYPSEQEKALLSQQTHLSTLQVCNWFINARRRLLPDMLRKDGKDPNQFTISRRGAKISETSSVESVMGIKNFMPALEETPFHSCTAGPNPTLGRPLSPKPSSPGSVLARPSVICHTTVTALKDVPFS

SEQ ID NO: 809950 - protein, 167 aa, Homo sapiens; identical to SEQ ID NO: 809949

SEQ ID NO: 809951 - protein, 167 aa, Homo sapiens; identical to SEQ ID NO: 809949

SEQ ID NO: 809952 - protein, 50 aa, Homo sapiens
TPPPTPPDLNQDFSGFQLLVDVALKRAAEMELQASGVGQASGVGQASGVG

SEQ ID NO: 809953 - protein, 272 aa, Homo sapiens; identical to SEQ ID NO: 809947

SEQ ID NO: 809954 - protein, 272 aa, Homo sapiens; identical to SEQ ID NO: 809947

SEQ ID NO: 809955 - protein, 443 aa, Homo sapiens
SPPPHPRRPPTVAAGGRAPGGEGCAAPRPRVNGSRAFWKNFRTKRTLASPGKKGPREKPGALGWCPHRRARDAGGPCAAGGKDRVSGPGHPPRPHRRPRGTSDSGRRARSSLPGWKRAPGIRASCLAITAGARPTSYGRVGCEGDVRLSPVSPLLAPPDPRLASRWEGRSRMKGKKGIVAASGSETEDEDSMDIPLDLSSSAGSGKRRRRGNLPKESVQILRDWLYEHRYNAYPSEQEKALLSQQTHLSTLQVCNWFINARRRLLPDMLRKDGKDPNQFTISRRGAKISETSSVESVMGIKNFMPALEETPFHSCTAGPNPTLGRPLSPKPSSPGSVLARPSVICHTTVTALKDVPFSLCQSVGVGQNTDIQQIAAKNFTDTSLMYPEDTCKSGPSTNTQSGLFNTPPPTPPDLNQDFSGFQLLVDVALKRAAEMELQAKLTA

SEQ ID NO: 809956 - protein, 252 aa, Homo sapiens; identical to SEQ ID NO: 743368

SEQ ID NO: 809957 - protein, 252 aa, Homo sapiens; identical to SEQ ID NO: 743368

SEQ ID NO: 809958 - protein, 323 aa, Homo sapiens
QWGCIYGSGWAVSFRYITELCQCFSLECLASFNNRLDMTCSGKSCALARSSLTSSQGIVAASGSETEDEDSMDIPLDLSSSAGSGKRRRRGNLPKESVQILRDWLYEHRYNAYPSEQEKALLSQQTHLSTLQVCNWFINARRRLLPDMLRKDGKDPNQFTISRRGAKISETSSVESVMGIKNFMPALEETPFHSCTAGPNPTLGRPLSPKPSSPGSVLARPSVICHTTVTALKDVPFSLCQSVGVGQNTDIQQIAAKNFTDTSLMYPEDTCKSGPSTNTQSGLFNTPPPTPPDLNQDFSGFQLLVDVALKRAAEMELQAKLTA

SEQ ID NO: 809959 - protein, 175 aa, Homo sapiens
MRKDGKDPNQFTISRRGAKISETSSVESVMGIKNFMPALEETPFHSCTAGPNPTLGRPLSPKPSSPGSVLARPSVICHTTVTALKDVPFSLCQSVGVGQNTDIQQIAAKNFTDTSLMYPEDTCKSGPSTNTQSGLFNTPPPTPPDLNQDFSGFQLLVDVALKRAAEMELQAKLTA

SEQ ID NO: 809960 - protein, 320 aa, Homo sapiens
MVLAQSRVSAGVGSPHCSGSGGGGSDSFPWPASHPGNPQCSFSTAFLASPRLSRGTLAYLPPAPWSSLATPSALLGSSCAPPPPPARCPQPRALSPELGTKLGPAGRIGGNFRGPHPRAHRVQLLGADSWKQGKVLLQHLAVRLRMRKDGKDPNQFTISRRGAKISETSSVESVMGIKNFMPALEETPFHSCTAGPNPTLGRPLSPKPSSPGSVLARPSVICHTTVTALKDVPFSLCQSVGVGQNTDIQQIAAKNFTDTSLMYPEDTCKSGPSTNTQSGLFNTPPPTPPDLNQDFSGFQLLVDVALKRAAEMELQAKLTA

SEQ ID NO: 809961 - protein, 360 aa, Homo sapiens
MVTQILGAMESQVGGGPAGPALPNGPLLGTNGATDDSKTNLIVNYLPQNMTQDEFKSLFGSIGDIESCKLVRDKITGQSLGYGFVNYSDPNDADKAINTLNGLKLQTKTIKVSYARPSSASIRDANLYVSGLPKTMSQKEMEQLFSQYGRIITSRILVDQVTGVSRGVGFIRFDKRIEAEEAIKGLNGQKPLGAAEPITVKFANNPSQKTGQALLTHLYQSSARRYAGPLHHQTQRFRLDNLLNMAYGVKRFSPIAIDGMSGLAGVGLSGGAAGAGWCIFVYNLSPEADESVLWQLFGPFGAVTNVKVIRDFTTNKCKGFGFVTMTNYDEAAMAIASLNGYRLGERVLQVSFKTSKQHKA

SEQ ID NO: 809962 - protein, 367 aa, Homo sapiens
MVTQILGAMESQVGGGPAGPALPNGPLLGTNGATDDSKTNLIVNYLPQNMTQDEFKSLFGSIGDIESCKLVRDKITGQSLGYGFVNYSDPNDADKAINTLNGLKLQTKTIKVSYARPSSASIRDANLYVSGLPKTMSQKEMEQLFSQYGRIITSRILVDQVTGVSRGVGFIRFDKRIEAEEAIKGLNGQKPLGAAEPITVKFANNPSQKTGQALLTHLYQSSARRYAGPLHHQTQRFRLDNLLNMAYGVKSPLSLIARFSPIAIDGMSGLAGVGLSGGAAGAGWCIFVYNLSPEADESVLWQLFGPFGAVTNVKVIRDFTTNKCKGFGFVTMTNYDEAAMAIASLNGYRLGERVLQVSFKTSKQHKA

SEQ ID NO: 809963 - protein, 367 aa, Homo sapiens; identical to SEQ ID NO: 809962

SEQ ID NO: 809964 - protein, 350 aa, Homo sapiens
MVTQILGAMESQVGGGPAGPALPNGPLLGTNGATDDSKTNLIVNYLPQNMTQDEFKSLFGSIGDIESCKLVRDKITDKAINTLNGLKLQTKTIKVSYARPSSASIRDANLYVSGLPKTMSQKEMEQLFSQYGRIITSRILVDQVTGVSRGVGFIRFDKRIEAEEAIKGLNGQKPLGAAEPITVKFANNPSQKTGQALLTHLYQSSARRYAGPLHHQTQRFRLDNLLNMAYGVKSPLSLIARFSPIAIDGMSGLAGVGLSGGAAGAGWCIFVYNLSPEADESVLWQLFGPFGAVTNVKVIRDFTTNKCKGFGFVTMTNYDEAAMAIASLNGYRLGERVLQVSFKTSKQHKA

SEQ ID NO: 809965 - protein, 135 aa, Homo sapiens
APPHVTPTAPWPLIGRSWQSRASRAPGSMQPAPCGCRVLGNSGSACKAVVSRNENEGRPGIGSPKREQHGLSRWLMPVFPALWEAKAGRSLEPRSLRPSWTSLQASGKQAIVWQRPRWQGTKGGFWPTASEDLRP

SEQ ID NO: 809966 - protein, 243 aa, Homo sapiens
RGGRRLLGGSAAPGPRAAMLGLDACELGAQLLELLRLALCARVLLADKEGGPPAVDEVLDEAVPEYRAPGRKSLLEIRQLDPDDRSLAKYKRVLLGPLPPAVDPSLPNVQVTRLTLLSEQAPGPVVMDLTGDLAVLKDQVFVLKEGVDYRVKISFKVHREIVSGLKCLHHTYRRGLRVDKTVYMVGSYGPSAQEYEFVTPVEEAPRGALVRGPYLVVSLFTDDDRTHHLSWEWGLCICQDWKD

SEQ ID NO: 809967 - protein, 176 aa, Homo sapiens
MRLCPSTGRRGGRASWRSGSWTRTTGAWPSTSGCCWGPCHRPWVTRLTLLSEQAPGPVVMDLTGDLAVLKDQVFVLKEGVDYRVKISFKVHREIVSGLKCLHHTYRRGLRVDKTVYMVGSYGPSAQEYEFVTPVEEAPRGALVRGPYLVVSLFTDDDRTHHLSWEWGLCICQDWKD

SEQ ID NO: 809968 - protein, 227 aa, Homo sapiens
AAPTPRLGSGRGGGLHPGSSPVGKGPVLLADKEGGPPAVDEVLDEAVPEYRAPGRKSLLEIRQLDPDDRSLAKYKRVLLGPLPPAVDPSLPNVQVTRLTLLSEQAPGPVVMDLTGDLAVLKDQVFVLKEGVDYRVKISFKVHREIVSGLKCLHHTYRRGLRVDKTVYMVGSYGPSAQEYEFVTPVEEAPRGALVRGPYLVVSLFTDDDRTHHLSWEWGLCICQDWKD

SEQ ID NO: 809969 - protein, 328 aa, Homo sapiens
NFLLTPPAPTTSSCFPSMRQRADRRSMVSTSGAATASSAAGPSRGAAHSPSSAPHASRHRPPFSSRATGLLQQRQHCVHHCTQLCPRVQTPCLPPPPAPATELHSYLQQGGERGLLDTTPVQGSRLAKNVQLTENEIRGLCLKSREIFLDQPILLELEAPLKICGDIYTATYYEPSCRLIELWPRFPPESNYLFLGDYVGQEAKQFLGDHLPACWPYKIKVPRRTLFLLRGNHECARIPPRSMGYVRMQCKEDATTIHTCWQQPVQLTLLSTCTCPIRGPLAGRITILLGCQRRACSPGNCSSTWSQTQTGLHAGAHDASYTVRLLCY

SEQ ID NO: 809970 - protein, 357 aa, Homo sapiens
PYQSRKPAVRALTSPQSQPPTPGHLGPRVPPALSPPPRGSDKMYQVPLPLDRDGTLVRLRFTMVALVTVCCPLVAFLFCILWSLLFHFKETTATHCGATPCRMFSAASQPLDPDGTLFRLRFTAMVWWAITFPVFGFFFCIIWSLVFHFEYTVATDCGVPNYLPSVSSAIGGEVPQRYVWRFCIGLHSAPRFLVAFAYWNHYLSCTSPCSCYRPLCRLNFGLNVVENLALLVLTYVSSSEDFTIHENAFIVFIASSLGHMLLTCILWRLTKKHTVSQEDRKSYSWKQRLFIINFISFFSALAVYFRHNMYCEAGVYTIFAILEYTVVLTNMAFHMTAWWDFGNKELLITSQPEEKRF

SEQ ID NO: 809971 - protein, 311 aa, Homo sapiens
MARLGSTGGVSGRVVTQHRDSAPFLGAARLGLRELGPIRGTAPEWHGRWNAAERSDKMYQVPLPLDRDGTLVRLRFTMVALVTVCCPLVAFLFCILWSLLFHFKETTATHCGVPNYLPSVSSAIGGEVPQRYVWRFCIGLHSAPRFLVAFAYWNHYLSCTSPCSCYRPLCRLNFGLNVVENLALLVLTYVSSSEDFTIHENAFIVFIASSLGHMLLTCILWRLTKKHTVSQEDRKSYSWKQRLFIINFISFFSALAVYFRHNMYCEAGVYTIFAILEYTVVLTNMAFHMTAWWDFGNKELLITSQPEEKRF

SEQ ID NO: 809972 - protein, 231 aa, Homo sapiens
MLLHKSQDSWGMRIQHFGPRTWKERSFGRGMGTSEGGLLGRGGAGAEARVILSDGEKVLHMGGAGRGRCPDRSQLSVPNYLPSVSSAIGGEVPQRYVWRFCIGLHSAPRFLVAFAYWNHYLSCTSPCSCYRPLCRLNFGLNVVENLALLVLTYVSSSEDFSGCLDEGGVGKCSLRGRACPYHIRTFLLRGVGTPCNVAPNPLSLQPSTKMLSLCSLPHPSGTCSSPAFSGG

SEQ ID NO: 809973 - protein, 294 aa, Homo sapiens
MVDGTQLRGLTRCTRSHYHWIGMGPWYGSASPWWPWSRSAVHLSPSSSASSGPCSSTSRRQRPHTVGTEASIGVPGIKMDGGDAQEHGHFLRLPQVPNYLPSVSSAIGGEVPQRYVWRFCIGLHSAPRFLVAFAYWNHYLSCTSPCSCYRPLCRLNFGLNVVENLALLVLTYVSSSEDFTIHENAFIVFIASSLGHMLLTCILWRLTKKHTVSQEDRKSYSWKQRLFIINFISFFSALAVYFRHNMYCEAGVYTIFAILEYTVVLTNMAFHMTAWWDFGNKELLITSQPEEKRF

SEQ ID NO: 809974 - protein, 161 aa, Homo sapiens
MVDGTQLRGAQLPALGELSHRRGGAPALRVAFLHRPALGASLLGGLRLLEPLPQLHLPVFLLSPALPPQLRPQCRGEPRVASAHLCLLLRGLHHPRKCFHCVHCLIPRAHAPHLHSLAVDQEAHSKSGGSQVLQLETAALHHQLHLLLLGAGCLLSAQHVL

SEQ ID NO: 809975 - protein, 277 aa, Homo sapiens
RTHASGTAPEWHGRWNAAERSDKMYQVPLPLDRDGTLVRLRFTMVALVTVCCPLVAFLFCILWSLLFHFKETTATHCGVPNYLPSVSSAIGGEVPQRYVWRFCIGLHSAPRFLVAFAYWNHYLSCTSPCSCYRPLCRLNFGLNVVENLALLVLTYVSSSEDFTIHENAFIVFIASSLGHMLLTCILWRLTKKHTVSQEDRKSYSWKQRLFIINFISFFSALAVYFRHNMYCEAGVYTIFAILEYTVVLTNMAFHMTAWWDFGNKELLITSQPEEKRF

SEQ ID NO: 809976 - protein, 234 aa, Homo sapiens
PYQSRKPAVRALTSPQSQPPTPGHLGPRVPPALSPPPRGQVPVCGGDGEGATMLLHKSQDSWGMRIQHFGPRTWKERSFGRGAQLPALGELSHRRGGAPALRVAFLHRPALGASLLGGLRLLEPLPQLHLPVFLLSPALPPQLRPQCRGEPRVASAHLCLLLRGLHHPRKCFHCVHCLIPRAHAPHLHSLAVDQEAHSKSGGSQVLQLETAALHHQLHLLLLGAGCLLSAQHVL

SEQ ID NO: 809977 - protein, 296 aa, Homo sapiens
PYQSRKPAVRALTSPQSQPPTPGHLGPRVPPALSPPPRGSDKMYQVPLPLDRDGTLVRLRFTMVALVTVCCPLVAFLFCILWSLLFHFKETTATHCGVPNYLPSVSSAIGGEVPQRYVWRFCIGLHSAPRFLVAFAYWNHYLSCTSPCSCYRPLCRLNFGLNVVENLALLVLTYVSSSEDFTIHENAFIVFIASSLGHMLLTCILWRLTKKHTVSQEDRKSYSWKQRLFIINFISFFSALAVYFRHNMYCEAGVYTIFAILEYTVVLTNMAFHMTAWWDFGNKELLITSQPEEKRF

SEQ ID NO: 809978 - protein, 211 aa, Homo sapiens
MVEMHKNMVISLDYPRQVPVCGGDGEGATMLLHKSQDSWGMRIQHFGPRTWKERSFGRGAQLPALGELSHRRGGAPALRVAFLHRPALGASLLGGLRLLEPLPQLHLPVFLLSPALPPQLRPQCRGEPRVASAHLCLLLRGLHHPRKCFHCVHCLIPRAHAPHLHSLAVDQEAHSKSGGSQVLQLETAALHHQLHLLLLGAGCLLSAQHVL

SEQ ID NO: 809979 - protein, 255 aa, Homo sapiens
MFSAASQPLDPDGTLFRLRFTAMVWWAITFPVFGFFFCIIWSLVFHFEYTVATDCGVPNYLPSVSSAIGGEVPQRYVWRFCIGLHSAPRFLVAFAYWNHYLSCTSPCSCYRPLCRLNFGLNVVENLALLVLTYVSSSEDFTIHENAFIVFIASSLGHMLLTCILWRLTKKHTVSQEDRKSYSWKQRLFIINFISFFSALAVYFRHNMYCEAGVYTIFAILEYTVVLTNMAFHMTAWWDFGNKELLITSQPEEKRF

SEQ ID NO: 809980 - protein, 308 aa, Homo sapiens
MARLGSTGGVSGRVVTQHRDSAPFLGAARLGLRELGPIRGTAPEWHGRWNAAERSDKMYQVPLPLDRDGTLVRLRFTMVALVTVCCPLVAFLFCILWSLLFHFKETTATHCGVPNYLPSVSSAIGGEVPQRYVWRFCIGLHSAPRFLVAFAYWNHYLSCTSPCSCYRPLCRLNFGLNVVENLALLVLTYVSSSEDFTIHENAFIVFIASSLGHMLLTCILWRLTKKHTVSQEEVRSIPSGGSKAAQKKIKDICPQDSGKIASPTAGNSGSSSSTSSPSSRRWLSTFGTTCIVRLECTPSLPSWSTLLS

SEQ ID NO: 809981 - protein, 138 aa, Homo sapiens
MARLGSTGGVSGRVVTQHRDSAPFLGAARLGLRELGPIRGTAPEWHGRWNAAERSDKMYQVPLPLDRDGTLVRLRFTMVALVTVCCPLVAFLFCILWSLLFHFKETTATHCGPSTKMLSLCSLPHPSGTCSSPAFSGG

SEQ ID NO: 809982 - protein, 331 aa, Homo sapiens
MGPWYGSASPWWPWSRSAVHLSPSSSASSGPCSSTSRRQRPHTVGQVPVCGGDGEGATMLLHKSQDSWGMRIQHFGPRTWKERSFGRGAQLPALGELSHRRGGAPALRVAFLHRPALGASLLGGLRLLEPLPQLHLPVFLLSPALPPQLRPQCRGEPRVASAHLCLLLRGLQWVPGGGRSGEVFPEGTGLPLPHSDLPTSWCGHSLQCGSQSSFPPAIHENAFIVFIASSLGHMLLTCILWRLTKKHTVSQEDRKSYSWKQRLFIINFISFFSALAVYFRHNMYCEAGVYTIFAILEYTVVLTNMAFHMTAWWDFGNKELLITSQPEEKRF

SEQ ID NO: 809983 - protein, 134 aa, Homo sapiens
GPTRPGRPQNGMVDGTQLRAIHENAFIVFIASSLGHMLLTCILWRLTKKHTVSQEDRKSYSWKQRLFIINFISFFSALAVYFRHNMYCEAGVYTIFAILEYTVVLTNMAFHMTAWWDFGNKELLITSQPEEKRF

SEQ ID NO: 809984 - protein, 137 aa, Homo sapiens
MARLGSTGGVSGRVVTQHRDSAPFLGAARLGLRELGPIRGTAPEWHAWNAAERSDKMYQVPLPLDRDGTLVRLRFTMVALVTVCCPLVAFLFCILWSLLFHFKETTATHCGPSTKMLSLCSLPHPSGTCSSPAFSGG

SEQ ID NO: 809985 - protein, 265 aa, Homo sapiens
MARLGSTGGVSGRVVTQHRDSAPFLGAARLGLRELGPIRGTAPEWHAWNAAERSDKMYQVPLPLDRDGTLVRLRFTMVALVTVCCPLVAFLFCILWSLLFHFKETTATHCGVPNYLPSVSSAIGGEVPQRYVWRFCIGLHSAPRFLVAFAYWNHYLSCTSPCSCYRPLCRLNFGLNVVENLALLVLTYVSSSEDFTIHENAFIVFIASSLGHMLLTCILWRLTKKHTVSQEEVRSIPSGGSKAAQKKIKDICPQDSGNGEVGTEF

SEQ ID NO: 809986 - protein, 193 aa, Homo sapiens
ALPIAKTRRSRSDQPAEPAPDPGPPGPPGSAGTLATTAWVPNYLPSVSSAIGGEVPQRYVWRFCIGLHSAPRFLVAFAYWNHYLSCTSPCSCYRPLCRLNFGLNVVENLALLVLTYVSSSEDFTIHENAFIVFIASSLGHMLLTCILWRLTKKHTVSQEEVRSIPSGGSKAAQKKIKDICPQDSGNGEVGTEF

SEQ ID NO: 809987 - protein, 197 aa, Homo sapiens
MVPNYLPSVSSAIGGEVPQRYVWRFCIGLHSAPRFLVAFAYWNHYLSCTSPCSCYRPLCRLNFGLNVVENLALLVLTYVSSSEDFTIHENAFIVFIASSLGHMLLTCILWRLTKKHTVSQEEVRSIPSGGSKAAQKKIKDICPQDSGKIASPTAGNSGSSSSTSSPSSRRWLSTFGTTCIVRLECTPSLPSWSTLLS

SEQ ID NO: 809988 - protein, 120 aa, Homo sapiens
HEDGTQLRAIHENAFIVFIASSLGHMLLTCILWRLTKKHTVSQEEVRSIPSGGSKAAQKKIKDICPQDSGKIASPTAGNSGSSSSTSSPSSRRWLSTFGTTCIVRLECTPSLPSWSTLLS

SEQ ID NO: 809989 - protein, 311 aa, Homo sapiens; identical to SEQ ID NO: 809971

SEQ ID NO: 809990 - protein, 311 aa, Homo sapiens; identical to SEQ ID NO: 809971

SEQ ID NO: 809991 - protein, 311 aa, Homo sapiens; identical to SEQ ID NO: 809971

SEQ ID NO: 809992 - protein, 138 aa, Homo sapiens; identical to SEQ ID NO: 809981

SEQ ID NO: 809993 - protein, 251 aa, Homo sapiens
RVTVKGAAMARLWGALSLWPLWAAVPWGGAAAVGVRACSSTAAPDGVEGPALRRSYWRHLRRLVLGPPEPPFSHVCQVGDPVLRGVAAPVERAQLGGPELQRLTQRLVQVMRRRRCVGLSAPQLGVPRQVLALELPEALCRECPPRQRALRQMEPFPLRVFVNPSLRVLDSRLVTFPEGCESVAGFLACVPRFQAVQISGLDPNGEQVVWQASGWAARIIQHEMDHLQGCLFIDKMDSRTFTNVYWMKVND

SEQ ID NO: 809994 - protein, 83 aa, Homo sapiens
GKRQPPPTHPHPTPTPNPPPSPPTHPPLPPRGLDPNGEQVVWQASGWAARIIQHEMDHLQGCLFIDKMDSRTFTNVYWMKVND

SEQ ID NO: 809995 - protein, 631 aa, Homo sapiens
SSESAPLVVRKGSDVVAGKMATAATIPSVATATAAALGEVEDEGLLASLFRDRFPEAQWRERPDVGRYLRELSGSGLERLRREPERLAEERAQLLQQTRDLAFANYKTFIRGAECTERIHRLFGDVEASLGRLLDRLPSFQQSCRNFVKEAEEISSNRRMNSLTLNRHTEILEILEIPQLMDTCVRNSYYEEALELAAYVRRLERKYSSIPVIQGIVNEVRQSMQLMLSQLIQQLRTNIQLPACLRVIGYLRRMDVFTEAELRVKFLQARDAWLRSILTAIPNDDPYFHITKTIEASRVHLFDIITQYRAIFSDEDPLLPPAMGEHTVNESAIFHGWVLQKVSQFLQVLETDLYRGIGGHLDSLLGQCMYFGLSFSRVGADFRGQLAPVFQRVAISTFQKAIQETVEKFQEEMNSYMLISAPAILGTSNMPAAVPATQPGTLQPPMVLLDFPPLACFLNNILVAFNDLRLCCPVALAQDVTGALEDALAKVTKIILAFHRAEEAAFSSGEQELFVQFCTVFLEDLVPYLNRCLQVLFPPAQIAQTLGIPPTQLSKYGNLGHVNIGAIQEPLAFILPKRETLFTLDDQALGPELTAPAPEPPAEEPRLEPAGPACPEGGRAETQAEPPSVGP

SEQ ID NO: 809996 - protein, 472 aa, Homo sapiens
MNSLTLNRHTEILEILEIPQLMDTCVRNSYYEEALELAAYVRRLERKYSSIPVIQGIVNEVRQSMQLMLSQLIQQLRTNIQLPACLRVIGYLRRMDVFTEAELRVKFLQARDAWLRSILTAIPNDDPYFHITKTIEASRVHLFDIITQYRAIFSDEDPLLPPAMGEHTVNESAIFHGWVLQKVSQFLQVLETDLYRGIGGHLDSLLGQCMYFGLSFSRVGADFRGQLAPVFQRVAISTFQKAIQETVEKFQEEMNSYMLISAPAILGTSNMPAAVPATQPGTLQPPMVLLDFPPLACFLNNILVAFNDLRLCCPVALAQDVTGALEDALAKVTKIILAFHRAEEAAFSSGEQELFVQFCTVFLEDLVPYLNRCLQVLFPPAQIAQTLGIPPTQLSKYGNLGHVNIGAIQEPLAFILPKRETLFTLDDQALGPELTAPAPEPPAEEPRLEPAGPACPEGGRAETQAEPPSVGP

SEQ ID NO: 809997 - protein, 537 aa, Homo sapiens
SSESAPLVVRKGSDVVAGKMATAATIPSVATATAAALGEVEDEGLLASLFRDRFPEAQWRERPDVGRYLRELSGSGLERLRREPERLAEERAQLLQQTRDLAFANYKTFIRGAECTERIHRLFGDVEASLGRLLDRLPSFQQSCRNFVKEAEEISSNRRMNSLTLNRHTEILEILEIPQLMDTCVRNSYYEEALELAAYVRRLERKYSSIPVIQGIVNEVRQSMQLMLSQLIQQLRTNIQLPACLRVIGYLRRMDVFTEAELRVKFLQARDAWLRSILTAIPNDDPYFHITKTIEASRVHLFDIITQYRAIFSDEDPLLPPAMGEHTVNESAIFHGWVLQKVSQFLQVLETDLYRGIGGHLDSLLGQCMYFGLSFSRVGADFRGQLAPVFQRVAISTFQKAIQETVEKFQEEMNSYMLISAPAILGTSNMPAAVPATQPGTLQPPMVLLDFPPLACFLNNILVAFNDLRLCCPVALAQDVTGALEDALAKGWTPMENRWCGRRAGGQPASSSTRWTTCRAACLLTKWTAGRSQTSIG

SEQ ID NO: 809998 - protein, 472 aa, Homo sapiens; identical to SEQ ID NO: 809996

SEQ ID NO: 809999 - protein, 553 aa, Homo sapiens
SSESAPLVVRKGSDVVAGKMATAATIPSVATATAAALGEVEDEGLLASLFRDRFPEAQWRERPDVGRYLRELSGSGLERLRREPERLAEERAQLLQQTRDLAFANYKTFIRGAECTERIHRLFGDVEASLGRLLDRLPSFQQSCRNFVKEAEEISSNRRMNSLTLNRHTEILEILEIPQLMDTCVRNSYYEEALELAAYVRRLERKYSSIPVIQGIVNEVRQSMQLMLSQLIQQLRTNIQLPACLRVIGYLRRMDVFTEAELRVKFLQARDAWLRSILTAIPNDDPYFHITKTIEASRVHLFDIITQYRAIFSDEDPLLPPAMGEHTVNESAIFHGWVLQKVSQFLQVLETDLYRGIGGHLDSLLGQCMYFGLSFSRVGADFRGQLAPVFQRVAISTFQKAIQETVEKFQEEMNSYMLISAPAILGTSNMPAAVPATQPGTLQPPMVLLDFPPLACFLNNILVAFNDLRLCCPVALAQDVTGALEDALAKVTKIILAFHRAEEAAFSSGEQELFVQFCTVFLEDLVPYLNRCLQVLFPPAQIAQTLGKRMKIL

SEQ ID NO: 810000 - protein, 553 aa, Homo sapiens; identical to SEQ ID NO: 809999

SEQ ID NO: 810001 - protein, 505 aa, Homo sapiens
SSESAPLVVRKGSDVVAGKMATAATIPSVATATAAALGEVEDEGLLASLFRDRFPEAQWRERPDVGRYLRELSGSGLERLRREPERLAEERAQLLQQTRDLAFANYKTFIRGAECTERIHRLFGDVEASLGRLLDRLPSFQQSCRNFVKEAEEISSNRRMNSLTLNRHTEILEILEIPQLMDTCVRNSYYEEALELAAYVRRLERKYSSIPVIQGIVNEVRQSMQLMLSQLIQQLRTNIQLPACLRVIGYLRRMDVFTEAELRVKFLQARDAWLRSILTAIPNDDPYFHITKTIEASRVHLFDIITQYRAIFSDEDPLLPPAMGEHTVNESAIFHGWVLQKVSQFLQVLETDLYRGIGGHLDSLLGQCMYFGLSFSRVGADFRGQLAPVFQRVAISTFQKAIQETVEKFQEEMNSYMLISAPAILGTSNMPAAVPATQPGTLQPPMVLLDFPPLACFLNNILVAFNDLRLCCPVALAQDVTGALEDALAKVSTFCWFSATLGLLW

SEQ ID NO: 810002 - protein, 424 aa, Homo sapiens
SSESAPLVVRKGSDVVAGKMATAATIPSVATATAAALGEVEDEGLLASLFRDRFPEAQWRERPDVGRYLRELSGSGLERLRREPERLAEERAQLLQQTRDLAFANYKTFIRGAECTERIHRLFGDVEASLGRLLDRLPSFQQSCRNFVKEAEEISSNRRMNSLTLNRHTEILEILEIPQLMDTCVRNSYYEEALELAAYVRRLERKYSSIPVIQGIVNEVRQSMQLMLSQLIQQLRTNIQLPACLRVIGYLRRMDVFTEAELRVKFLQARDAWLRSILTAIPNDDPYFHITKTIEASRVHLFDIITQYRAIFSDEDPLLPPAMGEHTVNESAIFHGWVLQKVSQFLQVLETDLYRGIGGHLDSLLGQCMYFGLSFSRVGADFRGQLAPVFQRVAISTFQKANLTWHQLGWLAYDRKLDCQGMAD

SEQ ID NO: 810003 - protein, 273 aa, Homo sapiens
SSESAPLVVRKGSDVVAGKMATAATIPSVATATAAALGEVEDEGLLASLFRDRFPEAQWRERPDVGRYLRELSGSGLERLRREPERLAEERAQLLQQTRDLAFANYKTFIRGAECTERIHRLFGDVEASLGRLLDRLPSFQQSCRNFVKEAEEISSNRRMNSLTLNRHTEILEILEIPQLMDTCVRNSYYEEALELAAYVRRLERKYSSIPVIQGIVNEVRQSMQLMLSQLIQQLRTNIQLPACLRVIGYLRRMDVFTIAQVKQLLTLLPKVL

SEQ ID NO: 810004 - protein, 109 aa, Homo sapiens
MTGSFLRPPKKLSRCQHCASCTACRTGTSGGIPSPSGWVQAVPLVPWICNSRRKIMSQHCGKMSLCPSDQSLRLGREVKLETAEWIFSSRSTFKENKGFCDQYFMSNIL

SEQ ID NO: 810005 - protein, 79 aa, Homo sapiens
VNATSSYSHLRAVTETVSSVPPLQPFNARLPDRITCSVPAANWGGPMAVTDKGCGVRGQWARASHAACTSAGSESQRPP

SEQ ID NO: 810006 - protein, 79 aa, Homo sapiens; identical to SEQ ID NO: 810005

SEQ ID NO: 810007 - protein, 79 aa, Homo sapiens; identical to SEQ ID NO: 810005

SEQ ID NO: 810008 - protein, 105 aa, Homo sapiens
MCWIHTLEKQEIRLPEKRAVYFYRRVHPHRWTNVSGEFSHTQSRRCGRPDAQDGHSAPPSSPPLLASRVAASTRETIVPVEAARMSVIYAPSCSCKRTRASAGPT

SEQ ID NO: 810009 - protein, 79 aa, Homo sapiens; identical to SEQ ID NO: 810005

SEQ ID NO: 810010 - protein, 79 aa, Homo sapiens; identical to SEQ ID NO: 810005

SEQ ID NO: 810011 - protein, 386 aa, Homo sapiens
APPTTLPNGKSEGSVRLVGGANLCQGRVEILHSGLWGTVCDDDWGLPDAAVVCRQLGCGAAMAATTNAFFGYGTGHILLDNVHCEGGEPRLAACQSLGWGVHNCGHHEDAGALCAGLGPPTLTALPSSATREDWAWQTDPSATGVGPQPSRETALLTTAAWAAGKKSGRLRLVGGPGPCRGRVEVLHAGGWGTVCDDDWDFADARVAAAKRAAGLRWALRDEARLSDCFHLGWGQHNCGHHEDAGALCAGEADSEGPEELGLQVQQDGSETTRVPTPRPRDGHLRLVNGAHRCEGRVELYLGQRWGTVCDDAWDLRAAGVLCRQLGCGQALAAPGEAHFGPGRGPILLDNVKCRGEESALLLCSHIRWDAHNCDHSEDASVLCQPS

SEQ ID NO: 810012 - protein, 190 aa, Homo sapiens
MTGTLRTRAWPAAKRAAGLRWALRDEARLSDCFHLGWGQHNCGHHEDAGALCAGEADSEGPEELGLQVQQDGSETTRVPTPRPRDGHLRLVNGAHRCEGRVELYLGQRWGTVCDDAWDLRAAGVLCRQLGCGQALAAPGEAHFGPGRGPILLDNVKCRGEESALLLCSHIRWDAHNCDHSEDASVLCQPS

SEQ ID NO: 810013 - protein, 246 aa, Homo sapiens
APPTTLPNGKSEGSVRLVGGANLCQGRVEILHSGLWGTVCDDDWGLPDAAVVCRQLGCGAAMAATTNAFFGYGTGHILLDNVHCEGGEPRLAACQSLGWGVHNCGHHEDAGALCAGPEELGLQVQQDGSETTRVPTPRPRDGHLRLVNGAHRCEGRVELYLGQRWGTVCDDAWDLRAAGVLCRQLGCGQALAAPGEAHFGPGRGPILLDNVKCRGEESALLLCSHIRWDAHNCDHSEDASVLCQPS

SEQ ID NO: 810014 - protein, 100 aa, Homo sapiens
CDDDWDFADARVACREAGCGPALGATGLGHFGYGRGPVLLDNVGCAGTEARLSDCFHLGWGQHNCGHHEDAGALCAGEADSEGEADSGAAHCGVGGAGRR

SEQ ID NO: 810015 - protein, 515 aa, Homo sapiens
QIHITKQIFSIIWAESSLESGKGAAAENPNPKADITKYHFSKLGAQRGVIMSDVTIVKEGWVQKRGEYIKNWRPRYFLLKTDGSFIGYKEKPQDVDLPYPLNNFSVAKCQLMKTERPKPNTFIIRCLQWTTVIERTFHVDTPEEREEWTEAIQAVADRLQRQEEERMNCSPTSQIDNIGEEEMDASTTHHKRKTMNDFDYLKLLGKGTFGKVILVREKASGKYYAMKILKKEVIIAKDEVAHTLTESRVLKNTRHPFLTSLKYSFQTKDRLCFVMEYVNGGELFFHLSRERVFSEDRTRFYGAEIVSALDYLHSGKIVYRDLKLENLMLDKDGHIKITDFGLCKEGITDAATMKTFCGTPEYLAPEVLEDNDYGRAVDWWGLGVVMYEMMCGRLPFYNQDHEKLFELILMEDIKFPRTLSSDAKSLLSGLLIKDPNKRLGGGPDDAKEIMRHSFFSGVNWQDVYDKKLVPPFKPQVTSETDTRYFDEEFTAQTITITPPEKCQQSDCGMLGNWKK

SEQ ID NO: 810016 - protein, 161 aa, Homo sapiens
MGNFTHFYREEWTEAIQAVADRLQRQEEERMNCSPTSQIDNIGEEEMDASTTHHKRKTMNDFDYLKLLGKGTFGKVILVREKASGKYYAMKILKKEVIIAKDEVAHTLTESRVLKNTRHPFLTSLKYSFQTKDRLCFVMEYVNGGEMEFRSVVRLECSSTI

SEQ ID NO: 810017 - protein, 594 aa, Homo sapiens
MCGRLPFYNQDHEKLFELILMEDIKFPRTLSSDAKSLLSGLLIKDPNKRLGGGPDDAKEIMRHSFFSGVNWQDVYDKKAESSLESGKGAAAENPNPKADITKYHFSKLGAQRGVIMSDVTIVKEGWVQKRGEYIKNWRPRYFLLKTDGSFIGYKEKPQDVDLPYPLNNFSVAKCQLMKTERPKPNTFIIRCLQWTTVIERTFHVDTPEEREEWTEAIQAVADRLQRQEEERMNCSPTSQIDNIGEEEMDASTTHHKRKTMNDFDYLKLLGKGTFGKVILVREKASGKYYAMKILKKEVIIAKDEVAHTLTESRVLKNTRHPFLTSLKYSFQTKDRLCFVMEYVNGGELFFHLSRERVFSEDRTRFYGAEIVSALDYLHSGKIVYRDLKLENLMLDKDGHIKITDFGLCKEGITDAATMKTFCGTPEYLAPEVLEDNDYGRAVDWWGLGVVMYEMMCGRLPFYNQDHEKLFELILMEDIKFPRTLSSDAKSLLSGLLIKDPNKRLGGGPDDAKEIMRHSFFSGVNWQDVYDKKLVPPFKPQVTSETDTRYFDEEFTAQTITITPPEKYDEDGMDCMDNERRPHFPQFSYSASGRE

SEQ ID NO: 810018 - protein, 551 aa, Homo sapiens
MCGRLPFYNQDHEKLFELILMEDIKFPRTLSSDAKSLLSGLLIKDPNKRLGGGPDDAKEIMRHSFFSGVNWQDVYDKKAESSLESGKGAAAENPNPKADITKYHFSKLGAQRGVIMSDVTIVKEGWVQKRGEYIKNWRPRYFLLKTDGSFIGYKEKPQDVDLPYPLNNFSVAKCQLMKTERPKPNTFIIRCLQWTTVIERTFHVDTPEEREEWTEAIQAVADRLQRQEEERMNCSPTSQIDNIGEEEMDASTTHHKRKTMNDFDYLKLLGKGTFGKVILVREKASGKYYAMKILKKEVIIAKDEVAHTLTESRVLKNTRHPFLTSLKYSFQTKDRLCFVMEYVNGGELFFHLSRERVFSEDRTRFYGAEIVSALDYLHSGKIVYRDLKLENLMLDKDGHIKITDFGLCKEGITDAATMKTFCGTPEYLAPEVLEDNDYGRAVDWWGLGVVMYEMMCGRLPFYNQDHEKLFELILMEDIKFPRTLSSDAKSLLSGLLIKDPNKRLGGGPDDAKEIMRHSFFSGVNWQDVYDKKLVPPFKPQVTSWRKLAISA

SEQ ID NO: 810019 - protein, 580 aa, Homo sapiens
MCGRLPFYNQDHEKLFELILMEDIKFPRTLSSDAKSLLSGLLIKDPNKRLGGGPDDAKEIMRHSFFSGVNWQDVYDKKAESSLESGKGAAAENPNPKADITKYHFSKLGAQRGVIMSDVTIVKEGWVQKRGEYIKNWRPRYFLLKTDGSFIGYKEKPQDVDLPYPLNNFSVAKCQLMKTERPKPNTFIIRCLQWTTVIERTFHVDTPEEREEWTEAIQAVADRLQRQEEERMNCSPTSQIDNIGEEEMDASTTHHKRKTMNDFDYLKLLGKGTFGKVILVREKASGKYYAMKILKKEVIIAKDEVAHTLTESRVLKNTRHPFLTSLKYSFQTKDRLCFVMEYVNGGELFFHLSRERVFSEDRTRFYGAEIVSALDYLHSGKIVYRDLKLENLMLDKDGHIKITDFGLCKEGITDAATMKTFCGTPEYLAPEVLEDNDYGRAVDWWGLGVVMYEMMCGRLPFYNQDHEKLFELILMEDIKFPRTLSSDAKSLLSGLLIKDPNKRLGGGPDDAKEIMRHSFFSGVNWQDVYDKKLVPPFKPQVTSETDTRYFDEEFTAQTITITPPEKCQQSDCGMLGNWKK

SEQ ID NO: 810020 - protein, 362 aa, Homo sapiens
MCGRLPFYNQDHEKLFELILMEDIKFPRTLSSDAKSLLSGLLIKDPNKRLGGGPDDAKEIMRHSFFSGVNWQDVYDKKAESSLESGKGAAAENPNPKADITKYHFSKLGAQRGVIMSDVTIVKEGWVQKRGEYIKNWRPRYFLLKTDGSFIGYKEKPQDVDLPYPLNNFSVAKCQLMKTERPKPNTFIIRCLQWTTVIERTFHVDTPEEREEWTEAIQAVADRLQRQEEERMNCSPTSQIDNIGEEEMDASTTHHKRKTMNDFDYLKLLGKGTFGKVILVREKASGKYYAMKILKKEVIIAKDEVAHTLTESRVLKNTRHPFLTSLKYSFQTKDRLCFVMEYVNGGEMEFRSVVRLECSSTI

SEQ ID NO: 810021 - protein, 138 aa, Homo sapiens
MCGRLPFYNQDHEKLFELILMEDIKFPRTLSSDAKSLLSGLLIKDPNKRLGGGPDDAKEIMRHSFFSGVNWQDVYDKKAESSLESGKGAAAENPNPKADITKYHFSKLGAQRGVIMSDVTIVKEGWVQKRGKCSANQK

SEQ ID NO: 810022 - protein, 219 aa, Homo sapiens
MPRGRKSRRRRNARAAEENRNNRKIQASEASETPMAASVVASTPEDDLSGPEEDPSTPEEASTTPEEASSTAQAQKPSVPRSNFQGTKKSLLMSILALIFIMGNSAKEALVWKVLGKLGMQPGRQHSIFGDPKKIVTEEFVRRGYLIYKPVPRSSPVEYEFFWGPRAHVESSKLKVMHFVARVRNRCSKDWPCNYDWDSDDDAEVEAILNSGARGYSAP

SEQ ID NO: 810023 - protein, 219 aa, Homo sapiens; identical to SEQ ID NO: 810022

SEQ ID NO: 810024 - protein, 219 aa, Homo sapiens; identical to SEQ ID NO: 810022

SEQ ID NO: 810025 - protein, 190 aa, Homo sapiens
MREPQKRTATIASTPEDDLSGPEEDPSTPEEASTTPEEASSTAQAQKPSVPRSNFQGTKKSLLMSILALIFIMGNSAKEALVWKVLGKLGMQPGRQHSIFGDPKKIVTEEFVRRGYLIYKPVPRSSPVEYEFFWGPRAHVESSKLKVMHFVARVRNRCSKDWPCNYDWDSDDDAEVEAILNSGARGYSAP

SEQ ID NO: 810026 - protein, 134 aa, Homo sapiens
MSAEFLLMSILALIFIMGNSAKEALVWKVLGKLGMQPGRQHSIFGDPKKIVTEEFVRRGYLIYKPVPRSSPVEYEFFWGPRAHVESSKLKVMHFVARVRNRCSKDWPCNYDWDSDDDAEVEAILNSGARGYSAP

SEQ ID NO: 810027 - protein, 219 aa, Homo sapiens; identical to SEQ ID NO: 810022

SEQ ID NO: 810028 - protein, 106 aa, Homo sapiens
MRQVPQVPWGRNNGWPEPYYLAPAFCYRSFAVTNNRVSNSNTAATSSFPQCTSESTHTALRSQPFRFLFFPPTNPERKEIDLAAVLQYFYIIGQALPRPCLMQPMG

SEQ ID NO: 810029 - protein, 116 aa, Homo sapiens
TTTKFAALELATSILTRMAAAAASRGVGAKLGLREIRIHLCQRSPGSQGVRDFIEKRYVELKKANPDLPILIRECSDVQPKLWARYAFGQETNVPLNNFSADQVTRALENVLSGKA

SEQ ID NO: 810030 - protein, 106 aa, Homo sapiens; identical to SEQ ID NO: 810028

SEQ ID NO: 810031 - protein, 106 aa, Homo sapiens; identical to SEQ ID NO: 810028

SEQ ID NO: 810032 - protein, 106 aa, Homo sapiens; identical to SEQ ID NO: 810028

SEQ ID NO: 810033 - protein, 106 aa, Homo sapiens; identical to SEQ ID NO: 810028

SEQ ID NO: 810034 - protein, 106 aa, Homo sapiens; identical to SEQ ID NO: 810028

SEQ ID NO: 810035 - protein, 106 aa, Homo sapiens; identical to SEQ ID NO: 810028

SEQ ID NO: 810036 - protein, 106 aa, Homo sapiens; identical to SEQ ID NO: 810028

SEQ ID NO: 810037 - protein, 116 aa, Homo sapiens; identical to SEQ ID NO: 810029

SEQ ID NO: 810038 - protein, 106 aa, Homo sapiens; identical to SEQ ID NO: 810028

SEQ ID NO: 810039 - protein, 106 aa, Homo sapiens; identical to SEQ ID NO: 810028

SEQ ID NO: 810040 - protein, 106 aa, Homo sapiens; identical to SEQ ID NO: 810028

SEQ ID NO: 810041 - protein, 106 aa, Homo sapiens; identical to SEQ ID NO: 810028

SEQ ID NO: 810042 - protein, 107 aa, Homo sapiens
LGSDLPSSSSGVANGTGTRAGGRRPPPRGGSRPRCPALTSPAAPRRPRSCFLGGAWRRGPSRRSPLSASRTAAAARRTRRTRCTAALRMAAAAGTGRWAGAPAGRSW

SEQ ID NO: 810043 - protein, 559 aa, Homo sapiens
GRRAGPSRRRRHASPAAAAPGQWAGGTEGRRGRARRGDRASAVPSGRANMPRGFLVKRSKKSTPVSYRVRGGEDGDRALLLSPSCGGARAEPPAPSPVPGPLPPPPPAERAHAALAAALACAPGPQPPPQGPRAAHFGNPEAAHPAPLYSPTRPVSREHEKHKYFERSFNLGSPVSAESFPTPAALLGGGGGGGASGAGGGGTCGGDPLLFAPAELKMGTAFSAGAEAARGPGPGPPLPPAAALRPPGKRPPPPTAAEPPAKAVKAPGAKKPKAIRKLHFEDEVTTSPVLGLKIKEGPVEAPRGRAGGAARPLGEFICQLCKEEYADPFALAQHKCSRIVRVEYRCPECAKVFSCPANLASHRRWHKPRPAPAAARAPEPEAAARAEAREAPGGGSDRDTPSPGGVSESGSEDGLYECHHCAKKFRRQAYLRKHLLAHHQALQAKGAPLAPPAEDLLALYPGPDEKAPQEAAGDGEGAGVLGLSASAECHLCPVCGESFASKGAQERHLRLLHAAQVFPCKYCPATFYSSPGLTRHINKCHPSENRQVILLQVPVRPAC

SEQ ID NO: 810044 - protein, 202 aa, Homo sapiens
MALLTNLLPLCCLALLALPAQSCGPGRGPVGRRRYARKQLVPLLYKQFVPGVPERTLGASGPAEGRVARGSERFRDLVPNYNPDIIFKDEENSGADRLMTERCKERVNALAIAVMNMWPGVRLRVTEGWDEDGHHAQDSLHYEGRALDITTSDRDRNKYGLLARLAVEAGFDWVYYESRNHVHVSVKADNSLAVRAGGCFPG

SEQ ID NO: 810045 - protein, 118 aa, Homo sapiens
PNLRVHICVPSLIQDSREGPVSVYPTSLGAGSFEPIHPLPWHQAAGLGPTTHPTSSSSGSGGRGELGEHSRSRTEGLLRIQARQIGYSGVFSLNWAKSTLRSNSLITYVSGKVGMGGV

SEQ ID NO: 810046 - protein, 193 aa, Homo sapiens
MEQHFLGCVKRAWDSAEVAPEPQPPPIVSSEDRGPWPLPLYPVLGEYSLDSCDLGLLSSPCWRLPGVYWQNGLSPGVQSTLEPSTAKPTEFSWPGTQKQQEAPVEEVGQAEEPDRLRLQQLPWSSPLHPWDRQQDTEVCDSGCLLERRHPPALQPWRHLPGFSDCLEWILRVGFAAFSVLWACCSRICGAKQP

SEQ ID NO: 810047 - protein, 193 aa, Homo sapiens; identical to SEQ ID NO: 810046

SEQ ID NO: 810048 - protein, 193 aa, Homo sapiens; identical to SEQ ID NO: 810046

SEQ ID NO: 810049 - protein, 587 aa, Homo sapiens
RDAPSGGCFKMADVAGPSRPSAAAFWSRDFSDEEQSVVYVPGISAEGNVRSRHKLMSPKADVKLKTSRVTDASISMESLKGTGDSVDEQNSCRGEIKSASLKDLCLEDKRRIANLIKELARVSEEKEVTEERLKAEQESFEKKIRQLEEQNELIIKEREALQLQYRECQELLSLYQKYLSEQQEKLTMSLSELGAARMQEQQVSSRKSTLQCSSVELDGSYLSIARPQTYYQTKQRPKSAVQDSASESLIAFRNNSLKPVTLHHPKDDLDKIPSETTTCNCESPGRKPAVPTEKMPQEELHMKECPHLKPTPSQCCGHRLAADRVHDSHPTNMTPQHPKTHPESCSYCRLSWASLVHGGGALQPIETLKKQISEDRKQQLMLQKMELEIEKERLQHLLAQQETKLLLKQQQLHQSRLDYNCLLKSNCDGWLLGTSSSIKKHQDPPNSGENRKERKTVGFHSHMKDDAQWSCQKKDTCRPQRGTVTGVRKDASTSPMPTGSLKDFVTTASPSLQHTTSRYETSLLDLVQSLSPNSAPKPQRYPSREAGAWNHGTFRLSPLKSTRKKMGMHRTPEELEENQILEDIFFI

SEQ ID NO: 810050 - protein, 173 aa, Homo sapiens
RDAPSGGCFKMADVAGPSRPSAAAFWSRDFSDEEQSVVYVPGISAEGNVRSRHKLMSPKADVKLKTSRVTDASISMESLKGTGDSVDEQNSCRGEIKSASLKDLCLEDKRRIANLIKELARVSEEKEVTEERLKAEQESFEKKIRQLEEQNELIIKEREDILLKVLFFNVQEV

SEQ ID NO: 810051 - protein, 587 aa, Homo sapiens; identical to SEQ ID NO: 810049

SEQ ID NO: 810052 - protein, 129 aa, Homo sapiens
MPQEELHMKECPHLKPTPSQCCGHRLAADRVHDSHPTNMTPQHPKTHPESCSYCRLSWASLVHGGGALQPIETLKKQISEDRKQQLMLQKMELEIEKERLQHLLAQQETKLLLKQQQLHQSRLDYNCSE

SEQ ID NO: 810053 - protein, 457 aa, Homo sapiens
RDAPSGGCFKMADVAGPSRPSAAAFWSRDFSDEEQSVVYVPGISAEGNVRSRHKLMSPKADVKLKTSRVTDASISMESLKGTGDSVDEQNSCRGEIKSASLKDLCLEDKRRIANLIKELARVSEEKEVTEERLKAEQESFEKKIRQLEEQNELIIKEREALQLQYRECQELLSLYQKYLSEQQEKLTMSLSELGAARMQEQQVSSRKSTLQCSSVELDGSYLSIARPQTYYQTKQRPKSAVQDSASESLIAFRNNSLKPVTLHHPKDDLDKIPSETTTCNCESPGRKPAVPTEKMPQEELHMKECPHLKPTPSQCCGHRLAADRVHDSHPTNMTPQHPKTHPESCSYCRLSWASLVHGGGALQPIETLKKQISEDRKQQLMLQKMELEIEKERLQHLLAQQETKLLLKQQQLHQSRLDYNWLKAQALFKSRELVAEKQLTKPQELKLDMNGSDSGPR

SEQ ID NO: 810054 - protein, 209 aa, Homo sapiens
MLGALVWMLVAGFLLALPPSWAAGAPRAGRRPARPRGCADRPEELLEQLYGRLAAGVLSAFHHTLQLGPREQARNASCPAGGRPADRRFRPPTNLRSVSPWAYRISYDPARYPRYLPEAYCLCRGCLTGLFGEEDVRFRSAPVYMPTVVLRRTPACAGGRSVYTEAYVTIPVGCTCVPEPEKDADSINSSIDKQGAKLLLGPNDAPAGP

SEQ ID NO: 810055 - protein, 300 aa, Homo sapiens
MLGALVWMLVAGFLLALPPSWAAGAPRAGRRPARPRGCADRPEELLEQLYGRLAAGVLSAFHHTLQLGPREQARNASCPAGGRPADRRFRPPTNLRSVSPWAYSSVSITSESSLEDSSFVPGLSRATCHSLKPSFPRGQGHFCDPIRGENLMCFKNALVPSFCRAARRKCEDKRMTAHRRRGTGQNSARLLVRVGISYDPARYPRYLPEAYCLCRGCLTGLFGEEDVRFRSAPVYMPTVVLRRTPACAGGRSVYTEAYVTIPVGCTCVPEPEKDADSINSSIDKQGAKLLLGPNDAPAGP

SEQ ID NO: 810056 - protein, 202 aa, Homo sapiens
MLVAGFLLALPPSWAAGAPRAGRRPARPRGCADRPEELLEQLYGRLAAGVLSAFHHTLQLGPREQARNASCPAGGRPADRRFRPPTNLRSVSPWAYRISYDPARYPRYLPEAYCLCRGCLTGLFGEEDVRFRSAPVYMPTVVLRRTPACAGGRSVYTEAYVTIPVGCTCVPEPEKDADSINSSIDKQGAKLLLGPNDAPAGP

SEQ ID NO: 810057 - protein, 514 aa, Homo sapiens
MSISSDEVNFLVYRYLQESGFSHSAFTFGIESHISQSNINGALVPPAALISIIQKGLQYVEAEVSINEDGTLFDGRPIESLSLIDAVMPDVVQTRQQAYRDKLAQQQAAAAAAAAAAASQQGSAKNGENTANGEENGAHTIANNHTDMMEVDGDVEIPPNKAVVLRGHESEVFICAWNPVSDLLASGSGDSTARIWNLSENSTSGSTQLVLRHCIREGGQDVPSNKDVTSLDWNSEGTLLATGSYDGFARIWTKDGNLASTLGQHKGPIFALKWNKKGNFILSAGVDKTTIIWDAHTGEAKQQFPFHSAPALDVDWQSNNTFASCSTDMCIHVCKLGQDRPIKTFQGHTNEVNAIKWDPTGNLLASCSDDMTLKIWSMKQDNCVHDLQAHNKEIYTIKWSPTGPGTNNPNANLMLASASFDSTVRLWDVDRGICIHTLTKHQEPVYSVAFSPDGRYLASGSFDKCVHIWNTQTGALVHSYRGTGGIFEVCWNAAGDKVGASASDGSVCVLDLRK

SEQ ID NO: 810058 - protein, 514 aa, Homo sapiens; identical to SEQ ID NO: 810057

SEQ ID NO: 810059 - protein, 514 aa, Homo sapiens; identical to SEQ ID NO: 810057

SEQ ID NO: 810060 - protein, 514 aa, Homo sapiens; identical to SEQ ID NO: 810057

SEQ ID NO: 810061 - protein, 148 aa, Homo sapiens
MASTRPVLIWSMKQDNCVHDLQAHNKEIYTIKWSPTGPGTNNPNANLMLASASFDSTVRLWDVDRGICIHTLTKHQEPVYSVAFSPDGRYLASGSFDKCVHIWNTQTGALVHSYRGTGGIFEVCWNAAGDKVGASASDGSVCVLDLRK

SEQ ID NO: 810062 - protein, 514 aa, Homo sapiens; identical to SEQ ID NO: 810057

SEQ ID NO: 810063 - protein, 514 aa, Homo sapiens; identical to SEQ ID NO: 810057

SEQ ID NO: 810064 - protein, 331 aa, Homo sapiens
HEGERTVPVKIDKVRIFLLGLADNEAAIVQAESEETKERLFESMLSECRDAIQVVREELKPDQKQRDYILEGEPGKVSNLQYLHSYLTYIKLSTAIKRNENMAKGLQRALLQQQPEDDSKRSPRPQDLIRLYDIILQNLVELLQLPGLEEDKAFQKEIGLKTLVFKAYRCFFIAQSYVLVKKWSEALVLYDRVLKYANEVNSDAGAFKNSLKDLPDVQELITQVRSEKCSLQAAAILDANDAHQTETSSSQVKDNKPLVERFETFCLDPSLVTKQANLVHFPPGFQPIPCKPLFFDLALNHVAFPPLEDKLEQKTKSGLTGYIKGIFGFRS

SEQ ID NO: 810065 - protein, 127 aa, Homo sapiens
PPTTTKFAAASMQTTLIKQRPPPPKSRTISLWLNGLRHSAWTLPLSPSKPTLCTSHQASSPFPASLCSLTWPSTMWLSHPLRTSWNRRPRVASLDTSRASLDSGANQALPRGRGLVDAAANLVVVVD

SEQ ID NO: 810066 - protein, 287 aa, Homo sapiens
HEGERTVPVKIDKVRIFLLGLADNEAAIVQAESEETKERLFESMLSECRDAIQVVREELKPDQKQRDYILEGEPGKVSNLQYLHSYLTYIKLSTAIKRNENMAKGLQRALLQQQPEDDSKRSPRPQDLIRLYDIILQNLVELLQLPGLEEDKAFQKEIGLKTLVFKAYRCFFIAQSYVLVKKWSEALVLYDRVLKYANEVNSDAGAFKNSLKDLPDVQELITQVRSEKCSLQAAAILDANDAHQTETSSSQVKDNKPLVERFETFCLDPSLVTKQANLVHFPPGFQL

SEQ ID NO: 810067 - protein, 128 aa, Homo sapiens
REYTFSESYQDLPDVQELITQVRSEKCSLQAAAILDANDAHQTETSSSQVKDNKPLVERFETFCLDPSLVTKRHTAFMSCNTHHEDLQLQLLKPARPQAHREERTAPDALLEALDCILPPTRPTDKPP

SEQ ID NO: 810068 - protein, 331 aa, Homo sapiens; identical to SEQ ID NO: 810064

SEQ ID NO: 810069 - protein, 331 aa, Homo sapiens; identical to SEQ ID NO: 810064

SEQ ID NO: 810070 - protein, 331 aa, Homo sapiens; identical to SEQ ID NO: 810064

SEQ ID NO: 810071 - protein, 331 aa, Homo sapiens; identical to SEQ ID NO: 810064

SEQ ID NO: 810072 - protein, 893 aa, Homo sapiens
TTQPRPGRLFTRQALGIQGRLQKNQGTRDLLADARPHTRASGSHEVDGLRLGGAASGTRARRGAAVGTAQAPRQTPPTPPRRRRVAPRGSRRRGFQANMAVLLLLLRALRRGPGPGPRPLWGPGPAWSPGFPARPGRGRPYMASRPPGDLAEAGGRALQSLQLRLLTPTFEGINGLLLKQHLVQNPVRLWQLLGGTFYFNTSRLKQKNKEKDKSKGKAPEEDEEERRRRERDDQMYRERLRTLLVIAVVMSLLNALSTSGGSISWNDFVHEMLAKGEVQRVQVVPESDVVEVYLHPGAVVFGRPRLALMYRMQVANIDKFEEKLRAAEDELNIEAKDRIPVSYKRTGFFGNALYSVGMTAVGLAILWYVFRLAGMTGREGGFSAFNQLKMARFTIVDGKMGKGVSFKDVAGMHEAKLEVREFVDYLKSPERFLQLGAKVPKGALLLGPPGCGKTLLAKAVATEAQVPFLAMAGPEFVEVIGGLGAARVRSLFKEARARAPCIVYIDEIDAVGKKRSTTMSGFSNTEEEQTLNQLLVEMDGMGTTDHVIVLASTNRADILDGALMRPGRLDRHVFIDLPTLQERREIFEQHLKSLKLTQSSTFYSQRLAELTPGFSGADIANICNEAALHAAREGHTSVHTLNFEYAVERVLAGTAKKSKILSKEEQKVVAFHESGHALVGWMLEHTEAVMKVSITPRTNAALGFAQMLPRDQHLFTKEQLFERMCMALGGRASEALSFNEVTSGAQDDLRKVTRIAYSMVKQFGMAPGIGPISFPEAQEGLMGIGRRPFSQGLQQMMDHEARLLVAKAYRHTEKVLQDNLDKLQALANALLEKEVINYEDIEALIGPPPHGPKKMIAPQRWIDAQREKQDLGEEETEETQQPPLGGEEPTWPK

SEQ ID NO: 810073 - protein, 127 aa, Homo sapiens
MGTTDHVIVLASTNRADILDGALMRPGRLDRHVFIDLPTLQERREIFEQHLKSLKLTQSSTFYSQRLAELTPGFSGADIANICNEAALHAAREGHTSVHTLNFEYAVERVLAGTGGAPWVKALLSRA

SEQ ID NO: 810074 - protein, 298 aa, Homo sapiens
TTQPRPGRLFTRQALGIQGRLQKNQGTRDLLADARPHTRASGSHEVDGLRLGGAASGTRARRGAAVGTAQAPRQTPPTPPRRRRVAPRGSRRRGFQANMAVLLLLLRALRRGPGPGPRPLWGPGPAWSPGFPARPGRGRPYMASRPPGDLAEAGGRALQSLQLRLLTPTFEGINGLLLKQHLVQNPVRLWQLLGGTFYFNTSRLKQKNKEKDKSKGKAPEEDEESHSVAPAGVQWCDLSSMQPPPPGFKQFSCLSLRSSWDYRCSPPHPANFLFFVRLFVFETESRSVAQAGVQWHNL

SEQ ID NO: 810075 - protein, 86 aa, Homo sapiens
LEERLTCLGGLREDCGLACGGHCWEPVWLQDYSPPGPWTVGSDPCGHFAQWPSWLSFSPPCPPQRRLPGFAAWRCLPRLLAGLHEE

SEQ ID NO: 810076 - protein, 561 aa, Homo sapiens
TTQPRPGRLFTRQALGIQGRLQKNQGTRDLLADARPHTRASGSHEVDGLRLGGAASGTRARRGAAVGTAQAPRQTPPTPPRRRRVAPRGSRRRGFQANMAVLLLLLRALRRGPGPGPRPLWGPGPAWSPGFPARPGRGRPYMASRPPGDLAEAGGRALQSLQLRLLTPTFEGINGLLLKQHLVQNPVRLWQLLGGTFYFNTSRLKQKNKEKDKSKGKAPEEDEEERRRRERDDQMYRERLRTLLVIAVVMSLLNALSTSGGSISWNDFVHEMLAKGEVQRVQVVPESDVVEVYLHPGAVVFGRPRLALMYRMQVANIDKFEEKLRAAEDELNIEAKDRIPVSYKRTGFFGNALYSVGMTAVGLAILWYVFRLAGMTGREGGFSAFNQLKMARFTIVDGKMGKGVSFKDVAGMHEAKLEVREFVDYLKSPERFLQLGAKVPKGALLLGPPGCGKTLLAKAVATEAQVPFLAMAGPEFVEVIGGLGAARVRSLFKEARARAPCIVYIDEIDAVGKKRSTTMSGFSNTEEEQTLNQLLVEMDVFYAEIEELKLVYPYHGVLHSN

SEQ ID NO: 810077 - protein, 358 aa, Homo sapiens
MSPVSVAHVFVSPFCFSAGSEERRRRERDDQMYRERLRTLLVIAVVMSLLNALSTSGGSISWNDFVHEMLAKGEVQRVQVVPESDVVEVYLHPGAVVFGRPRLALMYRMQVANIDKFEEKLRAAEDELNIEAKDRIPVSYKRTGFFGNALYSVGMTAVGLAILWYVFRLAGMTGREGGFSAFNQLKMARFTIVDGKMGKGVSFKDVAGMHEAKLEVREFVDYLKSPERFLQLGAKVPKGALLLGPPGCGKTLLAKAVATEAQVPFLAMAGPEFVEVIGGLGAARVRSLFKEARARAPCIVYIDEIDAVGKKRSTTMSGFSNTEEEQTLNQLLVEMDVFYAEIEELKLVYPYHGVLHSN

SEQ ID NO: 810078 - protein, 667 aa, Homo sapiens
TTQPRPGRLFTRQALGIQGRLQKNQGTRDLLADARPHTRASGSHEVDGLRLGGAASGTRARRGAAVGTAQAPRQTPPTPPRRRRVAPRGSRRRGFQANMAVLLLLLRALRRGPGPGPRPLWGPGPAWSPGFPARPGRGRPYMASRPPGDLAEAGGRALQSLQLRLLTPTFEGINGLLLKQHLVQNPVRLWQLLGGTFYFNTSRLKQKNKEKDKSKGKAPEEDEEERRRRERDDQMYRERLRTLLVIAVVMSLLNALSTSGGSISWNDFVHEMLAKGEVQRVQVVPESDVVEVYLHPGAVVFGRPRLALMYRMQVANIDKFEEKLRAAEDELNIEAKDRIPVSYKRTGFFGNALYSVGMTAVGLAILWYVFRLAGMTGREGGFSAFNQLKMARFTIVDGKMGKGVSFKDVAGMHEAKLEVREFVDYLKSPERFLQLGAKVPKGALLLGPPGCGKTLLAKAVATEAQVPFLAMAGPEFVEVIGGLGAARVRSLFKEARARAPCIVYIDEIDAVGKKRSTTMSGFSNTEEEQTLNQLLVEMDGMGTTDHVIVLASTNRADILDGALMRPGRLDRHVFIDLPTLQERREIFEQHLKSLKLTQSSTFYSQRLAELTPGFSGADIANICNEAALHAAREGHTSVHTLNFEYAVERVLAGTGGAPWVKALLSRA

SEQ ID NO: 810079 - protein, 1131 aa, Homo sapiens
TTQPRPGRLFTRQALGIQGRLQKNQGTRDLLADARPHTRASGSHEVDGLRLGGAASGTRARRGAAVGTAQAPRQTPPTPPRRRRVAPRGSRRRGFQANMAVLLLLLRALRRGPGPGPRPLWGPGPAWSPGFPARPGRGRPYMASRPPGDLAEAGGRALQSLQLRLLTPTFEGINGLLLKQHLVQNPVRLWQLLGGTFYFNTSRLKQKNKEKDKSKGKAPEEDEEERRRRERDDQMYRERLRTLLVIAVVMSLLNALSTSGGSISWNDFVHEMLAKGEVQRVQVVPESDVVEVYLHPGAVVFGRPRLALMYRMQVANIDKFEEKLRAAEDELNIEAKDRIPVSYKRTGFFGNALYSVGMTAVGLAILWYVFRLAGMTGREGGFSAFNQLKMARFTIVDGKMGKGVSFKDVAGMHEAKLEVREFVDYLKSPERFLQLGAKVPKGALLLGPPGCGKTLLAKAVATEAQVPFLAMAGPEFVEVIGGLGAARVRSLFKEARARAPCIVYIDEIDAVGKKRSTTMSGFSNTEEEQTLNQLLVEMDVFYAEIEELKLVYPYHGVLHSNYEELKLVYPYHGVYAEIEELKLVYPYHGVVRRNRRAETGVSFITVFYAEIEELKLVYPYHGVLRRNRRAETGVSFITVFYAAIEELKLVYPYHGVLCSSRRKLSSCSNKEMTQRMGTTDHVIVLASTNRADILDGALMRPGRLDRHVFIDLPTLQRKGVRCHPGWSAVLRSPLTAASTFRAQAEELGLLWACAAVLVNFVTESRCVAKAGVKPLASSDPHPPLLPRAFSFFFFETVSLYPPGWSAAARSRLTATTISQERREIFEQHLKSLKLTQSSTFYSQRLAELTPGFSGADIANICNEAALHAAREGHTSVHTLNFEYAVERVLAGTAKKSKILSKEEQKVVAFHESGHALVGWMLEHTEAVMKVSITPRTNAALGFAQMLPRDQHLFTKEQLFERMCMALGGRASEALSFNEVTSGAQDDLRKVTRIAYSMVKQFGMAPGIGPISFPEAQEGLMGIGRRPFSQGLQQMMDHEARLLVAKAYRHTEKVLQDNLDKLQALANALLEKEVINYEDIEALIGPPPHGPKKMIAPQRWIDAQREKQDLGEEETEETQQPPLGGEEPTWPK

SEQ ID NO: 810080 - protein, 996 aa, Homo sapiens
TTQPRPGRLFTRQALGIQGRLQKNQGTRDLLADARPHTRASGSHEVDGLRLGGAASGTRARRGAAVGTAQAPRQTPPTPPRRRRVAPRGSRRRGFQANMAVLLLLLRALRRGPGPGPRPLWGPGPAWSPGFPARPGRGRPYMASRPPGDLAEAGGRALQSLQLRLLTPTFEGINGLLLKQHLVQNPVRLWQLLGGTFYFNTSRLKQKNKEKDKSKGKAPEEDEEERRRRERDDQMYRERLRTLLVIAVVMSLLNALSTSGGSISWNDFVHEMLAKGEVQRVQVVPESDVVEVYLHPGAVVFGRPRLALMYRMQVANIDKFEEKLRAAEDELNIEAKDRIPVSYKRTGFFGNALYSVGMTAVGLAILWYVFRLAGMTGREGGFSAFNQLKMARFTIVDGKMGKGVSFKDVAGMHEAKLEVREFVDYLKSPERFLQLGAKVPKGALLLGPPGCGKTLLAKAVATEAQVPFLAMAGPEFVEVIGGLGAARVRSLFKEARARAPCIVYIDEIDAVGKKRSTTMSGFSNTEEEQTLNQLLVEMDGMGTTDHVIVLASTNRADILDGALMRPGRLDRHVFIDLPTLQRKGVALSPRLECSAAITTHCGLNLQGSAEELGLLWACAAVLVNFEQSLAVLPRLVSNPWPQVIPTHLSFQERSLFFFFETVSLYPPGWSAAARSRLTATTISQERREIFEQHLKSLKLTQSSTFYSQRLAELTPGFSGADIANICNEAALHAAREGHTSVHTLNFEYAVERVLAGTAKKSKILSKEEQKVVAFHESGHALVGWMLEHTEAVMKVSITPRTNAALGFAQMLPRDQHLFTKEQLFERMCMALGGRASEALSFNEVTSGAQDDLRKVTRIAYSMVKQFGMAPGIGPISFPEAQEGLMGIGRRPFSQGLQQMMDHEARLLVAKAYRHTEKVLQDNLDKLQALANALLEKEVINYEDIEALIGPPPHGPKKMIAPQRWIDAQREKQDLGEEETEETQQPPLGGEEPTWPK

SEQ ID NO: 810081 - protein, 480 aa, Homo sapiens
TTQPRPGRLFTRQALGIQGRLQKNQGTRDLLADARPHTRASGSHEVDGLRLGGAASGTRARRGAAVGTAQAPRQTPPTPPRRRRVAPRGSRRRGFQANMAVLLLLLRALRRGPGPGPRPLWGPGPAWSPGFPARPGRGRPYMASRPPGDLAEAGGRALQSLQLRLLTPTFEGINGLLLKQHLVQNPVRLWQLLGGTFYFNTSRLKQKNKEKDKSKGKAPEEDEEERRRRERDDQMYRERLRTLLVIAVVMSLLNALSTSGGSISWNDFVHEMLAKGEVQRVQVVPESDVVEVYLHPGAVVFGRPNQLKMARFTIVDGKMGKGVSFKDVAGMHEAKLEVREFVDYLKSPERFLQLGAKVPKGALLLGPPGCGKTLLAKAVATEAQVPFLAMAGPEFVEVIGGLGAARVRSLFKEARARAPCIVYIDEIDAVGKKRSTTMSGFSNTEEEQTLNQLLVEMDVFYAEIEELKLVYPYHGVLHSN

SEQ ID NO: 810082 - protein, 481 aa, Homo sapiens
STSFPALGVSSRPKADGGRGRGGGGPRAPGSPRGTLPGPGGRTLKRTEPLPKLPDGASPLPTMGSRSGRGRTEARSASESLQLRLLTPTFEGINGLLLKQHLVQNPVRLWQLLGGTFYFNTSRLKQKNKEKDKSKGKAPEEDEEERRRRERDDQMYRERLRTLLVIAVVMSLLNALSTSGGSISWNDFVHEMLAKGEVQRVQVVPESDVVEVYLHPGAVVFGRPRLALMYRMQVANIDKFEEKLRAAEDELNIEAKDRIPVSYKRTGFFGNALYSVGMTAVGLAILWYVFRLAGMTGREGGFSAFNQLKMARFTIVDGKMGKGVSFKDVAGMHEAKLEVREFVDYLKSPERFLQLGAKVPKGALLLGPPGCGKTLLAKAVATEAQVPFLAMAGPEFVEVIGGLGAARVRSLFKEARARAPCIVYIDEIDAVGKKRSTTMSGFSNTEEEQTLNQLLVEMDVFYAEIEELKLVYPYHGVLHSN

SEQ ID NO: 810083 - protein, 212 aa, Homo sapiens
MLEHTEAVMKVSITPRTNAALGFAQMLPRDQHLFTKEQLFERMCMALGGRASEALSFNEVTSGAQDDLRKVTRIAYSMVKQFGMAPGIGPISFPEAQEGLMGIGRRPFSQGLQQMMDHEARLLVAKAYRHTEKVLQDNLDKLQALANALLEKEVINYEDIEALIGPPPHGPKKMIAPQRWIDAQREKQDLGEEETEETQQPPLGGEEPTWPK

SEQ ID NO: 810084 - protein, 212 aa, Homo sapiens; identical to SEQ ID NO: 810083

SEQ ID NO: 810085 - protein, 212 aa, Homo sapiens; identical to SEQ ID NO: 810083

SEQ ID NO: 810086 - protein, 212 aa, Homo sapiens; identical to SEQ ID NO: 810083

SEQ ID NO: 810087 - protein, 212 aa, Homo sapiens; identical to SEQ ID NO: 810083

SEQ ID NO: 810088 - protein, 875 aa, Homo sapiens
TTQPRPGRLFTRQALGIQGRLQKNQGTRDLLADARPHTRASGSHEVDGLRLGGAASGTRARRGAAVGTAQAPRQTPPTPPRRRRVAPRGSRRRGFQANMAVLLLLLRALRRGPGPGPRPLWGPGPAWSPGFPARPGRGRPYMASRPPGDLAEAGGRALQSLQLRLLTPTFEGINGLLLKQHLVQNPVRLWQLLGGTFYFNTSRLKQKNKEKDKSKGKAPEEDEEERRRRERDDQMYRERLRTLLVIAVVMSLLNALSTSGGSISWNDFVHEMLAKGEVQRVQVVPESDVVEVYLHPGAVVFGRPRLALMYRMQVANIDKFEEKLRAAEDELNIEAKDRIPVSYKRTGFFGNALYSVGMTAVGLAILWYVFRLAGMTGREGGFSAFNQLKMARFTIVDGKMGKGVSFKDVAGMHEAKLEVREFVDYLKSPERFLQLGAKVPKGALLLGPPGCGKTLLAKAVATEAQVPFLAMAGPEFVEVIGGLGAARVRSLFKEARARAPCIVYIDEIDAVGKKRSTTMSGFSNTEEEQTLNQLLVEMDGMGTTDHVIVLASTNRADILDGALMRPGRLDRHVFIDLPTLQERREIFEQHLKSLKLTQSSTFYSQRLAELTPGFSGADIANICNEAALHAAREGHTSVHTLNFEYAVERVLAGTAKKSKILSKEEQKVVAFHESGHALVGWMLEHTEAVMKVSITPRTNAALGFAQMLPRDQHLFTKEQLFERMCMALGGRASEALSFNEVTSGAQDDLRKVTRIAYSMVKQFGMAPGIGPISFPEAQEGLMGIGRRPFSQGLQQMMDHEARLLVAKAYRHTEKVLQDNLDKLQALANALLEKEVINYEDIEALIGPPPHGPKGEEETEETQQPPLGGEEPTWPK

SEQ ID NO: 810089 - protein, 880 aa, Homo sapiens
TTQPRPGRLFTRQALGIQGRLQKNQGTRDLLADARPHTRASGSHEVDGLRLGGAASGTRARRGAAVGTAQAPRQTPPTPPRRRRVAPRGSRRRGFQANMAVLLLLLRALRRGPGPGPRPLWGPGPAWSPGFPARPGRGRPYMASRPPGDLAEAGGRALQSLQLRLLTPTFEGINGLLLKQHLVQNPVRLWQLLGGTFYFNTSRLKQKNKEKDKSKGKAPEEDEEERRRRERDDQMYRERLRTLLVIAVVMSLLNALSTSGGSISWNDFVHEMLAKGEVQRVQVVPESDVVEVYLHPGAVVFGRPRLALMYRMQVANIDKFEEKLRAAEDELNIEAKDRIPVSYKRTGFFGNALYSVGMTAVGLAILWYVFRLAGMTGREGGFSAFNQLKMARFTIVDGKMGKGVSFKDVAGMHEAKLEVREFVDYLKSPERFLQLGAKVPKGALLLGPPGCGKTLLAKAVATEAQVPFLAMAGPEFVEVIGGLGAARVRSLFKEARARAPCIVYIDEIDAVGKKRSTTMSGFSNTEEEQTLNQLLVEMDGMGTTDHVIVLASTNRADILDGALMRPGRLDRHVFIDLPTLQERREIFEQHLKSLKLTQSSTFYSQRLAELTPGFSGADIANICNEAALHAAREGHTSVHTLNFEYAVERVLAGTAKKSKILSKEEQKVVAFHESGHALVGWMLEHTEAVMKVSITPRTNAALGFAQMLPRDQHLFTKEQLFERMCMALGGRASEALSFNEVTSGAQDDLRKVTRIAYSMVKQFGMAPGIGPISFPEAQEGLMGIGRRPFSQGLQQMMDHEARLLVAKAYRHTEKVLQDNLDKLQALANALLEKEVINYEDIEALIGPPPHGPKKMIAPQRWIDALSCFSAEVCTSSRGPQ

SEQ ID NO: 810090 - protein, 516 aa, Homo sapiens
GGELGTRHNQLKMARFTIVDGKMGKGVSFKDVAGMHEAKLEVREFVDYLKSPERFLQLGAKVPKGALLLGPPGCGKTLLAKAVATEAQVPFLAMAGPEFVEVIGGLGAARVRSLFKEARARAPCIVYIDEIDAVGKKRSTTMSGFSNTEEEQTLNQLLVEMDGMGTTDHVIVLASTNRADILDGALMRPGRLDRHVFIDLPTLQERREIFEQHLKSLKLTQSSTFYSQRLAELTPGFSGADIANICNEAALHAAREGHTSVHTLNFEYAVERVLAGTAKKSKILSKEEQKVVAFHESGHALVGWMLEHTEAVMKVSITPRTNAALGFAQMLPRDQHLFTKEQLFERMCMALGGRASEALSFNEVTSGAQDDLRKVTRIAYSMVKQFGMAPGIGPISFPEAQEGLMGIGRRPFSQGLQQMMDHEARLLVAKAYRHTEKVLQDNLDKLQALANALLEKEVINYEDIEALIGPPPHGPKKMIAPQRWIDAQREKQDLGEEETEETQQPPLGGEEPTWPK

SEQ ID NO: 810091 - protein, 212 aa, Homo sapiens; identical to SEQ ID NO: 810083

SEQ ID NO: 810092 - protein, 311 aa, Homo sapiens
LISDRGRRQIIGLWYQSSTFYSQRLAELTPGFSGADIANICNEAALHAAREGHTSVHTLNFEYAVERVLAGTAKKSKILSKEEQKVVAFHESGHALVGWMLEHTEAVMKVSITPRTNAALGFAQMLPRDQHLFTKEQLFERMCMALGGRASEALSFNEVTSGAQDDLRKVTRIAYSMVKQFGMAPGIGPISFPEAQEGLMGIGRRPFSQGLQQMMDHEARLLVAKAYRHTEKVLQDNLDKLQALANALLEKEVINYEDIEALIGPPPHGPKKMIAPQRWIDAQREKQDLGEEETEETQQPPLGGEEPTWPK

SEQ ID NO: 810093 - protein, 212 aa, Homo sapiens; identical to SEQ ID NO: 810083

SEQ ID NO: 810094 - protein, 187 aa, Homo sapiens [sequence omitted]

SEQ ID NO: 810095 - protein, 893 aa, Homo sapiens; identical to SEQ ID NO: 810072

SEQ ID NO: 810096 - protein, 893 aa, Homo sapiens; identical to SEQ ID NO: 810072

SEQ ID NO: 810097 - protein, 893 aa, Homo sapiens; identical to SEQ ID NO: 810072

SEQ ID NO: 810098 - protein, 833 aa, Homo sapiens
TTQPRPGRLFTRQALGIQGRLQKNQGTRDLLADARPHTRASGSHEVDGLRLGGAASGTRARRGAAVGTAQAPRQTPPTPPRRRRVAPRGSRRRGFQANMAVLLLLLRALRRGPGPGPRPLWGPGPAWSPGFPARPGRGRPYMASRPPGDLAEAGGRALQSLQLRLLTPTFEGINGLLLKQHLVQNPVRLWQLLGGTFYFNTSRLKQKNKEKDKSKGKAPEEDEEERRRRERDDQMYRERLRTLLVIAVVMSLLNALSTSGGSISWNDFVHEMLAKGEVQRVQVVPESDVVEVYLHPGAVVFGRPRLALMYRMQVANIDKFEEKLRAAEDELNIEAKDRIPVSYKRTGFFGNALYSVGMTAVGLAILWYVFRLAGMTGREGGFSAFNQLKMARFTIVDGKMGKGVSFKDVAGMHEAKLEVREFVDYLKSPERFLQLGAKVPKGALLLGPPGCGKTLLAKAVATEAQVPFLAMAGPEFVEVIGGLGAARVRSLFKEARARAPCIVYIDEIDAVGKKRSTTMSGFSNTEEEQTLNQLLVEMDGMGTTDHVIVLASTNRADILDGALMRPGRLDRHVFIDLPTLQERREIFEQHLKSLKLTQSSTFYSQRLAELTPGFSGADIANICNEAALHAAREGHTSVHTLNFEYAVERVLAGTAKKSKILSKEEQKVVAFHESGHALVGWMLEHTEAVMKVSITPRTNAALGFAQMLPRDQHLFTKEQLFERMCMALGGRASEALSFNEVTSGAQDDLRKVTRIAYSMVKQFGMAPGIGPISFPEAQEGLMGIGRRPFSQGLQQMMDHEARLLVAKAYRHTEKVLQDNLDKLQAKSSVSSLK

SEQ ID NO: 810099 - protein, 775 aa, Homo sapiens
TTQPRPGRLFTRQALGIQGRLQKNQGTRDLLADARPHTRASGSHEVDGLRLGGAASGTRARRGAAVGTAQAPRQTPPTPPRRRRVAPRGSRRRGFQANMAVLLLLLRALRRGPGPGPRPLWGPGPAWSPGFPARPGRGRPYMASRPPGDLAEAGGRALQSLQLRLLTPTFEGINGLLLKQHLVQNPVRLWQLLGGTFYFNTSRLKQKNKEKDKSKGKAPEEDEEERRRRERDDQMYRERLRTLLVIAVVMSLLNALSTSGGSISWNDFVHEMLAKGEVQRVQVVPESDVVEVYLHPGAVVFGRPRLALMYRMQVANIDKFEEKLRAAEDELNIEAKDRIPVSYKRTGFFGNALYSVGMTAVGLAILWYVFRLAGMTGREGGFSAFNQLKMARFTIVDGKMGKGVSFKDVAGMHEAKLEVREFVDYLKSPERFLQLGAKVPKGALLLGPPGCGKTLLAKAVATEAQVPFLAMAGPEFVEVIGGLGAARVRSLFKEARARAPCIVYIDEIDAVGKKRSTTMSGFSNTEEEQTLNQLLVEMDGMGTTDHVIVLASTNRADILDGALMRPGRLDRHVFIDLPTLQERREIFEQHLKSLKLTQSSTFYSQRLAELTPGFSGADIANICNEAALHAAREGHTSVHTLNFEYAVERVLAGTAKKSKILSKEEQKVVAFHESGHALVGWMLEHTEAVMKVSITPRTNAALGFAQMLPRDQHLFTKEQLFERMCMALGGRASEALSFNEVTSGARATVEVPWLSWGPLVGLVAPSPGAGQGGGP

SEQ ID NO: 810100 - protein, 667 aa, Homo sapiens; identical to SEQ ID NO: 810078

SEQ ID NO: 810101 - protein, 667 aa, Homo sapiens; identical to SEQ ID NO: 810078

SEQ ID NO: 810102 - protein, 561 aa, Homo sapiens; identical to SEQ ID NO: 810076

SEQ ID NO: 810103 - protein, 421 aa, Homo sapiens
TTQPRPGRLFTRQALGIQGRLQKNQGTRDLLADARPHTRASGSHEVDGLRLGGAASGTRARRGAAVGTAQAPRQTPPTPPRRRRVAPRGSRRRGFQANMAVLLLLLRALRRGPGPGPRPLWGPGPAWSPGFPARPGRGRPYMASRPPGDLAEAGGRALQSLQLRLLTPTFEGINGLLLKQHLVQNPVRLWQLLGGTFYFNTSRLKQKNKEKDKSKGKAPEEDEEERRRRERDDQMYRERLRTLLVIAVVMSLLNALSTSGGSISWNDFVHEMLAKGEVQRVQVVPESDVVEVYLHPGAVVFGRPRLALMYRMQVANIDKFEEKLRAAEDELNIEAKDRIPVSYKRTGFFGNALYSVGMTAVGLAILWYVFRLAGMTGREGGFSAFVSSVNQSSLNSFWFVFAEYFSHKLYDEYTGKTCCRE

SEQ ID NO: 810104 - protein, 357 aa, Homo sapiens
TTQPRPGRLFTRQALGIQGRLQKNQGTRDLLADARPHTRASGSHEVDGLRLGGAASGTRARRGAAVGTAQAPRQTPPTPPRRRRVAPRGSRRRGFQANMAVLLLLLRALRRGPGPGPRPLWGPGPAWSPGFPARPGRGRPYMASRPPGDLAEAGGRALQSLQLRLLTPTFEGINGLLLKQHLVQNPVRLWQLLGGTFYFNTSRLKQKNKEKDKSKGKAPEEDEEERRRRERDDQMYRERLRTLLVIAVVMSLLNALSTSGGSISWNDFVHEMLAKGEVQRVQVVPESDVVEVYLHPGAVVFGRPRLALMYRMQVANIDKFEEKLRAAEDELNIEAKDRIPVSYKRTGFFGKYVGCIC

SEQ ID NO: 810105 - protein, 136 aa, Homo sapiens [sequence omitted]

SEQ ID NO: 810106 - protein, 355 aa, Homo sapiens
RAMASHLRPPSPLLVRVYKSGPRVRRKLESYFQSSKSSGGGECTVSTQEHEAPGTFRVEFSERAAKERVLKKGEHQILVDEKPVPIFLVPTDNSIKKNTRPQISSLTQSQAETPSGDMHQHEGHIPNAVDSCLQKIFLTVTADLNCNLFSKEQRAYITTLCPSIRKMEGHDGIEKVCGDFQDIERIHQFLSEQFLESEQKQQFSPSMTERKPLSQQERDSCISPSEPETKAEQKSNYFEVPLPYFEYFKYICPDKINSIEKRFGVNIEIQESSPNMVCLDFTSSRSGDLEAARESFASEFQKNTEPLKQECVSLADSKQANKFKQELNHQFTKLLIKEKGGELTLLGTQDDISAA

SEQ ID NO: 810107 - protein, 69 aa, Homo sapiens
REIRASRLVEGARSFAVVCECVQGQSPEQGNLEGREEYHGIESCLVALTDTVASHPHATLSCHGKEQQL

SEQ ID NO: 810108 - protein, 451 aa, Homo sapiens
MPREIITLQLGQCGNQIGFEFWKQLCAEHGISPEGIVEEFATEGTDRKDVFFYQADDEHYIPRAVLLDLEPRVIHSILNSPYAKLYNPENIYLSEHGGGAGNNWASGFSQGEKIHEDIFDIIDREADGSDSLEGFVLCHSIAGGTGSGLGSYLLERLNDRYPKKLVQTYSVFPYQDEMSDVVVQPYNSLLTLKRLTQNADCVVVLDNTALNRIATDRLHIQNPSFSQINQLVSTIMSASTTTLRYPGYMNNDLIGLIASLIPTPRLHFLMTGYTPLTTDQSVASVRKTTVLDVMRRLLQPKNVMVSTGRDRQTNHCYIAILNIIQGEVDPTQVHKSLQRIRERKLANFIPWGPASIQVALSRKSPYLPSAHRVSGLMMANHTSISSLFESSCQQFDKLRKRDAFLEQFRKEDMFKDNFDEMDRSREVVQELIDEYHAATQPDYISWGTQEQ

SEQ ID NO: 810109 - protein, 280 aa, Homo sapiens
YVESLVVNRPREGKERALPTSCAPGCRAFVSAVTLAREIITLQLGQCGNQIGFEFWKQLCAEHGISPEGIVEEFATEGTDRKDVFFYQADDEHYIPRAVLLDLEPRVIHSILNSPYAKLYNPENIYLSEHGGGAGNNWASGFSQGEKIHEDIFDIIDREADGSDSLEGFVLCHSIAGGTGSGLGSYLLERLNDRYPKKLVQTYSVFPYQDEMSDVVVQPYNSLLTLKRLTQNADCVRGCWTMTSTLYRIATGSPATYRTRPCYQIQPVGVHIDGRQSHHL

SEQ ID NO: 810110 - protein, 451 aa, Homo sapiens; identical to SEQ ID NO: 810108

SEQ ID NO: 810111 - protein, 451 aa, Homo sapiens; identical to SEQ ID NO: 810108

SEQ ID NO: 810112 - protein, 460 aa, Homo sapiens
MPREIITLQLGQCGNQIGFEFWKQLCAEHGISPEGIVEEFATEGTDRKDVFFYQADDEHYIPRAVLLDLEPRVIHSILNSPYAKLYNPENIYLSEHGGGAGNNWASGFSQGEKIHEDIFDIIDREADGSDSLELQNSSRVIKGFVLCHSIAGGTGSGLGSYLLERLNDRYPKKLVQTYSVFPYQDEMSDVVVQPYNSLLTLKRLTQNADCVVVLDNTALNRIATDRLHIQNPSFSQINQLVSTIMSASTTTLRYPGYMNNDLIGLIASLIPTPRLHFLMTGYTPLTTDQSVASVRKTTVLDVMRRLLQPKNVMVSTGRDRQTNHCYIAILNIIQGEVDPTQVHKSLQRIRERKLANFIPWGPASIQVALSRKSPYLPSAHRVSGLMMANHTSISSLFESSCQQFDKLRKRDAFLEQFRKEDMFKDNFDEMDRSREVVQELIDEYHAATQPDYISWGTQEQ

SEQ ID NO: 810113 - protein, 451 aa, Homo sapiens; identical to SEQ ID NO: 810108

SEQ ID NO: 810114 - protein, 298 aa, Homo sapiens
MEVTVWRYPKKLVQTYSVFPYQDEMSDVVVQPYNSLLTLKRLTQNADCVVVLDNTALNRIATDRLHIQNPSFSQINQLVSTIMSASTTTLRYPGYMNNDLIGLIASLIPTPRLHFLMTGYTPLTTDQSVASVRKTTVLDVMRRLLQPKNVMVSTGRDRQTNHCYIAILNIIQGEVDPTQVHKSLQRIRERKLANFIPWGPASIQVALSRKSPYLPSAHRVSGLMMANHTSISSLFESSCQQFDKLRKRDAFLEQFRKEDMFKDNFDEMDRSREVVQELIDEYHAATQPDYISWGTQEQ

SEQ ID NO: 810115 - protein, 451 aa, Homo sapiens; identical to SEQ ID NO: 810108

SEQ ID NO: 810116 - protein, 274 aa, Homo sapiens
MSDVVVQPYNSLLTLKRLTQNADCVVVLDNTALNRIATDRLHIQNPSFSQINQLVSTIMSASTTTLRYPGYMNNDLIGLIASLIPTPRLHFLMTGYTPLTTDQSVASVRKTTVLDVMRRLLQPKNVMVSTGRDRQTNHCYIAILNIIQGEVDPTQVHKSLQRIRERKLANFIPWGPASIQVALSRKSPYLPSAHRVSGLMMANHTSISSLFESSCQQFDKLRKRDAFLEQFRKEDMFKDNFDEMDRSREVVQELIDEYHAATQPDYISWGTQEQ

SEQ ID NO: 810117 - protein, 298 aa, Homo sapiens; identical to SEQ ID NO: 810114

SEQ ID NO: 810118 - protein, 274 aa, Homo sapiens; identical to SEQ ID NO: 810116

SEQ ID NO: 810119 - protein, 394 aa, Homo sapiens
MPREIITLQLGQCGNQIGFEFWKQLCAEHGISPEGIVEEFATEGTDRKDVFFYQADDEHYIPRAVLLDLEPRVIHSILNSPYAKLYNPENIYLSEHGGGAGNNWASGFSQGEKIHEDIFDIIDREADGSDSLEGFVLCHSIAGGTGSGLGSYLLERLNDRYPKKLVQTYSVFPYQDEMSDVVVQPYNSLLTLKRLTQNADCVVVLDNTALNRIATDRLHIQNPSFSQINQLVSTIMSASTTTLRYPGYMNNDLIGLIASLIPTPRLHFLMTGYTPLTTDQSVASVRKTTVLDVMRRLLQPKNVMVSTGRDRQTNHCYIAILNIIQGEVDPTQVHKSLQRIRERKLANFIPWGPASIQVALSRKSPYLPSAHRVSGLMMANHTSISSVSLGFYSS

SEQ ID NO: 810120 - protein, 343 aa, Homo sapiens
GRGSTEFEAFRLILFGSEDSVLPSPLLYKMAHMGSDGGVLPVHYATILFSLRYPKKLVQTYSVFPYQDEMSDVVVQPYNSLLTLKRLTQNADCVVVLDNTALNRIATDRLHIQNPSFSQINQLVSTIMSASTTTLRYPGYMNNDLIGLIASLIPTPRLHFLMTGYTPLTTDQSVASVRKTTVLDVMRRLLQPKNVMVSTGRDRQTNHCYIAILNIIQGEVDPTQVHKSLQRIRERKLANFIPWGPASIQVALSRKSPYLPSAHRVSGLMMANHTSISSLFESSCQQFDKLRKRDAFLEQFRKEDMFKDNFDEMDRSREVVQELIDEYHAATQPDYISWGTQEQ

SEQ ID NO: 810121 - protein, 306 aa, Homo sapiens
TGRLYSRQMVVTVWRYPKKLVQTYSVFPYQDEMSDVVVQPYNSLLTLKRLTQNADCVVVLDNTALNRIATDRLHIQNPSFSQINQLVSTIMSASTTTLRYPGYMNNDLIGLIASLIPTPRLHFLMTGYTPLTTDQSVASVRKTTVLDVMRRLLQPKNVMVSTGRDRQTNHCYIAILNIIQGEVDPTQVHKSLQRIRERKLANFIPWGPASIQVALSRKSPYLPSAHRVSGLMMANHTSISSLFESSCQQFDKLRKRDAFLEQFRKEDMFKDNFDEMDRSREVVQELIDEYHAATQPDYISWGTQEQ

SEQ ID NO: 810122 - protein, 312 aa, Homo sapiens
MSDVVVQPYNSLLTLKRLTQNADCVVVLDNTALNRIATDRLHIQNPSFSQINQLVGPHSRTPLDWKPSLLEGHLGKEGPTQAEPHDMAACPQVSTIMSASTTTLRYPGYMNNDLIGLIASLIPTPRLHFLMTGYTPLTTDQSVASVRKTTVLDVMRRLLQPKNVMVSTGRDRQTNHCYIAILNIIQGEVDPTQVHKSLQRIRERKLANFIPWGPASIQVALSRKSPYLPSAHRVSGLMMANHTSISSLFESSCQQFDKLRKRDAFLEQFRKEDMFKDNFDEMDRSREVVQELIDEYHAATQPDYISWGTQEQ

SEQ ID NO: 810123 - protein, 296 aa, Homo sapiens
MPREIITLQLGQCGNQIGFEFWKQLCAEHGISPEGIVEEFATEGTDRKDVFFYQADDEHYIPRAVLLDLEPRVIHSILNSPYAKLYNPENIYLSEHGGGAGNNWASGFSQGEKIHEDIFDIIDREADGSDSLEGFVLCHSIAGGTGSGLGSYLLERLNDRYPKKLVQTYSVFPYQDEMSDVVVQPYNSLLTLKRLTQNADCVVVLDNTALNRIATDRLHIQNPSFSQINQLVSTIMSASTTTLRYPGYMNNDLIGLIASLIPTPRLHFLMTGYTPQTTFPGAPRSSDFPPHYSFSF

SEQ ID NO: 810124 - protein, 112 aa, Homo sapiens
MPREIITLQLGQCGNQIGFEFWKQLCAEHGISPEGIVEEFATEGTDRKDVFFYQADDEHYIPRAVLLDLEPRVIHSILNSPYAKLYNPENIYLSEHGGGAGNNWASGFSQVS

SEQ ID NO: 810125 - protein, 194 aa, Homo sapiens
RGGPFIPRPGPAGVEERPPPLLLCPPQVHKSLQRIRERKLANFIPWGPASIQVALSRKSPYLPSAHRVSGLMMANHTSISSVSLGFYFFLEESVPLATFIIFPKFTPNPLARILEIFISFSSLKVPASSLTSCGSGMPSSSSSVRRTCSRTTLMRWTGLGRLFRSSLMSTMRPPSQTTFPGAPRSSDFPPHYSF

SEQ ID NO: 810126 - protein, 106 aa, Homo sapiens
GEACAAHAQTEHPRQEAKRARAPHVLRSWLPGIRLSRDSRQAGAGAPTSEERCPGRSSPCSWASAATRVSKRAPAPPVSGSAPSGPTQVPGFHQSPFPFHEPPALL

SEQ ID NO: 810127 - protein, 124 aa, Homo sapiens
KLTNLLPGFGVQQGLSQYLISMPILSSRCCDALLSPQVVLDNTALNRIATDRLHIQNPSFSQINQLVGPHSRTPLDWKPSLLEGHLGKEGPTQAEPHDMARLSPGVHHHVGQHHHPALPRLHEQ

SEQ ID NO: 810128 - protein, 468 aa, Homo sapiens
MAARGSGPRALRLLLLVQLVAGRCGLAGAAGGAQRGLSEPSSIAKHEDSLLKDLFQDYERWVRPVEHLNDKIKIKFGLAISQLVDVDEKNQLMTTNVWLKQEWIDVKLRWNPDDYGGIKVIRVPSDSVWTPDIVLFDNADGRFEGTSTKTVIRYNGTVTWTPPANYKSSCTIDVTFFPFDLQNCSMKFGSWTYDGSQVDIILEDQDVDKRDFFDNGEWEIVSATGSKGNRTDSCCWYPYVTYSFVIKRLPLFYTLFLIIPCIGLSFLTVLVFYLPSNEGEKICLCTSVLVSLTVFLLVIEEIIPSSSKVIPLIGEYLVFTMIFVTLSIMVTVFAINIHHRSSSTHNAMAPLVRKIFLHTLPKLLCMRSHVDRYFTQKEETESGSGPKSSRNTLEAALDSIRYITRHIMKENDVREVVEDWKFIAQVLDRMFLWTFLFVSIVGSLGLFVPVIYKWANILIPVHIGNANK

SEQ ID NO: 810129 - protein, 243 aa, Homo sapiens
MAARGSGPRALRLLLLVQLVAGRCGLAGAAGGAQRGLSEPSSIAKHEDSLLKDLFQDYERWVRPVEHLNDKIKIKFGLAISQLVDVDEKNQLMTTNVWLKQEWIDVKLRWNPDDYGGIKVIRVPSDSVWTPDIVLFDNADGRFEGTSTKTVIRYNGTVTWTPPANYKSSCTIDVTFFPFDLQNCSMKFGSWTYDGSQVDIILEDQDVDKRDFFDNGEWEIVSATGSKGNRTDSCCWLLKIGNS

SEQ ID NO: 810130 - protein, 436 aa, Homo sapiens
MAARGSGPRALRLLLLVQLVAGRCGLAGAAGGAQRGLSEPSSIAKHEDSLLKDLFQDYERWVRPVEHLNDKIKIKFGLAISQLVDVDEKNQLMTTNVWLKQEWIDVKLRWNPDDYGGIKVIRVPSDSVWTPDIVLFDNADGRFEGTSTKTVIRYNGTVTWTPPANYKSSCTIDVTFFPFDLQNCSMKFGSWTYDGSQVDIILEDQDVDKRDFFDNGEWEIVSATGSKGNRTDSCCWYPYVTYSFVIKRLPLFYTLFLIIPCIGLSFLTVLVFYLPSNEGEKICLCTSVLVSLTVFLLVIEEIIPSSSKVIPLIGEYLVFTMIFVTLSIMVTVFAINIHHRSSSTHNAMAPLVRKIFLHTLPKLLCMRSHVDRYFTQKEETESGSGPKSSRNTLEAALDSIRYITRHIMKENDVREVCDVYLQMQIFFHFKFRSYFH

SEQ ID NO: 810131 - protein, 210 aa, Homo sapiens
APPPRPAQLCPRSLAGCRALWFARAAGPLLGVSLRACADSSPSLQDNSFSSTTVTECDEDPVSLHEDQTDCSSLRDENNKENYPDAGALVEEHAPPSWEPQQQNVEATVLVDSVLRPSMGNFKSRKPKSIFKAESGRSHGESQETEHVVSSQSECQVRAGTPAHESPQNNAFKCQETVRLQPRIDQRTAISPKDAFETRQDLNEGVNYID

SEQ ID NO: 810132 - protein, 620 aa, Homo sapiens
APPPRPAQLCPRSLAGCRALWFARAAGPLLGVSLRACADSSPSLQDNSFSSTTVTECDEDPVSLHEDQTDCSSLRDENNKENYPDAGALVEEHAPPSWEPQQQNVEATVLVDSVLRPSMGNFKSRKPKSIFKAESGRSHGESQETEHVVSSQSECQVRAGTPAHESPQNNAFKCQETVRLQPRIDQRTAISPKDAFETRQDLNEEEAAQVHGVKDPAPASTQSVLADGTDSADPSPVHKDGQNEADSAPEDLHSVGTSRLLYHITDGDNPLLSPRCSIFSQSQRFNLDPESAPSPPSTQQFMMPRSSSRCSCGDGKEPQTITQLTKHIQSLKRKIRKFEEKFEQEKKYRPSHGDKTSNPEVLKWMNDLAKGRKQLKELKLKLSEEQGSAPKGPPRNLLCEQPTVPRENGKPEAAGPEPSSSGEETPDAALTCLKERREQLPPQEDSKVTKQDKNLIKPLYDRYRIIKQILSTPSLIPTIQEEEDSDEDRPQGSQQPSLADPASHLPVGDHLTYSNETEPVRALLPDEKKEVKPPALSMSNLHEATMPVLLDHLRETRADKKRLRKALREFEEQFFKQTGRSPQKEDRIPMADEYYEYKHIKAKLRLLEVLISKQDVAKTI

SEQ ID NO: 810133 - protein, 424 aa, Homo sapiens
MTLQGILKEEAAQVHGVKDPAPASTQSVLADGTDSADPSPVHKDGQNEADSAPEDLHSVGTSRLLYHITDGDNPLLSPRCSIFSQSQRFNLDPESAPSPPSTQQFMMPRSSSRCSCGDGKEPQTITQLTKHIQSLKRKIRKFEEKFEQEKKYRPSHGDKTSNPEVLKWMNDLAKGRKQLKELKLKLSEEQGSAPKGPPRNLLCEQPTVPRENGKPEAAGPEPSSSGEETPDAALTCLKERREQLPPQEDSKVTKQDKNLIKPLYDRYRIIKQILSTPSLIPTIQEEEDSDEDRPQGSQQPSLADPASHLPVGDHLTYSNETEPVRALLPDEKKEVKPPALSMSNLHEATMPVLLDHLRETRADKKRLRKALREFEEQFFKQTGRSPQKEDRIPMADEYYEYKHIKAKLRLLEVLISKQDVAKTI

SEQ ID NO: 810134 - protein, 493 aa, Homo sapiens
APPPRPAQLCPRSLAGCRALWFARAAGPLLGVSLRACADSSPSLQDNSFSSTTVTECDEDPVSLHEDQTDCSSLRDENNKENYPDAGALVEEHAPPSWEPQQQNVEATVLVDSVLRPSMGNFKSRKPKSIFKAESGRSHGESQETEHVVSSQSECQVRAGTPAHESPQNNAFKCQETVRLQPRIDQRTAISPKDAFETRQDLNEEEAAQVHGVKDPAPASTQSVLADGTDSADPSPVHKDGQNEADSAPEDLHSVGTSRLLYHITDGDNPLLSPRCSIFSQSQRFNLDPESAPSPPSTQQFMMPRSSSRCSCGDGKEPQTITQLTKHIQSLKRKIRKFEEKFEQEKKYRPSHGDKTSNPEVLKWMNDLAKGRKQLKELKLKLSEEQGSAPKGPPRNLLCEQPTVPRENGKPEAAGPEPSSSGEETPDAALTCLKERREQLPPQEDSKVTKQDKNLIKPLYDRYRIIKQILSTPSLIPTIVSQDTCMLLLCTDV

SEQ ID NO: 810135 - protein, 405 aa, Homo sapiens
APPPRPAQLCPRSLAGCRALWFARAAGPLLGVSLRACADSSPSLQDNSFSSTTVTECDEDPVSLHEDQTDCSSLRDENNKENYPDAGALVEEHAPPSWEPQQQNVEATVLVDSVLRPSMGNFKSRKPKSIFKAESGRSHGESQETEHVVSSQSECQVRAGTPAHESPQNNAFKCQETVRLQPRIDQRTAISPKDAFETRQDLNEEEAAQVHGVKDPAPASTQSVLADGTDSAGTKQDKNLIKPLYDRYRIIKQILSTPSLIPTIQEEEDSDEDRPQGSQQPSLADPASHLPVGDHLTYSNETEPVRALLPDEKKEVKPPALSMSNLHEATMPVLLDHLRETRADKKRLRKALREFEEQFFKQTGRSPQKEDRIPMADEYYEYKHIKAKLRLLEVLISKQDVAKTI

SEQ ID NO: 810136 - protein, 493 aa, Homo sapiens; identical to SEQ ID NO: 810134

SEQ ID NO: 810137 - protein, 546 aa, Homo sapiens
APPPRPAQLCPRSLAGCRALWFARAAGPLLGVSLRACADSSPSLQDNSFSSTTVTECDEDPVSLHEDQTDCSSLRDENNKENYPDAGALVEEHAPPSWEPQQQNVEATVLVDSVLRPSMGNFKSRKPKSIFKAESGRSHGESQETEHVVSSQSECQVRAGTPAHESPQNNAFKCQETVRLQPRIDQRTAISPKDAFETRQDLNEEEAAQVHGVKDPAPASTQSVLADGTDSADPSPVHKDGQNEADSAPEDLHSVGTSRLLYHITDGDNPLLSPRCSIFSQSQRFNLDPESAPSPPSTQQFMMPRSSSRCSCGDGKEPQTITQLTKHIQSLKRKIRKFEEKFEQEKKYRPSHGDKTSNPEVLKWMNDLAKGRKQLKELKLKLSEEQGSAPKGPPRNLLCEQPTVPRENGKPEAAGPEPSSSGEETPDAALTCLKERREQLPPQEDSKVTKQDKNLIKPLYDRYRIIKQILSTPSLIPTIQEEEDSDEDRPQGSQQPSLADPASHLPVGDHLTYSNETEPVRALLPDEKKEVKPPALSMSNLHEATM

SEQ ID NO: 810138 - protein, 391 aa, Homo sapiens
APPPRPAQLCPRSLAGCRALWFARAAGPLLGVSLRACADSSPSLQDNSFSSTTVTECDEDPVSLHEDQTDCSSLRDENNKENYPDAGALVEEHAPPSWEPQQQNVEATVLVDSVLRPSMGNFKSRKPKSIFKAESGRSHGESQETEHVVSSQSECQVRAGTPAHESPQNNAFKCQETVRLQPRIDQRTAISPKDAFETRQDLNEEEAAQVHGVKDPAPASTQSVLADGTDSADPSPVHKDGQNEADSAPEDLHSVGTSRLLYHITDGDNPLLSPRCSIFSQSQRFNLDPESAPSPPSTQQFMMPRSSSRCSCGDGKEPQTITQLTKHIQSLKRKIRKFEEKFEQEKKYRPSHGDKTSNPEVLKWMNDLAKGRKQLKGKSQPKIFFPHKGSS

SEQ ID NO: 810139 - protein, 247 aa, Homo sapiens
APPPRPAQLCPRSLAGCRALWFARAAGPLLGVSLRACADSSPSLQDNSFSSTTVTECDEDPVSLHEDQTDCSSLRDENNKENYPDAGALVEEHAPPSWEPQQQNVEATVLVDSVLRPSMGNFKSRKPKSIFKAESGRSHGESQETEHVVSSQSECQVRAGTPAHESPQNNAFKCQETVRLQPRIDQRTAISPKDAFETRQDLNEEEAAQVHGVKDPAPASTQSVLADGTDSAGKIQGWGLSQIVLSR

SEQ ID NO: 810140 - protein, 1997 aa, Homo sapiens
MLSHGAGLALWITLSLLQTGLAEPERCNFTLAESKASSHSVSIQWRILGSPCNFSLIYSSDTLGAALCPTFRIDNTTYGCNLQDLQAGTIYNFKIISLDEERTVVLQTDPLPPARFGVSKEKTTSTGLHVWWTPSSGKVTSYEVQLFDENNQKIQGVQIQESTSWNEYTFFNLTAGSKYNIAITAVSGGKRSFSVYTNGSTVPSPVKDIGISTKANSLLISWSHGSGNVERYRLMLMDKGILVHGGVVDKHATSYAFHGLTPGYLYNLTVMTEAAGLQNYRWKLVRTAPMEVSNLKVTNDGSLTSLKVKWQRPPGNVDSYNITLSHKGTIKESRVLAPWITETHFKELVPGRLYQVTVSCVSGELSAQKMAVGRTFPDKVANLEANNNGRMRSLVVSWSPPAGDWEQYRILLFNDSVVLLNITVGKEETQYVMDDTGLVPGRQYEVEVIVESGNLKNSERCQGRTVPLAVLQLRVKHANETSLSIMWQTPVAEWEKYIISLADRDLLLIHKSLSKDAKEFTFTDLVPGRKYMATVTSISGDLKNSSSVKGRTVPAQVTDLHVANQGMTSSLFTNWTQAQGDVEFYQVLLIHENVVIKNESISSETSRYSFHSLKSGSLYSVVVTTVSGGISSRQVVVEGRTVPSSVSGVTVNNSGRNDYLSVSWLLAPGDVDNYEVTLSHDGKVVQSLVIAKSVRECSFSSLTPGRLYTVTITTRSGKYENHSFSQERTVPDKVQGVSVSNSARSDYLRVSWVHATGDFDHYEVTIKNKNNFIQTKSIPKSENECVFVQLVPGRLYSVTVTTKSGQYEANEQGNGRTIPEPVKDLTLRNRSTEDLHVTWSGANGDVDQYEIQLLFNDMKVFPPFHLVNTATEYRFTSLTPGRQYKILVLTISGDVQQSAFIEGFTVPSAVKNIHISPNGATDSLTVNWTPGGGDVDSYTVSAFRHSQKVDSQTIPKHVFEHTFHRLEAGEQYQIMIASVSGSLKNQINVVGRTVPASVQGVIADNAYSSYSLIVSWQKAAGVAERYDILLLTENGILLRNTSEPATTKQHKFEDLTPGKKYKIQILTVSGGLFSKEAQTEGRTVPAAVTDLRITENSTRHLSFRWTASEGELSWYNIFLYNPDGNLQERAQVDPLVQSFSFQNLLQGRMYKMVIVTHSGELSNESFIFGRTVPASVSHLRGSNRNTTDSLWFNWSPASGDFDFYELILYNPNGTKKENWKDKDLTEWRFQGLVPGRKYVLWVVTHSGDLSNKVTAESRTAPSPPSLMSFADIANTSLAITWKGPPDWTDYNDFELQWLPRDALTVFNPYNNRKSEGRIVYGLRPGRSYQFNVKTVSGDSWKTYSKPIFGSVRTKPDKIQNLHCRPQNSTAIACSWIPPDSDFDGYSIECRKMDTQEVEFSRKLEKEKSLLNIMMLVPHKRYLVSIKVQSAGMTSEVVEDSTITMIDRPPPPPPHIRVNEKDVLISKSSINFTVNCSWFSDTNGAVKYFTVVVREADGSDELKPEQQHPLPSYLEYRHNASIRVYQTNYFASKCAENPNSNSKSFNIKLGAEMESLGGKRDPTQQKFCDGPLKPHTAYRISIRAFTQLFDEDLKEFTKPLYSDTFFSLPITTESEPLFGAIEGVSAGLFLIGMLVAVVALLICRQKVSHGRERPSARLSIRRDRPLSVHLNLGQKGNRTTFAPIKINQFEGHFMKLQADSNYLLSKEYEELKDVGRNQSCDIALLPENRGKNRYNNILPYDATRVKLSNVDDDPCSDYINASYIPGNNFRREYIVTQGPLPGTKDDFWKMVWEQNVHNIVMVTQCVEKGRVKCDHYWPADQDSLYYGDLILQMLSESVLPEWTIREFKICGEEQLDAHRLIRHFHYTVWPDHGVPETTQSLIQFVRTVRDYINRSPGAGPTVVHCSAGVGRTGTFIALDRILQQLDSKDSVDIYGAVHDLRLHRVHMVQTECQYVYLHQCVRDVLRARKLRSEQENPLFPIYENVNPEYHRDPVYSRH

SEQ ID NO: 810141 - protein, 344 aa, Homo sapiens
MVEKDPLPVCALSVHLNLGQKGNRKTSCPIKINQFEGHFMKLQADSNYLLSKEYEELKDVGRNQSCDIALLPENRGKNRYNNILPYDATRVKLSNVDDDPCSDYINASYIPGNNFRREYIVTQGPLPGTKDDFWKMVWEQNVHNIVMVTQCVEKGRVKCDHYWPADQDSLYYGDLILQMLSESVLPEWTIREFKICGEEQLDAHRLIRHFHYTVWPDHGVPETTQSLIQFVRTVRDYINRSPGAGPTVVHCSAGVGRTGTFIALDRILQQLDSKDSVDIYGAVHDLRLHRVHMVQTECQYVYLHQCVRDVLRARKLRSEQENPLFPIYENVNPEYHRDPVYSRH

SEQ ID NO: 810142 - protein, 912 aa, Homo sapiens [sequence omitted]

SEQ ID NO: 810143 - protein, 294 aa, Homo sapiens
MLSHGAGLALWITLSLLQTGLAEPERCNFTLAESKASSHSVSIQWRILGSPCNFSLIYSSDTLGAALCPTFRIDNTTYGCNLQDLQAGTIYNFKIISLDEERTVVLQTDPLPPARFGVSKEKTTSTGLHVWWTPSSGKVTSYEVQLFDENNQKIQGVQIQESTSWNEYTFFNLTAGSKYNIAITAVSGGKRSFSVYTNGSTVPSPVKDIGISTKANSLLISWSHGSGNVERYRLMLMDKGILVHGGVVDKHATSYAFHGLTPGYLYNLTVMTEAAGLQNYRWKLVRTGKFPLAS

SEQ ID NO: 810144 - protein, 100 aa, Homo sapiens
MEVSNLKVTNDGSLTSLKVKWQRPPGNVDSYNITLSHKGTIKESRVLAPWITETHFKELVPGRLYQVTVSCVSGELSAQKMAVGRTCESWAPECSLVAQI

SEQ ID NO: 810145 - protein, 94 aa, Homo sapiens
NSAQGCHCPSAVTFSSPRLAASEAPDPMEEWDVPQMKKEVESLKYQLAFQREMASKTIPELLKWIEDGIPKDPFLNPDLMKNNPWVEKGKCTIL

SEQ ID NO: 810146 - protein, 140 aa, Homo sapiens
SGVRFFTHPSPSFNQWKAANWPAQHTAAQGHGRRSQSSTRVCTHMCTDQCQKHRPASSQSWEQSTHAHPEWLWKLQGARDTGSPCSHGKAGTGDLKATNRKIGEKREMVVTVGHYFLAKPWKNTFYTSRWQIVAAICVCK

SEQ ID NO: 810147 - protein, 142 aa, Homo sapiens
EETGPGPAVEGSELARSAHRGPGPRQALTIEHTRVHTHVHRSVSEASTCELTELGAEHPRTPRMAMEAAGRQGHWESLLSWQSRDGGLKSHQQENRGKKGDGGNSWTLFLGKTVEKHVLHQQVANCGRHLCLQIKFNWSLKK

SEQ ID NO: 810148 - protein, 189 aa, Homo sapiens
MSGQSLTDRITAAQHSVTGSAVSKTVCKATTHEIMGPKKKHLDYLIQCTNEMNVNIPQLADSLFERTTNSSWVVVFKSLITTHHLMVYGNERFIQYLASRNTLFNLSNFLDKSGLQGYDMSTFIRRYSRYLNEKAVSYRQVAFDFTKVKRGADGVMRTMNTEKLLKTVPIIQNQMDALLDFNVSYAFVI

SEQ ID NO: 810149 - protein, 610 aa, Homo sapiens
MSGQSLTDRITAAQHSVTGSAVSKTVCKATTHEIMGPKKKHLDYLIQCTNEMNVNIPQLADSLFERTTNSSWVVVFKSLITTHHLMVYGNERFIQYLASRNTLFNLSNFLDKSGLQGYDMSTFIRRYSRYLNEKAVSYRQVAFDFTKVKRGADGVMRTMNTEKLLKTVPIIQNQMDALLDFNVNSNELTNGVINAAFMLLFKDAIRLFAAYNEGIINLLEKYFDMKKNQCKEGLDIYKKFLTRMTRISEFLKVAEQVGIDRGDIPDLSQAPSSLLDALEQHLASLEGKKIKDSTAASRATTLSNAVSSLASTGLSLTKVDEREKQAALEEEQARLKALKEQRLKELAKKPHTSLTTAASPVSTSAGGIMTAPAIDIFSTPSSSNSTSKLPNDLLDLQQPTFHPSVHPMSTASQVASTWGGFTPSPVAQPHPSAGLNVDFESVFGNKSTNVIVDSGGFDELGGLLKPTVASQNQNLPVAKLPPSKLVSDDLDSSLANLVGNLGIGNGTTKNDVNWSQPGEKKLTGGSNWQPKVAPTTAWNAATMNGMHFPQYAPPVMAYPATTPTGMIGYGIPPQMGSVPVMTQPTLIYSQPVMRPPNPFGPVSGAQIQFM

SEQ ID NO: 810150 - protein, 613 aa, Homo sapiens
GRTRGRPTRPRTRGAAQHSVTGSAVSKTVCKATTHEIMGPKKKHLDYLIQCTNEMNVNIPQLADSLFERTTNSSWVVVFKSLITTHHLMVYGNERFIQYLASRNTLFNLSNFLDKSGLQGYDMSTFIRRYSRYLNEKAVSYRQVAFDFTKVKRGADGVMRTMNTEKLLKTVPIIQNQMDALLDFNVNSNELTNGVINAAFMLLFKDAIRLFAAYNEGIINLLEKYFDMKKNQCKEGLDIYKKFLTRMTRISEFLKVAEQVGIDRGDIPDLSQAPSSLLDALEQHLASLEGKKIKDSTAASRATTLSNAVSSLASTGLSLTKVDEREKQAALEEEQARLKALKEQRLKELAKKPHTSLTTAASPVSTSAGGIMTAPAIDIFSTPSSSNSTSKLPNDLLDLQQPTFHPSVHPMSTASQVASTWGGFTPSPVAQPHPSAGLNVDFESVFGNKSTNVIVDSGGFDELGGLLKPTVASQNQNLPVAKLPPSKLVSDDLDSSLANLVGNLGIGNGTTKNDVNWSQPGEKKLTGGSNWQPKVAPTTAWNAATMNGMHFPQYAPPVMAYPATTPTGMIGYGIPPQMGSVPVMTQPTLIYSQPVMRPPNPFGPVSGAQIQFM

SEQ ID NO: 810151 - protein, 491 aa, Homo sapiens [sequence omitted]

SEQ ID NO: 810152 - protein, 586 aa, Homo sapiens
PLTSSHPMSTASQVASTWGDLIQCTNEMNVNIPQLADSLFERTTNSSWVVVFKSLITTHHLMVYGNERFIQYLASRNTLFNLSNFLDKSGLQGYDMSTFIRRYSRYLNEKAVSYRQVAFDFTKVKRGADGVMRTMNTEKLLKTVPIIQNQMDALLDFNVNSNELTNGVINAAFMLLFKDAIRLFAAYNEGIINLLEKYFDMKKNQCKEGLDIYKKFLTRMTRISEFLKVAEQVGIDRGDIPDLSQAPSSLLDALEQHLASLEGKKIKDSTAASRATTLSNAVSSLASTGLSLTKVDEREKQAALEEEQARLKALKEQRLKELAKKPHTSLTTAASPVSTSAGGIMTAPAIDIFSTPSSSNSTSKLPNDLLDLQQPTFHPSVHPMSTASQVASTWGGFTPSPVAQPHPSAGLNVDFESVFGNKSTNVIVDSGGFDELGGLLKPTVASQNQNLPVAKLPPSKLVSDDLDSSLANLVGNLGIGNGTTKNDVNWSQPGEKKLTGGSNWQPKVAPTTAWNAATMNGMHFPQYAPPVMAYPATTPTGMIGYGIPPQMGSVPVMTQPTLIYSQPVMRPPNPFGPVSGAQIQFM

SEQ ID NO: 810153 - protein, 660 aa, Homo sapiens
MSGQSLTDRITAAQHSVTGSAVSKTVCKATTHEIMGPKKKHLDYLIQCTNEMNVNIPQLADSLFERTTNSSWVVVFKSLITTHHLMVYGNERFIQYLASRNTLFNLSNFLDKSGLQGYDMSTFIRRYSRYLNEKAVSYRQVAFDFTKVKRGADGVMRTMNTEKLLKTVPIIQNQMDALLDFNVNSNELTNGVINAAFMLLFKDAIRLFAAYNEGIINLLEKYFDMKKNQCKEGLDIYKKFLTRMTRISEFLKVAEQVGIDRGDIPDLSQAPSSLLDALEQHLASLEGKKIKDSTAASRATTLSNAVSSLASTGLSLTKVDEREKQAALEEEQARLKALKEQRLKELAKKPHTSLTTAASPVSTSAGGIMTAPAIDIFSTPSSSNSTSKLPNDLLDLQQPTFHPSVHPMSTASQVASTWGDPFSATVDAVDDAIPSLNPFLTKSSGDVHLSISSDVSTFTTRTPTHEMFVGFTPSPVAQPHPSAGLNVDFESVFGNKSTNVIVDSGGFDELGGLLKPTVASQNQNLPVAKLPPSKLVSDDLDSSLANLVGNLGIGNGTTKNDVNWSQPGEKKLTGGSNWQPKVAPTTAWNAATMNGMHFPQYAPPVMAYPATTPTGMIGYGIPPQMGSVPVMTQPTLIYSQPVMRPPNPFGPVSGAQIQFM

SEQ ID NO: 810154 - protein, 652 aa, Homo sapiens
MSGQSLTDRITAAQHSVTGSAVSKTVCKATTHEIMGPKKKHLDYLIQCTNEMNVNIPQLADSLFERTTNSSWVVVFKSLITTHHLMVYGNERFIQYLASRNTLFNLSNFLDKSGLQGYDMSTFIRRYSRYLNEKAVSYRQVAFDFTKVKRGADGVMRTMNTEKLLKTVPIIQNQMDALLDFNVNSNELTNGVINAAFMLLFKDAIRLFAAYNEGIINLLEKYFDMKKNQCKEGLDIYKKFLTRMTRISEFLKVAEQVGIDRGDIPDLSQAPSSLLDALEQHLASLEGKKIKDSTAASRATTLSNAVSSLASTGLSLTKVDEREKQAALEEEQARLKALKEQRLKELAKKPHTSLTTAASPVSTSAGGIMTAPAIDIFSTPSSSNSTSKLPNDLLDLQQPTFHPSVHPMSTASQVASTWGDPFSATVDAVDDAIPSLNPFLTKSSGDVHLSISSDVSTFTTRTPTHEMFVGFTPSPVAQPHPSAGLNVDFESVFGNKSTNVIVDSGGFDELGGLLKPTVASQNQNLPVAKLPPSKLVSDDLDSSLANLVGNLGIGNGTTKNDVNWSQPGEKKLTGGSNWQPKVAPTTAWNAATMAPPVMAYPATTPTGMIGYGIPPQMGSVPVMTQPTLIYSQPVMRPPNPFGPVSGAQIQFM

SEQ ID NO: 810155 - protein, 379 aa, Homo sapiens
MSFFQILFIKYFYYNLLNTMLFLQQVGIDRGDIPDLSQAPSSLLDALEQHLASLEGKKIKDSTAASRATTLSNAVSSLASTGLSLTKVDEREKQAALEEEQARLKALKEQRLKELAKKPHTSLTTAASPVSTSAGGIMTAPAIDIFSTPSSSNSTSKLPNDLLDLQQPTFHPSVHPMSTASQVASTWGGFTPSPVAQPHPSAGLNVDFESVFGNKSTNVIVDSGGFDELGGLLKPTVASQNQNLPVAKLPPSKLVSDDLDSSLANLVGNLGIGNGTTKNDVNWSQPGEKKLTGGSNWQPKVAPTTAWNAATMNGMHFPQYAPPVMAYPATTPTGMIGYGIPPQMGSVPVMTQPTLIYSQPVMRPPNPFGPVSGAQIQFM

SEQ ID NO: 810156 - protein, 351 aa, Homo sapiens
MKFLIFVQLQAPSSLLDALEQHLASLEGKKIKDSTAASRATTLSNAVSSLASTGLSLTKVDEREKQAALEEEQARLKALKEQRLKELAKKPHTSLTTAASPVSTSAGGIMTAPAIDIFSTPSSSNSTSKLPNDLLDLQQPTFHPSVHPMSTASQVASTWGGFTPSPVAQPHPSAGLNVDFESVFGNKSTNVIVDSGGFDELGGLLKPTVASQNQNLPVAKLPPSKLVSDDLDSSLANLVGNLGIGNGTTKNDVNWSQPGEKKLTGGSNWQPKVAPTTAWNAATMNGMHFPQYAPPVMAYPATTPTGMIGYGIPPQMGSVPVMTQPTLIYSQPVMRPPNPFGPVSGAQIQFM

SEQ ID NO: 810157 - protein, 632 aa, Homo sapiens
MSGQSLTDRITAAQHSVTGSAVSKTVCKATTHEIMGPKKKHLDYLIQCTNEMNVNIPQLADSLFERTTNSSWVVVFKSLITTHHLMVYGNERFIQYLASRNTLFNLSNFLDKSGLQGYDMSTFIRRYSRYLNEKAVSYRQVAFDFTKVKRGADGVMRTMNTEKLLKTVPIIQNQMDALLDFNVNSNELTNGVINAAFMLLFKDAIRLFAAYNEGIINLLEKYFDMKKNQCKEGLDIYKKFLTRMTRISEFLKVAEQVGIDRGDIPDLSQAPSSLLDALEQHLASLEGKKIKDSTAASRATTLSNAVSSLASTGLSLTKVDEREKQAALEEEQARLKALKEQRLKELAKKPHTSLTTAASPVSTSAGGIMTAPAIDIFSTPSSSNSTSKLPNDLLDLQQPTFHPSVHPMSTASQVASTWGDPFSATVDAVDDAIPSLNPFLTKSSGDVHLSISSDVSTFTTRTPTHEMFVGFTPSPVAQPHPSAGLNVDFESVFGNKSTNVIVDSGGFDELGGLLKPTVASQNQNLPVAKLPPSKLVSDDLDSSLANLVGNLGIGNGTTKNDVNWSQPGEKKLTGGSNWQPKVAPTTAWNAATMPPQMGSVPVMTQPTLIYSQPVMRPPNPFGPVSGAQIQFM

SEQ ID NO: 810158 - protein, 230 aa, Homo sapiens
GGRVGDPRVRGRVASPVSTSAGGIMTAPAIDIFSTPSSSNSTSKLPNDLLDLQQPTFHPSVHPMSTASQVASTWGGFDELGGLLKPTVASQNQNLPVAKLPPSKLVSDDLDSSLANLVGNLGIGNGTTKNDVNWSQPGEKKLTGGSNWQPKVAPTTAWNAATMNGMHFPQYAPPVMAYPATTPTGMIGYGIPPQMGSVPVMTQPTLIYSQPVMRPPNPFGPVSGAQIQFM

SEQ ID NO: 810159 - protein, 597 aa, Homo sapiens
MSGQSLTDRITAAQHSVTGSAVSKTVCKATTHEIMGPKKKHLDYLIQCTNEMNVNIPQLADSLFERTTNSSWVVVFKSLITTHHLMVYGNERFIQYLASRNTLFNLSNFLDKSGLQGYDMSTFIRRYSRYLNEKAVSYRQVAFDFTKVKRGADGVMRTMNTEKLLKTVPIIQNQMDALLDFNVNSNELTNGVINAAFMLLFKDAIRLFAAYNEGIINLLEKYFDMKKNQCKEGLDIYKKFLTRMTRISEFLKVAEQVGIDRGDIPDLSQAPSSLLDALEQHLASLEGKKIKDSTAASRATTLSNAVSSLASTGLSLTKVDEREKQAALEEEQARLKALKEQRLKELAKKPHTSLTTAASPVSTSAGGIMTAPAIDIFSTPSSSNSTSKLPNDLLDLQQPTFHPSVHPMSTASQVASTWGDPFSATVDAVDDAIPSLNPFLTKSSGDVHLSISSDVSTFTTRTPTHEMFVGFTPSPVAQPHPSAGLNVDFESVFGNKSTNVIVDSGGFDELGGLLKPTVASQNQNLPVAKLPPSKLVSDDLDSSLANLVGNLGIGNGTTKNDVNWSQPGEKKLTGGSNWQPKVAPTTAWNAATMIQFM

SEQ ID NO: 810160 - protein, 104 aa, Homo sapiens
ENPLVYCDGHGCSVAVHQACYGIVQVPTGPWFCRKCESQERAARVAPPVMAYPATTPTGMIGYGIPPQMGSVPVMTQPTLIYSQPVMRPPNPFGPVSGAQIQFM

SEQ ID NO: 810161 - protein, 84 aa, Homo sapiens
ENPLVYCDGHGCSVAVHQACYGIVQVPTGPWFCRKCESQERAARVPPQMGSVPVMTQPTLIYSQPVMRPPNPFGPVSGAQIQFM

SEQ ID NO: 810162 - protein, 610 aa, Homo sapiens; identical to SEQ ID NO: 810149

SEQ ID NO: 810163 - protein, 610 aa, Homo sapiens; identical to SEQ ID NO: 810149

SEQ ID NO: 810164 - protein, 610 aa, Homo sapiens; identical to SEQ ID NO: 810149

SEQ ID NO: 810165 - protein, 610 aa, Homo sapiens; identical to SEQ ID NO: 810149

SEQ ID NO: 810166 - protein, 610 aa, Homo sapiens; identical to SEQ ID NO: 810149

SEQ ID NO: 810167 - protein, 610 aa, Homo sapiens; identical to SEQ ID NO: 810149

SEQ ID NO: 810168 - protein, 610 aa, Homo sapiens; identical to SEQ ID NO: 810149

SEQ ID NO: 810169 - protein, 610 aa, Homo sapiens; identical to SEQ ID NO: 810149

SEQ ID NO: 810170 - protein, 170 aa, Homo sapiens
GRTRGRPTRPRTRGAAQHSVTGSAVSKTVCKATTHEIMGPKKKHLDYLIQCTNEMNVNIPQLADSLFERTTNSSWVVVFKSLITTHHLMVYGNERFIQYLASRNTLFNLSNFLDKSGLQGYDMSTFIRRYSRYLNEKAVSYRQVAFDFTKVKRGKTLEGVTRGREGGQSP

SEQ ID NO: 810171 - protein, 652 aa, Homo sapiens; identical to SEQ ID NO: 810154

SEQ ID NO: 810172 - protein, 610 aa, Homo sapiens; identical to SEQ ID NO: 810149

SEQ ID NO: 810173 - protein, 632 aa, Homo sapiens; identical to SEQ ID NO: 810157

SEQ ID NO: 810174 - protein, 622 aa, Homo sapiens
MSGQSLTDRITAAQHSVTGSAVSKTVCKATTHEIMGPKKKHLDYLIQCTNEMNVNIPQLADSLFERTTNSSWVVVFKSLITTHHLMVYGNERFIQYLASRNTLFNLSNFLDKSGLQGYDMSTFIRRYSRYLNEKAVSYRQVAFDFTKVKRGADGVMRTMNTEKLLKTVPIIQNQMDALLDFNVNSNELTNGVINAAFMLLFKDAIRLFAAYNEGIINLLEKYFDMKKNQCKEGLDIYKKFLTRMTRISEFLKVAEQVGIDRGDIPDLSQAPSSLLDALEQHLASLEGKKIKDSTAASRATTLSNAVSSLASTGLSLTKVDEREKQAALEEEQARLKALKEQRLKELAKKPHTSLTTAASPVSTSAGGIMTAPAIDIFSTPSSSNSTSKLPNDLLDLQQPTFHPSVHPMSTASQVASTWGDPFSATVDAVDDAIPSLNPFLTKSSGDVHLSISSDVSTFTTRTPTHEMFVGFTPSPVAQPHPSAGLNVDFESVFGNKSTNVIVDSGGFDELGGLLKPTVASQNQNLPVAKLPPSKLVSDDLDSSLANLVGNLGIGNGTTKNDVNWSQPGEKKLTGGSNWQPKVAPTTAWNAATMNGMLFPQYAPPVWLFCLENNRLIGLEFPK

SEQ ID NO: 810175 - protein, 294 aa, Homo sapiens
MSGQSLTDRITAAQHSVTGSAVSKTVCKATTHEIMGPKKKHLDYLIQCTNEMNVNIPQLADSLFERTTNSSWVVVFKSLITTHHLMVYGNERFIQYLASRNTLFNLSNFLDKSGLQGYDMSTFIRRYSRYLNEKAVSYRQVAFDFTKVKRGADGVMRTMNTEKLLKTVPIIQNQMDALLDFNVNSNELTNGVINAAFMLLFKDAIRLFAAYNEGIINLLEKYFDMKKNQCKEGLDIYKKFLTRMTRISEFLKVAEQVGIDRGDIPDLSQVSLLLKYQSTICCVQVVKSIKISNI

SEQ ID NO: 810176 - protein, 259 aa, Homo sapiens
MSGQSLTDRITAAQHSVTGSAVSKTVCKATTHEIMGPKKKHLDYLIQCTNEMNVNIPQLADSLFERTTNSSWVVVFKSLITTHHLMVYGNERFIQYLASRNTLFNLSNFLDKSGLQGYDMSTFIRRYSRYLNEKAVSYRQVAFDFTKVKRGADGVMRTMNTEKLLKTVPIIQNQMDALLDFNVNSNELTNGVINAAFMLLFKDAIRLFAAYNEGIINLLEKYFDMKKNQCKEGLDIYKKFLTRMTRISEFLKVAEVNCL

SEQ ID NO: 810177 - protein, 47 aa, Homo sapiens
PAGDISILLLLLAACVTLGKGLGLQASVTAPVKQGCRCLPPGALRGH

SEQ ID NO: 810178 - protein, 273 aa, Homo sapiens
MKRSAFLLCEEHPRRPDHGRRGRGEGRRSVRYPVPQPQAPRSRKRGGKGSRLLTQTSEGRSARRGVWLPSGDSRAHYGWPCVAKFKLSLRECLPRRRNTASSGHSAKRGGGDLRAEERRPSWERGGRASGGCALGAPGRRGSGESSLGRASGGAPGGSSPGACGPGPGVCKKPWNEADPPVQRWPRQGSPFWAGYQLGAEGGAETVVPAARCRRVHAAKPHTAPKPRGSPALAASFPRETWRLGGEKRTRCCSDPTVRRSQSHALRAVGRVQD

SEQ ID NO: 810179 - protein, 1004 aa, Homo sapiens
MLVWLVASGIVFYGELWVCAGLDYDYTFDGNEEDKTETIDYKDPCKAAVFWGDIALDDEDLNIFQIDRTIDLTQNPFGNLGHTTGGLGDHAMSKKRGALYQLIDRIRRIGFGLEQNNTVKGKVPLQFSGQNEKNRVPRAATSRTERIWPGGVIPYVIGGNFTGSQRAMFKQAMRHWEKHTCVTFIERSDEESYIVFTYRPCGCCSYVGRRGNGPQAISIGKNCDKFGIVVHELGHVIGFWHEHTRPDRDNHVTIIRENIQPGQEYNFLKMEPGEVNSLGERYDFDSIMHYARNTFSRGMFLDTILPSRDDNGIRPAIGQRTRLSKGDIAQARKLYRCPACGETLQESNGNLSSPGFPNGYPSYTHCIWRVSVTPGEKIVLNFTTMDLYKSSLCWYDYIEVRDGYWRKSPLLGRFCGDKLPEVLTSTDSRMWIEFRSSSNWVGKGFAAVYEAICGGEIRKNEGQIQSPNYPDDYRPMKECVWKITVSESYHVGLTFQSFEIERHDNCAYDYLEVRDGTSENSPLIGRFCGYDKPEDIRSTSNTLWMKFVSDGTVNKAGFAANFFKEEDECAKPDRGGCEQRCLNTLGSYQCACEPGYELGPDRRSCEAACGGLLTKLNGTITTPGWPKEYPPNKNCVWQVVAPTQYRISVKFEFFELEGNEVCKYDYVEIWSGLSSESKLHGKFCGAEVPEVITSQFNNMRIEFKSDNTVSKKGFKAHFFSDKDECSKDNGGCQHECVNTMGSYMCQCRNGFVLHDNKHDCKEAECEQKIHSPSGLITSPNWPDKYPSRKECTWEISATPGHRIKLAFSEFEIEQHQECAYDHLEVFDGETEKSPILGRLCGNKIPDPLVATGNKMFVRFVSDASVQRKGFQATHSTECGGRLKAESKPRDLYSHAQFGDNNYPGQVDCEWLLVSERGSRLELSFQTFEVEEEADCGYDYVELFDGLDSTAVGLGRFCGSGPPEEIYSIGDSVLIHFHTDDTINKKGFHIRYKSIRYPDTTHTKK

SEQ ID NO: 810180 - protein, 1004 aa, Homo sapiens; identical to SEQ ID NO: 810179

SEQ ID NO: 810181 - protein, 387 aa, Homo sapiens
MLVWLVASGIVFYGELWVCAGLDYDYTFDGNEEDKTETIDYKDPCKAAVFWGDIALDDEDLNIFQIDRTIDLTQNPFGNLGHTTGGLGDHAMSKKRGALYQLIDRIRRIGFGLEQNNTVKGKVPLQFSGQNEKNRVPRAATSRTERIWPGGVIPYVIGGNFTGSQRAMFKQAMRHWEKHTCVTFIERSDEESYIVFTYRPCGCCSYVGRRGNGPQAISIGKNCDKFGIVVHELGHVIGFWHEHTRPDRDNHVTIIRENIQPGQEYNFLKMEPGEVNSLGERYDFDSIMHYARNTFSRGMFLDTILPSRDDNGIRPAIGQRTRLSKGDIAQARKLYRCPACGETLQESNGNLSSPGFPNGYPSYTHCIWRVSVTPGEKVVYTVKPTIL

SEQ ID NO: 810182 - protein, 158 aa, Homo sapiens
MNQEKLAKLQAQVRIGGKGTARRKKKVVHRTATADDKKLQSSLKKLAVNNIAGIEEVNMIKDDGTVIHFNNPKVQASLSANTFAITGHAEAKPITEMLPGILSQLGADSLTSLRKLAEQFPRQVLDSKAPKPEDIDEEDDDVPDLVENFDEASKNEAN

SEQ ID NO: 810183 - protein, 163 aa, Homo sapiens
SPRMPRGHLHLPPLALRGMRKAGGGWSSDVRSRDRLPRRGRGGVGCITWICSRRRRRRRRLSLSRLRQPSFSCRVLVLEDPPCFRFTNSMNQEKLAKLQAQVRIGGKGTARRKKKVVHRTATADDKKLQSSLKKLAVNNIAGIEEHYLQEPRFGRNLFPSTDE

SEQ ID NO: 810184 - protein, 158 aa, Homo sapiens; identical to SEQ ID NO: 810182

SEQ ID NO: 810185 - protein, 143 aa, Homo sapiens
SPRMPRGHLHLPPLALRGMRKAGGGWSSDVRSRDRLPRRGRGGVGCITWICSRRRRRRRRLSLSRLRQPSFSCRVLVLEDPPCFRFTNSMNQEKLAKLQAQVRIGGKVFLTNSYLFFHVGEYEYQLSYSLYFLKPKEELVVSN

SEQ ID NO: 810186 - protein, 101 aa, Homo sapiens
AADYYYYIRGRVDNPKVQASLSANTFAITGHAEAKPITEMLPGILSQLGADSLTSLRKLAEQFPRQVLDSKAPKPEDIDEEDDDVPDLVENFDEASKNEAN

SEQ ID NO: 810187 - protein, 167 aa, Homo sapiens
SPRMPRGHLHLPPLALRGMRKAGGGWSSDVRSRDRLPRRGRGGVGCITWICSRRRRRRRRLSLSRLRQPSFSCRVLVLEDPPCFRFTNSMNQEKLAKLQAQVRIGGKGTARRKKKVVHRTATADDKKLQSSLKKLAVNNIAGIEESWTVKHQNQKTLMRKMMMFQIL

SEQ ID NO: 810188 - protein, 158 aa, Homo sapiens; identical to SEQ ID NO: 810182

SEQ ID NO: 810189 - protein, 2089 aa, Homo sapiens
MEDTQAIDWDVEEEEETEQSSESLRCNVEPVGRLHIFSGAHGPEKDFPLHLGKNVVGRMPDCSVALPFPSISKQHAEIEILAWDKAPILRDCGSLNGTQILRPPKVLSPGVSHRLRDQELILFADLLCQYHRLDVSLPFVSRGPLTVEETPRVQGETQPQRLLLAEDSEEEVDFLSERRMVKKSRTTSSSVIVPESDEEGHSPVLGGLGPPFAFNLNSDTDVEEGQQPATEEASSAARRGATVEAKQSEAEVVTEIQLEKDQPLVKERDNDTKVKRGAGNGVVPAGVILERSQPPGEDSDTDVDDDSRPPGRPAEVHLERAQPFGFIDSDTDAEEERIPATPVVIPMKKRKIFHGVGTRGPGAPGLAHLQESQAGSDTDVEEGKAPQAVPLEKSQASMVINSDTDDEEEVSAALTLAHLKESQPAIWNRDAEEDMPQRVVLLQRSQTTTERDSDTDVEEEELPVENREAVLKDHTKIRALVRAHSEKDQPPFGDSDDSVEADKSSPGIHLERSQASTTVDINTQVEKEVPPGSAIIHIKKHQVSVEGTNQTDVKAVGGPAKLLVVSLEEAWPLHGDCETDAEEGTSLTASVVADVRKSQLPAEGDAGAEWAAAVLKQERAHEVGAQGGPPVAQVEQDLPISRENLTDLVVDTDTLGESTQPQREGAQVPTGREREQHVGGTKDSEDNYGDSEDLDLQATQCFLENQGLEAVQSMEDEPTQAFMLTPPQELGPSHCSFQTTGTLDEPWEVLATQPFCLRESEDSETQPFDTHLEAYGPCLSPPRAIPGDQHPESPVHTEPMGIQGRGRQTVDKVMGIPKETAERVGPERGPLERETEKLLPERQTDVTGEEELTKGKQDREQKQLLARDTQRQESDKNGESASPERDRESLKVEIETSEEIQEKQVQKQTLPSKAFEREVERPVANRECDPAELEEKVPKVILERDTQRGEPEGGSQDQKGQASSPTPEPGVGAGDLPGPTSAPVPSGSQSGGRGSPVSPRRHQKGLLNCKMPPAEKASRIRAAEKVSRGDQESPDACLPPTVPEAPAPPQKPLNSQSQKHLAPPPLLSPLLPSIKPTVRKTRQDGSQEAPEAPLSSELEPFHPKPKIRTRKSSRMTPFPATSAAPEPHPSTSTAQPVTPKPTSQATRSRTNRSSVKTPEPVVPTAPELQPSTSTDQPVTSEPTSQVTRGRKSRSSVKTPETVVPTALELQPSTSTDRPVTSEPTSQATRGRKNRSSVKTPEPVVPTAPELQPSTSTDQPVTSEPTYQATRGRKNRSSVKTPEPVVPTAPELRPSTSTDRPVTPKPTSRTTRSRTNMSSVKTPETVVPTAPELQISTSTDQPVTPKPTSRTTRSRTNMSSVKNPESTVPIAPELPPSTSTEQPVTPEPTSRATRGRKNRSSGKTPETLVPTAPKLEPSTSTDQPVTPEPTSQATRGRTNRSSVKTPETVVPTAPELQPSTSTDQPVTPEPTSQATRGRTDRSSVKTPETVVPTAPELQASASTDQPVTSEPTSRTTRGRKNRSSVKTPETVVPAAPELQPPTSTDQPVTPEPTSRATRGRTNRSSVKTPESIVPIAPELQPSTSRNQLVTPEPTSRATRCRTNRSSVKTPEPVVPTAPEPHPTTSTDQPVTPKLTSRATRRKTNRSSVKTPKPVEPAASDLEPFTPTDQSVTPEAIAQGGQSKTLRSSTVRAMPVPTTPEFQSPVTTDQPISPEPITQPSCIKRQRAAGNPGSLAAPIDHKPCSAPLEPKSQASRNQRWGAVRAAESLTAIPEPASPQLLETPIHASQIQKVEPAGRSRFTPELQPKASQSRKRSLATMDSPPHQKQPQRGEVSQKTVIIKEEEEDTAEKPGKEEDVVTPKPGKRKRDQAEEEPNRIPSRSLRRTKLNQESTAPKVLFTGVVDARGERAVLALGGSLAGSAAEASHLVTDRIRRTVKFLCALGRGIPILSLDWLHQSRKAGFFLPPDEYVVTDPEQEKNFGFSLQDALSRARERRLLEGYEIYVTPGVQPPPPQMGEIISCCGGTYLPSMPRSYKPQRVVITCPQDFPHCSIPLRVGLPLLSPEFLLTGVLKQEAKPEAFVLSPLEMSST

SEQ ID NO: 810190 - protein, 1825 aa, Homo sapiens
MEDTQAIDWDVEEEEETEQSSESLRCNVEPVGRLHIFSGAHGPEKDFPLHLGKNVVGRMPDCSVALPFPSISKQHAEIEILAWDKAPILRDCGSLNGTQILRPPKVLSPGVSHRLRDQELILFADLLCQYHRLDVSLPFVSRGPLTVEETPRVQGETQPQRLLLAEDSEEEVDFLSERRMVKKSRTTSSSVIVPESDEEGHSPVLGGLGPPFAFNLNSDTDVEEGQQPATEEASSAARRGATVEAKQSEAEVVTEIQLEKDQPLVKERDNDTKVKRGAGNGVVPAGVILERSQPPGEDSDTDVDDDSRPPGRPAEVHLERAQPFGFIDSDTDAEEERIPATPVVIPMKKRKIFHGVGTRGPGAPGLAHLQESQAGSDTDVEEGKAPQAVPLEKSQASMVINSDTDDEEEVSAALTLAHLKESQPAIWNRDAEEDMPQRVVLLQRSQTTTERDSDTDVEEEELPVENREAVLKDHTKIRALVRAHSEKDQPPFGDSDDSVEADKSSPGIHLERSQASTTVDINTQVEKEVPPGSAIIHIKKHQVSVEGTNQTDVKAVGGPAKLLVVSLEEAWPLHGDCETDAEEGTSLTASVVADVRKSQLPAEGDAGAEWAAAVLKQERAHEVGAQGGPPVAQVEQDLPISRENLTDLVVDTDTLGESTQPQREGAQVPTGREREQHVGGTKDSEDNYGDSEDLDLQATQCFLENQGLEAVQSMEDEPTQAFMLTPPQELGPSHCSFQTTGLLNCKMPPAEKASRIRAAEKVSRGDQESPDACLPPTVPEAPAPPQKPLNSQSQKHLAPPPLLSPLLPSIKPTVRKTRQDGSQEAPEAPLSSELEPFHPKPKIRTRKSSRMTPFPATSAAPEPHPSTSTAQPVTPKPTSQATRSRTNRSSVKTPEPVVPTAPELQPSTSTDQPVTSEPTSQVTRGRKSRSSVKTPETVVPTALELQPSTSTDRPVTSEPTSQATRGRKNRSSVKTPEPVVPTAPELQPSTSTDQPVTSEPTYQATRGRKNRSSVKTPEPVVPTAPELRPSTSTDRPVTPKPTSRTTRSRTNMSSVKTPETVVPTAPELQISTSTDQPVTPKPTSRTTRSRTNMSSVKNPESTVPIAPELPPSTSTEQPVTPEPTSRATRGRKNRSSGKTPETLVPTAPKLEPSTSTDQPVTPEPTSQATRGRTNRSSVKTPETVVPTAPELQPSTSTDQPVTPEPTSQATRGRTDRSSVKTPETVVPTAPELQASASTDQPVTSEPTSRTTRGRKNRSSVKTPETVVPAAPELQPPTSTDQPVTPEPTSRATRGRTNRSSVKTPESIVPIAPELQPSTSRNQLVTPEPTSRATRCRTNRSSVKTPEPVVPTAPEPHPTTSTDQPVTPKLTSRATRRKTNRSSVKTPKPVEPAASDLEPFTPTDQSVTPEAIAQGGQSKTLRSSTVRAMPVPTTPEFQSPVTTDQPISPEPITQPSCIKRQRAAGNPGSLAAPIDHKPCSAPLEPKSQASRNQRWGAVRAAESLTAIPEPASPQLLETPIHASQIQKVEPAGRSRFTPELQPKASQSRKRSLATMDSPPHQKQPQRGEVSQKTVIIKEEEEDTAEKPGKEEDVVTPKPGKRKRDQAEEEPNRIPSRSLRRTKLNQESTAPKVLFTGVVDARGERAVLALGGSLAGSAAEASHLVTDRIRRTVKFLCALGRGIPILSLDWLHQSRKAGFFLPPDEYVVTDPEQEKNFGFSLQDALSRARERRLLEGYEIYVTPGVQPPPPQMGEIISCCGGTYLPSMPRSYKPQRVVITCPQDFPHCSIPLRVGLPLLSPEFLLTGVLKQEAKPEAFVLSPLEMSST

SEQ ID NO: 810191 - protein, 2089 aa, Homo sapiens; identical to SEQ ID NO: 810189

SEQ ID NO: 810192 - protein, 2089 aa, Homo sapiens; identical to SEQ ID NO: 810189

SEQ ID NO: 810193 - protein, 721 aa, Homo sapiens
MEDTQAIDWDVEEEEETEQSSESLRCNVEPVGRLHIFSGAHGPEKDFPLHLGKNVVGRMPDCSVALPFPSISKQHAEIEILAWDKAPILRDCGSLNGTQILRPPKVLSPGVSHRLRDQELILFADLLCQYHRLDVSLPFVSRGPLTVEETPRVQGETQPQRLLLAEDSEEEVDFLSERRMVKKSRTTSSSVIVPESDEEGHSPVLGGLGPPFAFNLNSDTDVEEGQQPATEEASSAARRGATVEAKQSEAEVVTEIQLEKDQPLVKERDNDTKVKRGAGNGVVPAGVILERSQPPGEDSDTDVDDDSRPPGRPAEVHLERAQPFGFIDSDTDAEEERIPATPVVIPMKKRKIFHGVGTRGPGAPGLAHLQESQAGSDTDVEEGKAPQAVPLEKSQASMVINSDTDDEEEVSAALTLAHLKESQPAIWNRDAEEDMPQRVVLLQRSQTTTERDSDTDVEEEELPVENREAVLKDHTKIRALVRAHSEKDQPPFGDSDDSVEADKSSPGIHLERSQASTTVDINTQVEKEVPPGSAIIHIKKHQVSVEGTNQTDVKAVGGPAKLLVVSLEEAWPLHGDCETDAEEGTSLTASVVADVRKSQLPAEGDAGAEWAAAVLKQERAHEVGAQGGPPVAQVEQDLPISRENLTDLVVDTDTLGESTQPQREGAQVPTGREREQHVGGTKDSEDNYGDSEDLDLQATQCFLENQGLEVQSMEDEPTQDN

SEQ ID NO: 810194 - protein, 112 aa, Homo sapiens
PVGVEDAQLAQRGQRARGERLQEVVPQVQLFQPRELLEGLGVQRADLVVLQVQPSELPQTVEVEGRDVGYEVAAEAVGATLREVWAARSPPAFYRKFGGAQGCLQKAIRRGE

SEQ ID NO: 810195 - protein, 146 aa, Homo sapiens
RGAQRQALGLLLQRHRQLHGASWTAAPAPRGPGCKEVSVRGGAHSGGEERVSVSWDPTESSAGSAPRWAPSAASVPQSCSSSRSLSYSTKALEQIPALPPTSSVSLDKRECSMAAFSLEQIKKIVTNNRRNTSTHIFSMGNKQISI

SEQ ID NO: 810196 - protein, 1722 aa, Homo sapiens [sequence omitted]

SEQ ID NO: 810197 - protein, 1336 aa, Homo sapiens
MYTFRKLSPYLNKISVCKSPVDVLQIFRVGRVNETTEFLSKLGNVRPLLHGSPVQNIVGILCRGLLLPKVVEDRGVQRTDVGNLGSGIYFSDSLSTSIKYSHPGETDGTRLLLICDVALGKCMDLHEKDFSLTEAPPGYDSVHGVSQTASVTTDFEDDEFVVYKTNQVKMKYIIKFSMPGDQIKDFHPSDHTELEEYRPEFSNFSKVEDYQLPDAKTSSSTKAGLQDASGNLVPLEDVHIKGRIIDTVAQVIVFQTYTNKSHVPIEAKYIFPLDDKAAVCGFEAFINGKHIVGEIKEKEEAQQEYLEAVTQGHGAYLMSQDAPDVFTVSVGNLPPKAKVLIKITYITELSILGTVGVFFMPATVAPWQQDKALNENLQDTVEKICIKEIGTKQSFSLTMSIEMPYVIEFIFSDTHELKQKRTDCKAVISTMEGSSLDSSGFSLHIGLSAAYLPRMWVEKHPEKESEACMLVFQPDLDVDLPDLASESEVIICLDCSSSMEGVTFLQAKQIALHALSLVGEKQKVNIIQFGTGYKELFSYPKHITSNTTAAEFIMSATPTMGNTDFWKTLRYLSLLYPARGSRNILLVSDGHLQDESLTLQLVKRSRPHTRLFACGIGSTANRHVLRILSQCGAGVFEYFNAKSKHSWRKQIEDQMTRLCSPSCHSVSVKWQQLNPDAPEALQAPAQVPSLFRNDRLLVYGFIPHCTQATLCALIQEKEFCTMVSTTELQKTTGTMIHKLAARALIRDYEDGILHENETSHEMKKQTLKSLIIKLSKENSLITQFTSFVAVEKRDENESPFPDIPKVSELIAKEDVDFLPYMSWQGEPQEAVRNQSLLASSEWPELRLSKRKHRKIPFSKRKMELSQPEVSEDFEEDGLGVLPAFTSNLERGGVEKLLDLSWTESCKPTATEPLFKKVSPWETSTSSFFPILAPAVGSYLPPTARAHSPASLSFASYRQVASFGSAAPPRQFDASQFSQGPVPGTCADWIPQSASCPTGPPQNPPSAPYCGIVFSGSSLSSAQSAPLQHPGGFTTRPSAGTFPELDSPQLHFSLPTDPDPIRGFGSYHPSAYSPFHFQPSAASLTANLRLPMASALPEALCSQSRTTPVDLCLLEESVGSLEGSRCPVFAFQSSDTESDELSEVLQDSCFLQIKCDTKDDSIPCFLEVKEEDEIVCTQHWQDAVPWTELLSLQTEDGFWKLTPELGLILNLNTNGLHSFLKQKGIQSLGVKGRECLLDLIATMLVLQFIRTRLEKEGIVFKSLMKMDDPSISRNIPWAFEAIKQASEWVRRTEGQYPSICPRLELGNDWDSATKQLLGLQPISTVSPLHRVLHYSQG

SEQ ID NO: 810198 - protein, 938 aa, Homo sapiens
MSIEMPYVIEFIFSDTHELKQKRTDCKAVISTMEGSSLDSSGFSLHIGLSAAYLPRMWVEKHPEKESEACMLVFQPDLDVDLPDLASESEVIICLDCSSSMEGVTFLQAKQIALHALSLVGEKQKVNIIQFGTGYKELFSYPKHITSNTTAAEFIMSATPTMGNTDFWKTLRYLSLLYPARGSRNILLVSDGHLQDESLTLQLVKRSRPHTRLFACGIGSTANRHVLRILSQCGAGVFEYFNAKSKHSWRKQIEDQMTRLCSPSCHSVSVKWQQLNPDAPEALQAPAQVPSLFRNDRLLVYGFIPHCTQATLCALIQEKEFCTMVSTTELQKTTGTMIHKLAARALIRDYEDGILHENETSHEMKKQTLKSLIIKLSKENSLITQFTSFVAVEKRDENESPFPDIPKVSELIAKEDVDFLPYMSWQGEPQEAVRNQSLLASSEWPELRLSKRKHRKIPFSKRKMELSQPEVSEDFEEDGLGVLPAFTSNLERGGVEKLLDLSWTESCKPTATEPLFKKVSPWETSTSSFFPILAPAVGSYLPPTARAHSPASLSFASYRQVASFGSAAPPRQFDASQFSQGPVPGTCADWIPQSASCPTGPPQNPPSAPYCGIVFSGSSLSSAQSAPLQHPGGFTTRPSAGTFPELDSPQLHFSLPTDPDPIRGFGSYHPSAYSPFHFQPSAASLTANLRLPMASALPEALCSQSRTTPVDLCLLEESVGSLEGSRCPVFAFQSSDTESDELSEVLQDSCFLQIKCDTKDDSIPCFLEVKEEDEIVCTQHWQDAVPWTELLSLQTEDGFWKLTPELGLILNLNTNGLHSFLKQKGIQSLGVKGRECLLDLIATMLVLQFIRTRLEKEGIVFKSLMKMDDPSISRNIPWAFEAIKQASEWVRRTEGQYPSICPRLELGNDWDSATKQLLGLQPISTVSPLHRVLHYSQG

SEQ ID NO: 810199 - protein, 1722 aa, Homo sapiens [sequence omitted]

SEQ ID NO: 810200 - protein, 1297 aa, Homo sapiens
MGIFANCIFCLKVKYLPQQQKKKLQTDIKENGGKFSFSLNPQCTHIILDNADVLSQYQLNSIQKNHVHIANPDFIWKSIREKRLLDVKNYDPYKPLDITPPPDQKASSSEVKTEGLCPDSATEEEDTVELTEFGMQNVEIPHLPQDFEVAKYNTLEKVGMEGGQEAVVVELQCSRDSRDCPFLISSHFLLDDGMETRRQFAIKKTSEDASEYFENYIEELKKQGFLLREHFTPEATQLASEQLQALLLEEVMNSSTLSQEVSDLVEMIWAEALGHLEHMLLKPVNRISLNDVSKAEGILLLVKAALKNGETAEQLQKMMTEFYRLIPHKGTMPKEVNLGLLAKKADLCQLIRDMVNVCETNLSKPNPPSLAKYRALRCKIEHVEQNTEEFLRVRKEVLQNHHSKSPVDVLQIFRVGRVNETTEFLSKLGNVRPLLHGSPVQNIVGILCRGLLLPKVVEDRGVQRTDVGNLGSGIYFSDSLSTSIKYSHPGETDGTRLLLICDVALGKCMDLHEKDFSLTEAPPGYDSVHGVSQTASVTTDFEDDEFVVYKTNQVKMKYIIKFSMPGDQIKDFHPSDHTELEEYRPEFSNFSKVEDYQLPDAKTSSSTKAGLQDASGNLVPLEDVHIKGRIIDTVAQVIVFQTYTNKSHVPIEAKYIFPLDDKAAVCGFEAFINGKHIVGEIKEKEEAQQEYLEAVTQGHGAYLMSQDAPDVFTVSVGNLPPKAKVLIKITYITELSILGTVGVFFMPATVAPWQQDKALNENLQDTVEKICIKEIGTKQSFSLTMSIEMPYVIEFIFSDTHELKQKRTDCKAVISTMEGSSLDSSGFSLHIGLSAAYLPRMWVEKHPEKESEACMLVFQPDLDVDLPDLASESEVIICLDCSSSMEGVTFLQAKQIALHALSLVGEKQKVNIIQFGTGYKELFSYPKHITSNTTAAEFIMSATPTMGNTDFWKTLRYLSLLYPARGSRNILLVSDGHLQDESLTLQLVKRSRPHTRLFACGIGSTANRHVLRILSQCGAGVFEYFNAKSKHSWRKQIEDQMTRLCSPSCHSVSVKWQQLNPDAPEALQAPAQVPSLFRNDRLLVYGFIPHCTQATLCALIQEKEFCTMVSTTELQKTTGTMIHKLAARALIRDYEDGILHENETSHEMKKQTLKSLIIKLSKENSLITQFTSFVAVEKRDENESPFPDIPKVSELIAKEDVDFLPYMSWQGEPQEAVRNQSLLASSEWPELRLSKRKHRKIPFSKRKMELSQPEVSEDFEEDGLGVLPAFTSNLERGVLTQKVMSYQKYFKTAAFYK

SEQ ID NO: 810201 - protein, 1722 aa, Homo sapiens [sequence omitted]

SEQ ID NO: 810202 - protein, 246 aa, Homo sapiens [sequence omitted]

SEQ ID NO: 810203 - protein, 1003 aa, Homo sapiens
MGIFANCIFCLKVKYLPQQQKKKLQTDIKENGGKFSFSLNPQCTHIILDNADVLSQYQLNSIQKNHVHIANPDFIWKSIREKRLLDVKNYDPYKPLDITPPPDQKASSSEVKTEGLCPDSATEEEDTVELTEFGMQNVEIPHLPQDFEVAKYNTLEKVGMEGGQEAVVVELQCSRDSRDCPFLISSHFLLDDGMETRRQFAIKKTSEDASEYFENYIEELKKQGFLLREHFTPEATQLASEQLQALLLEEVMNSSTLSQEVSDLVEMIWAEALGHLEHMLLKPVNRISLNDVSKAEGILLLVKAALKNGETAEQLQKMMTEFYRLIPHKGTMPKEVNLGLLAKKADLCQLIRDMVNVCETNLSKPNPPSLAKYRALRCKIEHVEQNTEEFLRVRKEVLQNHHSKSPVDVLQIFRVGRVNETTEFLSKLGNVRPLLHGSPVQNIVGILCRGLLLPKVVEDRGVQRTDVGNLGSGIYFSDSLSTSIKYSHPGETDGTRLLLICDVALGKCMDLHEKDFSLTEAPPGYDSVHGVSQTASVTTDFEDDEFVVYKTNQVKMKYIIKFSMPGDQIKDFHPSDHTELEEYRPEFSNFSKVEDYQLPDAKTSSSTKAGLQDASGNLVPLEDVHIKGRIIDTVAQVIVFQTYTNKSHVPIEAKYIFPLDDKAAVCGFEAFINGKHIVGEIKEKEEAQQEYLEAVTQGHGAYLMSQDAPDVFTVSVGNLPPKAKVLIKITYITELSILGTVGVFFMPATVAPWQQDKALNENLQDTVEKICIKEIGTKQSFSLTMSIEMPYVIEFIFSDTHELKQKRTDCKAVISTMEGSSLDSSGFSLHIGLSAAYLPRMWVEKHPEKESEACMLVFQPDLDVDLPDLASESEVIICLDCSSSMEGVTFLQAKQIALHALSLVGEKQKVNIIQFGTGYKELFSYPKHITSNTTAAEFIMSATPTMGNTDFWKTLRYLSLLYPARGSRNILLVSDGHLQDESLTLQLVKRSRPHTRLFACGIG

SEQ ID NO: 810204 - protein, 1003 aa, Homo sapiens; identical to SEQ ID NO: 810203

SEQ ID NO: 810205 - protein, 864 aa, Homo sapiens
MGIFANCIFCLKVKYLPQQQKKKLQTDIKENGGKFSFSLNPQCTHIILDNADVLSQYQLNSIQKNHVHIANPDFIWKSIREKRLLDVKNYDPYKPLDITPPPDQKASSSEVKTEGLCPDSATEEEDTVELTEFGMQNVEIPHLPQDFEVAKYNTLEKVGMEGGQEAVVVELQCSRDSRDCPFLISSHFLLDDGMETRRQFAIKKTSEDASEYFENYIEELKKQGFLLREHFTPEATQLASEQLQALLLEEVMNSSTLSQEVSDLVEMIWAEALGHLEHMLLKPVNRISLNDVSKAEGILLLVKAALKNGETAEQLQKMMTEFYRLIPHKGTMPKEVNLGLLAKKADLCQLIRDMVNVCETNLSKPNPPSLAKYRALRCKIEHVEQNTEEFLRVRKEVLQNHHSKSPVDVLQIFRVGRVNETTEFLSKLGNVRPLLHGSPVQNIVGILCRGLLLPKVVEDRGVQRTDVGNLGSGIYFSDSLSTSIKYSHPGETDGTRLLLICDVALGKCMDLHEKDFSLTEAPPGYDSVHGVSQTASVTTDFEDDEFVVYKTNQVKMKYIIKFSMPGDQIKDFHPSDHTELEEYRPEFSNFSKVEDYQLPDAKTSSSTKAGLQDASGNLVPLEDVHIKGRIIDTVAQVIVFQTYTNKSHVPIEAKYIFPLDDKAAVCGFEAFINGKHIVGEIKEKEEAQQEYLEAVTQGHGAYLMSQDAPDVFTVSVGNLPPKAKVLIKITYITELSILGTVGVFFMPATVAPWQQDKALNENLQDTVEKICIKEIGTKQSFSLTMSIEMPYVIEFIFSDTHELKQKRTDCKAVISTMEGSSLDSSGFSLHIGLSAAYLPRMWVEKHPEKESEVYSFLLRHRRHY

SEQ ID NO: 810206 - protein, 525 aa, Homo sapiens
MAVPGEAEEEATVYLVVSGIPSVLRSAHLRSYFSQFREERGGGFLCFHYRHRPERAPPQAAPNSALIPTDPAAEGQLLSQTSATDVRPLSTRDSTPIQTRTCCCVISVRGLAQAQRLIRMYSGRRWLDSHGTWLPGRCLIRRLRLPTEASGLGSFPFKTRKELQSWKAENEAFTLADLKQLPELNPPVLMPRGNVGTPLRVFLELIRACRLPPRIITQLQLQFPKTGSSRRYGNVPFEYEDSETVEQEELVYTAEGEEIPQGTYLADIPASPCGEPEEEVGKEEEEESHSDEDDDRGEEWERHEALHEDVTGQERTTEQLFEEEIELKWEKGGSGLVFYTDAQFWQEEEGDFDEQTADDWDVDMSVYYDRDGGDKDARDSVQMRLEQRLRDGQEDGSVIERQVGTFERHTKGIGRKVMERQGWAEGQGLGCRCSGVPEALDSDGQHPRCKRGLGYHGEKLQPFGQLKRPRRNGLGLISTIYDEPLPQDQTESLLRRQPPTSMKFRTDMAFVRGSSCASDSPSLPD

SEQ ID NO: 810207 - protein, 334 aa, Homo sapiens
MSGLSPLETLLQSRPAPAAASSRIITQLQLQFPKTGSSRRYGNVPFEYEDSETVEQEELVYTAEGEEIPQGTYLADIPASPCGEPEEEVGKEEEEESHSDEDDDRGEEWERHEALHEDVTGQERTTEQLFEEEIELKWEKGGSGLVFYTDAQFWQEEEGDFDEQTADDWDVDMSVYYDRDGGDKDARDSVQMRLEQRLRDGQEDGSVIERQVGTFERHTKGIGRKVMERQGWAEGQGLGCRCSGVPEALDSDGQHPRCKRGLGYHGEKLQPFGQLKRPRRNGLGLISTIYDEPLPQDQTESLLRRQPPTSMKFRTDMAFVRGSSCASDSPSLPD

SEQ ID NO: 810208 - protein, 324 aa, Homo sapiens
MGNLLKVLTCTDLEQGPNFFLDFENAQPTESEKEIYNQVNVVLKDAEGILEDLQSYRGAGHEIREAIQHPADEKLQEKAWGAVVPLVGKLKKFYEFSQRLEAALRGLLGALTSTPYSPTQHLEREQALAKQFAEILHFTLRFDELKMTNPAIQNDFSYYRRTLSRMRINNVPAEGENEVNNELANRMSLFYAEATPMLKTLSDATTKFVSENKNLPIENTTDCLSTMASVCRVMLETPEYRSRFTNEETVSFCLRVMVGVIILYDHVHPVGAFAKTSKIDMKGCIKVLKDQPPNSVEGLLNALRYTTKHLNDETTSKQIKSMLQ

SEQ ID NO: 810209 - protein, 324 aa, Homo sapiens; identical to SEQ ID NO: 810208

SEQ ID NO: 810210 - protein, 107 aa, Homo sapiens
MTNPAIQNDFSYYRRTLSRMRINNVPAEGENEVNNELANRMSLFYAEATPMLKTLSDATTKFVSENKNLPIENTTDCLSTMASVCRVMLETPEYRSRLPPGGDAVIC

SEQ ID NO: 810211 - protein, 324 aa, Homo sapiens; identical to SEQ ID NO: 810208

SEQ ID NO: 810212 - protein, 324 aa, Homo sapiens; identical to SEQ ID NO: 810208

SEQ ID NO: 810213 - protein, 324 aa, Homo sapiens; identical to SEQ ID NO: 810208

SEQ ID NO: 810214 - protein, 324 aa, Homo sapiens; identical to SEQ ID NO: 810208

SEQ ID NO: 810215 - protein, 324 aa, Homo sapiens; identical to SEQ ID NO: 810208

SEQ ID NO: 810216 - protein, 324 aa, Homo sapiens; identical to SEQ ID NO: 810208

SEQ ID NO: 810217 - protein, 324 aa, Homo sapiens; identical to SEQ ID NO: 810208

SEQ ID NO: 810218 - protein, 324 aa, Homo sapiens; identical to SEQ ID NO: 810208

SEQ ID NO: 810219 - protein, 324 aa, Homo sapiens; identical to SEQ ID NO: 810208

SEQ ID NO: 810220 - protein, 351 aa, Homo sapiens
MGNLIKVLTRGHRPQCSTFFLGLWYLNMGNLLKVLTCTDLEQGPNFFLDFENAQPTESEKEIYNQVNVVLKDAEGILEDLQSYRGAGHEIREAIQHPADEKLQEKAWGAVVPLVGKLKKFYEFSQRLEAALRGLLGALTSTPYSPTQHLEREQALAKQFAEILHFTLRFDELKMTNPAIQNDFSYYRRTLSRMRINNVPAEGENEVNNELANRMSLFYAEATPMLKTLSDATTKFVSENKNLPIENTTDCLSTMASVCRVMLETPEYRSRFTNEETVSFCLRVMVGVIILYDHVHPVGAFAKTSKIDMKGCIKVLKDQPPNSVEGLLNALRYTTKHLNDETTSKQIKSMLQ

SEQ ID NO: 810221 - protein, 324 aa, Homo sapiens; identical to SEQ ID NO: 810208

SEQ ID NO: 810222 - protein, 351 aa, Homo sapiens; identical to SEQ ID NO: 810220

SEQ ID NO: 810223 - protein, 178 aa, Homo sapiens
MTNPAIQNDFSYYRRTLSRMRINNVPAEGENEVNNELANRMSLFYAEATPMLKTLSDATTKFVSENKNLPIENTTDCLSTMASVCRVMLETPEYRSRFTNEETVSFCLRVMVGVIILYDHVHPVGAFAKTSKIDMKGCIKVLKDQPPNSVEGLLNALRYTTKHLNDETTSKQIKSMLQ

SEQ ID NO: 810224 - protein, 178 aa, Homo sapiens; identical to SEQ ID NO: 810223

SEQ ID NO: 810225 - protein, 178 aa, Homo sapiens; identical to SEQ ID NO: 810223

SEQ ID NO: 810226 - protein, 324 aa, Homo sapiens; identical to SEQ ID NO: 810208

SEQ ID NO: 810227 - protein, 324 aa, Homo sapiens; identical to SEQ ID NO: 810208

SEQ ID NO: 810228 - protein, 324 aa, Homo sapiens; identical to SEQ ID NO: 810208

SEQ ID NO: 810229 - protein, 310 aa, Homo sapiens
MGNLLKVLTCTDLEQGPNFFLDFENAQPTESEKEIYNQVNVVLKDAEGILEDLQSYRGAGHEIREAIQHPADEKLQEKAWGAVVPLVGKLKKFYEFSQRLEAALRGLLGALTSTPYSPTQHLEREQALAKQFAEILHFTLRFDELKMTNPAIQNDFSYYRRTLSRMRINNVPAEGENEVNNELANRMSLFYAEATPMLKTLSDATTKFVSENKNLPIENTTDCLSTMASVCRVMLETPEYRSRFTNEETVSFCLRVMVGVIILYDHVHPVGAFAKTSKIDMKGCIKVLKDQPPNSVEGLLNALSAITILE

SEQ ID NO: 810230 - protein, 296 aa, Homo sapiens
MGNLLKVLTCTDLEQGPNFFLDFENAQPTESEKEIYNQVNVVLKDAEGILEDLQSYRGAGHEIREAIQHPADEKLQEKAWGAVVPLVGKLKKFYEFSQRLEAALRGLLGALTSTPYSPTQHLEREQALAKQFAEILHFTLRFDELKMTNPAIQNDFSYYRRTLSRMRINNVPAEGENEVNNELANRMSLFYAEATPMLKTLSDATTKFVSENKNLPIENTTDCLSTMASVCRVMLETPEYRSRFTNEETVSFCLRVMVGVIILYDHVHPVGAFAKTSKIDCGRSSKCSQVHNKTFE

SEQ ID NO: 810231 - protein, 324 aa, Homo sapiens; identical to SEQ ID NO: 810208

SEQ ID NO: 810232 - protein, 298 aa, Homo sapiens
MGNLLKVLTCTDLEQGPNFFLDFENAQPTESEKEIYNQVNVVLKDAEGILEDLQSYRGAGHEIREAIQHPADEKLQEKAWGAVVPLVGKLKKFYEFSQRLEAALRGLLGALTSTPYSPTQHLEREQALAKQFAEILHFTLRFDELKMTNPAIQNDFSYYRRTLSRMRINNVPAEGENEVNNELANRMSLFYAEATPMLKTLSDATTKFVSENKNLPIENTTDCLSTMASVCRVMLETPEYRSRFTNEETVSFCLRVMVGVIILYDHVHPVGAFAKTSKIDCKLLFYINNFKRVSPWKP

SEQ ID NO: 810233 - protein, 241 aa, Homo sapiens
MGNLLKVLTCTDLEQGPNFFLDFENAQPTESEKEIYNQVNVVLKDAEGILEDLQSYRGAGHEIREAIQHPADEKLQEKAWGAVVPLVGKLKKFYEFSQRLEAALRGLLGALTSTPYSPTQHLEREQALAKQFAEILHFTLRFDELKMTNPAIQNDFSYYRRTLSRMRINNVPAEGENEVNNELANRMSLFYAEATPMLKTLSDATTKFVSEQYTISLEIPDCVSPRFVFQVFWEPGYNALH

SEQ ID NO: 810234 - protein, 966 aa, Homo sapiens
MCPLAHPAQDLPLLPSQLSLDPSGPEWDCPLGSKDLEEEGPWGGGSGLPPTGCFPGSWRQDVGLDCKGSPEGAEARAWTVYYYSLLQSCLQQAGLPETQDRGQVPRTGCPGAEVTLCVLGSPSTFLPVLLEGGVQSPGNMLLCLSPAWLMKVPAPGQPGEAALLVSKAVSFHPGGLTFLDDFVPPRRATYFLAGLGLGPGRGREAAELARDLTCPTGASAELARLLEDRLLTRQLLAQQGGVAVPATLAFTYKPPGLLRGGDASLGLRLVELSGKEGQETLVKEEVEAFLRSEALGDILQVAVKLSGWRWRGRQAWRLHPRAELGAVVDTVLALLEKLEEEESVLVEAVYPPAQLPCSDGPSPGPGLAVRICAVVCRTQGDRPLLSKVVCGVGRGDRPLRHHNSLPRTLEVALAQCGLGEEAQVAAVRQRVKAAAEAALAAVLALEAGLSAEQRGGRRAHTDFLGVDFALTAAGGVLTPVALELNGGLCLEACGALEGLWAAPRLGPAADEAVAAPLVETMLRRSARCLMEGKQLLVVGAGGVSKKFVWEAARDYGLQLHLVESDPNHFASQLVQTFIHFDMTEHRRDEENARLLAELVRARGLKLDGCFSYWDDCLVLTALLCQELGLPCSSPAAMRLAKQKSLTQLHLLHHHGPPWPAPSLHAVPCCPLESEADVERAVHQVPLPGVMKLEFGAGAVGVRLVEDAPQCHEHFSRITRDLQGEADHPGIGLGWGNAMLLMEFVEGTEHDVDLVLFGGRLLAAFVSDNGPTRLPGFTETAACMPTGLAPEQEAQMVQAAFRCCLGCGLLDGVFNVELKLTGAGPRLIEINPRMGGFYLRDWILELYGVDLLLAAVMVACGLRPALPTRPRARGHLVGVMCLVSQHLQALSSTASRETLQALHDRGLLRLNLLEEALVPGEYEEPYCSVACAGPSPTEARLRLLGLCQGLGIDGPSYPVAHFLSHFK

SEQ ID NO: 810235 - protein, 126 aa, Homo sapiens
MAPQGAHLLGDGTEALALANWDSMPSGLRPSPLPSGPQHTISQQPRDSLRPSLISPQGMGEGRHQATRSKETSRLAQGGRACPLEDRLSCQACPGLGTAKNKNSIHTKPPSSPILGGRQPQRGEGR

SEQ ID NO: 810236 - protein, 385 aa, Homo sapiens
MTEHRRDEENARLLAELVRARGLKLDGCFSYWDDCLVLTALLCQELGLPCSSPAAMRLAKQKSLTQLHLLHHHGPPWPAPSLHAVPCCPLESEADVERAVHQVPLPGVMKLEFGAGAVGVRLVEDAPQCHEHFSRITRDLQGEADHPGIGLGWGNAMLLMEFVEGTEHDVDLVLFGGRLLAAFVSDNGPTRLPGFTETAACMPTGLAPEQEAQMVQAAFRCCLGCGLLDGVFNVELKLTGAGPRLIEINPRMGGFYLRDWILELYGVDLLLAAVMVACGLRPALPTRPRARGHLVGVMCLVSQHLQALSSTASRETLQALHDRGLLRLNLLEEALVPGEYEEPYCSVACAGPSPTEARLRLLGLCQGLGIDGPSYPVAHFLSHFK

SEQ ID NO: 810237 - protein, 979 aa, Homo sapiens
GRCATATAAAAASRPVRIRPPRPPSRCRRQLSLDPSGPEWDCPLGSKDLEEEGPWGGGSGLPPTGCFPGSWRQDVGLDCKGSPEGAEARAWTVYYYSLLQSCLQQAGLPETQDRGQVPRTGCPGAEVTLCVLGSPSTFLPVLLEGGVQSPGNMLLCLSPAWLMKVPAPGQPGEAALLVSKAVSFHPGGLTFLDDFVPPRRATYFLAGLGLGPGRGREAAELARDLTCPTGASAELARLLEDRLLTRQLLAQQGGVAVPATLAFTYKPPGLLRGGDASLGLRLVELSGKEGQETLVKEEVEAFLRSEALGDILQVAVKLSGWRWRGRQAWRLHPRAELGAVVDTVLALLEKLEEEESVLVEAVYPPAQLPCSDGPSPGPGLAVRICAVVCRTQGDRPLLSKVVCGVGRGDRPLRHHNSLPRTLEVALAQCGLGEEAQVAAVRQRVKAAAEAALAAVLALEAGLSAEQRGGRRAHTDFLGVDFALTAAGGVLTPVALELNGGLCLEACGALEGLWAAPRLGPAADEAVAAPLVETMLRRSARCLMEGKQLLVVGAGGVSKKFVWEAARDYGLQLHLVESDPNHFASQLVQTFIHFDMTEHRRDEENARLLAELVRARGLKLDGCFSYWDDCLVLTALLCQELGLPCSSPAAMRLAKQKSLTQLHLLHHHGPPWPAPSLHAVPCCPLESEADVERAVHQVPLPGVMKLEFGAGAVGVRLVEDAPQCHEHFSRITRDLQGEADHPGIGLGWGNAMLLMEFVEGTEHDVDLVLFGGRLLAAFVSDNGPTRLPGFTETAACMPTGLAPEQEAQMVQAAFRCCLGCGLLDGVFNVELKLTGAGPRLIEINPRMGGFYLRDWILELYGVDLLLAAVMVACGLRPALPTRPRARGHLVGVMCLVSQHLQALSSTASRETLQALHDRGLLRLNLLEEALVPGEYEEPYCSVACAGPSPTEARLRLLGLCQGLGIDGPSYPVAHFLSHFK

SEQ ID NO: 810238 - protein, 966 aa, Homo sapiens; identical to SEQ ID NO: 810234

SEQ ID NO: 810239 - protein, 977 aa, Homo sapiens
AARAWLGPGEREGRSEGAKEQAERPSPKPSRAANPPARPRSCPPCLAAGPSMVMADGPRHLQRGPVRVGFYDIEGTLGKGNFAVVKLGRHRITKTEVAIKIIDKSQLDAVNLEKIYREVQIMKMLDHPHIIKLYQVMETKSMLYLVTEYAKNGEIFDYLANHGRLNESEARRKFWQILSAVDYCHGRKIVHRDLKAENLLLDNNMNIKIADFGFGNFFKSGELLATWCGSPPYAAPEVFEGQQYEGPQLDIWSMGVVLYVLVCGALPFDGPTLPILRQRVLEGRFRIPYFMSEDCEHLIRRMLVLDPSKRLTIAQIKEHKWMLIEVPVQRPVLYPQEQENEPSIGEFNEQVLRLMHSLGIDQQKTIESLQNKSYNHFAAIYFLLVERLKSHRSSFPVEQRLDGRQRRPSTIAEQTVAKAQTVGLPVTMHSPNMRLLRSALLPQASNVEAFSFPASGCQAEAAFMEEECVDTPKVNGCLLDPVPPVLVRKGCQSLPSNMMETSIDEGLETEGEAEEDPAHAFEAFQSTRSGQRRHTLSEVTNQLVVMPGAGKIFSMNDSPSLDSVDSEYDMGSVQRDLNFLEDNPSLKDIMLANQPSPRMTSPFISLRPTNPAMQALSSQKREVHNRSPVSFREGRRASDTSLTQGIVAFRQHLQNLARTKGILELNKVQLLYEQIGPEADPNLAPAAPQLQDLASSCPQEEVSQQQESVSTLPASVHPQLSPRQSLETQYLQHRLQKPSLLSKAQNTCQLYCKEPPRSLEQQLQEHRLQQKRLFLQKQSQLQAYFNQMQIAESSYPQPSQQLPLPRQETPPPSQQAPPFSLTQPLSPVLEPSSEQMQYSPFLSQYQEMQLQPLPSTSGPRAAPPLPTQLQQQQPPPPPPPPPPRQPGAAPAPLQFSYQTCELPSAASPAPDYPTPCQYPVDGAQQSDLTGPDCPRSPGLQEAPSSYDPLALSELPGLFDCEMLDAVDPQHNGYVLVN

SEQ ID NO: 810240 - protein, 617 aa, Homo sapiens
AARAWLGPGEREGRSEGAKEQAERPSPKPSRAANPPARPRSCPPCLAAGPSMVMADGPRHLQRGPVRVGFYDIEGTLGKGNFAVVKLGRHRITKTEVAIKIIDKSQLDAVNLEKIYREVQIMKMLDHPHIIKLYQVMETKSMLYLVTEYAKNGEIFDYLANHGRLNESEARRKFWQILSAVDYCHGRKIVHRDLKAENLLLDNNMNIKIADFGFGNFFKSGELLATWCGSPPYAAPEVFEGQQYEGPQLDIWSMGVVLYVLVCGALPFDGPTLPILRQRVLEGRFRIPYFMSEDCEHLIRRMLVLDPSKRLTIAQIKEHKWMLIEVPVQRPVLYPQEQENEPSIGEFNEQVLRLMHSLGIDQQKTIESLQNKSYNHFAAIYFLLVERLKSHRSSFPVEQRLDGRQRRPSTIAEQTVAKAQTVGLPVTMHSPNMRLLRSALLPQASNVEAFSFPASGCQAEAAFMEEECVDTPKVNGCLLDPVPPVLVRKGCQSLPSNMMETSIDEGLETEGEAEEDPAHAFEAFQSTRSGQRRHTLSEVTNQLVVMPGAGKIFSMNDSPSLDSVDSEYDMGSVQRDLNFLEDNPSLKDIMLANQPSPKSLKGKEVERKVCFTSGTAV

SEQ ID NO: 810241 - protein, 977 aa, Homo sapiens; identical to SEQ ID NO: 810239

SEQ ID NO: 810242 - protein, 977 aa, Homo sapiens; identical to SEQ ID NO: 810239

SEQ ID NO: 810243 - protein, 977 aa, Homo sapiens; identical to SEQ ID NO: 810239

SEQ ID NO: 810244 - protein, 977 aa, Homo sapiens; identical to SEQ ID NO: 810239

SEQ ID NO: 810245 - protein, 1023 aa, Homo sapiens
AARAWLGPGEREGRSEGAKEQAERPSPKPSRAANPPARPRSCPPCLAAGPSMVMADGPRHLQRGPVRVGFYDIEGTLGKGNFAVVKLGRHRITKTEVAIKIIDKSQLDAVNLEKIYREVQIMKMLDHPHIIKLYQVMETKSMLYLVTEYAKNGEIFDYLANHGRLNESEARRKFWQILSAVDYCHGRKIVHRDLKAENLLLDNNMNIKIADFGFGNFFKSGELLATWCGSPPYAAPEVFEGQQYEGPQLDIWSMGVVLYVLVCGALPFDGPTLPILRQRVLEGRFRIPYFMSEDCEHLIRRMLVLDPSKRLTIAQIKEHKWMLIEVPVQRPVLYPQEQENEPSIGEFNEQVLRLMHSLGIDQQKTIESLQNKSYNHFAAIYFLLVERLKSHRSSFPVEQRLDGRQRRPSTIAEQTVAKAQTVGLPVTMHSPNMRLLRSALLPQASNVEAFSFPASGCQAEAAFMEEECVDTPKVNGCLLDPVPPVLVRKGCQSLPSNMMETSIDEGLETEGEAEEDPAHAFEAFQSTRSGQRRHTLSEVTNQLVVMPGAGKIFSMNDSPSLDSVDSEYDMGSVQRDLNFLEDNPSLKDIMLANQPSPRMTSPFISLRPTNPAMQALSSQKREVHNRSPVSFREGRRASDTSLTQGEHFLLCFLKLSVVGEQFLAMLVWSPVVTERPCILVKLFGLGAFFSGIVAFRQHLQNLARTKGILELNKVQLLYEQIGPEADPNLAPAAPQLQDLASSCPQEEVSQQQESVSTLPASVHPQLSPRQSLETQYLQHRLQKPSLLSKAQNTCQLYCKEPPRSLEQQLQEHRLQQKRLFLQKQSQLQAYFNQMQIAESSYPQPSQQLPLPRQETPPPSQQAPPFSLTQPLSPVLEPSSEQMQYSPFLSQYQEMQLQPLPSTSGPRAAPPLPTQLQQQQPPPPPPPPPPRQPGAAPAPLQFSYQTCELPSAASPAPDYPTPCQYPVDGAQQSDLTGPDCPRSPGLQEAPSSYDPLALSELPGLFDCEMLDAVDPQHNGYVLVN

SEQ ID NO: 810246 - protein, 657 aa, Homo sapiens
AARAWLGPGEREGRSEGAKEQAERPSPKPSRAANPPARPRSCPPCLAAGPSMVMADGPRHLQRGPVRVGFYDIEGTLGKGNFAVVKLGRHRITKTEVAIKIIDKSQLDAVNLEKIYREVQIMKMLDHPHIIKLYQVMETKSMLYLVTEYAKNGEIFDYLANHGRLNESEARRKFWQILSAVDYCHGRKIVHRDLKAENLLLDNNMNIKIADFGFGNFFKSGELLATWCGSPPYAAPEVFEGQQYEGPQLDIWSMGVVLYVLVCGALPFDGPTLPILRQRVLEGRFRIPYFMSEDCEHLIRRMLVLDPSKRLTIAQIKEHKWMLIEVPVQRPVLYPQEQENEPSIGEFNEQVLRLMHSLGIDQQKTIESLQNKSYNHFAAIYFLLVERLKSHRSSFPVEQRLDGRQRRPSTIAEQTVAKAQTVGLPVTMHSPNMRLLRSALLPQASNVEAFSFPASGCQAEAAFMEEECVDTPKVNGCLLDPVPPVLVRKGCQSLPSNMMETSIDEGLETEGEAEEDPAHAFEAFQSTRSGQRRHTLSEVTNQLVVMPGAGKIFSMNDSPSLDSVDSEYDMGSVQRDLNFLEDNPSLKDIMLANQPSPRMTSPFISLRPTNPAMQALSSQKREVHNRSPVSFREGRRASDTSLTQGEHFLLCFLKLAS

SEQ ID NO: 810247 - protein, 1023 aa, Homo sapiens; identical to SEQ ID NO: 810245

SEQ ID NO: 810248 - protein, 190 aa, Homo sapiens [sequence omitted]

SEQ ID NO: 810249 - protein, 359 aa, Homo sapiens
SLLYDEPFDCGLRVQAQTHQTASLTQGIVAFRQHLQNLARTKGILELNKVQLLYEQIGPEADPNLAPAAPQLQDLASSCPQEEVSQQQESVSTLPASVHPQLSPRQSLETQYLQHRLQKPSLLSKAQNTCQLYCKEPPRSLEQQLQEHRLQQKRLFLQKQSQLQAYFNQMQIAESSYPQPSQQLPLPRQETPPPSQQAPPFSLTQPLSPVLEPSSEQMQYSPFLSQYQEMQLQPLPSTSGPRAAPPLPTQLQQQQPPPPPPPPPPRQPGAAPAPLQFSYQTCELPSAASPAPDYPTPCQYPVDGAQQSDLTGPDCPRSPGLQEAPSSYDPLALSELPGLFDCEMLDAVDPQHNGYVLVN

SEQ ID NO: 810250 - protein, 1023 aa, Homo sapiens; identical to SEQ ID NO: 810245

SEQ ID NO: 810251 - protein, 339 aa, Homo sapiens
EKPHECRDCGKAFKTRNRLCMHQLIHTGEKPYKCNCCGKAFQFKHSLTIHGRIHTGEKPYECEECGKAFSGSSDLTKHIRIHTGERPYECSKCGRAFSRSSDLSKHKRIHTREKHYGCPQCGKDFSIKAELTKHRRIHTEEKRYRCEECGKAFRHNCKRRAHEREHTGEKPYQCRDCGKTFQDKHCLTIHQRIHTGEKPYKCLECGKAFSGKSNLTNHRRIHTGEKPHKCEVCGMAFHHSSVLRQHKRIHTGEKPYTCSECGTSFRQGSALIGHKRVHTGEKPYECEECGKAFRVSSNLTGHKKRKHQVWSTHELDGSRKSLSPVTVSQTSVVSILTSA

SEQ ID NO: 810252 - protein, 1064 aa, Homo sapiens
SESLENEPENLVRVESRDDHLSLPDVTCENFISKVQDVISINHDESLLPESLESMMYGKKVLSQEPSSFQESPSTNTESRKDVITISISKDGNCQSGGPEAEIASGPTFMGSLEAGGVAQANIKNGKHLLMSISKEGELCCSEAGQRPENIGQLEAKCLASPSLNPGNESGFVDMCSLSVCDSKRNLSSDQQLIDLLENKSLESKLILSQNHSDEEEEEEENEEENLAMAVGMGERPEVLHLTEPTTNISREKNQGFQDETKKGSLEVANQTPGLQRAFPAPAACQCHCKHMERWMHGLENDEFEIEKPKAYIPDLFKSKTNTIAMEGEPTAIPSQPFKVKHELLKEPWKESAEGQNVFPTYPLEGSELKSEDMDFENKDDYDRDGNCHSQDYPGKYSEEESKSSTSGITGDIGDELQEARAPTIAQLLQEKTLYSFSEWPKDRVIINRLDNICHVVLKGKWPSSQQYEPSGTLPTPVLTSSAGSRTSLSEPEAAEHSFSNGAALAAQIHKESFLAPVFTKDEQKHRRPYEFEVERDAKARGLEQFSATHGHTPIILNGWHGESAMDLSCSSEGSPGATSPFPVSASTPKIGAISSLQGALGMDLSGILQAGLIHPVTGQIVNGSLRRDDAATRRRRGRRKHVEGGMDLIFLKEQTLQAGILEVHEDPGQATLSTTHPEGPGPATSAPEPATAASSQAEKSIPSKSLLDWLRQQADYSLEVPGFGANFSDKPKQRRPRCKEPGKLDVSSLSGEERVPAIPKEPGLRGFLPENKFNHTLAEPILRDTGPRRRGRRPRSELLKAPSIVADSPSGMGPLFMNGLIAGMDLVGLQNMRNMPGIPLTGLVGFPAGFATMPTGEEVKSTLSMLPMMLPGMAAVPQMFGVGGLLSPPMATTCTSTAPASLSSTTKSGTAVTEKTAEDKPSSHDVKTDTLAEDKPGPGPFSDQSEPAITTSSPVAFNPFLIPGVSPGLIYPSMFLSPGMGMALPAMQQARHSEIVGLESQKRKKKKTKGDNPNSHPEPAPSCEREPSGDENCAEPSAPLPAEREHGAQAGEGALKDSNNDTN

SEQ ID NO: 810253 - protein, 252 aa, Homo sapiens [sequence omitted]

SEQ ID NO: 810254 - protein, 234 aa, Homo sapiens
MGPLFMNGLIAGMDLVGLQNMRNMPGIPLTGLVGFPAGFATMPTGEEVKSTLSMLPMMLPGMAAVPQMFGVGGLLSPPMATTCTSTAPASLSSTTKSGTAVTEKTAEDKPSSHDVSEPAITTSSPVAFNPFLIPGVSPGLIYPSMFLSPGMGMALPAMQQARHSEIVGLESQKRKKKKTKGDNPNSHPEPAPSCEREPSGDENCAEPSAPLPAEREHGAQAGEGALKDSNNDTN

SEQ ID NO: 810255 - protein, 252 aa, Homo sapiens [sequence omitted]

SEQ ID NO: 810256 - protein, 240 aa, Homo sapiens
MDLVGLQNMRNMPGIPLTGLVGFPAGFATMPTGEEVKSTLSMLPMMLPGMAAVPQMFGVGGLLSPPMATTCTSTAPASLSSTTKSGTAVTEKTAEDKPSSHDVKTDTLAEDKPGPGPFSDQSEPAITTSSPVAFNPFLIPGVSPGLIYPSMFLSPGMGMALPAMQQARHSEIVGLESQKRKKKKTKGDNPNSHPEPAPSCEREPSGDENCAEPSAPLPAEREHGAQAGEGALKDSNNDTN

SEQ ID NO: 810257 - protein, 363 aa, Homo sapiens
MQAFLKGTSISTKPPLTKDRGVAASAGSSGENKKAKPVPWVEKYRPKCVDEVAFQEEVVAVLKKSLEGADLPNLLFYGPPGTGKTSTILAAARELFGPELFRLRVLELNASDERGIQVVREKVKNFAQLTVSGSRSDGKPCPPFKIVILDEADSMTSAAQAALRRTMEKESKTTRFCLICNYVSRIIEPLTSRCSKFRFKPLSDKIQQQRLLDIAKKENVKISDEGIAYLVKVSEGDLRKAITFLQSATRLTGGKEITEKVITDIAGVIPAEKIDGVFAACQSGSFDKLEAVVKDLIDEGHAATQLVNQLHDVVVENNLSDKQKSIITEKLAEVDKCLADGADEHLQLISLCATVMQQLSQNC

SEQ ID NO: 810258 - protein, 363 aa, Homo sapiens; identical to SEQ ID NO: 810257

SEQ ID NO: 810259 - protein, 363 aa, Homo sapiens; identical to SEQ ID NO: 810257

SEQ ID NO: 810260 - protein, 336 aa, Homo sapiens
MQAFLKGTSISTKPPLTKDRGVAASAGSSGENKKAKPVPWVEKYRPKCVDEVAFQEEVVAVLKKSLEGADLPNLLFYGPPGTGKTSTILAAARELFGPELFRLRVLELNASDERGIQVVREKVKNFAQLTVSGSRSDGKPCPPFKIVILDEADSMTSAAQAALRRTMEKESKTTRFCLICNYVSRIIEPLTSRCSKFRFKPLSDKIQQQRLLDIAKKENVKISDEGIAYLVKVSEGDLRKAITFLQSATRLTGGKEITEKVITDIAGDLIDEGHAATQLVNQLHDVVVENNLSDKQKSIITEKLAEVDKCLADGADEHLQLISLCATVMQQLSQNC

SEQ ID NO: 810261 - protein, 299 aa, Homo sapiens [sequence omitted]

SEQ ID NO: 810262 - protein, 505 aa, Homo sapiens
MGSGPLSLPLALSPPRLLLLLLLSLLPVARASEAEHRLFERLFEDYNEIIRPVANVSDPVIIHFEVSMSQLVKVDEVNQIMETNLWLKQIWNDYKLKWNPSDYGGAEFMRVPAQKIWKPDIVLYNNAVGDFQVDDKTKALLKYTGEVTWIPPAIFKSSCKIDVTYFPFDYQNCTMKFGSWSYDKAKIDLVLIGSSMNLKDYWESGEWAIIKAPGYKHDIKYNCCEEIYPDITYSLYIRRLPLFYTINLIIPCLLISFLTVLVFYLPSDCGEKVTLCISVLLSLTVFLLVITETIPSTSLVIPLIGEYLLFTMIFVTLSIVITVFVLNVHYRTPTTHTMPSWVKTVFLNLLPRVMFMTRPTSNEGNAQKPRPLYGAELSNLNCFSRAESKGCKEGYPCQDGMCGYCHHRRIKISNFSANLTRSSSSESVDAVLSLSALSPEIKEAIQSVKYIAENMKAQNEAKEIQDDWKYVAMVIDRIFLWVFTLVCILGTAGLFLQPLMAREDA

SEQ ID NO: 810263 - protein, 676 aa, Homo sapiens
EVHLAGPAPPVSLYGACTSPGGPNPLRELHTPRKPGTETESLSFLVVVTAPAQIWSDAAGRSTQPGGEGARPALGTGTWSPFPYRTYAPPRARPPARPRLAQLQLRMVPVLPRVRGRWKPSGGEAERSPARLRPHGSRSGVCAGAARGEAVSATAAPAPDRPGPRPARPPAMGSGPLSLPLALSPPRLLLLLLLSLLPVARASEAEHRLFERLFEDYNEIIRPVANVSDPVIIHFEVSMSQLVKVDEVNQIMETNLWLKQIWNDYKLKWNPSDYGGAEFMRVPAQKIWKPDIVLYNNAVGDFQVDDKTKALLKYTGEVTWIPPAIFKSSCKIDVTYFPFDYQNCTMKFGSWSYDKAKIDLVLIGSSMNLKDYWESGEWAIIKAPGYKHDIKYNCCEEIYPDITYSLYIRRLPLFYTINLIIPCLLISFLTVLVFYLPSDCGEKVTLCISVLLSLTVFLLVITETIPSTSLVIPLIGEYLLFTMIFVTLSIVITVFVLNVHYRTPTTHTMPSWVKTVFLNLLPRVMFMTRPTSNEGNAQKPRPLYGAELSNLNCFSRAESKGCKEGYPCQDGMCGYCHHRRIKISNFSANLTRSSSSESVDAVLSLSALSPEIKEAIQSVKYIAENMKAQNEAKEIQDDWKYVAMVIDRIFLWVFTLVCILGTAGLFLQPLMAREDA

SEQ ID NO: 810264 - protein, 505 aa, Homo sapiens; identical to SEQ ID NO: 810262

SEQ ID NO: 810265 - protein, 505 aa, Homo sapiens; identical to SEQ ID NO: 810262

SEQ ID NO: 810266 - protein, 505 aa, Homo sapiens; identical to SEQ ID NO: 810262

SEQ ID NO: 810267 - protein, 505 aa, Homo sapiens; identical to SEQ ID NO: 810262

SEQ ID NO: 810268 - protein, 489 aa, Homo sapiens
MGSGPLSLPLALSPPRLLLLLLLSLLPVARASEAEHRLFERLFEDYNEIIRPVANVSDPVIIHFEVSMSQLVKVDEVNQIMETNLWLKQIWNDYKLKWNPSDYGGAEFMRVPAQKIWKPDIVLYNNAVGDFQVDDKTKALLKYTGEVTWIPPAIFKSSCKIDVTYFPFDYQNCTMKFGSWSYDKAKIDLVLIGSSMNLKDYWESGEWAIIKAPGYKHDIKYNCCEEIYPDITYSLYIRRLPLFYTINLIIPCLLISFLTVLVFYLPSDCGEKVTLCISVLLSLTVFLLVITETIPSTSLVIPLIGEYLLFTMIFVTLSIVITVFVLNVHYRTPTTHTMPSWVKTVFLNLLPRVMFMTRPTSNEGNAQKPRPLYGAELSNLNCFSRAESKGCKEGYPCQDGMCGYCHHRRIKISNFSANLTRSSSSESVDAVLSLSALSPEIKEAIQSVKYIAENMKAQNEAKEEQKAQEIQQLKRKEKSTETSDQEPGL

SEQ ID NO: 810269 - protein, 298 aa, Homo sapiens
EAGGNRTRKHDIKYNCCEEIYPDITYSLYIRRLPLFYTINLIIPCLLISFLTVLVFYLPSDCGEKVTLCISVLLSLTVFLLVITETIPSTSLVIPLIGEYLLFTMIFVTLSIVITVFVLNVHYRTPTTHTMPSWVKTVFLNLLPRVMFMTRPTSNEGNAQKPRPLYGAELSNLNCFSRAESKGCKEGYPCQDGMCGYCHHRRIKISNFSANLTRSSSSESVDAVLSLSALSPEIKEAIQSVKYIAENMKAQNEAKEIQDDWKYVAMVIDRIFLWVFTLVCILGTAGLFLQPLMAREDA

SEQ ID NO: 810270 - protein, 202 aa, Homo sapiens
RPLTVKPVGGGTACRRFSTVFVLNVHYRTPTTHTMPSWVKTVFLNLLPRVMFMTRPTSNEGNAQKPRPLYGAELSNLNCFSRAESKGCKEGYPCQDGMCGYCHHRRIKISNFSANLTRSSSSESVDAVLSLSALSPEIKEAIQSVKYIAENMKAQNEAKEIQDDWKYVAMVIDRIFLWVFTLVCILGTAGLFLQPLMAREDA

SEQ ID NO: 810271 - protein, 831 aa, Homo sapiens
MMKDCKHPNIVAYFGSYLRRDKLWICMEFCGGGSLQDIYHVTGPLSELQIAYVSRETLQGLYYLHSKGKMHRDIKGANILLTDNGHVKLADFGVSAQITATIAKRKSFIGTPYWMAPEVAAVERKGGYNQLCDLWAVGITAIELAELQPPMFDLHPMRALFLMTKSNFQPPKLKDKMKWSNSFHHFVKMALTKNPKKRPTAEKLLQHPFVTQHLTRSLAIELLDKVNNPDHSTYHDFDDDDPEPLVAVPHRIHSTSRNVREEKTRSEITFGQVKFDPPLRKETEPHHELPDSDGFLDSSEEIYYTARSNLDLQLEYGQGHQGGYFLGANKSLLKSVEEELHQRGHVAHLEDDEGDDDESKHSTLKAKIPPPLPPKPKSIFIPQEMHSTEDENQGTIKRCPMSGSPAKPSQVPPRPPPPRLPPHKPVALGNGMSSFQLNGERDGSLCQQQNEHRGTNLSRKEKKDVPKPISNGLPPTPKVHMGACFSKVFNGCPLKIHCASSWINPDTRDQYLIFGAEEGIYTLNLNELHETSMEQLFPRRCTWLYVMNNCLLSISGKASQLYSHNLPGLFDYARQMQKLPVAIPAHKLPDRILPRKFSVSAKIPETKWCQKCCVVRNPYTGHKYLCGALQTSIVLLEWVEPMQKFMLIKHIDFPIPCPLRMFEMLVVPEQEYPLVCVGVSRGRDFNQVVRFETVNPNSTSSWFTESDTPQTNVTHVTQLERDTILVCLDCCIKIVNLQGRLKSSRKLSSELTFDFQIESIVCLQDSVLAFWKHGMQGRSFRSNEVTQEISDSTRIFRLLGSDRVVVLESRPTDNPTANSNLYILAGHENSY

SEQ ID NO: 810272 - protein, 133 aa, Homo sapiens
LLFLFNTFVWKENNTLHKLSKLNCSTKTISKGMVATNTILTDALGFETVNPNSTSSWFTESDTPQTNVTHVTQLERDTILVCLDCCIKIVNLQGRLKSSRKLSSELTFDFQIESIVCLQDSVLAFYLAFHVSS

SEQ ID NO: 810273 - protein, 79 aa, Homo sapiens
MNPGFDLSRRNPQEDFELIQRIGSGTYGDVYKARNVNTGELAAIKVIKLEPGEDFAVVQQEIISDKYPVKNHLHKTPCK

SEQ ID NO: 810274 - protein, 894 aa, Homo sapiens
MNPGFDLSRRNPQEDFELIQRIGSGTYGDVYKARNVNTGELAAIKVIKLEPGEDFAVVQQEIIMMKDCKHPNIVAYFGSYLRRDKLWICMEFCGGGSLQDIYHVTGPLSELQIAYVSRETLQGLYYLHSKGKMHRDIKGANILLTDNGHVKLADFGVSAQITATIAKRKSFIGTPYWMAPEVAAVERKGGYNQLCDLWAVGITAIELAELQPPMFDLHPMRALFLMTKSNFQPPKLKDKMKWSNSFHHFVKMALTKNPKKRPTAEKLLQHPFVTQHLTRSLAIELLDKVNNPDHSTYHDFDDDDPEPLVAVPHRIHSTSRNVREEKTRSEITFGQVKFDPPLRKETEPHHELPDSDGFLDSSEEIYYTARSNLDLQLEYGQGHQGGYFLGANKSLLKSVEEELHQRGHVAHLEDDEGDDDESKHSTLKAKIPPPLPPKPKSIFIPQEMHSTEDENQGTIKRCPMSGSPAKPSQVPPRPPPPRLPPHKPVALGNGMSSFQLNGERDGSLCQQQNEHRGTNLSRKEKKDVPKPISNGLPPTPKVHMGACFSKVFNGCPLKIHCASSWINPDTRDQYLIFGAEEGIYTLNLNELHETSMEQLFPRRCTWLYVMNNCLLSISGKASQLYSHNLPGLFDYARQMQKLPVAIPAHKLPDRILPRKFSVSAKIPETKWCQKCCVVRNPYTGHKYLCGALQTSIVLLEWVEPMQKFMLIKHIDFPIPCPLRMFEMLVVPEQEYPLVCVGVSRGRDFNQVVRFETVNPNSTSSWFTESDTPQTNVTHVTQLERDTILVCLDCCIKIVNLQGRLKSSRKLSSELTFDFQIESIVCLQDSVLAFWKHGMQGRSFRSNEVTQEISDSTRIFRLLGSDRVVVLESRPTDNPTANSNLYILAGHENSY

SEQ ID NO: 810275 - protein, 873 aa, Homo sapiens
MNPGFDLSRRNPQEDFELIQRIGSGTYGDVYKARNVNTGELAAIKVIKLEPGEDFAVVQQEIIMMKDCKHPNIVAYFGSYLRRDKLWICMEFCGGGSLQDIYHVTGPLSELQIAYVSRETLQGLYYLHSKGKMHRDIKGANILLTDNGHVKLADFGVSAQITATIAKRKSFIGTPYWMAPEVAAVERKGGYNQLCDLWAVGITAIELAELQPPMFDLHPMRALFLMTKSNFQPPKLKDKMKWSNSFHHFVKMALTKNPKKRPTAEKLLQHPFVTQHLTRSLAIELLDKVNNPDHSTYHDFDDDDPEPLVAVPHRIHSTSRNVREEKTRSEITFGQVKFDPPLRKETEPHHELDLQLEYGQGHQGGYFLGANKSLLKSVEEELHQRGHVAHLEDDEGDDDESKHSTLKAKIPPPLPPKPKSIFIPQEMHSTEDENQGTIKRCPMSGSPAKPSQVPPRPPPPRLPPHKPVALGNGMSSFQLNGERDGSLCQQQNEHRGTNLSRKEKKDVPKPISNGLPPTPKVHMGACFSKVFNGCPLKIHCASSWINPDTRDQYLIFGAEEGIYTLNLNELHETSMEQLFPRRCTWLYVMNNCLLSISGKASQLYSHNLPGLFDYARQMQKLPVAIPAHKLPDRILPRKFSVSAKIPETKWCQKCCVVRNPYTGHKYLCGALQTSIVLLEWVEPMQKFMLIKHIDFPIPCPLRMFEMLVVPEQEYPLVCVGVSRGRDFNQVVRFETVNPNSTSSWFTESDTPQTNVTHVTQLERDTILVCLDCCIKIVNLQGRLKSSRKLSSELTFDFQIESIVCLQDSVLAFWKHGMQGRSFRSNEVTQEISDSTRIFRLLGSDRVVVLESRPTDNPTANSNLYILAGHENSY

SEQ ID NO: 810276 - protein, 859 aa, Homo sapiens
MNPGFDLSRRNPQEDFELIQRIGSGTYGDVYKARNVNTGELAAIKVIKLEPGEDFAVVQQEIIMMKDCKHPNIVAYFGSYLRRDKLWICMEFCGGGSLQDIYHVTGPLSELQIAYVSRETLQGLYYLHSKGKMHRDIKLILEYLHRYTATIAKRKSFIGTPYWMAPEVAAVERKGGYNQLCDLWAVGITAIELAELQPPMFDLHPMRALFLMTKSNFQPPKLKDKMKWSNSFHHFVKMALTKNPKKRPTAEKLLQHPFVTQHLTRSLAIELLDKVNNPDHSTYHDFDDDDPEPLVAVPHRIHSTSRNVREEKTRSEITFGQVKFDPPLRKETEPHHELDLQLEYGQGHQGGYFLGANKSLLKSVEEELHQRGHVAHLEDDEGDDDESKHSTLKAKIPPPLPPKPKSIFIPQEMHSTEDENQGTIKRCPMSGSPAKPSQVPPRPPPPRLPPHKPVALGNGMSSFQLNGERDGSLCQQQNEHRGTNLSRKEKKDVPKPISNGLPPTPKVHMGACFSKVFNGCPLKIHCASSWINPDTRDQYLIFGAEEGIYTLNLNELHETSMEQLFPRRCTWLYVMNNCLLSISGKASQLYSHNLPGLFDYARQMQKLPVAIPAHKLPDRILPRKFSVSAKIPETKWCQKCCVVRNPYTGHKYLCGALQTSIVLLEWVEPMQKFMLIKHIDFPIPCPLRMFEMLVVPEQEYPLVCVGVSRGRDFNQVVRFETVNPNSTSSWFTESDTPQTNVTHVTQLERDTILVCLDCCIKIVNLQGRLKSSRKLSSELTFDFQIESIVCLQDSVLAFWKHGMQGRSFRSNEVTQEISDSTRIFRLLGSDRVVVLESRPTDNPTANSNLYILAGHENSY

SEQ ID NO: 810277 - protein, 937 aa, Homo sapiens
RGRSGESGSHVGVSPRARGCEGSPLLVGVTRFGAAAGRGGRGRLAACRRPQRREGSGGGGGGGRSVEPGDCDRRNPQEDFELIQRIGSGTYGDVYKARNVNTGELAAIKVIKLEPGEDFAVVQQEIIMMKDCKHPNIVAYFGSYLRRDKLWICMEFCGGGSLQDIYHVTGPLSELQIAYVSRETLQGLYYLHSKGKMHRDIKGANILLTDNGHVKLADFGVSAQITATIAKRKSFIGTPYWMAPEVAAVERKGGYNQLCDLWAVGITAIELAELQPPMFDLHPMRALFLMTKSNFQPPKLKDKMKWSNSFHHFVKMALTKNPKKRPTAEKLLQHPFVTQHLTRSLAIELLDKVNNPDHSTYHDFDDDDPEPLVAVPHRIHSTSRNVREEKTRSEITFGQVKFDPPLRKETEPHHELDLQLEYGQGHQGGYFLGANKSLLKSVEEELHQRGHVAHLEDDEGDDDESKHSTLKAKIPPPLPPKPKSIFIPQEMHSTEDENQGTIKRCPMSGSPAKPSQVPPRPPPPRLPPHKPVALGNGMSSFQLNGERDGSLCQQQNEHRGTNLSRKEKKDVPKPISNGLPPTPKVHMGACFSKVFNGCPLKIHCASSWINPDTRDQYLIFGAEEGIYTLNLNELHETSMEQLFPRRCTWLYVMNNCLLSISGKASQLYSHNLPGLFDYARQMQKLPVAIPAHKLPDRILPRKFSVSAKIPETKWCQKCCVVRNPYTGHKYLCGALQTSIVLLEWVEPMQKFMLIKHIDFPIPCPLRMFEMLVVPEQEYPLVCVGVSRGRDFNQVVRFETVNPNSTSSWFTESDTPQTNVTHVTQLERDTILVCLDCCIKIVNLQGRLKSSRKLSSELTFDFQIESIVCLQDSVLAFWKHGMQGRSFRSNEVTQEISDSTRIFRLLGSDRVVVLESRPTDNPTANSNLYILAGHENSY

SEQ ID NO: 810278 - protein, 297 aa, Homo sapiens
AVIELGPGCSVYVMNNAAINIGKASQLYSHNLPGLFDYARQMQKLPVAIPAHKLPDRILPRKFSVSAKIPETKWCQKCCVVRNPYTGHKYLCGALQTSIVLLEWVEPMQKFMLIKHIDFPIPCPLRMFEMLVVPEQEYPLVCVGVSRGRDFNQVVRFETVNPNSTSSWFTESDTPQTNVTHVTQLERDTILVCLDCCIKIVNLQGRLKSSRKLSSELTFDFQIESIVCLQDSVLAFWKHGMQGRSFRSNEVTQEISDSTRIFRLLGSDRVVVLESRPTDNPTANSNLYILAGHENSY

SEQ ID NO: 810279 - protein, 190 aa, Homo sapiens
MQKFMLIKHIDFPIPCPLRMFEMLVVPEQEYPLVCVGVSRGRDFNQVVRFETVNPNSTSSWFTESDTPQTNVTHVTQLERDTILVCLDCCIKIVNLQGRLKSSRKLSSELTFDFQIESIVCLQDSVLAFWKHGMQGRSFRSNEVTQEISDSTRIFRLLGSDRVVVLESRPTDNPTANSNLYILAGHENSY

SEQ ID NO: 810280 - protein, 820 aa, Homo sapiens
MNPGFDLSRRNPQEDFELIQRIGSGTYGDVYKARNVNTGELAAIKVIKLEPGEDFAVVQQEIIMMKDCKHPNIVAYFGSYLRRDKLWICMEFCGGGSLQDIYHVTGPLSELQIAYVSRETLQGLYYLHSKGKMHRDIKGANILLTDNGHVKLADFGVSAQITATIAKRKSFIGTPYWMAPEVAAVERKGGYNQLCDLWAVGITAIELAELQPPMFDLHPMRALFLMTKSNFQPPKLKDKMKWSNSFHHFVKMALTKNPKKRPTAEKLLQHPFVTQHLTRSLAIELLDKVNNPDHSTYHDFDDDDPEPLVAVPHRIHSTSRNVREEKTRSEITFGQVKFDPPLRKETEPHHELDLQLEYGQGHQGGYFLGANKSLLKSVEEELHQRGHVAHLEDDEGDDDESKHSTLKAKIPPPLPPKPKSIFIPQEMHSTEDENQGTIKRCPMSGSPAKPSQVPPRPPPPRLPPHKPVALGNGMSSFQLNGERDGSLCQQQNEHRGTNLSRKEKKDVPKPISNGLPPTPKVHMGACFSKVFNGCPLKIHCASSWINPDTRDQYLIFGAEEGIYTLNLNELHETSMEQLFPRRCTWLYVMNNCLLSISGKASQLYSHNLPGLFDYARQMQKLPVAIPAHKLPDRILPRKFSVSAKIPETKWCQKCCVVRNPYTGHKYLCGALQTSIVLLEWVEPMQKFMLIKHIDFPIPCPLRMFEMLVVPEQEYPLVCVGVSRGRDFNQVVRFETVNPNSTSSWFTESDTPQTNVTHVTQLERDTILVCLDCCIKIVNLQGRLKSSRKLSSELTFDFQIESIVCLQDSVLAFYLAFHVSS

SEQ ID NO: 810281 - protein, 750 aa, Homo sapiens
MNPGFDLSRRNPQEDFELIQRIGSGTYGDVYKARNVNTGELAAIKVIKLEPGEDFAVVQQEIIMMKDCKHPNIVAYFGSYLRRDKLWICMEFCGGGSLQDIYHVTGPLSELQIAYVSRETLQGLYYLHSKGKMHRDIKGANILLTDNGHVKLADFGVSAQITATIAKRKSFIGTPYWMAPEVAAVERKGGYNQLCDLWAVGITAIELAELQPPMFDLHPMRALFLMTKSNFQPPKLKDKMKWSNSFHHFVKMALTKNPKKRPTAEKLLQHPFVTQHLTRSLAIELLDKVNNPDHSTYHDFDDDDPEPLVAVPHRIHSTSRNVREEKTRSEITFGQVKFDPPLRKETEPHHELDLQLEYGQGHQGGYFLGANKSLLKSVEEELHQRGHVAHLEDDEGDDDESKHSTLKAKIPPPLPPKPKSIFIPQEMHSTEDENQGTIKRCPMSGSPAKPSQVPPRPPPPRLPPHKPVALGNGMSSFQLNGERDGSLCQQQNEHRGTNLSRKEKKDVPKPISNGLPPTPKVHMGACFSKVFNGCPLKIHCASSWINPDTRDQYLIFGAEEGIYTLNLNELHETSMEQLFPRRCTWLYVMNNCLLSISGKASQLYSHNLPGLFDYARQMQKLPVAIPAHKLPDRILPRKFSVSAKIPETKWCQKCCVVRNPYTGHKYLCGALQTSIVLLEWVEPMQKFMLIKHIDFPIPCPLRMFEMLVVPEQEYPLVCVGVSRGRDFNQVVRPVKPYSGWEWFWVLKTRR

SEQ ID NO: 810282 - protein, 316 aa, Homo sapiens
MNPGFDLSRRNPQEDFELIQRIGSGTYGDVYKARNVNTGELAAIKVIKLEPGEDFAVVQQEIIMMKDCKHPNIVAYFGSYLRRDKLWICMEFCGGGSLQDIYHVTGPLSELQIAYVSRETLQGLYYLHSKGKMHRDIKGANILLTDNGHVKLADFGVSAQITATIAKRKSFIGTPYWMAPEVAAVERKGGYNQLCDLWAVGITAIELAELQPPMFDLHPMRALFLMTKSNFQPPKLKDKMKWSNSFHHFVKMALTKNPKKRPTAEKLLQHPFVTQHLTRSLAIELLDKVNNPDHSTYHDFDDDDPEVGIAFTSGHI

SEQ ID NO: 810283 - protein, 199 aa, Homo sapiens
RGRSGESGSHVGVSPRARGCEGSPLLVGVTRFGAAAGRGGRGRLAACRRPQRREGSAAAAAAAAAWSRVIVTAGGAGSRPRRPLSVWPPERPPSPAREGGGGHLGPAMNPGFDLSRRNPQEDFELIQRIGSGTYGDVYKARNVNTGELAAIKVIKLEPGEDFAVVQQEIIMMKDCKHPNIVAYFGSYLRYTVCFPFEKQ

SEQ ID NO: 810284 - protein, 143 aa, Homo sapiens
SRQCPSPARGYRPEGEGATTAAAGPLAPTSGLTGSSSRRCLRLQPHCPQASSPPLAPSVQARAPALEQFENGAEGRSGPTRRRRRGCPGNGSGGRLAARGGDALGDDGGAPVPGNATARTARGHGAPWRSAPAASKCQTSAGA

SEQ ID NO: 810285 - protein, 143 aa, Homo sapiens; identical to SEQ ID NO: 810284

SEQ ID NO: 810286 - protein, 143 aa, Homo sapiens; identical to SEQ ID NO: 810284

SEQ ID NO: 810287 - protein, 82 aa, Homo sapiens
DLVLLAHRPRCYLRDLQLLEAHALLPAGATVLADHVLFPGAPRFLQYAKSCGRYRCRLHHTGLPDFPAIKDGIAQLTYAGPG

SEQ ID NO: 810288 - protein, 103 aa, Homo sapiens
DATEPMQQPQGRAHWGPGFQFLLCKVSMLCPERRPPAPAGSTTSTMLCDSRCITGCLWPSPRQREKKAQESVETAGTPPLVPWKRLHSPPPALQLEFHLRLHS

SEQ ID NO: 810289 - protein, 344 aa, Homo sapiens
MQSISFASGGDPDTTDYVAYVAKDPVNQRACHIWECHKGMAQDVISTIGQAFELRFKQYLKNPSLNTSGESEEVHIDSHAEEREDHEYYNEIPGKQPPVGGVSDMRIKVQATEQMAYCPIQCEKLCYLPGNSKCSSVYENCLEQSRAIGNVHPRGVQSQRDTSLLKHTCRVDLFDDPCYINTQALQSTPGSAGNQRSAQPLGSPWHCGKAPETVQPGATAQPASSHSLPHIKQQLWSEECYHGKLSRKAAESLLVKDGDFLVRESATSPGQYVLSGLQGGQAKHLLLVDPEGKVRTKDHVFDNVGHLIRYHMDNSLPIISSGSEVSLKQPVRKDNNPALLHSNK

SEQ ID NO: 810290 - protein, 344 aa, Homo sapiens; identical to SEQ ID NO: 810289

SEQ ID NO: 810291 - protein, 105 aa, Homo sapiens
MTGSWAAPPRPAWAGLGPFWHLRRSRRQDGLCCPGPRPPSSTVASHCKKAWIRNLIRATLLCEARRLRTSGLVPKSLSRGQALWEHGLPATHPDQAEKERLEKEE

SEQ ID NO: 810292 - protein, 105 aa, Homo sapiens; identical to SEQ ID NO: 810291

SEQ ID NO: 810293 - protein, 155 aa, Homo sapiens
MSLCEDMLLCNYRKCRIKLSGYAWVTACSHIFCDQHGSGEFSRSPAICPACNSTLSGKLDIVRTELSPSEEYKAMVLAGLRPEIVLDISSRALAFWTYQVLQERLYQEYNFSKAEGHLNRWGRYFPESKQGGNGPMKGGSRERSKTEKRSRNRGR

SEQ ID NO: 810294 - protein, 102 aa, Homo sapiens
MSLCEDMLLCNYRKCRIKLSGYAWVTACSHIFCDQHGSGEFSRSPAICPACNSTLSGKLDIVRTELSPSEEYKAMVLAGLRPEIVLDISSRALAFWTYQYFL

SEQ ID NO: 810295 - protein, 158 aa, Homo sapiens
MSLCEDMLLCNYRKCRIKLSGYAWVTACSHIFCDQHGSGEFSRSPAICPACNSTLSGKLDIVRTELSPSEEYKAMVLAGLRPEIVLDISSRALAFWTYQVHQEQSSNQGNTKSSSAGAEGPSETRWRRYILSKYQAKDVDIEPAMKRGRVTIPCTKSS

SEQ ID NO: 810296 - protein, 102 aa, Homo sapiens; identical to SEQ ID NO: 810294

SEQ ID NO: 810297 - protein, 102 aa, Homo sapiens; identical to SEQ ID NO: 810294

SEQ ID NO: 810298 - protein, 138 aa, Homo sapiens
MPEDLFGAVNPGYTVDEYCVFLLWTLFSFWRPHYPIMSLCEDMLLCNYRKCRIKLSGYAWVTACSHIFCDQHGSGEFSRSPAICPACNSTLSGKLDIVRTELSPSEEYKAMVLAGLRPEIVLDISSRALAFWTYQYFL

SEQ ID NO: 810299 - protein, 115 aa, Homo sapiens [sequence omitted]

SEQ ID NO: 810300 - protein, 220 aa, Homo sapiens
AFLYSDGQSETILGGLGLRMGSSDCRVKIATKANPWIGNSLKPDSVRSQLETSLKRLQFPEWTSSIYMHLTTAPRWKRHCVPATSCTRRASSWSLASPTMPPGKWPRSVPSARATAGSCPLCTSFWKEHHFEGIALVEKALQAAYGASAPSMTSAALRWMYHHSQLQGAHGDAVILGMSSLEQLEQNLAAAEEGPLEPAVVDAFNQAWHLFAHECPNYFI

SEQ ID NO: 810301 - protein, 811 aa, Homo sapiens
MEAARALRLLLVVCGCLALPPLAEPVCPERCDCQHPQHLLCTNRGLRVVPKTSSLPSPHDVLTYSLGGNFITNITAFDFHRLGQLRRLDLQYNQIRSLHPKTFEKLSRLEELYLGNNLLQALAPGTLAPLRKLRILYANGNEISRLSRGSFEGLESLVKLRLDGNALGALPDAVFAPLGNLLYLHLESNRIRFLGKNAFAQLGKLRFLNLSANELQPSLRHAATFAPLRSLSSLILSANSLQHLGPRIFQHLPRLGLLSLRGNQLTHLAPEAFWGLEALRELRLEGNRLSQLPTALLEPLHSLEALDLSGNELSALHPATFGHLGRLRELSLRNNALSALSGDIFAASPALYRLDLDGNGWTCDCRLRGLKRWMGDWHSQGRLLTVFVQCRHPPALRGKYLDYLDDQQLQNGSCADPSPSASLTADRRRQPLPTAAGEEMTPPAGLAEELPPQPQLQQQGRFLAGVAWDGAARELVGNRSALRLSRRGPGLQQPSPSVAAAAGPAPQSLDLHKKPQRGRPTRADPALAEPTPTASPGSAPSPAGDPWQRATKHRLGTEHQERAAQSDGGAGLPPLVSDPCDFNKFILCNLTVEAVGADSASVRWAVREHRSPRPLGGARFRLLFDRFGQQPKFHRFVYLPESSDSATLRELRGDTPYLVCVEGVLGGRVCPVAPRDHCAGLVTLPEAGSRGGVDYQLLTLALLTVNALLVLLALAAWASRWLRRKLRARRKGGAPVHVRHMYSTRRPLRSMGTGVSADFSGFQSHRPRTTVCALSEADLIEFPCDRFMDSAGGGAGGSLRREDRLLQRFAD

SEQ ID NO: 810302 - protein, 811 aa, Homo sapiens; identical to SEQ ID NO: 810301

SEQ ID NO: 810303 - protein, 811 aa, Homo sapiens; identical to SEQ ID NO: 810301

SEQ ID NO: 810304 - protein, 452 aa, Homo sapiens
AEGGRTAQLTAVLRKILDPRLISTEENTQGAETMGPLSAPPCTQHITWKGLLLTASLLNFWNPPTTAQVTIEAQPPKVSEGKDVLLLVHNLPQNLTGYIWYKGQIRDLYHYVTSYVVDGQIIKYGPAYSGRETVYSNASLLIQNVTQEDTGSYTLHIIKRGDGTGGVTGRFTFTLYLETPKPSISSSNFNPREATEAVILTCDPETPDASYLWWMNGQSLPMTHSLQLSETNRTLYLFGVTNYTAGPYECEIRNPVSASRSDPVTLNLLPKLPKPYITINNLNPRENKDVSTFTCEPKSENYTYIWWLNGQSLPVSPRVKRRIENRILILPSVTRNETGPYQCEIRDRYGGIRSDPVTLNVLYGPDLPRIYPSFTYYHSGQNLYLSCFADSNPPAQYSWTINGKFQLSGQKLSIPQITTKHSGLYACSVRNSATGKESSKSVTVRVSDWTLP

SEQ ID NO: 810305 - protein, 261 aa, Homo sapiens
MITGVPWPPKVSEGKDVLLLVHNLPQNLTGYIWYKGQIRDLYHYVTSYVVDGQIIKYGPAYSGRETVYSNASLLIQNVTQEDTGSYTLHIIKRGDGTGGVTGRFTFTLYLETPKPSISSSNFNPREATEAVILTCDPETPDASYLWWMNGQSLPMTHSLQLSETNRTLYLFGVTNYTAGPYECEIRNPVSASRSDPVTLNLLREYLLFLCEPGCHPKYKWPEARPLSPSQVQVQRPLSLNIKAGHDFLLQANQSRPRLDQQ

SEQ ID NO: 810306 - protein, 67 aa, Homo sapiens
AEGGRTAQLTAVLRKILDPRLISTEENTQGAETMGPLSAPPCTQHITWKGLLLTASLLNFWNPPTTV

SEQ ID NO: 810307 - protein, 141 aa, Homo sapiens
VRQDTVGGSAVILTCDPETPDASYLWWMNGQSLPMTHSLQLSETNRTLYLFGVTNYTAGPYECEIRNPVSASRSDPVTLNLLREYLLFLCEPGCHPKYKWPEARPLSPSQVQVQRPLSLNIKAGHDFLLQANQSRPRLDQQ

SEQ ID NO: 810308 - protein, 81 aa, Homo sapiens
SVRGSPADRHALYLSCFADSNPPAQYSWTINGKFQLSGQKLSIPQITTKHSGLYACSVRNSATGKESSKSVTVRVSDWTLP

SEQ ID NO: 810309 - protein, 217 aa, Homo sapiens
MITGVPWPPKVSEGKDVLLLVHNLPQNLTGYIWYKGQIRDLYHYVTSYVVDGQIIKYGPAYSGRETVYSNASLLIQNVTQEDTGSYTLHIIKRGDGTGGVTGRFTFTLYLETPKPSISSSNFNPREATEAVILTCDPETPDASYLWWMNGQSLPMTHSLQLSETNRTLYLFGVTNYTAGPYECEIRNPVSASRSDPVTLNLLREYLLFLCEPGCHPV

SEQ ID NO: 810310 - protein, 146 aa, Homo sapiens
SGGVSGGQAALLGAHVRPAPDRAARCAPRAKKAGANAGARGQGRGAAAGPERPPHVQGRRPAPRGAVGARRALLGAVGKAGGLTRARETRRRGEEGVPAAGTPRCLQQEGATQVAVRLPLVSVLVRHDGPLPLSAAALGAPGLRTA

SEQ ID NO: 810311 - protein, 146 aa, Homo sapiens; identical to SEQ ID NO: 810310

SEQ ID NO: 810312 - protein, 1185 aa, Homo sapiens
MMCEVMPTISEAEGPPGGGGGHGSGSPSQPDADSHFEQLMVSMLEERDRLLDTLRETQETLALTQGKLHEVGHERDSLQRQLNTALPQEFAALTKELNVCREQLLEREEEIAELKAERNNTRLLLEHLECLVSRHERSLRMTVVKRQAQSPAGVSSEVEVLKALKSLFEHHKALDEKVRERLRVALERCSLLEEELGATHKELMILKEQNNQKKTLTDGVLDINHEQENTPSTSGKRSSDGSLSHEEDLAKVIELQEIISKQSREQSQMKERLASLSSHVTELEEDLDTARKDLIKSEEMNTKLQRDVREAMAQKEDMEERITTLEKRYLAAQREATSVHDLNDKLENEIANKDSMHRQTEDKNRQLQERLELAEQKLQQTLRKAETLPEVEAELAQRVAALSKAEERHGNIEERLRQMEAQLEEKNQELQRARQREKMNEEHNKRLSDTVDKLLSESNERLQLHLKERMAALEDKNSLLREVESAKKQLEETQHDKDQLVLNIEALRAELDHMRLRGASLHHGRPHLGSVPDFRFPMADGHTDSYSTSAVLRRPQKGRLAALRDEPSKVQTLNEQDWERAQQASVLANVAQAFESDADVSDGEDDRDTLLSSVDLLSPSGQADAHTLAMMLQEQLDAINKEIRLIQEEKENTEQRAEEIESRVGSGSLDNLGRFRSMSSIPPYPASSLASSSPPGSGRSTPRRIPHSPAREVDRLGVMTLLPPSREEVRDDKTTIKCETSPPSSPRALRLDRLHKGALHTVSHEDIRDIRNSTGSQDGPVSNPSSSNSSQDSLHKAPKKKGIKSSIGRLFGKKEKGRPGQTGKEALGQAGVSETDNSSQDALGLSKLGGQAEKNRKLQKKHELLEEARRQGLPFAQWDGPTVVVWLELWVGMPAWYVAACRANVKSGAIMSALSDTEIQREIGISNPLHRLKLRLAIQEIMSLTSPSAPPTSRTTLAYGDMNHEWIGNEWLPSLGLPQYRSYFMECLVDARMLDHLTKKDLRGQLKMVDSFHRNSFQCGIMCLRRLNYDRKELERKREESQSEIKDVLVWSNDRVIRWILSIGLKEYANNLIESGVHGALLALDETFDFSALALLLQIPTQNTQARAVLEREFNNLLVMGTDRRFDEDDDKSFRRAPSWRKKFRPKDIRGLAAGSAETLPANFRVTSSMSSPSMQPKKMQMDGM

SEQ ID NO: 810313 - protein, 208 aa, Homo sapiens
MMLQEQLDAINKEIRLIQEEKENTEQRAEEIESRVGSGSLDNLGRFRSMSSIPPYPASSLASSSPPGSGRSTPRRIPHSPAREVDRLGVMTLLPPSREEVRDDKTTIKCETSPPSSPRALRLDRLHKGALHTVSHEDIRDIRNSTGSQDGPVSNPSSSNSSQDSLHKAPKKKGIKSSIGRLFGKKEKGRPGQTGKEALGQGWLVFRTL

SEQ ID NO: 810314 - protein, 1202 aa, Homo sapiens
MMCEVMPTISEAEGPPGGGGGHGSGSPSQPDADSHFEQLMVSMLEERDRLLDTLRETQETLALTQGKLHEVGHERDSLQRQLNTALPQEFAALTKELNVCREQLLEREEEIAELKAERNNTRLLLEHLECLVSRHERSLRMTVVKRQAQSPAGVSSEVEVLKALKSLFEHHKALDEKVRERLRVALERCSLLEEELGATHKELMILKEQNNQKKTLTDGVLDINHEQENTPSTSGKRSSDGSLSHEEDLAKVIELQEIISKQSREQSQMKERLASLSSHVTELEEDLDTARKDLIKSEEMNTKLQRDVREAMAQKEDMEERITTLEKRYLAAQREATSVHDLNDKLENEIANKDSMHRQTEDKNRQLQERLELAEQKLQQTLRKAETLPEVEAELAQRVAALSKAEERHGNIEERLRQMEAQLEEKNQELQRARQREKMNEEHNKRLSDTVDKLLSESNERLQLHLKERMAALEDKNSLLREVESAKKQLEETQHDKDQLVLNIEALRAELDHMRLRGASLHHGRPHLGSVPDFRFPMADGHTDSYSTSAVLRRPQKGRLAALRDEPSKVQTLNEQDWERAQQASVLANVAQAFESDADVSDGEDDRDTLLSSVDLLSPSGQADAHTLAMMLQEQLDAINKEIRLIQEEKENTEQRAEEIESRVGSGSLDNLGRFRSMSSIPPYPASSLASSSPPGSGRSTPRRIPHSPAREVDRLGVMTLLPPSREEVRDDKTTIKCETSPPSSPRALRLDRLHKGALHTVSHEDIRDIRNSTGSQDGPVSNPSSSNSSQDSLHKAPKKKGIKSSIGRLFGKKEKGRPGQTGKEALGQAGVSETDNSSQDALGLSKLGGQAEKNRKLQKKHELLEEARRQGLPFAQWDGPTVVVWLELWVGMPAWYVAACRANVKSGAIMSALSDTEIQREIGISNPLHRLKLRLAIQEIMSLTSPSAPPTSRTTLAYGDMNHEWIGNEWLPSLGLPQYRSYFMECLVDARMLDHLTKKDLRGQLKMVDSFHRNSFQCGIMCLRRLNYDRKELERKREESQSEIKDVLVWSNDRVIRWILSIGLKEYANNLIESGVHGALLALDETFDFSALALLLQIPTQNTQARAVLEREFNNLLVMGTDRRFDEDDDKSFRRAPSWRKKFRPKDIRGLAAGSAETLPANFRVTSSMSSPSMQPKKMQMDGNVSGTQRLDSATVRTYSC

SEQ ID NO: 810315 - protein, 1202 aa, Homo sapiens; identical to SEQ ID NO: 810314

SEQ ID NO: 810316 - protein, 1202 aa, Homo sapiens; identical to SEQ ID NO: 810314

SEQ ID NO: 810317 - protein, 1202 aa, Homo sapiens; identical to SEQ ID NO: 810314

SEQ ID NO: 810318 - protein, 891 aa, Homo sapiens [sequence omitted]

SEQ ID NO: 810319 - protein, 1212 aa, Homo sapiens
MMCEVMPTISEAEGPPGGGGGHGSGSPSQPDADSHFEQLMVSMLEERDRLLDTLRETQETLALTQGKLHEVGHERDSLQRQLNTALPQEFAALTKELNVCREQLLEREEEIAELKAERNNTRLLLEHLECLVSRHERSLRMTVVKRQAQSPAGVSSEVEVLKALKSLFEHHKALDEKVRERLRVALERCSLLEEELGATHKELMILKEQNNQKKTLTDGVLDINHEQENTPSTSGKRSSDGSLSHEEDLAKVIELQEIISKQSREQSQMKERLASLSSHVTELEEDLDTARKDLIKSEEMNTKLQRDVREAMAQKEDMEERITTLEKRYLAAQREATSVHDLNDKLENEIANKDSMHRQTEDKNRQLQERLELAEQKLQQTLRKAETLPEVEAELAQRVAALSKAEERHGNIEERLRQMEAQLEEKNQELQRARQREKMNEEHNKRLSDTVDKLLSESNERLQLHLKERMAALEDKNSLLREVESAKKQLEETQHDKDQLVLNIEALRAELDHMRLRGASLHHGRPHLGSVPDFRFPMADGHTDSYSTSAVLRRPQKGRLAALRDEPSKVQTLNEQDWERAQQASVLANVAQAFESDADVSDGEDDRDTLLSSVDLLSPSGQADAHTLAMMLQEQLDAINKEIRLIQEEKENTEQRAEEIESRVGSGSLDNLGRFRSMSSIPPYPASSLASSSPPGSGRSTPRRIPHSPAREVDRLGVMTLPSDLRKHRRKLPPSREEVRDDKTTIKCETSPPSSPRALRLDRLHKGALHTVSHEDIRDIRNSTGSQDGPVSNPSSSNSSQDSLHKAPKKKGIKSSIGRLFGKKEKGRPGQTGKEALGQAGVSETDNSSQDALGLSKLGGQAEKNRKLQKKHELLEEARRQGLPFAQWDGPTVVVWLELWVGMPAWYVAACRANVKSGAIMSALSDTEIQREIGISNPLHRLKLRLAIQEIMSLTSPSAPPTSRTTLAYGDMNHEWIGNEWLPSLGLPQYRSYFMECLVDARMLDHLTKKDLRGQLKMVDSFHRNSFQCGIMCLRRLNYDRKELERKREESQSEIKDVLVWSNDRVIRWILSIGLKEYANNLIESGVHGALLALDETFDFSALALLLQIPTQNTQARAVLEREFNNLLVMGTDRRFDEDDDKSFRRAPSWRKKFRPKDIRGLAAGSAETLPANFRVTSSMSSPSMQPKKMQMDGNVSGTQRLDSATVRTYSC

SEQ ID NO: 810320 - protein, 598 aa, Homo sapiens
GEEKVPQPFQSWSWKPQPSLPLYSVHLSEVLSPAHTQRLGLIQEEKENTEQRAEEIESRVGSGSLDNLGRFRSMSSIPPYPASSLASSSPPGSGRSTPRRIPHSPAREVDRLGVMTLLPPSREEVRDDKTTIKCETSPPSSPRALRLDRLHKGALHTVSHEDIRDIRNSTGSQDGPVSNPSSSNSSQDSLHKAPKKKGIKSSIGRLFGKKEKGRPGQTGKEALGQAGVSETDNSSQDALGLSKLGGQAEKNRKLQKKHELLEEARRQGLPFAQWDGPTVVVWLELWVGMPAWYVAACRANVKSGAIMSALSDTEIQREIGISNPLHRLKLRLAIQEIMSLTSPSAPPTSRTTLAYGDMNHEWIGNEWLPSLGLPQYRSYFMECLVDARMLDHLTKKDLRGQLKMVDSFHRNSFQCGIMCLRRLNYDRKELERKREESQSEIKDVLVWSNDRVIRWILSIGLKEYANNLIESGVHGALLALDETFDFSALALLLQIPTQNTQARAVLEREFNNLLVMGTDRRFDEDDDKSFRRAPSWRKKFRPKDIRGLAAGSAETLPANFRVTSSMSSPSMQPKKMQMDGNVSGTQRLDSATVRTYSC

SEQ ID NO: 810321 - protein, 1232 aa, Homo sapiens
MMCEVMPTISEAEGPPGGGGGHGSGSPSQPDADSHFEQLMVSMLEERDRLLDTLRETQETLALTQGKLHEVGHERDSLQRQLNTALPQEFAALTKELNVCREQLLEREEEIAELKAERNNTRLLLEHLECLVSRHERSLRMTVVKRQAQSPAGVSSEVEVLKALKSLFEHHKALDEKVRERLRVALERCSLLEEELGATHKELMILKEQNNQKKTLTDGVLDINHEQENTPSTSGKRSSDGSLSHEEDLAKVIELQEIISKQSREQSQMKERLASLSSHVTELEEDLDTARKDLIKSEEMNTKLQRDVREAMAQKEDMEERITTLEKRYLAAQREATSVHDLNDKLENEIANKDSMHRQTEDKNRQLQERLELAEQKLQQTLRKAETLPEVEAELAQRVAALSKAEERHGNIEERLRQMEAQLEEKNQELQRARQREKMNEEHNKRLSDTVDKLLSESNERLQLHLKERMAALEDKNSLLREVESAKKQLEETQHDKDQLVLNIEALRAELDHMRLRGASLHHGRPHLGSVPDFRFPMADGHTDSYSTSAVLRRPQKGRLAALRDEPSKVQTLNEQDWERAQQASVLANVAQAFESDADVSDGEDDRDTLLSSVDLLSPSGQADAHTLAMMLQEQLDAINKEIRLIQEEKENTEQRAEEIESRVGSGSLDNLGRFRSMSSIPPYPASSLASSSPPGSGRSTPRRIPHSPAREVDRLGVMTLLPPSREEVRDDKTTIKCETSPPSSPRALRLDRLHKGALHTVSHEDIRDIRNSTGSQDGPVSNPSSSNSSQDSLHKAPKKKGIKSSIGRLFGKKEKGRPGQTGKEALGQAGVSETDNSSQDALGLSKLGGQAEKNRKLQKKHELLEEARRQGLPFAQWDGPTVVVWLELWVGMPAWYVAACRANVKSGAIMSALSDTEIQREIGISNPLHRLKLRLAIQEIMSLTSPSAPPTSRTTTGNVWLTHEEMETLAATPQTEDEEGSWAQTLAYGDMNHEWIGNEWLPSLGLPQYRSYFMECLVDARMLDHLTKKDLRGQLKMVDSFHRNSFQCGIMCLRRLNYDRKELERKREESQSEIKDVLVWSNDRVIRWILSIGLKEYANNLIESGVHGALLALDETFDFSALALLLQIPTQNTQARAVLEREFNNLLVMGTDRRFDEDDDKSFRRAPSWRKKFRPKDIRGLAAGSAETLPANFRVTSSMSSPSMQPKKMQMDGNVSGTQRLDSATVRTYSC

SEQ ID NO: 810322 - protein, 583 aa, Homo sapiens
MMLQEQLDAINKEIRLIQEEKENTEQRAEEIESRVGSGSLDNLGRFRSMSSIPPYPASSLASSSPPGSGRSTPRRIPHSPAREVDRLGVMTLPSDLRKHRRKLPPSREEVRDDKTTIKCETSPPSSPRALRLDRLHKGALHTVSHEDIRDIRNSTGSQDGPVSNPSSSNSSQDSLHKAPKKKGIKSSIGRLFGKKEKGRPGQTGKEALGQAGVSETDNSSQDALGLSKLGGQAEKNRKLQKKHELLEEARRQGLPFAQWDGPTVVVWLELWVGMPAWYVAACRANVKSGAIMSALSDTEIQREIGISNPLHRLKLRLAIQEIMSLTSPSAPPTSRTTLAYGDMNHEWIGNEWLPSLGLPQYRSYFMECLVDARMLDHLTKKDLRGQLKMVDSFHRNSFQCGIMCLRRLNYDRKELERKREESQSEIKDVLVWSNDRVIRWILSIGLKEYANNLIESGVHGALLALDETFDFSALALLLQIPTQNTQARAVLEREFNNLLVMGTDRRFDEDDDKSFRRAPSWRKKFRPKDIRGLAAGSAETLPANFRVTSSMSSPSMQPKKMQMDGNVSGTQRLDSATVRTYSC

SEQ ID NO: 810323 - protein, 482 aa, Homo sapiens
MLPPSREEVRDDKTTIKCETSPPSSPRALRLDRLHKGALHTVSHEDIRDIRNSTGSQDGPVSNPSSSNSSQDSLHKAPKKKGIKSSIGRLFGKKEKGRPGQTGKEALGQAGVSETDNSSQDALGLSKLGGQAEKNRKLQKKHELLEEARRQGLPFAQWDGPTVVVWLELWVGMPAWYVAACRANVKSGAIMSALSDTEIQREIGISNPLHRLKLRLAIQEIMSLTSPSAPPTSRTTLAYGDMNHEWIGNEWLPSLGLPQYRSYFMECLVDARMLDHLTKKDLRGQLKMVDSFHRNSFQCGIMCLRRLNYDRKELERKREESQSEIKDVLVWSNDRVIRWILSIGLKEYANNLIESGVHGALLALDETFDFSALALLLQIPTQNTQARAVLEREFNNLLVMGTDRRFDEDDDKSFRRAPSWRKKFRPKDIRGLAAGSAETLPANFRVTSSMSSPSMQPKKMQMDGNVSGTQRLDSATVRTYSC

SEQ ID NO: 810324 - protein, 400 aa, Homo sapiens
MLLVAQKLGCKMANLVLEHMWHNGAVVARPRLLHQVCIGLLRSLRTYDRLKKIVNFKKKHELLEEARRQGLPFAQWDGPTVVVWLELWVGMPAWYVAACRANVKSGAIMSALSDTEIQREIGISNPLHRLKLRLAIQEIMSLTSPSAPPTSRTTLAYGDMNHEWIGNEWLPSLGLPQYRSYFMECLVDARMLDHLTKKDLRGQLKMVDSFHRNSFQCGIMCLRRLNYDRKELERKREESQSEIKDVLVWSNDRVIRWILSIGLKEYANNLIESGVHGALLALDETFDFSALALLLQIPTQNTQARAVLEREFNNLLVMGTDRRFDEDDDKSFRRAPSWRKKFRPKDIRGLAAGSAETLPANFRVTSSMSSPSMQPKKMQMDGNVSGTQRLDSATVRTYSC

SEQ ID NO: 810325 - protein, 241 aa, Homo sapiens
MNHEWIGNEWLPSLGLPQYRSYFMECLVDARMLDHLTKKDLRGQLKMVDSFHRNSFQCGIMCLRRLNYDRKELERKREESQSEIKDVLVWSNDRVIRWILSIGLKEYANNLIESGVHGALLALDETFDFSALALLLQIPTQNTQARAVLEREFNNLLVMGTDRRFDEDDDKSFRRAPSWRKKFRPKDIRGLAAGSAETLPANFRVTSSMSSPSMQPKKMQMDGNVSGTQRLDSATVRTYSC

SEQ ID NO: 810326 - protein, 241 aa, Homo sapiens; identical to SEQ ID NO: 810325

SEQ ID NO: 810327 - protein, 1136 aa, Homo sapiens
MMCEVMPTISEAEGPPGGGGGHGSGSPSQPDADSHFEQLMVSMLEERDRLLDTLRETQETLALTQGKLHEVGHERDSLQRQLNTALPQEFAALTKELNVCREQLLEREEEIAELKAERNNTRLLLEHLECLVSRHERSLRMTVVKRQAQSPAGVSSEVEVLKALKSLFEHHKALDEKVRERLRVALERCSLLEEELGATHKELMILKEQNNQKKTLTDGVLDINHEQENTPSTSGKRSSDGSLSHEEDLAKVIELQEIISKQSREQSQMKERLASLSSHVTELEEDLDTARKDLIKSEEMNTKLQRDVREAMAQKEDMEERITTLEKRYLAAQREATSVHDLNDKLENEIANKDSMHRQTEDKNRQLQERLELAEQKLQQTLRKAETLPEVEAELAQRVAALSKAEERHGNIEERLRQMEAQLEEKNQELQRARQREKMNEEHNKRLSDTVDKLLSESNERLQLHLKERMAALEDKNSLLREVESAKKQLEETQHDKDQLVLNIEALRAELDHMRLRGASLHHGRPHLGSVPDFRFPMADGHTDSYSTSAVLRRPQKGRLAALRDEPSKVQTLNEQDWERAQQASVLANVAQAFESDADVSDGEDDRDTLLSSVDLLSPSGQADAHTLAMMLQEQLDAINKEIRLIQEEKENTEQRAEEIESRVGSGSLDNLGRFRSMSSIPPYPASSLASSSPPGSGRSTPRRIPHSPAREVDRLGVMTLLPPSREEVRDDKTTIKCETSPPSSPRALRLDRLHKGALHTVSHEDIRDIRNSTGSQDGPVSNPSSSNSSQDSLHKAPKKKGIKSSIGRLFGKKEKGRPGQTGKEALGQAGVSETDNSSQDALGLSKLGGQAEKNRKLQKKHELLEEARRQGLPFAQWDGPTVVVWLELWVGMPAWYVAACRANVKSGAIMSALSDTEIQREIGISNPLHRLKLRLAIQEIMSLTSPSAPPTSRTTLAYGDMNHEWIGNEWLPSLGLPQYRSYFMECLVDARMLDHLTKKDLRGQLKMVDSFHRNSFQCGIMCLRRLNYDRKELERKREESQSEIKDVLVWSNDRVIRWILSIGLKEYANNLIESGVHGALLALDETFDFSALALLLQIPTQNTQARAVLEREFNNLLVMGTDRRFDEVSFWPNVL

SEQ ID NO: 810328 - protein, 1191 aa, Homo sapiens
MMCEVMPTISEAEGPPGGGGGHGSGSPSQPDADSHFEQLMVSMLEERDRLLDTLRETQETLALTQGKLHEVGHERDSLQRQLNTALPQEFAALTKELNVCREQLLEREEEIAELKAERNNTRLLLEHLECLVSRHERSLRMTVVKRQAQSPAGVSSEVEVLKALKSLFEHHKALDEKVRERLRVALERCSLLEEELGATHKELMILKEQNNQKKTLTDGVLDINHEQENTPSTSGKRSSDGSLSHEEDLAKVIELQEIISKQSREQSQMKERLASLSSHVTELEEDLDTARKDLIKSEEMNTKLQRDVREAMAQKEDMEERITTLEKRYLAAQREATSVHDLNDKLENEIANKDSMHRQTEDKNRQLQERLELAEQKLQQTLRKAETLPEVEAELAQRVAALSKAEERHGNIEERLRQMEAQLEEKNQELQRARQREKMNEEHNKRLSDTVDKLLSESNERLQLHLKERMAALEDKNSLLREVESAKKQLEETQHDKDQLVLNIEALRAELDHMRLRGASLHHGRPHLGSVPDFRFPMADGHTDSYSTSAVLRRPQKGRLAALRDEPSKVQTLNEQDWERAQQASVLANVAQAFESDADVSDGEDDRDTLLSSVDLLSPSGQADAHTLAMMLQEQLDAINKEIRLIQEEKENTEQRAEEIESRVGSGSLDNLGRFRSMSSIPPYPASSLASSSPPGSGRSTPRRIPHSPAREVDRLGVMTLLPPSREEVRDDKTTIKCETSPPSSPRALRLDRLHKGALHTVSHEDIRDIRNSTGSQDGPVSNPSSSNSSQDSLHKAPKKKGIKSSIGRLFGKKEKGRPGQTGKEALGQAGVSETDNSSQDALGLSKLGGQAEKNRKLQKKHELLEEARRQGLPFAQWDGPTVVVWLELWVGMPAWYVAACRANVKSGAIMSALSDTEIQREIGISNPLHRLKLRLAIQEIMSLTSPSAPPTSRTTLAYGDMNHEWIGNEWLPSLGLPQYRSYFMECLVDARMLDHLTKKDLRGQLKMVDSFHRNSFQCGIMCLRRLNYDRKELERKREESQSEIKDVLVWSNDRVIRWILSIGLKEYANNLIESGVHGALLALDETFDFSALALLLQIPTQNTQARAVLEREFNNLLVMGTDRRFDEHDDKSFGEHLHVESSLIPPREFLLCFTPSMHPIKYCHCTLCFKYPTARILLQLCTLLLLTSSC

SEQ ID NO: 810329 - protein, 1121 aa, Homo sapiens
MMCEVMPTISEAEGPPGGGGGHGSGSPSQPDADSHFEQLMVSMLEERDRLLDTLRETQETLALTQGKLHEVGHERDSLQRQLNTALPQEFAALTKELNVCREQLLEREEEIAELKAERNNTRLLLEHLECLVSRHERSLRMTVVKRQAQSPAGVSSEVEVLKALKSLFEHHKALDEKVRERLRVALERCSLLEEELGATHKELMILKEQNNQKKTLTDGVLDINHEQENTPSTSGKRSSDGSLSHEEDLAKVIELQEIISKQSREQSQMKERLASLSSHVTELEEDLDTARKDLIKSEEMNTKLQRDVREAMAQKEDMEERITTLEKRYLAAQREATSVHDLNDKLENEIANKDSMHRQTEDKNRQLQERLELAEQKLQQTLRKAETLPEVEAELAQRVAALSKAEERHGNIEERLRQMEAQLEEKNQELQRARQREKMNEEHNKRLSDTVDKLLSESNERLQLHLKERMAALEDKNSLLREVESAKKQLEETQHDKDQLVLNIEALRAELDHMRLRGASLHHGRPHLGSVPDFRFPMADGHTDSYSTSAVLRRPQKGRLAALRDEPSKVQTLNEQDWERAQQASVLANVAQAFESDADVSDGEDDRDTLLSSVDLLSPSGQADAHTLAMMLQEQLDAINKEIRLIQEEKENTEQRAEEIESRVGSGSLDNLGRFRSMSSIPPYPASSLASSSPPGSGRSTPRRIPHSPAREVDRLGVMTLLPPSREEVRDDKTTIKCETSPPSSPRALRLDRLHKGALHTVSHEDIRDIRNSTGSQDGPVSNPSSSNSSQDSLHKAPKKKGIKSSIGRLFGKKEKGRPGQTGKEALGQAGVSETDNSSQDALGLSKLGGQAEKNRKLQKKHELLEEARRQGLPFAQWDGPTVVVWLELWVGMPAWYVAACRANVKSGAIMSALSDTEIQREIGISNPLHRLKLRLAIQEIMSLTSPSAPPTSRTTLAYGDMNHEWIGNEWLPSLGLPQYRSYFMECLVDARMLDHLTKKDLRGQLKMVDSFHRNSFQCGIMCLRRLNYDRKELERKREESQSEIKDVLVWSNDRVIRWILSIGLKEYANNLIESGVHGALLALDETFDFSALALLLQIPTQNTQVTPNLSVSALIVQLAP

SEQ ID NO: 810330 - protein, 989 aa, Homo sapiens
MMCEVMPTISEAEGPPGGGGGHGSGSPSQPDADSHFEQLMVSMLEERDRLLDTLRETQETLALTQGKLHEVGHERDSLQRQLNTALPQEFAALTKELNVCREQLLEREEEIAELKAERNNTRLLLEHLECLVSRHERSLRMTVVKRQAQSPAGVSSEVEVLKALKSLFEHHKALDEKVRERLRVALERCSLLEEELGATHKELMILKEQNNQKKTLTDGVLDINHEQENTPSTSGKRSSDGSLSHEEDLAKVIELQEIISKQSREQSQMKERLASLSSHVTELEEDLDTARKDLIKSEEMNTKLQRDVREAMAQKEDMEERITTLEKRYLAAQREATSVHDLNDKLENEIANKDSMHRQTEDKNRQLQERLELAEQKLQQTLRKAETLPEVEAELAQRVAALSKAEERHGNIEERLRQMEAQLEEKNQELQRARQREKMNEEHNKRLSDTVDKLLSESNERLQLHLKERMAALEDKNSLLREVESAKKQLEETQHDKDQLVLNIEALRAELDHMRLRGASLHHGRPHLGSVPDFRFPMADGHTDSYSTSAVLRRPQKGRLAALRDEPSKVQTLNEQDWERAQQASVLANVAQAFESDADVSDGEDDRDTLLSSVDLLSPSGQADAHTLAMMLQEQLDAINKEIRLIQEEKENTEQRAEEIESRVGSGSLDNLGRFRSMSSIPPYPASSLASSSPPGSGRSTPRRIPHSPAREVDRLGVMTLLPPSREEVRDDKTTIKCETSPPSSPRALRLDRLHKGALHTVSHEDIRDIRNSTGSQDGPVSNPSSSNSSQDSLHKAPKKKGIKSSIGRLFGKKEKGRPGQTGKEALGQAGVSETDNSSQDALGLSKLGGQAEKNRKLQKKHELLEEARRQGLPFAQWDGPTVVVWLELWVGMPAWYVAACRANVKSGAIMSALSDTEIQREIGISNPLHRLKLRLAIQEIMSLTSPSAPPTSRTVRSETTPAFFGNRECLSEGITALFTLLLQFLNSI

SEQ ID NO: 810331 - protein, 1021 aa, Homo sapiens
MMCEVMPTISEAEGPPGGGGGHGSGSPSQPDADSHFEQLMVSMLEERDRLLDTLRETQETLALTQGKLHEVGHERDSLQRQLNTALPQEFAALTKELNVCREQLLEREEEIAELKAERNNTRLLLEHLECLVSRHERSLRMTVVKRQAQSPAGVSSEVEVLKALKSLFEHHKALDEKVRERLRVALERCSLLEEELGATHKELMILKEQNNQKKTLTDGVLDINHEQENTPSTSGKRSSDGSLSHEEDLAKVIELQEIISKQSREQSQMKERLASLSSHVTELEEDLDTARKDLIKSEEMNTKLQRDVREAMAQKEDMEERITTLEKRYLAAQREATSVHDLNDKLENEIANKDSMHRQTEDKNRQLQERLELAEQKLQQTLRKAETLPEVEAELAQRVAALSKAEERHGNIEERLRQMEAQLEEKNQELQRARQREKMNEEHNKRLSDTVDKLLSESNERLQLHLKERMAALEDKNSLLREVESAKKQLEETQHDKDQLVLNIEALRAELDHMRLRGASLHHGRPHLGSVPDFRFPMADGHTDSYSTSAVLRRPQKGRLAALRDEPSKVQTLNEQDWERAQQASVLANVAQAFESDADVSDGEDDRDTLLSSVDLLSPSGQADAHTLAMMLQEQLDAINKEIRLIQEEKENTEQRAEEIESRVGSGSLDNLGRFRSMSSIPPYPASSLASSSPPGSGRSTPRRIPHSPAREVDRLGVMTLLPPSREEVRDDKTTIKCETSPPSSPRALRLDRLHKGALHTVSHEDIRDIRNSTGSQDGPVSNPSSSNSSQDSLHKAPKKKGIKSSIGRLFGKKEKGRPGQTGKEALGQAGVSETDNSSQDALGLSKLGGQAEKNRKLQKKHELLEEARRQGLPFAQWDGPTVVVWLELWVGMPAWYVAACRANVKSGAIMSALSDTEIQREIGISNPLHRLKLRLAIQEIMSLTSPSAPPTSRTTTGNVWLTHEEMETLAATPQTVSHAPQPALLPARFPLKTVWVLCLFVENKMLFSIQSFQISISFSY

SEQ ID NO: 810332 - protein, 85 aa, Homo sapiens
VMPTISEAEGPPGGGGGHGSGSPSQPDADSHFEQLMVSMLEERDRLLDTLRETQETLALTQGKLHEVGHERDSLQRQLNTALPQV

SEQ ID NO: 810333 - protein, 86 aa, Homo sapiens
SHFYNCLYSFADVLVWSNDRVIRWILSIGLKEYANNLIESGVHGALLALDETFDFSALALLLQIPTQNTQVTPNLSVSALIVQLAP

SEQ ID NO: 810334 - protein, 262 aa, Homo sapiens
MVLADLGRKITSALRSLSNATIINEEVLNAMLKEVCTALLEADVNIKLVKQLRENVKSAIDLEEMASGLNKRKMIQHAVFKELVKLVDPGVKAWTPTKGKQNVIMFVGLQGSGKTTTCSKLAYYYQRKGWKTCLICADTFRAGAFDQLKQNATKARIPFYGSYTEMGSWSSLASDGVRENTEMKHVDIMTHRRNTSGQTTNQKEIYGSTQNASTDCLRHINPATIDNGKRWPSIGQDCSKTHRKGVKRYSNTYTHTTEQNCT

SEQ ID NO: 810335 - protein, 138 aa, Homo sapiens
GDATPGFFIHDLTDRMSEQELDSTDGAKVFSKQPGRIQRVARGSGVSTRDVQELLTQYTKFAQMVKKMGGIKGLFKGGDMSKNVSQSQMAKLNQQMAKMMDPRVLHHMGGMAGLQSMMRQFQQGAAGNMKGMMGFNNM

SEQ ID NO: 810336 - protein, 504 aa, Homo sapiens
MVLADLGRKITSALRSLSNATIINEEVLNAMLKEVCTALLEADVNIKLVKQLRENVKSAIDLEEMASGLNKRKMIQHAVFKELVKLVDPGVKAWTPTKGKQNVIMFVGLQGSGKTTTCSKLAYYYQRKGWKTCLICADTFRAGAFDQLKQNATKARIPFYGSYTEMDPVIIASEGVEKFKNENFEIIIVDTSGRHKQEDSLFEEMLQVANAIQPDNIVYVMDASIGQACEAQAKAFKDKVDVASVIVTKLDGHAKGGGALSAVAATKSPIIFIGTGEHIDDFEPFKTQPFISKLLGMGDIEGLIDKVNELKLDDNEALIEKLKHGQFTLRDMYEQFQNIMKMGPFSQILGMIPGFGTDFMSKGNEQESMARLKKLMTIMDSMNDQELDSTDGAKVFSKQPGRIQRVARGSGVSTRDVQELLTQYTKFAQMVKKMGGIKGLFKGGDMSKNVSQSQMAKLNQQMAKMMDPRVLHHMGGMAGLQSMMRQFQQGAAGNMKGMMGFNNM

SEQ ID NO: 810337 - protein, 477 aa, Homo sapiens
MVLADLGRKITSALRSLSNATIINEEVLNAMLKEVCTALLEADVNIKLVKQLRENVKSAIDLEEMASGLNKRKMIQHAVFKELVKLVDPGVKAWTPTKGKQNVIMFVGLQGSGKTTTCSKLAYYYQRKGWKTCLICADTFRAGAFDQLKQNATKARIPFYGSYTEMDPVIIASEGVEKFKNENFEIIIVDTSGRHKQEDSLFEEMLQVANAIQPDNIVYVMDASIGQACEAQAKAFKDKVDVASVIVTKLDGHAKGGGALSAVAATKSPIIFIGTGEHIDDFEPFKTQPFISKLLGMGDIEGLIDKVNELKLDDNEALIEKLKHGQFTLRDMYEQFQNIMKMGPFSQILGMIPGFGTDFMSKGNEQESMARLKKLMTIMDSMNDQELDSTDGAKVFSKQPGRIQRVARGSGVSTRDVQELLTQYTKFAQMVKKMGGIKGLFKDGKERKLRKKSAASIGKFTAEFHVIFKYFQDLCDL

SEQ ID NO: 810338 - protein, 450 aa, Homo sapiens
MVLADLGRKITSALRSLSNATIINEEVLNAMLKEVCTALLEADVNIKLVKQLRENVKSAIDLEEMASGLNKRKMIQHAVFKELVKLVDPGVKAWTPTKGKQNVIMFVGLQGSGKTTTCSKLAYYYQRKGWKTCLICADTFRAGAFDQLKQNATKARIPFYGSYTEMDPVIIASEGVEKFKNENFEIIIVDTSGRHKQEDSLFEEMLQVANAIQPDNIVYVMDASIGQACEAQAKAFKDKVDVASVIVTKLDGHAKGGGALSAVAATKSPIIFIGTGEHIDDFEPFKTQPFISKLLGMGDIEGLIDKVNELKLDDNEALIEKLKHGQFTLRDMYEQFQNIMKMGPFSQILGMIPGFGTDFMSKGNEQESMARLKKLMTIMDSMNDQELDSTDGAKVFSKQPGRIQRVARGSGVSTRDVQELLTQYTKFAQMVKKMGGIKGLFKEKNKLVIS

SEQ ID NO: 810339 - protein, 232 aa, Homo sapiens
MVLADLGRKITSALRSLSNATIINEEVLNAMLKEVCTALLEADVNIKLVKQLRENVKSAIDLEEMASGLNKRKMIQHAVFKELVKLVDPGVKAWTPTKGKQNVIMFVGLQGSGKTTTCSKLAYYYQRKGWKTCLICADTFRAGAFDQLKQNATKARIPFYGSYTEMDPVIIASEGVEKFKNENFEIIIVDTSGRHKQEDSLFEEMLQVANAIQTWITIGLKLKGLPKLGQGF

SEQ ID NO: 810340 - protein, 455 aa, Homo sapiens
MPPLSMKRSAIDLEEMASGLNKRKMIQHAVFKELVKLVDPGVKAWTPTKGKQNVIMFVGLQGSGKTTTCSKLAYYYQRKGWKTCLICADTFRAGAFDQLKQNATKARIPFYGSYTEMDPVIIASEGVEKFKNENFEIIIVDTSGRHKQEDSLFEEMLQVANAIQPDNIVYVMDASIGQACEAQAKAFKDKVDVASVIVTKLDGHAKGGGALSAVAATKSPIIFIGTGEHIDDFEPFKTQPFISKLLGMGDIEGLIDKVNELKLDDNEALIEKLKHGQFTLRDMYEQFQNIMKMGPFSQILGMIPGFGTDFMSKGNEQESMARLKKLMTIMDSMNDQELDSTDGAKVFSKQPGRIQRVARGSGVSTRDVQELLTQYTKFAQMVKKMGGIKGLFKGGDMSKNVSQSQMAKLNQQMAKMMDPRVLHHMGGMAGLQSMMRQFQQGAAGNMKGMMGFNNM

SEQ ID NO: 810341 - protein, 83 aa, Homo sapiens
MESRSVAQAGVQWPDLGSLQPLPPRFKRFFCLSLQSSWDYRHAPPRPANFVFLVETGFCHVSQAGLELLTSSDPPPRPPKVLR

SEQ ID NO: 810342 - protein, 83 aa, Homo sapiens; identical to SEQ ID NO: 810341

SEQ ID NO: 810343 - protein, 83 aa, Homo sapiens; identical to SEQ ID NO: 810341

SEQ ID NO: 810344 - protein, 167 aa, Homo sapiens
MTHSLVCPETVSRVSSVLNRNTRQFGKKHLFDQDEETCWNSDQGPSQWVTLEFPQLIRVSQLQIQFQGGFSSRRGCLEGSQGTQALHKIVDFYPEDNNSLQTFPIPAAEVDRLKVTFEDATDFFGRVVIYHLRVLGEKGTNRDPCRDLHYRAKLGEPRTHPRNLNFP

SEQ ID NO: 810345 - protein, 81 aa, Homo sapiens
KPTRFRVPRFGSKSYSQRNSLAQKATAPETRGKSVSCERPGLRALAVSLILSPKFSGRGLIEATFRTGVGEGVAVLVPSYR

SEQ ID NO: 810346 - protein, 139 aa, Homo sapiens
MTHSLVCPETVSRVSSVLNRNTRQFGKKHLFDQDEETCWNSDQGPSQWVTLEFPQLIRVSQLQIQFQGGFSSRRGCLEGSQGTQALHKIVDFYPEDNNSLQTFPIPAAEVDRLKVTFEDATDFFGRVVIYHLRVLGEKV

SEQ ID NO: 810347 - protein, 143 aa, Homo sapiens
MTHSLVCPETVSRVSSVLNRNTRQFGKKHLFDQDEETCWNSDQGPSQWVTLEFPQLIRVSQLQIQFQGGFSSRRGCLEGSQGTQALHKIVDFYPEDNNSLQDILPLLLGWVVCASGSFGLTQTRMGTLMCDLEHVTSRTPLFL

SEQ ID NO: 810348 - protein, 81 aa, Homo sapiens; identical to SEQ ID NO: 810345

SEQ ID NO: 810349 - protein, 134 aa, Homo sapiens
MVENSPSPLPERAIYGFVLFLSSQFGFILYLVWAFIPESWLNSLGLTYWPQKYWAVALPVYLLIAIVIGYVLLFGINMMSTSPLDSIHTITDNYAKNQQQKKYQEEAIPALRDISISEVNQMFFLAAKELYTKN

SEQ ID NO: 810350 - protein, 134 aa, Homo sapiens; identical to SEQ ID NO: 810349

SEQ ID NO: 810351 - protein, 108 aa, Homo sapiens
MVLYLVWAFIPESWLNSLGLTYWPQKYWAVALPVYLLIAIVIGYVLLFGINMMSTSPLDSIHTITDNYAKNQQQKKYQEEAIPALRDISISEVNQMFFLAAKELYTKN

SEQ ID NO: 810352 - protein, 134 aa, Homo sapiens; identical to SEQ ID NO: 810349

SEQ ID NO: 810353 - protein, 134 aa, Homo sapiens; identical to SEQ ID NO: 810349

SEQ ID NO: 810354 - protein, 246 aa, Homo sapiens
MLVGAARALFPALPSHREATLAELERASIAPEPPSLPYPPPPLLLRGARQPGCLYALEAGARVADGGAGGVLRGGGRTRGGARRREWINGATEHIADADCVPFPQLSKAPGKMVENSPSPLPERAIYGFVLFLSSQFGFILYLVWAFIPESWLNSLGLTYWPQKYWAVALPVYLLIAIVIGYVLLFGINMMSTSPLDSIHTITDNYAKNQQQKKYQEEAIPALRDISISEVNQMFFLAAKELYTKN

SEQ ID NO: 810355 - protein, 134 aa, Homo sapiens; identical to SEQ ID NO: 810349

SEQ ID NO: 810356 - protein, 108 aa, Homo sapiens; identical to SEQ ID NO: 810351

SEQ ID NO: 810357 - protein, 117 aa, Homo sapiens
MVENSPSPLPERAIYGFVLFLSSQFGFILYLVWAFIPESWLNSLGLTYWPQNYVLLFGINMMSTSPLDSIHTITDNYAKNQQQKKYQEEAIPALRDISISEVNQMFFLAAKELYTKN

SEQ ID NO: 810358 - protein, 1221 aa, Homo sapiens
MLPSVPATAVRVSCSGCKKILQKGQTAYQRKGSTQLFCSTLCLTGYTVPPARPPPPLTKKTCSSCSKDILNPKDVISAQFENTTTSKDFCSQSCLSTYELKKKPIVTINTNSISTKCSMCQKNAVIRHEVNYQNVVHKLCSDACFSKFRSANNLTMNCCENCGGYCYSGSGQCHMLQIEGQSKKFCSSSCITAYKQKSAKITPCALCKSLRSSAEMIENTNSLGKTELFCSVNCLSAYRVKMVTSAGVQVQCNSCKTSAIPQYHLAMSDGSIRNFCSYSCVVAFQNLFNKPTGMNSSVVPLSQGQVIVSIPTGSTVSAGGGSTSAVSPTSISSSAAAGLQRLAAQSQHVGFARSVVKLKCQHCNRLFATKPELLDYKGKMFQFCGKNCSDEYKKINNVMAMCEYCKIEKIVKETVRFSGADKSFCSEGCKLLYKHDLAKRWGNHCKMCSYCLQTSPKLVQNNLGGKVEEFCCEECMSKYTVLFYQMAKCDACKRQGKLSESLKWRGEMKHFCNLLCILMFCNQQSVCDPPSQNNAANISMVQAASAGPPSLRKDSTPVIANVVSLASAPAAQPTVNSNSVLQGAVPTVTAKIIGDASTQTDALKLPPSQPPRLLKNKALLCKPITQTKATSCKPHTQNKECQTEDTPSQPQIIVVPVPVPVFVPIPLHLYTQYAPVPFGIPVPMPVPMLIPSSMDSEDKVTESIEDIKEKLPTHPFEADLLEMAEMIAEDEEKKTLSQGESQTSEHELFLDTKIFEKDQGSTYSGDLESEAVSTPHSWEEELNHYALKSNAVQEADSELKQFSKGETEQDLEADFPSDSFDPLNKGQGIQARSRTRRRHRDGFPQPRRRGRKKSIVAVEPRSLIQGAFQGCSVSGMTLKYMYGVNAWKNWVQWKNAKEEQGDLKCGGVEQASSSPRSDPLGSTQDHALSQESSEPGCRVRSIKLKEDILSCTFAELSLGLCQFIQEVRRPNGEKYDPDSILYLCLGIQQYLFENGRIDNIFTEPYSRFMIELTKLLKIWEPTILPNGYMFSRIEEEHLWECKQLGAYSPIVLLNTLLFFNTKYFQLKNVTEHLKLSFAHVMRRTRTLKYSTKMTYLRFFPPLQKQESEPDKLTVGKRKRNEDDEVPVGVEMAENTDNPLRCPVRLYEFYLSKCSESVKQRNDVFYLQPERSCVPNSPMWYSTFPIDPGTLDTMLTRILMVREVHEELAKAKSEDSDVELSD

SEQ ID NO: 810359 - protein, 1575 aa, Homo sapiens
QCGRGPGGREVPPPPRGEPQRFRAGPNMAEREVESGPRKRFEQKSGAVFDEIVENCGGIMDTEMSEDIDHNLTPTLDSMSYGMPNQTGSENSLLDEDDYFLNSGDLAGIPVVGSDNEDEQDFSSKDNLVSSIHTDDSLEVERRVTQHESDNENEIQIQNKLKKDFPKQFDQVSVFKSIRKDFSLVRENSKETFSGKEKNRDLTYEREKRLDKPHKDLDSRLKSSFFDKAANQVEETLHTHLPQTPETNFRDSSYPFANKESIGSELGNSFASNIRIKEEPLDDEYDKAMAPQQGLLDKIKDEPDNAQEYSHGQQQKTQEGELKISAVFSVSGSPLAPQLTTGFQPSLASSGMNKMLPSVPATAVRVSCSGCKKILQKGQTAYQRKGSTQLFCSTLCLTGYTVPPARPPPPLTKKTCSSCSKDILNPKDVISAQFENTTTSKDFCSQSCLSTYELKKKPIVTINTNSISTKCSMCQKNAVIRHEVNYQNVVHKLCSDACFSKFRSANNLTMNCCENCGGYCYSGSGQCHMLQIEGQSKKFCSSSCITAYKQKSAKITPCALCKSLRSSAEMIENTNSLGKTELFCSVNCLSAYRVKMVTSAGVQVQCNSCKTSAIPQYHLAMSDGSIRNFCSYSCVVAFQNLFNKPTGMNSSVVPLSQGQVIVSIPTGSTVSAGGGSTSAVSPTSISSSAAAGLQRLAAQSQHVGFARSVVKLKCQHCNRLFATKPELLDYKGKMFQFCGKNCSDEYKKINNVMAMCEYCKIEKIVKETVRFSGADKSFCSEGCKLLYKHDLAKRWGNHCKMCSYCLQTSPKLVQNNLGGKVEEFCCEECMSKYTVLFYQMAKCDACKRQGKLSESLKWRGEMKHFCNLLCILMFCNQQSVCDPPSQNNAANISMVQAASAGPPSLRKDSTPVIANVVSLASAPAAQPTVNSNSVLQGAVPTVTAKIIGDASTQTDALKLPPSQPPRLLKNKALLCKPITQTKATSCKPHTQNKECQTEDTPSQPQIIVVPVPVPVFVPIPLHLYTQYAPVPFGIPVPMPVPMLIPSSMDSEDKVTESIEDIKEKLPTHPFEADLLEMAEMIAEDEEKKTLSQGESQTSEHELFLDTKIFEKDQGSTYSGDLESEAVSTPHSWEEELNHYALKSNAVQEADSELKQFSKGETEQDLEADFPSDSFDPLNKGQGIQARSRTRRRHRDGFPQPRRRGRKKSIVAVEPRSLIQGAFQGCSVSGMTLKYMYGVNAWKNWVQWKNAKEEQGDLKCGGVEQASSSPRSDPLGSTQDHALSQESSEPGCRVRSIKLKEDILSCTFAELSLGLCQFIQEVRRPNGEKYDPDSILYLCLGIQQYLFENGRIDNIFTEPYSRFMIELTKLLKIWEPTILPNGYMFSRIEEEHLWECKQLGAYSPIVLLNTLLFFNTKYFQLKNVTEHLKLSFAHVMRRTRTLKYSTKMTYLRFFPPLQKQESEPDKLTVGKRKRNEDDEVPVGVEMAENTDNPLRCPVRLYEFYLSKCSESVKQRNDVFYLQPERSCVPNSPMWYSTFPIDPGTLDTMLTRILMVREVHEELAKAKSEDSDVELSD

SEQ ID NO: 810360 - protein, 1602 aa, Homo sapiens
QCGRGPGGREVPPPPRGEPQRFRAGPNMAEREVESGPRKRFEQKSGAVFDEIVENCGGIMDTEMSEDIDHNLTPTLDSMSYGMPNQTGSENSLLDEDDYFLNSGDLAGIPVVGSDNEDEQDFSSKDNLVSSIHTDDSLEVERRVTQHESDNENEIQIQNKLKKDFPKQFDQVSVFKSIRKDFSLVRENSKETFSGKEKNRDLTYEREKRLDKPHKDLDSRLKSSFFDKAANQVEETLHTHLPQTPETNFRDSSYPFANKESIGSELGNSFASNIRIKEEPLDDEYDKAMAPQQGLLDKIKDEPDNAQEYSHGQQQKTQEGELKISAVFSVSGSPLAPQLTTGFQPSLASSGMNKMLPSVPATAVRVSCSGCKKILQKGQTAYQRKGSTQLFCSTLCLTGYTVPPARPPPPLTKKTCSSCSKDILNPKDVISAQFENTTTSKDFCSQSCLSTYELKKKPIVTINTNSISTKCSMCQKNAVIRHEVNYQNVVHKLCSDACFSKFRSANNLTMNCCENCGGYCYSGSGQCHMLQIEGQSKKFCSSSCITAYKQKSAKITPCALCKSLRSSAEMIENTNSLGKTELFCSVNCLSAYRVKMVTSAGVQVQCNSCKTSAIPQYHLAMSDGSIRNFCSYSCVVAFQNLFNKPTGMNSSVVPLSQGQVIVSIPTGSTVSAGGGSTSAVSPTSISSSAAAGLQRLAAQSQHVGFARSVVKLKCQHCNRLFATKPELLDYKGKMFQFCGKNCSDEYKKINNVMAMCEYCKIEKIVKETVRFSGADKSFCSEGCKLLYKHDLAKRWGNHCKMCSYCLQTSPKLVQNNLGGKVEEFCCEECMSKYTVLFYQMAKCDACKRQGKLSESLKWRGEMKHFCNLLCILMFCNQQSVCDPPSQNNAANISMVQAASAGPPSLRKDSTPVIANVVSLASAPAAQPTVNSNSVLQGAVPTVTAKIIGDASTQTDALKLPPSQPPRLLKNKALLCKPITQTKATSCKPHTQNKECQTEDTPSQPQIIVVPVPVPVFVPIPLHLYTQYAPVPFGIPVPMPVPMLIPSSMDSEDKVTESIEDIKEKLPTHPFEADLLEMAEMIAEDEEKKTLSQGESQTSEHELFLDTKIFEKDQGSTYSGDLESEAVSTPHSWEEELNHYALKSNAVQEADSELKQFSKGETEQDLEADFPSDSFDPLNKGQGIQARSRTRRRHRDGFPQPRRRLNKGQGIQARSRTRRRHRDGFPQPRRRGRKKSIVAVEPRSLIQGAFQGCSVSGMTLKYMYGVNAWKNWVQWKNAKEEQGDLKCGGVEQASSSPRSDPLGSTQDHALSQESSEPGCRVRSIKLKEDILSCTFAELSLGLCQFIQEVRRPNGEKYDPDSILYLCLGIQQYLFENGRIDNIFTEPYSRFMIELTKLLKIWEPTILPNGYMFSRIEEEHLWECKQLGAYSPIVLLNTLLFFNTKYFQLKNVTEHLKLSFAHVMRRTRTLKYSTKMTYLRFFPPLQKQESEPDKLTVGKRKRNEDDEVPVGVEMAENTDNPLRCPVRLYEFYLSKCSESVKQRNDVFYLQPERSCVPNSPMWYSTFPIDPGTLDTMLTRILMVREVHEELAKAKSEDSDVELSD

SEQ ID NO: 810361 - protein, 1516 aa, Homo sapiens
MDTEMSEDIDHNLTPTLDSMSYGMPNQTGSENSLLDEDDYFLNSGDLAGIPVVGSDNEDEQDFSSKDNLVSSIHTDDSLEVERRVTQHESDNENEIQIQNKLKKDFPKQFDQVSVFKSIRKDFSLVRENSKETFSGKEKNRDLTYEREKRLDKPHKDLDSRLKSSFFDKAANQVEETLHTHLPQTPETNFRDSSYPFANKESIGSELGNSFASNIRIKEEPLDDEYDKAMAPQQGLLDKIKDEPDNAQEYSHGQQQKTQEGELKISAVFSVSGSPLAPQLTTGFQPSLASSGMNKMLPSVPATAVRVSCSGCKKILQKGQTAYQRKGSTQLFCSTLCLTGYTVPPARPPPPLTKKTCSSCSKDILNPKDVISAQFENTTTSKDFCSQSCLSTYELKKKPIVTINTNSISTKCSMCQKNAVIRHEVNYQNVVHKLCSDACFSKFRSANNLTMNCCENCGGYCYSGSGQCHMLQIEGQSKKFCSSSCITAYKQKSAKITPCALCKSLRSSAEMIENTNSLGKTELFCSVNCLSAYRVKMVTSAGVQVQCNSCKTSAIPQYHLAMSDGSIRNFCSYSCVVAFQNLFNKPTGMNSSVVPLSQGQVIVSIPTGSTVSAGGGSTSAVSPTSISSSAAAGLQRLAAQSQHVGFARSVVKLKCQHCNRLFATKPELLDYKGKMFQFCGKNCSDEYKKINNVMAMCEYCKIEKIVKETVRFSGADKSFCSEGCKLLYKHDLAKRWGNHCKMCSYCLQTSPKLVQNNLGGKVEEFCCEECMSKYTVLFYQMAKCDACKRQGKLSESLKWRGEMKHFCNLLCILMFCNQQSVCDPPSQNNAANISMVQAASAGPPSLRKDSTPVIANVVSLASAPAAQPTVNSNSVLQGAVPTVTAKIIGDASTQTDALKLPPSQPPRLLKNKALLCKPITQTKATSCKPHTQNKECQTEDTPSQPQIIVVPVPVPVFVPIPLHLYTQYAPVPFGIPVPMPVPMLIPSSMDSEDKVTESIEDIKEKLPTHPFEADLLEMAEMIAEDEEKKTLSQGESQTSEHELFLDTKIFEKDQGSTYSGDLESEAVSTPHSWEEELNHYALKSNAVQEADSELKQFSKGETEQDLEADFPSDSFDPLNKGQGIQARSRTRRRHRDGFPQPRRRGRKKSIVAVEPRSLIQGAFQGCSVSGMTLKYMYGVNAWKNWVQWKNAKEEQGDLKCGGVEQASSSPRSDPLGSTQDHALSQESSEPGCRVRSIKLKEDILSCTFAELSLGLCQFIQEVRRPNGEKYDPDSILYLCLGIQQYLFENGRIDNIFTEPYSRFMIELTKLLKIWEPTILPNGYMFSRIEEEHLWECKQLGAYSPIVLLNTLLFFNTKYFQLKNVTEHLKLSFAHVMRRTRTLKYSTKMTYLRFFPPLQKQESEPDKLTVGKRKRNEDDEVPVGVEMAENTDNPLRCPVRLYEFYLSKCSESVKQRNDVFYLQPERSCVPNSPMWYSTFPIDPGTLDTMLTRILMVREVHEELAKAKSEDSDVELSD

SEQ ID NO: 810362 - protein, 1599 aa, Homo sapiens
QCGRGPGGREVPPPPRGEPQRFRAGPNMAEREVESGPRKRFEQKSGAVFDEIVENCGGIMDTEMSEDIDHNLTPTLDSMSYGMPNQTGSENSLLDEDDYFLNSGDLAGIPVVGSDNEDEQDFSSKDNLVSSIHTDDSLEVERRVTQHESDNENEIQIQNKLKKDFPKQFDQVSVFKSIRKDFSLVRENSKETFSGKEKNRDLTYEREKRLDKPHKDLDSRLKSSFFDKAANQVEETLHTHLPQTPETNFRDSSYPFANKESIGSELGNSFASNIRIKEEPLDDEYDKAMAPQQGLLDKIKDEPDNAQEYSHGQQQKTQEGELKISAVFSVSGSPLAPQLTTGFQPSLASSGMNKMLPSVPATAVRVSCSGCKKILQKGQTAYQRKGSTQLFCSTLCLTGYTVPPARPPPPLTKKTCSSCSKDILNPKDVISAQFENTTTSKDFCSQSCLSTYELKKKPIVTINTNSISTKCSMCQKNAVIRHEVNYQNVVHKLCSDACFSKFRSANNLTMNCCENCGGYCYSGSGQCHMLQIEGQSKKFCSSSCITAYKQKSAKITPCALCKSLRSSAEMIENTNSLGKTELFCSVNCLSAYRVKMVTSAGVQVQCNSCKTSAIPQYHLAMSDGSIRNFCSYSCVVAFQNLFNKPTGMNSSVVPLSQGQVIVSIPTGSTVSAGGGSTSAVSPTSISSSAAAGLQRLAAQSQHVGFARSVVKLKCQHCNRLFATKPELLDYKGKMFQFCGKNCSDEYKKINNVMAMCEYCKIEKIVKETVRFSGADKSFCSEGCKLLYKHDLAKRWGNHCKMCSYCLQTSPKLVQNNLGGKVEEFCCEECMSKYTVLFYQMAKCDACKRQGKLSESLKWRGEMKHFCNLLCILMFCNQQSVCDPPSQNNAANISMVQAASAGPPSLRKDSTPVIANVVSLASAPAAQPTVNSNSVLQGAVPTVTAKIIGDASTQTDALKLPPSQPPRLLKNKALLCKPITQTKATSCKPHTQNKECQTEDTPSQPQIIVVPVPVPVFVPIPLHLYTQYAPVPFGIPVPVLSPKGNSYEKIVRNTSKNNKNNNMPVPMLIPSSMDSEDKVTESIEDIKEKLPTHPFEADLLEMAEMIAEDEEKKTLSQGESQTSEHELFLDTKIFEKDQGSTYSGDLESEAVSTPHSWEEELNHYALKSNAVQEADSELKQFSKGETEQDLEADFPSDSFDPLNKGQGIQARSRTRRRHRDGFPQPRRRGRKKSIVAVEPRSLIQGAFQGCSVSGMTLKYMYGVNAWKNWVQWKNAKEEQGDLKCGGVEQASSSPRSDPLGSTQDHALSQESSEPGCRVRSIKLKEDILSCTFAELSLGLCQFIQEVRRPNGEKYDPDSILYLCLGIQQYLFENGRIDNIFTEPYSRFMIELTKLLKIWEPTILPNGYMFSRIEEEHLWECKQLGAYSPIVLLNTLLFFNTKYFQLKNVTEHLKLSFAHVMRRTRTLKYSTKMTYLRFFPPLQKQESEPDKLTVGKRKRNEDDEVPVGVEMAENTDNPLRCPVRLYEFYLSKCSESVKQRNDVFYLQPERSCVPNSPMWYSTFPIDPGTLDTMLTRILMVREVHEELAKAKSEDSDVELSD

SEQ ID NO: 810363 - protein, 1220 aa, Homo sapiens
GVSAWKYCLILSSIIGVKNLVTCGLAIGLCYRHKLIASVLFSYFSSQKGKRNELYHGLCYFFLIFRDILNPKDVISAQFENTTTSKDFCSQSCLSTYELKKKPIVTINTNSISTKCSMCQKNAVIRHEVNYQNVVHKLCSDACFSKFRSANNLTMNCCENCGGYCYSGSGQCHMLQIEGQSKKFCSSSCITAYKQKSAKITPCALCKSLRSSAEMIENTNSLGKTELFCSVNCLSAYRVKMVTSAGVQVQCNSCKTSAIPQYHLAMSDGSIRNFCSYSCVVAFQNLFNKPTGMNSSVVPLSQGQVIVSIPTGSTVSAGGGSTSAVSPTSISSSAAAGLQRLAAQSQHVGFARSVVKLKCQHCNRLFATKPELLDYKGKMFQFCGKNCSDEYKKINNVMAMCEYCKIEKIVKETVRFSGADKSFCSEGCKLLYKHDLAKRWGNHCKMCSYCLQTSPKLVQNNLGGKVEEFCCEECMSKYTVLFYQMAKCDACKRQGKLSESLKWRGEMKHFCNLLCILMFCNQQSVCDPPSQNNAANISMVQAASAGPPSLRKDSTPVIANVVSLASAPAAQPTVNSNSVLQGAVPTVTAKIIGDASTQTDALKLPPSQPPRLLKNKALLCKPITQTKATSCKPHTQNKECQTEDTPSQPQIIVVPVPVPVFVPIPLHLYTQYAPVPFGIPVPMPVPMLIPSSMDSEDKVTESIEDIKEKLPTHPFEADLLEMAEMIAEDEEKKTLSQGESQTSEHELFLDTKIFEKDQGSTYSGDLESEAVSTPHSWEEELNHYALKSNAVQEADSELKQFSKGETEQDLEADFPSDSFDPLNKGQGIQARSRTRRRHRDGFPQPRRRGRKKSIVAVEPRSLIQGAFQGCSVSGMTLKYMYGVNAWKNWVQWKNAKEEQGDLKCGGVEQASSSPRSDPLGSTQDHALSQESSEPGCRVRSIKLKEDILSCTFAELSLGLCQFIQEVRRPNGEKYDPDSILYLCLGIQQYLFENGRIDNIFTEPYSRFMIELTKLLKIWEPTILPNGYMFSRIEEEHLWECKQLGAYSPIVLLNTLLFFNTKYFQLKNVTEHLKLSFAHVMRRTRTLKYSTKMTYLRFFPPLQKQESEPDKLTVGKRKRNEDDEVPVGVEMAENTDNPLRCPVRLYEFYLSKCSESVKQRNDVFYLQPERSCVPNSPMWYSTFPIDPGTLDTMLTRILMVREVHEELAKAKSEDSDVELSD

SEQ ID NO: 810364 - protein, 1575 aa, Homo sapiens; identical to SEQ ID NO: 810359

SEQ ID NO: 810365 - protein, 1575 aa, Homo sapiens; identical to SEQ ID NO: 810359

SEQ ID NO: 810366 - protein, 382 aa, Homo sapiens
MFCKFLEFLQGRKKSIVAVEPRSLIQGAFQGCSVSGMTLKYMYGVNAWKNWVQWKNAKEEQGDLKCGGVEQASSSPRSDPLGSTQDHALSQESSEPGCRVRSIKLKEDILSCTFAELSLGLCQFIQEVRRPNGEKYDPDSILYLCLGIQQYLFENGRIDNIFTEPYSRFMIELTKLLKIWEPTILPNGYMFSRIEEEHLWECKQLGAYSPIVLLNTLLFFNTKYFQLKNVTEHLKLSFAHVMRRTRTLKYSTKMTYLRFFPPLQKQESEPDKLTVGKRKRNEDDEVPVGVEMAENTDNPLRCPVRLYEFYLSKCSESVKQRNDVFYLQPERSCVPNSPMWYSTFPIDPGTLDTMLTRILMVREVHEELAKAKSEDSDVELSD

SEQ ID NO: 810367 - protein, 1575 aa, Homo sapiens; identical to SEQ ID NO: 810359

SEQ ID NO: 810368 - protein, 87 aa, Homo sapiens
LYRYHSILNLSIPYLSILNSESVKQRNDVFYLQPERSCVPNSPMWYSTFPIDPGTLDTMLTRILMVREVHEELAKAKSEDSDVELSD

SEQ ID NO: 810369 - protein, 169 aa, Homo sapiens [sequence omitted]

SEQ ID NO: 810370 - protein, 97 aa, Homo sapiens
MADKVLKEKRKLFIHSMGEGTINGLLDELLQTRVLNQEEMEKVKRENATVMDKTRALIDSVIPKGAQACQICITYICEEDSYLAETLGLSAGPIPGN

SEQ ID NO: 810371 - protein, 110 aa, Homo sapiens
LVDPRGRNSARGVKAMADKVLKEKRKLFIHSMGEGTINGLLDELLQTRVLNQEEMEKVKRENATVMDKTRALIDSVIPKGAQACQICITYICEEDSYLAETLGLSAGKGQ

SEQ ID NO: 810372 - protein, 212 aa, Homo sapiens
LVDPRGRNSARGVKAMADKVLKEKRKLFIHSMGEGTINGLLDELLQTRVLNQEEMEKVKRENATVMDKTRALIDSVIPKGAQACQICITYICEEDSYLAETLGLSAALQAVQDNPAMPTCSSPEGRIKLCFLEDAQRIWKQKLQRCHVQNTIIKWSERYTSGSFEMQWLFLRTNFIERFWRNILLLPLHKGSLYPRIPGLGKELQTGTHKLS

SEQ ID NO: 810373 - protein, 92 aa, Homo sapiens
RVYPTEAPWSLPLVVPSPSQVPQPRLLPAQLLGMRGGFLQHQSPPPSTKSRPWEGVSTVPITLGEIEAEAGCAGKERQEDSWEENPHRERDI

SEQ ID NO: 810374 - protein, 359 aa, Homo sapiens
GIRRPLRAWCFRPLRAAPGLSQSPVAAVMSRQLSRARPATVLGAMEMGRRMDAPTSAAVTRAFLERGHTEIDTAFVYSEGQSETILGGLGLRLGGSDCRVKIDTKAIPLFGNSLKPDSLRFQLETSLKRLQCPRVDLFYLHMPDHSTPVEETLRACHQLHQEGKFMELGLSNYAAWEVAEICTLCKSNGWILPTVYQGMYNAITRQVETELFPCLRHFGLRFYAFNPLAGGLLTGKYKYEDKDGKQPVGRFFGNTWAEMYRNRYWKEHHFEGIALVEKALQAAYGASAPSMTSATLRWMYHHSQLQGAHGDAVILGMSSLEQLEQNLAAAEEGPLEPAVVDAFNQAWHLVAHECPNYFR

SEQ ID NO: 810375 - protein, 132 aa, Homo sapiens
TTTKLAAARRLQALRMVQRLTYRRRLSYNTASNKTRLSRTPGNRIVYLYTKKVGKAPKSACGVCPGRLRGVRAVRPKVLMRLSKTKKHVSRAYGGSMCAKCVRDRIKRAFLIEEQKIVVKVLKAQAQSQKAK

SEQ ID NO: 810376 - protein, 152 aa, Homo sapiens
FDPPLKRPRAFEMTTPKSRPLWPGLFRGRCLQALRMVQRLTYRRRLSYNTASNKTRLSRTPGNRIVYLYTKKVGKAPKSACGVCPGRLRGVRAVRPKVLMRLSKTKKHVSRAYGGSMCAKCVRDRIKRAFLIEEQKIVVKVLKAQAQSQKAK

SEQ ID NO: 810377 - protein, 146 aa, Homo sapiens
MGPAPLRWNPRIRPLWPGLFRGRCLQALRMVQRLTYRRRLSYNTASNKTRLSRTPGNRIVYLYTKKVGKAPKSACGVCPGRLRGVRAVRPKVLMRLSKTKKHVSRAYGGSMCAKCVRDRIKRAFLIEEQKIVVKVLKAQAQSQKAK

SEQ ID NO: 810378 - protein, 111 aa, Homo sapiens
YQIRGRVDTASNKTRLSRTPGNRIVYLYTKKVGKAPKSACGVCPGRLRGVRAVRPKVLMRLSKTKKHVSRAYGGSMCAKCVRDRIKRAFLIEEQKIVVKVLKAQAQSQKAK

SEQ ID NO: 810379 - protein, 111 aa, Homo sapiens; identical to SEQ ID NO: 810378

SEQ ID NO: 810380 - protein, 103 aa, Homo sapiens
SSGDVVCRSRTPGNRIVYLYTKKVGKAPKSACGVCPGRLRGVRAVRPKVLMRLSKTKKHVSRAYGGSMCAKCVRDRIKRAFLIEEQKIVVKVLKAQAQSQKAK

SEQ ID NO: 810381 - protein, 69 aa, Homo sapiens
AAAYYYYVRAVRPKVLMRLSKTKKHVSRAYGGSMCAKCVRDRIKRAFLIEEQKIVVKVLKAQAQSQKAK

SEQ ID NO: 810382 - protein, 287 aa, Homo sapiens
LGVKQLIVGVNKMDSTEPPYSQKRYEEIVKEVSTYIKKIGYNPDTVAFVPISGWNGDNMLEPSANMPWFKGWKVTRKDGNASGTTLLEALDCILPPTRPTDKPLRLPLQDVYKIGGIGTVPVGRVETGVLKPGMVVTFAPVNVTTEVNLSKCTMKLRVKLFRGRCLQALRMVQRLTYRRRLSYNTASNKTRLSRTPGNRIVYLYTKKVGKAPKSACGVCPGRLRGVRAVRPKVLMRLSKTKKHVSRAYGGSMCAKCVRDRIKRAFLIEEQKIVVKVLKAQAQSQKAK

SEQ ID NO: 810383 - protein, 188 aa, Homo sapiens
LRGVRAVRPKVLMRLSKTKKHVSRAYGGSMCAKCVRDRIKRAFLIEEQKIVVKVLKPRGTSFRGRCLQALRMVQRLTYRRRLSYNTASNKTRLSRTPGNRIVYLYTKKVGKAPKSACGVCPGRLRGVRAVRPKVLMRLSKTKKHVSRAYGGSMCAKCVRDRIKRAFLIEEQKIVVKVLKAQAQSQKAK

SEQ ID NO: 810384 - protein, 143 aa, Homo sapiens
STELLDGKRRVGPLSSFRGRCLQALRMVQRLTYRRRLSYNTASNKTRLSRTPGNRIVYLYTKKVGKAPKSACGVCPGRLRGVRAVRPKVLMRLSKTKKHVSRAYGGSMCAKCVRDRIKRAFLIEEQKIVVKVLKAQAQSQKAK

SEQ ID NO: 810385 - protein, 117 aa, Homo sapiens [sequence omitted]

SEQ ID NO: 810386 - protein, 117 aa, Homo sapiens [sequence omitted]

SEQ ID NO: 810387 - protein, 136 aa, Homo sapiens
RVPTRKAFLSRGRCLQALRMVQRLTYRRRLSYNTASNKTRLSRTPGNRIVYLYTKKVGKAPKSACGVCPGRLRGVRAVRPKVLMRLSKTKKHVSRAYGGSMCAKCVRDRIKRAFLIEEQKIVVKVLKAQAQSQKAK

SEQ ID NO: 810388 - protein, 146 aa, Homo sapiens; identical to SEQ ID NO: 810377

SEQ ID NO: 810389 - protein, 152 aa, Homo sapiens; identical to SEQ ID NO: 810376

SEQ ID NO: 810390 - protein, 152 aa, Homo sapiens; identical to SEQ ID NO: 810376

SEQ ID NO: 810391 - protein, 152 aa, Homo sapiens; identical to SEQ ID NO: 810376

SEQ ID NO: 810392 - protein, 152 aa, Homo sapiens; identical to SEQ ID NO: 810376

SEQ ID NO: 810393 - protein, 152 aa, Homo sapiens; identical to SEQ ID NO: 810376

SEQ ID NO: 810394 - protein, 152 aa, Homo sapiens
LEDPRMFTTTYVVVNMRVFHDDVCRRQTCPRRTHLAHMEPPYRRRLSYNTASNKTRLSRTPGNRIVYLYTKKVGKAPKSACGVCPGRLRGVRAVRPKVLMRLSKTKKHVSRAYGGSMCAKCVRDRIKRAFLIEEQKIVVKVLKAQAQSQKAK

SEQ ID NO: 810395 - protein, 152 aa, Homo sapiens; identical to SEQ ID NO: 810376

SEQ ID NO: 810396 - protein, 152 aa, Homo sapiens; identical to SEQ ID NO: 810376

SEQ ID NO: 810397 - protein, 152 aa, Homo sapiens; identical to SEQ ID NO: 810376

SEQ ID NO: 810398 - protein, 152 aa, Homo sapiens; identical to SEQ ID NO: 810376

SEQ ID NO: 810399 - protein, 152 aa, Homo sapiens; identical to SEQ ID NO: 810376

SEQ ID NO: 810400 - protein, 152 aa, Homo sapiens; identical to SEQ ID NO: 810376

SEQ ID NO: 810401 - protein, 152 aa, Homo sapiens; identical to SEQ ID NO: 810376

SEQ ID NO: 810402 - protein, 152 aa, Homo sapiens; identical to SEQ ID NO: 810376

SEQ ID NO: 810403 - protein, 152 aa, Homo sapiens; identical to SEQ ID NO: 810376

SEQ ID NO: 810404 - protein, 152 aa, Homo sapiens; identical to SEQ ID NO: 810376

SEQ ID NO: 810405 - protein, 152 aa, Homo sapiens; identical to SEQ ID NO: 810376

SEQ ID NO: 810406 - protein, 152 aa, Homo sapiens; identical to SEQ ID NO: 810376

SEQ ID NO: 810407 - protein, 152 aa, Homo sapiens; identical to SEQ ID NO: 810376

SEQ ID NO: 810408 - protein, 117 aa, Homo sapiens [sequence omitted]

SEQ ID NO: 810409 - protein, 117 aa, Homo sapiens [sequence omitted]

SEQ ID NO: 810410 - protein, 117 aa, Homo sapiens [sequence omitted]

SEQ ID NO: 810411 - protein, 117 aa, Homo sapiens [sequence omitted]

SEQ ID NO: 810412 - protein, 136 aa, Homo sapiens; identical to SEQ ID NO: 810387

SEQ ID NO: 810413 - protein, 173 aa, Homo sapiens
FDPPLKRPRAFEMTTPKSRPLWPGLFRGRCLQALRMVQRLTYRRRLSYNTASNKTRLSRTPGNRIVYLYTKKVGKAPKSACGVCPGRLRGVRAVRPKVLMRLSKTKKHVSRAYGGSMCAKCVRDRIKRAFLIEEQKIVVKVLKAQAQSPASFHFYYSKKFQLRILLSDSVLVD

SEQ ID NO: 810414 - protein, 112 aa, Homo sapiens
MVQRLTYRRRLSYNTASNKTRLSRTPGNRIVYLYTKKVGKAPKSACGVCPGRLRGVRAVRPKVLMRLSKTKKHVSRAYGGSMCAKCVRDRSSVLSFNRKGGEKGAPPQKGGK

SEQ ID NO: 810415 - protein, 274 aa, Homo sapiens
LGVKQLIVGVNKMDSTEPPYSQKRYEEIVKEVSTYIKKIGYNPDTVAFVPISGWNGDNMLEPSANMPWFKGWKVTRKDGNASGTTLLEALDCILPPTRPTDKPLRLPLQDVYKIGGIGTVPVGRVETGVLKPGMVVTFAPVNVTTEVNLSKCTMKLRVKLFRGRCLQALRMVQRLTYRRRLSYNTASNKTRLSRTPGNRIVYLYTKKVGKAPKSACGVCPGRLRGVRAVRPKVLMRLSKTKKHVSRAYGGSMCAKCVRDRSLLPYRTKNPVKFF

SEQ ID NO: 810416 - protein, 92 aa, Homo sapiens
VVCAQAAPGNRIVYLYTKGCLGTHHMQIRGVRAVRPKVLMRLSKTKKHVSRAYGGSMCAKCVRDRIKRAFLIEEQKIVVKVLKAQAQSQKAK

SEQ ID NO: 810417 - protein, 97 aa, Homo sapiens
LYRVVGRKEESGPTSSFRGRCLQALRMVQRLTYRRRLSYNTASNKTRLSRTPGNRIVYLYTKKVGKAPKSACGVCPGRLRGVRAVRPKVLMRLSACY

SEQ ID NO: 810418 - protein, 92 aa, Homo sapiens
MTLTELETYSPVLGRSTWDSMRISEGQAWENSLREVDGPLLPYSLEQLKGILVPLESELGTDPGRGTAPGPGYEALLNIRVKLEAEIRTYRR

SEQ ID NO: 810419 - protein, 121 aa, Homo sapiens
MSTLFPSLFPRVTETLWFNLDRPCVEETELQQQEQQHQAWLQSIAEKDNNLVPIGKPASEHYDDEEEEDDEDDEDSEEDSEDDEDMQDMDEMNDYNESPDDGEVNEVDMEGNEQDQDQWMI

SEQ ID NO: 810420 - protein, 121 aa, Homo sapiens; identical to SEQ ID NO: 810419

SEQ ID NO: 810421 - protein, 190 aa, Homo sapiens
MSTLFPSLFPRVTETLWFNLDRPCVEETELQQQEQQHQAWLQSIAEKDNNLVPIGKPASEHYDDEEEEDDEDDEDSEEDSEDDEDMQDMDEMNDYNESPDDGEVNEVHLSVLPTCGLYHSHPKQLCPESIKLSHSFMPHVYMWLALPFPPPSPSAWPTQNFQIQFKCCSFSMKSQAETTTLSFRFMKGLC

SEQ ID NO: 810422 - protein, 132 aa, Homo sapiens
MSTLFPSLFPRVTETLWFNLDRPCVEETELQQQEQQHQAWLQSIAEKDNNLVPIGKPASEHYDDEEEEDDEDDEDSEEDSEDDEDMQDMDEMNDYNESPDDGEVNEEDRERADSCQLDPRQTPSTKALNGAE

SEQ ID NO: 810423 - protein, 121 aa, Homo sapiens; identical to SEQ ID NO: 810419

SEQ ID NO: 810424 - protein, 190 aa, Homo sapiens
MSTLFPSLFPRVTETLWFNLDRPCVEETELQQQEQQHQAWLQSIAEKDNNLVPIGKPASEHYDDEEEEDDEDDEDSEEDSEDDEDMQDMDEMNDYNESPDDGEVNEESMGGLGATHRIRNRGVLADTGGPGIRPAKYLVQPHLSQHVAPLMLEPTGTWFCPPRLNAGITRDTWGVYKRKGTPPRVRLEKE

SEQ ID NO: 810425 - protein, 121 aa, Homo sapiens; identical to SEQ ID NO: 810419

SEQ ID NO: 810426 - protein, 121 aa, Homo sapiens; identical to SEQ ID NO: 810419

SEQ ID NO: 810427 - protein, 121 aa, Homo sapiens; identical to SEQ ID NO: 810419

SEQ ID NO: 810428 - protein, 133 aa, Homo sapiens
MSTLFPSLFPRVTETLWFNLDRPCVEETELQQQEQQHQAWLQSIAEKDNNLVPIGKPASEACRAYRLCPAHQHYDDEEEEDDEDDEDSEEDSEDDEDMQDMDEMNDYNESPDDGEVNEVDMEGNEQDQDQWMI

SEQ ID NO: 810429 - protein, 114 aa, Homo sapiens
MSTLFPSLFPRVTETLWFNLDRPCVEETELQQQEQQHQAWLQSIAEKDNNLVPIGKPASEHYDDEEEEDDEDDEDSEEDSEDDEDMQDMDGDSRPAQTTLHPNPQPSALEIPRA

SEQ ID NO: 810430 - protein, 77 aa, Homo sapiens
FLSETRPAFFLLVNCMVIIVMSKERAVALRRWVGLSEPRSLVCQYFLDMRVFTVVPNYAGWESEIQGRAAAGPGSVR

SEQ ID NO: 810431 - protein, 49 aa, Homo sapiens
MPYDQDSFSTLLGFLQASRKYSEFTLKCPICIYVPCQCFAVGFLKQSDQ

SEQ ID NO: 810432 - protein, 1180 aa, Homo sapiens
SWGKGREGVVSPAGLGGALPGDGKFGSPSRLGCSLGEGVQRVAALGMGKEQELLEAARTGHLPAVEKLLSGKRLSSGFGGGGGGGSGGGGGGSGGGGGGLGSSSHPLSSLLSMWRGPNVNCVDSTGYTPLHHAALNGHKDVVEVLLRNDALTNVADSKGCYPLHLAAWKGDAQIVRLLIHQGPSHTRVNEQNNDNETALHCAAQYGHTEVVKVLLEELTDPTMRNNKFETPLDLAALYGRLEVVKMLLNAHPNLLSCNTKKHTPLHLAARNGHKAVVQVLLDAGMDSNYQTEMGSALHEAALFGKTDVVQILLAAGTDVNIKDNHGLTALDTVRELPSQKSQQIAALIEDHMTGKRSTKEVDKTPPPQPPLISSMDSISQKSQGDVEKAVTELIIDFDANAEEEGPYEALYNAISCHSLDSMASGRSSDQDSTNKEAEAAGVKPAGVRPRERPPPPAKPPPDEEEEDHIDKKYFPLTASEVLSMRPRIHGSAAREEDEHPYELLLTAETKKVVLVDGKTKDHRRSSSSRSQDSAEGQDGQVPEQFSGLLHGSSPVCEVGQDPFQLLCTAGQSHPDGSPQQGACHKASMQLEETGVHAPGASQPSALDQSKRVGYLTGLPTTNSRSHPETLTHTASPHPGGAEEGDRSGARSRAPPTSKPKAELKLSRSLSKSDSDLLTCSPTEDATMGSRSESLSNCSIGKKRLEKSPSFASEWDEIEKIMSSIGEGIDFSQERQKISGSRTLEQSVGEWLESIGLQQYESKLLLNGFDDVHFLGSNVMEEQDLRDIGISDPQHRRKLLQAARSLPKVKALGYDGNSPPSVPSWLDSLGLQDYVHSFLSSGYSSIDTVKNLWELELVNVLKVQLLGHRKRIIASLADRPYEEPPQKPPRFSQLRCQDLLSQTSSPLSQNDSCTGRSADLLLPPGDTGRRRHDSLHDPAAPSRAERFRIQEEHREAKLTLRPPSLAAPYAPVQSWQHQPEKLIFESCGYEANYLGSMLIKDLRGTESTQDACAKMRKSTEHMKKIPTIILSITYKGVKFIDASNKNVIAEHEIRNISCAAQDPEDLCTFAYITKDLQTSHHYCHVFSTVDVNLTYEIILTLGQAFEVAYQLALQAQKSRATGASAAEMIETKSSKPVPKPRVGVRKSALEPPDMDQDAQSHASVSWVVDPKPDSKRSLSTN

SEQ ID NO: 810433 - protein, 175 aa, Homo sapiens
MTFTVQEFTGGSRTLEQSVGEWLESIGLQQYESKLLLNGFDDVHFLGSNVMEEQDLRDIGISDPQHRRKLLQAARSLPKVKALGYDGNSPPSVPSWLDSLGLQDYVHSFLSSGYSSIDTVKNLWELELVNVLKVQLLGHRKRIIASLADRPYEEPPQKPPRFSQLRCKDSPDVFH

SEQ ID NO: 810434 - protein, 1180 aa, Homo sapiens; identical to SEQ ID NO: 810432

SEQ ID NO: 810435 - protein, 236 aa, Homo sapiens
LLHRLPNQFNMAAMRWRWWQRLLPWRLLQARGFPQNSAPSLGLGARTYSQGDCSYSRTALYDLLGVPSTATQAQIKAAYYRQCFLYHPDRNSGSAEAAERFTRISQAYVVLGSATLRRKYDRGLLSDEDLRGPGVRPSRTPAPDPGSPRTPPPTSRTHDGSRASPGANRTMFNFDAFYQAHYGEQLERERRLRARREALRKRQEYRSMKGLRWEDTRDTAAIFLIFSIFIIIGFYI

SEQ ID NO: 810436 - protein, 236 aa, Homo sapiens; identical to SEQ ID NO: 810435

SEQ ID NO: 810437 - protein, 236 aa, Homo sapiens; identical to SEQ ID NO: 810435

SEQ ID NO: 810438 - protein, 411 aa, Homo sapiens
MRAHPGGGRCCPEQEEGESAAGGSGAGGDSAIEQGGQGSALAPSPVSGVRREGARGGGRGRGRWKQAGRGGGVCGRGRGRGRGRGRGRGRGRGRGRPPSGGSGLGGDGGGCGGGGSGGGGAPRREPVPFPSGSAGPGPRGPRATESGKRMDCPALPPGWKKEEVIRKSGLSAGKSDVYYFSPSGKKFRSKPQLARYLGNTVDLSSFDFRTGKMMPSKLQKNKQRLRNDPLNQNKGKPDLNTTLPIRQTASIFKQPVTKVTNHPSNKVKSDPQRMNEQPRQLFWEKRLQGLSASDVTEQIIKTMELPKGLQGVGPGSNDETLLSAVASALHTSSAPITGQVSAAVEKNPAVWLNTSQPLCKAFIVTDEDIRKQEERVQQVRKKLEEALMADILSRAADTEEMDIEMDSGDEA

SEQ ID NO: 810439 - protein, 411 aa, Homo sapiens; identical to SEQ ID NO: 810438

SEQ ID NO: 810440 - protein, 481 aa, Homo sapiens
MRAHPGGGRCCPEQEEGESAAGGSGAGGDSAIEQGGQGSALAPSPVSGVRREGARGGGRGRGRWKQAGRGGGVCGRGRGRGRGRGRGRGRGRGRGRPPSGGSGLGGDGGGCGGGGSGGGGAPRREPVPFPSGSAGPGPRGPRATESGKRMDCPALPPGWKKEEVIRKSGLSAGKSDVYYFSPSGKKFRSKPQLARYLGNTVDLSSFDFRTGKMMPSKLQKNKQRLRNDPLNQNKLLLEHSSSCTMACAFKTLLAHTLFALLGMCLPPSPSSGELLLIQDPASLSPSLGSLPCILQAEPILSSIMGKPDLNTTLPIRQTASIFKQPVTKVTNHPSNKVKSDPQRMNEQPRQLFWEKRLQGLSASDVTEQIIKTMELPKGLQGVGPGSNDETLLSAVASALHTSSAPITGQVSAAVEKNPAVWLNTSQPLCKAFIVTDEDIRKQEERVQQVRKKLEEALMADILSRAADTEEMDIEMDSGDEA

SEQ ID NO: 810441 - protein, 360 aa, Homo sapiens
MRAHPGGGRCCPEQEEGESAAGGSGAGGDSAIEQGGRGRGRGRGRPPSGGSGLGGDGGGCGGGGSGGGGAPRREPVPFPSGSAGPGPRGPRATESGKRMDCPALPPGWKKEEVIRKSGLSAGKSDVYYFSPSGKKFRSKPQLARYLGNTVDLSSFDFRTGKMMPSKLQKNKQRLRNDPLNQNKGKPDLNTTLPIRQTASIFKQPVTKVTNHPSNKVKSDPQRMNEQPRQLFWEKRLQGLSASDVTEQIIKTMELPKGLQGVGPGSNDETLLSAVASALHTSSAPITGQVSAAVEKNPAVWLNTSQPLCKAFIVTDEDIRKQEERVQQVRKKLEEALMADILSRAADTEEMDIEMDSGDEA

SEQ ID NO: 810442 - protein, 458 aa, Homo sapiens
MRAHPGGGRCCPEQEEGESAAGGSGAGGDSAIEQGGQGSALAPSPVSGVRREGARGGGRGRGRWKQAGRGGGVCGRGRGRGRGRGRGRGRGRGRGRPPSGGSGLGGDGGGCGGGGSGGGGAPRREPVPFPSGSAGPGPRGPRATESGKRMDCPALPPGWKKEEVIRKSGLSAGKSDVYYFSPSGKKFRSKPQLARYLGNTVDLSSFDFRTGKMMPSKLQKNKQRLRNDPLNQNKGKPDLNTTLPIRQTASIFKQPVTKVTNHPSNKVKSDPQRMNEQPRQCFFLFREPGKQKIFGATLDQHLAIDVSRFEVLNLLYCWSPRDSTGATLFWEKRLQGLSASDVTEQIIKTMELPKGLQGVGPGSNDETLLSAVASALHTSSAPITGQVSAAVEKNPAVWLNTSQPLCKAFIVTDEDIRKQEERVQQVRKKLEEALMADILSRAADTEEMDIEMDSGDEA

SEQ ID NO: 810443 - protein, 411 aa, Homo sapiens; identical to SEQ ID NO: 810438

SEQ ID NO: 810444 - protein, 411 aa, Homo sapiens; identical to SEQ ID NO: 810438

SEQ ID NO: 810445 - protein, 411 aa, Homo sapiens; identical to SEQ ID NO: 810438

SEQ ID NO: 810446 - protein, 409 aa, Homo sapiens
MRAHPGGGRCCPEQEEGESAAGGSGAGGDSAIEQGGQGSALAPSPVSGVRREGARGGGRGRGRWKQAGRGGGVCGRGRGRGRGRGRGRGRGRGRGRPPSGGSGLGGDGGGCGGGGSGGGGAPRREPVPFPSGSAGPGPRGPRATESGKRMDCPALPPGWKKEEVIRKSGLSAGKSDVYYFSPSGKKFRSKPQLARYLGNTVDLSSFDFRTGKMMPSKLQKNKQRLRNDPLNQNKGKPDLNTTLPIRQTASIFKQPVTKVTNHPSNKVKSDPQRMNEQPRQLFWEKRLQGLSASDVTEQIIKTMELPKGLQGVGPGSNDETLLSAVASALHTSSAPITGQVSAAVEKNPAVWLNTSQPLCKAFIVTDEDIRETGKRVQKLGRTGRSPMCESGARGNQRHEVEWAVYKRKL

SEQ ID NO: 810447 - protein, 260 aa, Homo sapiens
GRGPEKAETRWPPIALGGPKRRWPGPRPGQEGRCCARPLYDACARPPRAALRAGRVSGIPRARLRKKRSAGWGGGWMRAHPGGGRCCPEQEEGESAAGGSGAGGDSAIEQGGQGSALAPSPVSGVRREGARGGGRGRGRWKQAGRGGGVCGRGRGRGRGRGRGRGRGRGRGRPPSGGSGLGGDGGGCGGGGSGGGGAPRREPVPFPSGSAGPGPRGPRATEEREEDGLPGPPPRMEEGGSDPKIWAKCWQERCLLLQSKW

SEQ ID NO: 810448 - protein, 302 aa, Homo sapiens
MRAHPGGGRCCPEQEEGESAAGGSGAGGDSAIEQGGQGSALAPSPVSGVRREGARGGGRGRGRWKQAGRGGGVCGRGRGRGRGRGRGRGRGRGRGRPPSGGSGLGGDGGGCGGGGSGGGGAPRREPVPFPSGSAGPGPRGPRATESGKRMDCPALPPGWKKEEVIRKSGLSAGKSDVYYFSPSGKKFRSKPQLARYLGNTVDLSSFDFRTGKMMPSKLQKNKQRLRNDPLNQNKLRWNTHRPAPWHALSRLCLLIRCLLCLECAYPLPLHLVNSYSSKTQLHCLHLWEACPAYSRQNQSFPP

SEQ ID NO: 810449 - protein, 241 aa, Homo sapiens
MRAHPGGGRCCPEQEEGESAAGGSGAGGDSAIEQGGQGSALAPSPVSGVRREGARGGGRGRGRWKQAGRGGGVCGRGRGRGRGRGRGRGRGRGRGRPPSGGSGLGGDGGGCGGGGSGGGGAPRREPVPFPSGSAGPGPRGPRATESGKRMDCPALPPGWKKEEVIRKSGLSAGKSDVYYFSPSGKKFRSKPQLARYLGNTVDLSSFDFRTGKMMPSKLQKNKQRLRNDPLNQNKFVCTFLL

SEQ ID NO: 810450 - protein, 317 aa, Homo sapiens
PEFPGWRSGALSSRERPEQPSAQGCPSRAGGLPGLPAAAPCAPGGPGMLRQLLLAALCLAGPPAPARACQLPSEWRPLSEGCRAELAETIVYARVLALHPEAPGLYNHLPWQYHAGQGGLFYSAEVEMLCDQAWGSMLEVPAGSRLNLTGLGYFSCHSHTVVQDYSYFFFLRMDENYNLLPHGVNFQDAIFPDTQENRRMFSSLFQFSNCSQGQQLATFSSDWEIQEDSRLMCSSVQKALFEEEDHVKKLQQKVATLEKRNRQLRERVKKVKRSLRQARKKGRHLELANQKLSEKLAAGALPHINARGPVRPPYLRG

SEQ ID NO: 810451 - protein, 317 aa, Homo sapiens; identical to SEQ ID NO: 810450

SEQ ID NO: 810452 - protein, 1055 aa, Homo sapiens
QDADVAETPHPMFTKYGNSLLEEARGEIRNLENVIQSQRGQIEELEHLAEILKTQLRRKENEIELSLLQLREQQATDQRSNIRDNVEMIKLHKQLVEKSNALSAMEGKFIQLQEKQRTLKISHDALMANGDELNMQLKEQRLKCCSLEKQLHSMKFSERRIEELQDRINDLEKERELLKENYDKLYDSAFSAAHEEQWKLKEQQLKVQIAQLETALKSDLTDKTEILDRLKTERDQNEKLVQENRELQLQYLEQKQQLDELKKRIKLYNQENDINADELSEALLLIKAQKEQKNGDLSFLVKVDSEINKDLERSMRELQATHAETVQELEKTRNMLIMQHKINKDYQMEVEAVTRKMENLQQDYELKVEQYVHLLDIRAARIHKLEAQLKDIAYGTKQYKFKPEIMPDDSVDEFDETIHLERGENLFEIHINKVTFSSEVLQASGDKEPVTFCTYAFYDFELQTTPVVRGLHPEYNFTSQYLVHVNDLFLQYIQKNTITLEVHQAYSTEYETIAACQLKFHEILEKSGRIFCTASLIGTKGDIPNFGTVEYWFRLRVPMDQAIRLYRERAKALGYITSNFKGPEHMQSLSQQAPKTAQLSSTDSTDGNLNELHITIRCCNHLQSRASHLQPHPYVVYKFFDFADHDTAIIPSSNDPQFDDHMYFPVPMNMDLDRYLKSESLSFYVFDDSDTQENIYIGKVNVPLISLAHDRCISGIFELTDHQKHPAGTIHVILKWKFAYLPPSGSITTEDLGNFIRSEEPEVVQRLPPASSVSTLVLAPRPKPRQRLTPVDKKVSFVDIMPHQSDVSQEGSVDEVKENTEKMQQGKDDVSLLSEGQLAEQSLASSEDETEITEDLEPEVEEDMSASDSDDCIIPGPISKNIKQPSEKIRIEIIALSLNDSQVTMDDTIQRLFVECRFYSLPAEETPVSLPKPKSGQWVYYNYSNVIYVDKENNKAKRDILKAILQKQEMPNRSLRFTVVSDPPEDEQDLECEDIGVAHVDLADMFQEGRDLIEQNIDVFDARADGEGIGKLRVTVEALHALQSVYKQYRDDLEA

SEQ ID NO: 810453 - protein, 1089 aa, Homo sapiens
QDADVAETPHPMFTKYGNSLLEEARGEIRNLENVIQSQRGQIEELEHLAEILKTQLRRKENEIELSLLQLREQQATDQRSNIRDNVEMIKLHKQLVEKSNALSAMEGKFIQLQEKQRTLKISHDALMANGDELNMQLKEQRLKCCSLEKQLHSMKFSERRIEELQDRINDLEKERELLKENYDKLYDSAFSAAHEEQWKLKEQQLKVQIAQLETALKSDLTDKTEILDRLKTERDQNEKLVQENRELQLQYLEQKQQLDELKKRIKLYNQENDINADELSEALLLIKAQKEQKNGDLSFLVKVDSEINKDLERSMRELQATHAETVQELEKTRNMLIMQHKINKDYQMEVEAVTRKMENLQQDYELKVEQYVHLLDIRAARIHKLEAQLKDIAYGTKQYKFKPEIMPDDSVDEFDETIHLERGENLFEIHINKVTFSSEVLQASGDKEPVTFCTYAFYDFELQTTPVVRGLHPEYNFTSQYLVHVNDLFLQYIQKNTITLEVHQAYSTEYETIAACQLKFHEILEKSGRIFCTASLIGTKGDIPNFGTVEYWFRLRVPMDQAIRLYRERAKALGYITSNFKGPEHMQSLSQQAPKTAQLSSTDSTDGNLNELHITIRCCNHLQSRASHLQPHPYVVYKFFDFADHDTAIIPSSNDPQFDDHMYFPVPMNMDLDRYLKSESLSFYVFDDSDTQENIYIGKVNVPLISLAHDRCISGIFELTDHQKHPAGTIHVILKWKFAYLPPSGSITTEDLGNFIRSEEPEVVQRLPPASSVSTLVLAPRPKPRQRLTPVDKKVSFVDIMPHQSDETSPPPEDRKEISPEVEHIPEIEINMLTVPHVPKVSQEGSVDEVKENTEKMQQGKDDVSLLSEGQLAEQSLASSEDETEITEDLEPEVEEDMSASDSDDCIIPGPISKNIKQPSEKIRIEIIALSLNDSQVTMDDTIQRLFVECRFYSLPAEETPVSLPKPKSGQWVYYNYSNVIYVDKENNKAKRDILKAILQKQEMPNRSLRFTVVSDPPEDEQDLECEDIGVAHVDLADMFQEGRDLIEQNIDVFDARADGEGIGKLRVTVEALHALQSVYKQYRDDLEA

SEQ ID NO: 810454 - protein, 394 aa, Homo sapiens
QDADVAETPHPMFTKYGNSLLEEARGEIRNLENVIQSQRGQIEELEHLAEILKTQLRRKENEIELSLLQLREQQATDQRSNIRDNVEMIKLHKQLVEKSNALSAMEGKFIQLQEKQRTLKISHDALMANGDELNMQLKEQRLKCCSLEKQLHSMKFSERRIEELQDRINDLEKERELLKENYDKLYDSAFSAAHEEQWKLKEQQLKVQIAQLETALKSDLTDKTEILDRLKTERDQNEKLVQENRELQLQYLEQKQQLDELKKRIKLYNQENDINADELSEALLLIKAQKEQKNGDLSFLVKVDSEINKDLERSMRELQATHAETVQELEKTRNMLIMQHKINKDYQMEVEAVTRKMENLQQDYELKVEQYVHLLDIRAARIHKLEEAVSLGSI

SEQ ID NO: 810455 - protein, 894 aa, Homo sapiens
MTAIKHALQRDIFTPNDERLLSIVNVCKAGKKKKNCFLCATVTTERPVQVKVVKVKKSDKGDFYKRQIAWALRDLAVVDAKDAIKENPEFDLHFEKIYKWVASSTAEKNAFISCIWKLNQRYLRKKIDFVNVSSQLLEESVPSGENQSVTGGDEEVVDEYQELNAREEQDIEIMMEGCEYAISNAEAFAEKLSRELQVLDGANIQSIMASEKQVNILMKLLDEALKEVDQIELKLSSYEEMLQSVKEQMDQISESNHLIHLSNTNNVKLLSEIEFLVNHMDLAKGHIKALQEGDLASSRGIEACTNAADALLQCMNVALRPGHDLLLAVKQQQQRFSDLRELFARRLASHLNNVFVQQGHDQSSTLAQHSVELTLPNHHPFHRDLLRYAKLMEWLKSTDYGKYEGLTKNYMDYLSRLYEREIKDFFEVAKIKMTGTTKESKKFATLPRKESAVKQETESLHGSSGKLTGSTSSLNKLSVQSSGNRRSQSSSLLDMGNMSASDLDVADRTKFDKIFEQVLSELEPLCLAEQDFISKFFKLQQHQSMPGTMAEAEDLDGGTLSRQHNCGTPLPVSSEKDMIRQMMIKIFRCIEPELNNLIALGDKIDSFNSLYMLVKMSHHVWTAQNVDPASFLSTTLGNVLVTVKRNFDKCISNQIRQMEEVKISKKSKVGILPFVAEFEEFAGLAESIFKNAERRGDLDKAYTKLIRGVFVNVEKVANESQKTPRDVVMMENFHHIFATLSRLKISCLEAEKKEAKQKYTDHLQSYVIYSLGQPLEKLNHFFEGVEARVAQGIREEEVSYQLAFNKQELRKVIKEYPGKEVKKGLDNLYKKVDKHLCEEENLLQVVWHSMQDEFIRQYKHFEGLIARCYPGSGVTMEFTIQDILDYCSSIAQSH

SEQ ID NO: 810456 - protein, 879 aa, Homo sapiens
MTAIKHALQRDIFTPNDERLLSIVNVCKAGKKKKNCFLCATVTTERPVQVKVVKVKKSDKGDFYKRQIAWALRDLAVVDAKDAIKENPEFDLHFEKIYKWVASSTAEKNAFISCIWKLNQRYLRKKIDFVNVSSQLLEESVPSGENQSVTGGDEEVVDEYQELNAREEQDIEIMMEGCEYAISNAEAFAEKLSRELQVLDGANIQSIMASEKQVNILMKLLDEALKEVDQIELKLSSYEEMLQSVKEQMDQISESNHLIHLSNTNNVKLLSEIEFLVNHMDLAKGHIKALQEGDLASSRGIEACTNAADALLQCMNVALRPGHDLLLAVKQQQQRFSDLRELFARRLASHLNNVFVQQGHDQSSTLAQHSVELTLPNHHPFHRDLLRYAKLMEWLKSTDYGKYEGLTKNYMDYLSRLYEREIKDFFEVAKIKMTGTTKESKKFGLHGSSGKLTGSTSSLNKLSVQSSGNRRSQSSSLLDMGNMSASDLDVADRTKFDKIFEQVLSELEPLCLAEQDFISKFFKLQQHQSMPGTMAEAEDLDGGTLSRQHNCGTPLPVSSEKDMIRQMMIKIFRCIEPELNNLIALGDKIDSFNSLYMLVKMSHHVWTAQNVDPASFLSTTLGNVLVTVKRNFDKCISNQIRQMEEVKISKKSKVGILPFVAEFEEFAGLAESIFKNAERRGDLDKAYTKLIRGVFVNVEKVANESQKTPRDVVMMENFHHIFATLSRLKISCLEAEKKEAKQKYTDHLQSYVIYSLGQPLEKLNHFFEGVEARVAQGIREEEVSYQLAFNKQELRKVIKEYPGKEVKKGLDNLYKKVDKHLCEEENLLQVVWHSMQDEFIRQYKHFEGLIARCYPGSGVTMEFTIQDILDYCSSIAQSH

SEQ ID NO: 810457 - protein, 894 aa, Homo sapiens; identical to SEQ ID NO: 810455

SEQ ID NO: 810458 - protein, 897 aa, Homo sapiens
MTAIKHALQRDIFTPNDERLLSIVNVCKAGKKKKNCFLCATVTTERPVQVKVVKVKKSDKGDFYKRQIAWALRDLAVVDAKDAIKENPEFDLHFEKIYKWVASSTAEKNAFISCIWKLNQRYLRKKIDFVNVSSQLLEESVPSGENQSVTGGDEEVVDEYQELNAREEQDIEIMMEGCEYAISNAEAFAEKLSRELQVLDGANIQSIMASEKQVNILMKLLDEALKEVDQIELKLSSYEEMLQSVKEQMDQISESNHLIHLSNTNNVKLLSEIEFLVNHMDLAKGHIKALQEGDLASSRGIEACTNAADALLQCMNVALRPGHDLLLAVKQQQQRFSDLRELFARRLASHLNNVFVQQFTQALLQLYNRSYFLSVPGHDQSSTLAQHSVELTLPNHHPFHRDLLRYAKLMEWLKSTDYGKYEGLTKNYMDYLSRLYEREIKDFFEVAKIKMTGTTKESKKFGLHGSSGKLTGSTSSLNKLSVQSSGNRRSQSSSLLDMGNMSASDLDVADRTKFDKIFEQVLSELEPLCLAEQDFISKFFKLQQHQSMPGTMAEAEDLDGGTLSRQHNCGTPLPVSSEKDMIRQMMIKIFRCIEPELNNLIALGDKIDSFNSLYMLVKMSHHVWTAQNVDPASFLSTTLGNVLVTVKRNFDKCISNQIRQMEEVKISKKSKVGILPFVAEFEEFAGLAESIFKNAERRGDLDKAYTKLIRGVFVNVEKVANESQKTPRDVVMMENFHHIFATLSRLKISCLEAEKKEAKQKYTDHLQSYVIYSLGQPLEKLNHFFEGVEARVAQGIREEEVSYQLAFNKQELRKVIKEYPGKEVKKGLDNLYKKVDKHLCEEENLLQVVWHSMQDEFIRQYKHFEGLIARCYPGSGVTMEFTIQDILDYCSSIAQSH

SEQ ID NO: 810459 - protein, 317 aa, Homo sapiens
MIRQMMIKIFRCIEPELNNLIALGDKIDSFNSLYMLVKMSHHVWTAQNVDPASFLSTTLGNVLVTVKRNFDKCISNQIRQMEEVKISKKSKVGILPFVAEFEEFAGLAESIFKNAERRGDLDKAYTKLIRGVFVNVEKVANESQKTPRDVVMMENFHHIFATLSRLKISCLEAEKKEAKQKYTDHLQSYVIYSLGQPLEKLNHFFEGVEARVAQGIREEEVSYQLAFNKQELRKVIKEYPGKEVKKGLDNLYKKVDKHLCEEENLLQVVWHSMQDEFIRQYKHFEGLIARCYPGSGVTMEFTIQDILDYCSSIAQSH

SEQ ID NO: 810460 - protein, 879 aa, Homo sapiens; identical to SEQ ID NO: 810456

SEQ ID NO: 810461 - protein, 415 aa, Homo sapiens
MTAIKHALQRDIFTPNDERLLSIVNVCKAGKKKKNCFLCATVTTERPVQVKVVKVKKSDKGDFYKRQIAWALRDLAVVDAKDAIKENPEFDLHFEKIYKWVASSTAEKNAFISCIWKLNQRYLRKKIDFVNVSSQLLEESVPSGENQSVTGGDEEVVDEYQELNAREEQDIEIMMEGCEYAISNAEAFAEKLSRELQVLDGANIQSIMASEKQVNILMKLLDEALKEVDQIELKLSSYEEMLQSVKEQMDQISESNHLIHLSNTNNVKLLSEIEFLVNHMDLAKGHIKALQEGDLASSRGIEACTNAADALLQCMNVALRPGHDLLLAVKQQQQRFSDLRELFARRLASHLNNVFVQQGHDQSSTLAQHSVELTLPNHHPFHRDLLRYAKLMEWLKSTDYGKYEGLTKNSDLEIS

SEQ ID NO: 810462 - protein, 368 aa, Homo sapiens
MTAIKHALQRDIFTPNDERLLSIVNVCKAGKKKKNCFLCATVTTERPVQVKVVKVKKSDKGDFYKRQIAWALRDLAVVDAKDAIKENPEFDLHFEKIYKWVASSTAEKNAFISCIWKLNQRYLRKKIDFVNVSSQLLEESVPSGENQSVTGGDEEVVDEYQELNAREEQDIEIMMEGCEYAISNAEAFAEKLSRELQVLDGANIQSIMASEKQVNILMKLLDEALKEVDQIELKLSSYEEMLQSVKEQMDQISESNHLIHLSNTNNVKLLSEIEFLVNHMDLAKGHIKALQEGDLASSRGIEACTNAADALLQCMNVALRPGHDLLLAVKQQQQRFSDLRELFARRLASHLNNVFVQQRPHDSIYFCL

SEQ ID NO: 810463 - protein, 411 aa, Homo sapiens
MTAIKHALQRDIFTPNDERLLSIVNVCKAGKKKKNCFLCATVTTERPVQVKVVKVKKSDKGDFYKRQIAWALRDLAVVDAKDAIKENPEFDLHFEKIYKWVASSTAEKNAFISCIWKLNQRYLRKKIDFVNVSSQLLEESVPSGENQSVTGGDEEVVDEYQELNAREEQDIEIMMEGCEYAISNAEAFAEKLSRELQVLDGANIQSIMASEKQVNILMKLLDEALKEVDQIELKLSSYEEMLQSVKEQMDQISESNHLIHLSNTNNVKLLSEIEFLVNHMDLAKGHIKALQEGDLASSRGIEACTNAADALLQCMNVALRPGHDLLLAVKQQQQRFSDLRELFARRLASHLNNVFVQQGHDQSSTLAQHSVELTLPNHHPFHRDLLRYAKLMEWLKSTDYGKYEGLTKVWI

SEQ ID NO: 810464 - protein, 134 aa, Homo sapiens
CNLSSYRHLGSCGGLLGTGLLKGTMSGRLWSKAIFAGYKRGLRNQREHTALLKIEGVYARDETEFYLGKRCAYVYKAKNNTVTPGGKPNKTRVIWGKVTRAHGNSGMVRAKFRSNLPAKAIGHRFRVMLYPSRI

SEQ ID NO: 810465 - protein, 110 aa, Homo sapiens
MSGRLWSKAIFAGYKRGLRNQREHTALLKIEGVYARDETEFYLGKRCAYVYKAKNNTVTPGGKPNKTRVIWGKVTRAHGNSGMVRAKFRSNLPAKAIGHRFRVMLYPSRI

SEQ ID NO: 810466 - protein, 125 aa, Homo sapiens
VGAMAWTTAFQTEFLLEVPFPAKAIFAGYKRGLRNQREHTALLKIEGVYARDETEFYLGKRCAYVYKAKNNTVTPGGKPNKTRVIWGKVTRAHGNSGMVRAKFRSNLPAKAIGHRFRVMLYPSRI

SEQ ID NO: 810467 - protein, 691 aa, Homo sapiens
MELRSTAAPRAEGYSNVGFQNEENFLENENTSGNNSIRSRAVQSREHTNTKQDEEQVTVEQDSPRNREHMEDDDEEMQQKGCLERRYDTVCGFCRKHKTTLRHIIWGILLAGYLVMVISACVLNFHRALPLFVITVAAIFFVVWDHLMAKYEHRIDEMLSPGRRLLNSHWFWLKWVIWSSLVLAVIFWLAFDTAKLGQQQLVSFGGLIMYIVLLFLFSKYPTRVYWRPVLWGIGLQFLLGLLILRTDPGFIAFDWLGRQVQTFLEYTDAGASFVFGEKYKDHFFAFKVLPIVVFFSTVMSMLYYLGLMQWIIRKVGWIMLVTTGSSPIESVVASGNIFVGQTESPLLVRPYLPYITKSELHAIMTAGFSTIAGSVLGAYISFGVPSSHLLTASVMSAPASLAAAKLFWPETEKPKITLKNAMKMESGDSGNLLEAATQGASSSISLVANIAVNLIAFLALLSFMNSALSWFGNMFDYPQLSFELICSYIFMPFSFMMGVEWQDSFMVARLIGYKTFFNEFVAYEHLSKWIHLRKEGGPKFVNGVQQYISIRSEIIATYALCGFANIGSLGIVIGGLTSMAPSRKRDIASGAVRALIAGTVACFMTACIAGILSSTPVDINCHHVLENAFNSTFPGNTTKVIACCQSLLSSTVAKGPGEVIPGGNHSLYSLKGCCTLLNPSTFNCNGISNTF

SEQ ID NO: 810468 - protein, 750 aa, Homo sapiens
MELRSTAAPRAEGYSNVGFQNEENFLENENTSGNNSIRSRAVQSREHTNTKQRIKGHIGYDRRQVLRFDIILLRAHSNCSTSIYFLPHQLLYHWLQEPGLLFETLLETGDKDEEQVTVEQDSPRNREHMEDDDEEMQQKGCLERRYDTVCGFCRKHKTTLRHIIWGILLAGYLVMVISACVLNFHRALPLFVITVAAIFFVVWDHLMAKYEHRIDEMLSPGRRLLNSHWFWLKWVIWSSLVLAVIFWLAFDTAKLGQQQLVSFGGLIMYIVLLFLFSKYPTRVYWRPVLWGIGLQFLLGLLILRTDPGFIAFDWLGRQVQTFLEYTDAGASFVFGEKYKDHFFAFKVLPIVVFFSTVMSMLYYLGLMQWIIRKVGWIMLVTTGSSPIESVVASGNIFVGQTESPLLVRPYLPYITKSELHAIMTAGFSTIAGSVLGAYISFGVPSSHLLTASVMSAPASLAAAKLFWPETEKPKITLKNAMKMESGDSGNLLEAATQGASSSISLVANIAVNLIAFLALLSFMNSALSWFGNMFDYPQLSFELICSYIFMPFSFMMGVEWQDSFMVARLIGYKTFFNEFVAYEHLSKWIHLRKEGGPKFVNGVQQYISIRSEIIATYALCGFANIGSLGIVIGGLTSMAPSRKRDIASGAVRALIAGTVACFMTACIAGILSSTPVDINCHHVLENAFNSTFPGNTTKVIACCQSLLSSTVAKGPGEVIPGGNHSLYSLKGCCTLLNPSTFNCNGISNTF

SEQ ID NO: 810469 - protein, 660 aa, Homo sapiens
MDDWKPSPLIKPFGARKKRSWYLTWKYKLTNQRALRRFCQTGAVLFLLVTVIVNIKLILDTRRAISEANEDPEPEQDYDEALGRLEPPRRRGSGPRRVLDVEVYSSRSKVYVAVDGTTVLEDEAREQGRGIHVIVLNQATGHVMAKRVFDTYSPHEDEAMVLFLNMVAPGRVLICTVKDEGSFHLKDTAKALLRSLGSQAGPALGWRDTWAFVGRKGGPVFGEKHSKSPALSSWGDPVLLKTDVPLSSAEEAECHWADTELNRRRRRFCSKVEGYGSVCSCKDPTPIEFSPDPLPDNKVLNVPVAVIAGNRPNYLYRMLRSLLSAQGVSPQMITVFIDGYYEEPMDVVALFGLRGIQHTPISIKNARVSQHYKASLTATFNLFPEAKFAVVLEEDLDIAVDFFSFLSQSIHLLEEDDSLYCISAWNDQGYEHTAEDPALLYRVETMPGLGWVLRRSLYKEELEPKWPTPEKLWDWDMWMRMPEQRRGRECIIPDVSRSYHFGIVGLNMNGYFHEAYFKKHKFNTVPGVQLRNVDSLKKEAYEVEVHRLLSEAEVLDHSKNPCEDSFLPDTEGHTYVAFIRMEKDDDFTTWTQLAKCLHIWDLDVRGNHRGLWRLFRKKNHFLVVGVPASPYSVKKPPSVTPIFLEPPPKEEGAPGAPEQT

SEQ ID NO: 810470 - protein, 156 aa, Homo sapiens
MDDWKPSPLIKPFGARKKRSWYLTWKYKLTNQRALRRFCQTGAVLFLLVTVIVNIKLILDTRRAISEANEDPEPEQDYDEALGRLEPPRRRGSGPRRVLDVEVYSSRSKVYVAVDGTTVSGPGSGVQSLYSAQGMVHWQQGLLPKWELQLCQFLAV

SEQ ID NO: 810471 - protein, 660 aa, Homo sapiens; identical to SEQ ID NO: 810469

SEQ ID NO: 810472 - protein, 660 aa, Homo sapiens; identical to SEQ ID NO: 810469

SEQ ID NO: 810473 - protein, 687 aa, Homo sapiens
MDDWKPSPLIKPFGARKKRSWYLTWKYKLTNQRALRRFCQTGAVLFLLVTVIVNIKLILDTRRAISEANEDPEPEQDYDEALGRLEPPRRRGSGPRRVLDVEVYSSRSKVYVAVDGTTVLEDEAREQGRGIHVIVLNQATGHVMAKRVFDTYSPHEDEAMVLFLNMVAPGRVLICTVKDEGSFHLKDTAKALLRSLGSQAGPALGWRDTWAFVGRKGGPVFGEKHSKSPALSSWGDPVLLKTDVPLSSAEEAECHWADTELNRRRRRFCSKVEGYGSVCSCKDPTPIEFSPDPLPDNKVLNVPVAVIAGNRPNYLYRMLRSLLSAQGVSPQMITVFIDGYYEEPMDVVALFGLRGIQHTPISIKNARVSQHYKASLTATFNLFPEAKFAVVLEEDLDIAVDFFSFLSQSIHLLEEDDSLYCISAWNDQVGWNDQGLAGEFMRPQLIPPTMAPCPQGYEHTAEDPALLYRVETMPGLGWVLRRSLYKEELEPKWPTPEKLWDWDMWMRMPEQRRGRECIIPDVSRSYHFGIVGLNMNGYFHEAYFKKHKFNTVPGVQLRNVDSLKKEAYEVEVHRLLSEAEVLDHSKNPCEDSFLPDTEGHTYVAFIRMEKDDDFTTWTQLAKCLHIWDLDVRGNHRGLWRLFRKKNHFLVVGVPASPYSVKKPPSVTPIFLEPPPKEEGAPGAPEQT

SEQ ID NO: 810474 - protein, 732 aa, Homo sapiens
MDDWKPSPLIKPFGARKKRSWYLTWKYKLTNQRALRRFCQTGAVLFLLVTVIVNIKLILDTRRAISEANEDPEPEQDYDEALGRLEPPRRRGSGPRRVLDVEVYSSRSKVYVAVDGTTVLEDEAREQGRGIHVIVLNQATGHVMAKRVFDTYSPHEDEAMVLFLNMVAPGRVLICTVKDEGSFHLKDTAKALLRSLGSQAGPALGWRDTWAFVGRKGGPVFGEKHSKSPALSSWGDPVLLKTDVPLSSAEEAECHWADTELNRRRRRFCSKVEGYGSVCSCKDPTPIEFSPDPLPDNKVLNVPVAVIAGNRPNYLYRKAWEWAIPSTEQEGASGHLPPGGTLEVGRKAIDSETHSPLWVSIGTLGPAVNTGEPELRGDEVTLTIPGLPRMLRSLLSAQGVSPQMITVFIDGYYEEPMDVVALFGLRGIQHTPISIKNARVSQHYKASLTATFNLFPEAKFAVVLEEDLDIAVDFFSFLSQSIHLLEEDDSLYCISAWNDQGYEHTAEDPALLYRVETMPGLGWVLRRSLYKEELEPKWPTPEKLWDWDMWMRMPEQRRGRECIIPDVSRSYHFGIVGLNMNGYFHEAYFKKHKFNTVPGVQLRNVDSLKKEAYEVEVHRLLSEAEVLDHSKNPCEDSFLPDTEGHTYVAFIRMEKDDDFTTWTQLAKCLHIWDLDVRGNHRGLWRLFRKKNHFLVVGVPASPYSVKKPPSVTPIFLEPPPKEEGAPGAPEQT

SEQ ID NO: 810475 - protein, 688 aa, Homo sapiens
MDDWKPSPLIKPFGARKKRSWYLTWKYKLTNQRALRRFCQTGAVLFLLVTVIVNIKLILDTRRAISEANEDPEPEQDYDEALGRLEPPRRRGSGPRRVLDVEVYSSRSKVYVAVDGTTVLEDEAREQGRGIHVIVLNQATGHVMAKRVFDTYSPHEDEAMVLFLNMVAPGRVLICTVKDEGSFHLKDTAKALLRSLGSQAGPALGWRDTWAFVGRKGGPVFGEKHSKSPALSSWGDPVLLKTDVPLSSAEEAECHWADTELNRRRRRFCSKVEGYGSVCSCKDPTPIEFSPDPLPDNKVLNVPVAVIAGNRPNYLYRMLRSLLSAQGVSPQMITVFIDGYYEEPMDVVALFGLRGIQHTPISIKNARVSQHYKASLTATFNLFPEAKFAVVLEEDLDIAVDFFSFLSQSIHLLEEDDSLYCISAWNDQGYEHTAEDPALLYRVETMPGLGWVLRRSLYKEELEPKWPTPEKVTVRVGCGGWSPLPTRNILTFIVVHVCQLWDWDMWMRMPEQRRGRECIIPDVSRSYHFGIVGLNMNGYFHEAYFKKHKFNTVPGVQLRNVDSLKKEAYEVEVHRLLSEAEVLDHSKNPCEDSFLPDTEGHTYVAFIRMEKDDDFTTWTQLAKCLHIWDLDVRGNHRGLWRLFRKKNHFLVVGVPASPYSVKKPPSVTPIFLEPPPKEEGAPGAPEQT

SEQ ID NO: 810476 - protein, 790 aa, Homo sapiens
MDDWKPSPLIKPFGARKKRSWYLTWKYKLTNQRALRRFCQTGAVLFLLVTVIVNIKLILDTRRAISEANEDPEPEQDYDEALGRLEPPRRRGSGPRRVLDVEVYSSRSKVYVAVDGTTVLEDEAREQGRGIHVIVLNQATGHVMAKRVFDTYSPHEDEAMVLFLNMVAPGRVLICTVKDEGSFHLKDTAKALLRSLGSQAGPALGWRDTWAFVGRKGGPVFGEKHSKSPALSSWGDPVLLKTDVPLSSAEEAECHWADTELNRRRRRFCSKVEGYGSVCSCKDPTPIEFSPDPLPDNKVLNVPVAVIAGNRPNYLYRKAWEWAIPSTEQEGASGHLPPGGTLEVGRKAIDSETHSPLWVSIGTLGPAVNTGEPELRGDEVTLTIPGLPRMLRSLLSAQGVSPQMITVFIDGYYEVSRTWGGLGWSTTWSSSDCQGRARETAQARAVKCEGLGLQRWAEGKGPHMVSSGHVPQEPMDVVALFGLRGIQHTPISIKNARVSQHYKASLTATFNLFPEAKFAVVLEEDLDIAVDFFSFLSQSIHLLEEDDSLYCISAWNDQGYEHTAEDPALLYRVETMPGLGWVLRRSLYKEELEPKWPTPEKLWDWDMWMRMPEQRRGRECIIPDVSRSYHFGIVGLNMNGYFHEAYFKKHKFNTVPGVQLRNVDSLKKEAYEVEVHRLLSEAEVLDHSKNPCEDSFLPDTEGHTYVAFIRMEKDDDFTTWTQLAKCLHIWDLDVRGNHRGLWRLFRKKNHFLVVGVPASPYSVKKPPSVTPIFLEPPPKEEGAPGAPEQT

SEQ ID NO: 810477 - protein, 589 aa, Homo sapiens
MDDWKPSPLIKPFGARKKRSWYLTWKYKLTNQRALRRFCQTGAVLFLLVTVIVNIKLILDTRRAISEANEDPEPEQDYDEALGRLEPPRRRGSGPRRVLDVEVYSSRSKVYVAVDGTTVLEDEAREQGRGIHVIVLNQATGHVMAKRVFDTYSPHEDEAMVLFLNMVAPGRVLICTVKDEGSFHLKDTAKALLRSLGSQAGPALGWRDTWAFVGRKGGPVFGEKHSKSPALSSWGDPVLLKTDVPLSSAEEAECHWADTELNRRRRRFCSKVEGYGSVCSCKDPTPIEFSPDPLPDNKVLNVPVAVIAGNRPNYLYRMLRSLLSAQGVSPQMITVFIDGYYEEPMDVVALFGLRGIQHTPISIKNARVSQHYKASLTATFNLFPEAKFAVVLEEDLDIAVDFFSFLSQSIHLLEEDDSLYCISAWNDQGYEHTAEDPALLYRVETMPGLGWVLRRSLYKEELEPKWPTPEKLWDWDMWMRMPEQRRGRECIIPDVSRSYHFGIVGLNMNGYFHEAYFKKHKFNTVPGVQLRNVDSLKKEAYEVEVHRLLRYGLGQLGCSREQRVKYWGSWPHNLQGPVQNENQGPHLKH

SEQ ID NO: 810478 - protein, 642 aa, Homo sapiens
MDDWKPSPLIKPFGARKKRSWYLTWKYKLTNQRALRRFCQTGAVLFLLVTVIVNIKLILDTRRAISEANEDPEPEQDYDEALGRLEPPRRRGSGPRRVLDVEVYSSRSKVYVAVDGTTVLEDEAREQGRGIHVIVLNQATGHVMAKRVFDTYSPHEDEAMVLFLNMVAPGRVLICTVKDEGSFHLKDTAKALLRSLGSQAGPALGWRDTWAFVGRKGGPVFGEKHSKSPALSSWGDPVLLKTDVPLSSAEEAECHWADTELNRRRRRFCSKVEGYGSVCSCKDPTPIEFSPDPLPDNKVLNVPVAVIAGNRPNYLYRMLRSLLSAQGVSPQMITVFIDGYYEEPMDVVALFGLRGIQHTPISIKNARVSQHYKASLTATFNLFPEAKFAVVLEEDLDIAVDFFSFLSQSIHLLEEDDSLYCISAWNDQGYEHTAEDPALLYRVETMPGLGWVLRRSLYKEELEPKWPTPEKCIIPDVSRSYHFGIVGLNMNGYFHEAYFKKHKFNTVPGVQLRNVDSLKKEAYEVEVHRLLSEAEVLDHSKNPCEDSFLPDTEGHTYVAFIRMEKDDDFTTWTQLAKCLHIWDLDVRGNHRGLWRLFRKKNHFLVVGVPASPYSVKKPPSVTPIFLEPPPKEEGAPGAPEQT

SEQ ID NO: 810479 - protein, 660 aa, Homo sapiens; identical to SEQ ID NO: 810469

SEQ ID NO: 810480 - protein, 660 aa, Homo sapiens; identical to SEQ ID NO: 810469

SEQ ID NO: 810481 - protein, 493 aa, Homo sapiens
VLPRVQGDWKRDEGSFHLKDTAKALLRSLGSQAGPALGWRDTWAFVGRKGGPVFGEKHSKSPALSSWGDPVLLKTDVPLSSAEEAECHWADTELNRRRRRFCSKVEGYGSVCSCKDPTPIEFSPDPLPDNKVLNVPVAVIAGNRPNYLYRMLRSLLSAQGVSPQMITVFIDGYYEEPMDVVALFGLRGIQHTPISIKNARVSQHYKASLTATFNLFPEAKFAVVLEEDLDIAVDFFSFLSQSIHLLEEDDSLYCISAWNDQGYEHTAEDPALLYRVETMPGLGWVLRRSLYKEELEPKWPTPEKLWDWDMWMRMPEQRRGRECIIPDVSRSYHFGIVGLNMNGYFHEAYFKKHKFNTVPGVQLRNVDSLKKEAYEVEVHRLLSEAEVLDHSKNPCEDSFLPDTEGHTYVAFIRMEKDDDFTTWTQLAKCLHIWDLDVRGNHRGLWRLFRKKNHFLVVGVPASPYSVKKPPSVTPIFLEPPPKEEGAPGAPEQT

SEQ ID NO: 810482 - protein, 533 aa, Homo sapiens
MDDWKPSPLIKPFGARKKRSWYLTWKYKLTNQRALRRFCQTGAVLFLLVTVIVNIKLILDTRRAISEANEDPEPEQDYDEALGRLEPPRRRGSGPRRVLDVEVYSSRSKVYVAVDGTTVLEDEAREQGRGIHVIVLNQATGHVMAKRVFDTYSPHEDEAMVLFLNMVAPGRVLICTVKVIAGNRPNYLYRMLRSLLSAQGVSPQMITVFIDGYYEEPMDVVALFGLRGIQHTPISIKNARVSQHYKASLTATFNLFPEAKFAVVLEEDLDIAVDFFSFLSQSIHLLEEDDSLYCISAWNDQGYEHTAEDPALLYRVETMPGLGWVLRRSLYKEELEPKWPTPEKLWDWDMWMRMPEQRRGRECIIPDVSRSYHFGIVGLNMNGYFHEAYFKKHKFNTVPGVQLRNVDSLKKEAYEVEVHRLLSEAEVLDHSKNPCEDSFLPDTEGHTYVAFIRMEKDDDFTTWTQLAKCLHIWDLDVRGNHRGLWRLFRKKNHFLVVGVPASPYSVKKPPSVTPIFLEPPPKEEGAPGAPEQT

SEQ ID NO: 810483 - protein, 660 aa, Homo sapiens; identical to SEQ ID NO: 810469

SEQ ID NO: 810484 - protein, 660 aa, Homo sapiens; identical to SEQ ID NO: 810469

SEQ ID NO: 810485 - protein, 664 aa, Homo sapiens
MDDWKPSPLIKPFGARKKRSWYLTWKYKLTNQRALRRFCQTGAVLFLLVTVIVNIKLILDTRRAISEANEDPEPEQDYDEALGRLEPPRRRGSGPRRVLDVEVYSSRSKVYVAVDGTTVLEDEAREQGRGIHVIVLNQATGHVMAKRVFDTYSPHEDEAMVLFLNMVAPGRVLICTVKDEGSFHLKDTAKALLRSLGSQAGPALGWRDTWAFVGRKGGPVFGEKHSKSPALSSWGDPVLLKTDVPLSSAEEAECHWADTELNRRRRRFCSKVEGYGSVCSCKDPTPIEFSPDPLPDNKVLNVPVAVIAGNRPNYLYRMLRSLLSAQGVSPQMITVFIDGYYEEPMDVVALFGLRGIQHTPISIKNARVSQHYKASLTATFNLFPEAKFAVVLEEDLDIAVDFFSFLSQSIHLLEEDDSLYCISAWNDQGYEHTAEDPALLYRVETMPGLGWVLRRSLYKEELEPKWPTPEKLWDWDMWMRMPEQRRGRECIIPDVSRSYHFGIVGLNMNGYFHEAYFKKHKFNTVPGVQLRNVDSLKKEAYEVEVHRLLSEAEVLDHSKNPCEDSFLPDTEGHTYVAFIRMEKDDDFTTWTQLAKCLHIWDLDVRGNHRGLWRLFRKKNHFLVVGVPASPYSAQNLTYLLTVLRALKTGRTWRAWISFWAGMLP

SEQ ID NO: 810486 - protein, 327 aa, Homo sapiens [sequence omitted]

SEQ ID NO: 810487 - protein, 552 aa, Homo sapiens
MDDWKPSPLIKPFGARKKRSWYLTWKYKLTNQRALRRFCQTGAVLFLLVTVIVNIKLILDTRRAISEANEDPEPEQDYDEALGRLEPPRRRGSGPRRVLDVEVYSSRSKVYVAVDGTTVLEDEAREQGRGIHVIVLNQATGHVMAKRVFDTYSPHEDEAMVLFLNMVAPGRVLICTVKDEGSFHLKDTAKALLRSLGSQAGPALGWRDTWAFVGRKGGPVFGEKHSKSPALSSWGDPVLLKTDVPLSSAEEAECHWADTELNRRRRRFCSKVEGYGSVCSCKDPTPIEFSPDPLPDNKVLNVPVAVIAGNRPNYLYRMLRSLLSAQGVSPQMITVFIDGYYEEPMDVVALFGLRGIQHTPISIKNARVSQHYKASLTATFNLFPEAKFAVVLEEDLDIAVDFFSFLSQSIHLLEEDDSLYCISAWNDQVGWNDQGLAGEFMRPQLIPPTMAPCPQGYEHTAEDPALLYRVETMPGLGWVLRRSLYKEELEPKWPTPEKLWDWDMWMRMPEQRRGRECIIPDVSRSYHFGIVGLNMNGYFHVSGRQGAGHSVA

SEQ ID NO: 810488 - protein, 197 aa, Homo sapiens
PTLEAPEKLWDWDMWMRMPEQRRGRECIIPDVSRSYHFGIVGLNMNGYFHEAYFKKHKFNTVPGVQLRNVDSLKKEAYEVEVHRLLSEAEVLDHSKNPCEDSFLPDTEGHTYVAFIRMEKDDDFTTWTQLAKCLHIWDLDVRGNHRGLWRLFRKKNHFLVVGVPASPYSVKKPPSVTPIFLEPPPKEEGAPGAPEQT

SEQ ID NO: 810489 - protein, 128 aa, Homo sapiens
NSLGRGRVVMKWKSRLLSEAEVLDHSKNPCEDSFLPDTEGHTYVAFIRMEKDDDFTTWTQLAKCLHIWDLDVRGNHRGLWRLFRKKNHFLVVGVPASPYSVKKPPSVTPIFLEPPPKEEGAPGAPEQT

SEQ ID NO: 810490 - protein, 416 aa, Homo sapiens
MDDWKPSPLIKPFGARKKRSWYLTWKYKLTNQRALRRFCQTGAVLFLLVTVIVNIKLILDTRRAISEANEDPEPEQDYDEALGRLEPPRRRGSGPRRVLDVEVYSSRSKVYVAVDGTTVLEDEAREQGRGIHVIVLNQATGHVMAKRVFDTYSPHEDEAMVLFLNMVAPGRVLICTVKDEGSFHLKDTAKALLRSLGSQAGPALGWRDTWAFVGRKGGPVFGEKHSKSPALSSWGDPVLLKTDVPLSSAEEAECHWADTELNRRRRRFCSKVEGYGSVCSCKDPTPIEFSPDPLPDNKVLNVPVAVIAGNRPNYLYRMLRSLLSAQGVSPQGSESNLFIDCPEGLENRPNLEGLDFFLGWNAALRVGLALTQETAVPNPWTGPAGAHMLTQTHSETLRHWTRPPLSLLFVQISKAG

SEQ ID NO: 810491 - protein, 305 aa, Homo sapiens
MDDWKPSPLIKPFGARKKRSWYLTWKYKLTNQRALRRFCQTGAVLFLLVTVIVNIKLILDTRRAISEANEDPEPEQDYDEALGRLEPPRRRGSGPRRVLDVEVYSSRSKVYVAVDGTTVLEDEAREQGRGIHVIVLNQATGHVMAKRVFDTYSPHEDEAMVLFLNMVAPGRVLICTVKDEGSFHLKDTAKALLRSLGSQAGPALGWRDTWAFVGRKGGPVFGEKHSKSPALSSWGDPVLLKTDVPLSSAEEAECHWADTELNRRRRRFCSKVEGYGSVCSCKDPTPIEFSPDPPPGTPRAGDTLE

SEQ ID NO: 810492 - protein, 98 aa, Homo sapiens
KKKKKNFKVATAEHSTKYRVLWDTPMKWALSWLYSPTLYCSEAEVLDHSKNPCEDSFLPDTEGHTYVAFIRMEKDDDFTTWTQLAKVLQYHAHPGEPL

SEQ ID NO: 810493 - protein, 666 aa, Homo sapiens
MLPEAGSLWLLKLLRDIQLAQFYWPILEELNVTRPEHFDFVKPEDLDGIGMGRPAQRRLSEALKSLRSGPKSKNWVYKILGGFAPEHKEPTLPSDSPRHLPEPEGGLKCLIPEGAVCRGELLGSGCFGVVHRGLWTLPSGKSVPVAVKSLRVGPEGPMGTELGDFLREVSVMMNLEHPHVLRLHGLVLGQPLQMVMELAPLGSLHARLTAPAPTPPLLVALLCLFLRQLAGAMAYLGARGLVHRDLATRNLQLASPRTIKVADFGLVRPLGGARGRYVMGGPRPIPYTWCAPESLRHGAFSSASDVWMFGVTLWEMFSGGEEPWAGVPPYLILQRLEDRARLPRPPLSSRALYSLALRCWAPHPADRPSFSHLEGLLQEAGPSEACCVRDVTEPGALRMETGDPITVIEGSSSFHSPDSTIWKGQNGRTFKVGSFPASAVTLADAGGLPATRPVHRGTPARGDQHPGSIDGDRKKANLWDAPPARGQRRNMPLERMKGISRSLESVLSLGPRPTGGGSSPPEIRQARAVPQGPPGLPPRPPLSSSSPQPSQPSRERLPWPKRKPPHNHPMGMPGARKAAALSGGLLSDPELQRKIMEMELSVHGVTHQECQTALGATGGDVVSAIRNLKVDQLFHLSSRSRADCWRILEHYQWDLSAASRYVLARP

SEQ ID NO: 810494 - protein, 405 aa, Homo sapiens
MGALGGAPWRVGLQGARVPPLSAPLSGRCAPESLRHGAFSSASDVWMFGVTLWEMFSGGEEPWAGVPPYLILQRLEDRARLPRPPLSSRALYSLALRCWAPHPADRPSFSHLEGLLQEAGPSEACCVRDVTEPGALRMETGDPITVIEGSSSFHSPDSTIWKGQNGRTFKVGSFPASAVTLADAGGLPATRPVHRGTPARGDQHPGSIDGDRKKANLWDAPPARGQRRNMPLERMKGISRSLESVLSLGPRPTGGGSSPPEIRQARAVPQGPPGLPPRPPLSSSSPQPSQPSRERLPWPKRKPPHNHPMGMPGARKAAALSGGLLSDPELQRKIMEMELSVHGVTHQECQTALGATGGDVVSAIRNLKVDQLFHLSSRSRADCWRILEHYQWDLSAASRYVLARP

SEQ ID NO: 810495 - protein, 187 aa, Homo sapiens
GGGGCSQPSSSCFLLNCAGISRSLESVLSLGPRPTGGGSSPPEIRQARAVPQGPPGLPPRPPLSSSSPQPSQPSRERLPWPKRKPPHNHPMGMPGARKAAALSGGLLSDPELQRKIMEMELSVHGVTHQECQTALGATGGDVVSAIRNLKVDQLFHLSSRSRADCWRILEHYQWDLSAASRYVLARP

SEQ ID NO: 810496 - protein, 471 aa, Homo sapiens
MLPEAGSLWLLKLLRDIQLAQFYWPILEELNVTRPEHFDFVKPEDLDGIGMGRPAQRRLSEALKSLRSGPKSKNWVYKILGGFAPEHKEPTLPSDSPRHLPEPEGGLKCLIPEGAVCRGELLGSGCFGVVHRGLWTLPSGKSVPVAVKSLRVGPEGPMGTELGDFLREVSVMMNLEHPHVLRLHGLVLGQPLQMVMELAPLGSLHARLTAPAPTPPLLVALLCLFLRQLAGAMAYLGARGLVHRDLATRNLQLASPRTIKVADFGLVRPLGGARGRYVMGGPRPIPYTWCAPESLRHGAFSSASDVWMFGVTLWEMFSGGEEPWAGVPPYLILQRLEDRARLPRPPLSSRALYSLALRCWAPHPADRPSFSHLEGLLQEAGPSEACCVRDVTEPGALRMETGDPITVIEGSSSFHSPDSTIWKGQNGRTFKVGSFPASAVTLADAGGLPATRPVHRGTPARGDQHPGSIDG

SEQ ID NO: 810497 - protein, 155 aa, Homo sapiens
TPMKHRWRQKEGKSLGCAPSTGPEEEHAPGEDESSPQPSQPSRERLPWPKRKPPHNHPMGMPGARKAAALSGGLLSDPELQRKIMEMELSVHGVTHQECQTALGATGGDVVSAIRNLKVDQLFHLSSRSRADCWRILEHYQWDLSAASRYVLARP

SEQ ID NO: 810498 - protein, 272 aa, Homo sapiens
MGNTTSDRVSGERHGAKAARSEGAGGHAPGKEHKIMVGSTDDPSVFSLPDSKLPGDKEFVSWQQDLEDSVKPTQQARPTVIRWSEGGKEVFISGSFNNWSTKIPLIKSHNDFVAILDLPEGEHQYKFFVDGQWVHDPSEPVVTSQLGTINNLIHVKKSDFEVFDALKLDSMESSETSCRDLSSSPPGPYGQEMYAFRSEERFKSPPILPPHLLQVILNKDTNISCDPALLPEPNHVMLNHLYALSIKDSVMVLSATHRYKKKYVTTLLYKPI

SEQ ID NO: 810499 - protein, 265 aa, Homo sapiens
EEESLVASEGCGFNFNNFIGGLICRTAITSVALGGGSASPEVVPDELQPWETPPATGCPGSATAPRLHAPRAQAAMPRGRSTRSWWGVRTTPACSASLTPSHNDFVAILDLPEGEHQYKFFVDGQWVHDPSEPVVTSQLGTINNLIHVKKSDFEVFDALKLDSMESSETSCRDLSSSPPGPYGQEMYAFRSEERFKSPPILPPHLLQVILNKDTNISCDPALLPEPNHVMLNHLYALSIKDSVMVLSATHRYKKKYVTTLLYKPI

SEQ ID NO: 810500 - protein, 272 aa, Homo sapiens; identical to SEQ ID NO: 810498

SEQ ID NO: 810501 - protein, 272 aa, Homo sapiens; identical to SEQ ID NO: 810498

SEQ ID NO: 810502 - protein, 84 aa, Homo sapiens
GAQDVTGFALREVSLPEDAVQELPTMDYLHSQGVGAMPGAAFGEEGASGQEPKPQGFMGSRAENADCPGIPSVPPSSLLCLEAQ

SEQ ID NO: 810503 - protein, 1120 aa, Homo sapiens
MDLSMKKFAVRRFFSVYLRRKSRSKSSSLSRLEEEGVVKEIDISHHVKEGFEKADPSQFELLKVLGQGSYGKVFLVRKVKGSDAGQLYAMKVLKKATLKVRDRVRSKMERDILAEVNHPFIVKLHYAFQTEGKLYLILDFLRGGDLFTRLSKEVMFTEEDVKFYLAELALALDHLHSLGIIYRDLKPENILLDEEGHIKITDFGLSKEAIDHDKRAYSFCGTIEYMAPEVVNRRGHTQSADWWSFGVLMFEMLTGSLPFQGKDRKETMALILKAKLGMPQFLSGEAQSLLRALFKRNPCNRLGAGIDGVEEIKRHPFFVTIDWNTLYRKEIKPPFKPAVGRPEDTFHFDPEFTARTPTDSPGVPPSANAHHLFRGFSFVASSLIQEPSQQDLHKVPVHPIVQQLHGNNIHFTDGYEIKEDIGVGSYSVCKRCVHKATDTEYAVKIIDKSKRDPSEEIEILLRYGQHPNIITLKDVYDDGKFVYLVMELMRGGELLDRILRQRYFSEREASDVLCTITKTMDYLHSQGVVHRDLKPSNILYRDESGSPESIRVCDFGFAKQLRAGNGLLMTPCYTANFVAPEVLKRQGYDAACDIWSLGILLYTMLAGFTPFANGPDDTPEEILARIGSGKYALSGGNWDSISDAAKDVVSKMLHVDPHQRLTAMQVLKHPWVVNREYLSPNQLSRQDVHLVKGAMAATYFALNRTPQAPRLEPVLSSNLAQRRGMKRLTSTRCSGWDPGPSVPCQHPRGLTDPGLGARLAPRVTTSPAGRRRRPRRVRVFFFSPGEGPDLGASPSLTAPASPPALFSPKRNQMRPFTSRARARPGASFRARGSSHTWLLFLPRDLFSNYEAGRFGQTPDTHVPGTRWESGSARAQPLVVAGPQRAGVTWHPGAPHGLDDGVGTVASRRRCLVLPKIIQKSRFLLALQFLPEVLGSPSFPLSQIQMRSKSPDERKAGWIFALRAPCHQDGRGCLSEEPVSTSSLGFPRGAKRTGLPSVPSSRGHTAIWRLCRESWVLAPAQPCVGFLCAHLKLWFCCVHFDFSGLWRNCELEKWSSVASHPNLLSPAGGWRETQAPPSRLRGRGTGGRAAEISVDRSDALCRCCGFVLRFVSLLHRSVFSH

SEQ ID NO: 810504 - protein, 733 aa, Homo sapiens
MDLSMKKFAVRRFFSVYLRRKSRSKSSSLSRLEEEGVVKEIDISHHVKEGFEKADPSQFELLKVLGQGSYGKVFLVRKVKGSDAGQLYAMKVLKKATLKVRDRVRSKMERDILAEVNHPFIVKLHYAFQTEGKLYLILDFLRGGDLFTRLSKEVMFTEEDVKFYLAELALALDHLHSLGIIYRDLKPENILLDEEGHIKITDFGLSKEAIDHDKRAYSFCGTIEYMAPEVVNRRGHTQSADWWSFGVLMFEMLTGSLPFQGKDRKETMALILKAKLGMPQFLSGEAQSLLRALFKRNPCNRLGAGIDGVEEIKRHPFFVTIDWNTLYRKEIKPPFKPAVGRPEDTFHFDPEFTARTPTDSPGVPPSANAHHLFRGFSFVASSLIQEPSQQDLHKVPVHPIVQQLHGNNIHFTDGYEIKEDIGVGSYSVCKRCVHKATDTEYAVKIIDKSKRDPSEEIEILLRYGQHPNIITLKDVYDDGKFVYLVMELMRGGELLDRILRQRYFSEREASDVLCTITKTMDYLHSQGVVHRDLKPSNILYRDESGSPESIRVCDFGFAKQLRAGNGLLMTPCYTANFVAPEVLKRQGYDAACDIWSLGILLYTMLAGFTPFANGPDDTPEEILARIGSGKYALSGGNWDSISDAAKDVVSKMLHVDPHQRLTAMQVLKHPWVVNREYLSPNQLSRQDVHLVKGAMAATYFALNRTPQAPRLEPVLSSNLAQRRGMKRLTSTRL

SEQ ID NO: 810505 - protein, 733 aa, Homo sapiens; identical to SEQ ID NO: 810504

SEQ ID NO: 810506 - protein, 1029 aa, Homo sapiens
MLLGFILSMYEGAHIGELHTESGAVQYAVLCDVTVDTDGEALTESVTSWGEGTSSLRISDEDVMFTEEDVKFYLAELALALDHLHSLGIIYRDLKPENILLDEEGHIKITDFGLSKEAIDHDKRAYSFCGTIEYMAPEVVNRRGHTQSADWWSFGVLMFEMLTGSLPFQGKDRKETMALILKAKLGMPQFLSGEAQSLLRALFKRNPCNRLGAGIDGVEEIKRHPFFVTIDWNTLYRKEIKPPFKPAVGRPEDTFHFDPEFTARTPTDSPGVPPSANAHHLFRGFSFVASSLIQEPSQQDLHKVPVHPIVQQLHGNNIHFTDGYEIKEDIGVGSYSVCKRCVHKATDTEYAVKIIDKSKRDPSEEIEILLRYGQHPNIITLKDVYDDGKFVYLVMELMRGGELLDRILRQRYFSEREASDVLCTITKTMDYLHSQGVVHRDLKPSNILYRDESGSPESIRVCDFGFAKQLRAGNGLLMTPCYTANFVAPEVLKRQGYDAACDIWSLGILLYTMLAGFTPFANGPDDTPEEILARIGSGKYALSGGNWDSISDAAKDVVSKMLHVDPHQRLTAMQVLKHPWVVNREYLSPNQLSRQDVHLVKGAMAATYFALNRTPQAPRLEPVLSSNLAQRRGMKRLTSTRCSGWDPGPSVPCQHPRGLTDPGLGARLAPRVTTSPAGRRRRPRRVRVFFFSPGEGPDLGASPSLTAPASPPALFSPKRNQMRPFTSRARARPGASFRARGSSHTWLLFLPRDLFSNYEAGRFGQTPDTHVPGTRWESGSARAQPLVVAGPQRAGVTWHPGAPHGLDDGVGTVASRRRCLVLPKIIQKSRFLLALQFLPEVLGSPSFPLSQIQMRSKSPDERKAGWIFALRAPCHQDGRGCLSEEPVSTSSLGFPRGAKRTGLPSVPSSRGHTAIWRLCRESWVLAPAQPCVGFLCAHLKLWFCCVHFDFSGLWRNCELEKWSSVASHPNLLSPAGGWRETQAPPSRLRGRGTGGRAAEISVDRSDALCRCCGFVLRFVSLLHRSVFSH

SEQ ID NO: 810507 - protein, 211 aa, Homo sapiens [sequence omitted]

SEQ ID NO: 810508 - protein, 460 aa, Homo sapiens
MDLSMKKFAVRRFFSVYLRRKSRSKSSSLSRLEEEGVVKEIDISHHVKEGFEKADPSQFELLKVLGQGSYGKVFLVRKVKGSDAGQLYAMKVLKKATLKVRDRVRSKMERDILAEVNHPFIVKLHYAFQTEGKLYLILDFLRGGDLFTRLSKEVMFTEEDVKFYLAELALALDHLHSLGIIYRDLKPENILLDEEGHIKITDFGLSKEAIDHDKRAYSFCGTIEYMAPEVVNRRGHTQSADWWSFGVLMFEMLTGSLPFQGKDRKETMALILKAKLGMPQFLSGEAQSLLRALFKRNPCNRLGAGIDGVEEIKRHPFFVTIDWNTLYRKEIKPPFKPAVGRPEDTFHFDPEFTARTPTDSPGVPPSANAHHLFRGFSFVASSLIQEPSQQDLHKVPVHPIVQQLHGNNIHFTDGYEIKEDIGVGSYSVCKRCVHKATDTEYAVKPLPAGMRRRTVISNKM

SEQ ID NO: 810509 - protein, 320 aa, Homo sapiens
MDLSMKKFAVRRFFSVYLRRKSRSKSSSLSRLEEEGVVKEIDISHHVKEGFEKADPSQFELLKVLGQGSYGKVFLVRKVKGSDAGQLYAMKVLKKATLKVRDRVRSKMERDILAEVNHPFIVKLHYAFQTEGKLYLILDFLRGGDLFTRLSKEVMFTEEDVKFYLAELALALDHLHSLGIIYRDLKPENILLDEEGHIKITDFGLSKEAIDHDKRAYSFCGTIEYMAPEVVNRRGHTQSADWWSFGVLMFEMLTGSLPFQGKDRKETMALILKAKLGMPQFLSGEAQSLLRALFKRNPCNRLGEKTALCPRVSCSRLLGF

SEQ ID NO: 810510 - protein, 631 aa, Homo sapiens
MFYAHFVLSKRGPLAKIWLAAHWDKKLTKAHVFECNLESSVESIISPKVKMALRTSGHLLLGVVRIYHRKAKYLLADCNEAFIKIKMAFRPGVVDLPEENREAAYNAITLPEEFHDFDQPLPDLDDIDVAQQFSLNQSRVEEITMREEVGNISILQENDFGDFGMDDREIMREGSAFEDDDMLVSTTTSNLLLESEQSTSNLNEKINHLEYEDQYKDDNFGEGNDGGILDDKLISNNDGGIFDDPPALSEAGVMLPEQPAHDDMDEDDNVSMGGPDSPDSVDPVEPMPTMTDQTTLVPNEEEAFALEPIDITVKETKAKRKRKLIVDSVKELDSKTIRAQLSDYSDIVTTLDLAPPTKKLMMWKETGGVEKLFSLPAQPLWNNRLLKLFTRCLTPLVPEDLRKRRKGGEADNLDEFLKEFENPEVPREDQQQQHQQRDVIDEPIIEEPSRLQESVMEASRTNIDESAMPPPPPQGVKRKAGQIDPEPVMPPQQVEQMEIPPVELPPEEPPNICQLIPELELLPEKEKEKEKEKEDDEEEEDEDASGGDQDQEERRWNKRTQQMLHGLQRALAKTGAESISLLELCRNTNRKQAAAKFYSFLVLKKQQAIELTQEEPYSDIIATPGPRFHII

SEQ ID NO: 810511 - protein, 631 aa, Homo sapiens; identical to SEQ ID NO: 810510

SEQ ID NO: 810512 - protein, 631 aa, Homo sapiens; identical to SEQ ID NO: 810510

SEQ ID NO: 810513 - protein, 600 aa, Homo sapiens
STCARSTLDSVWYHLTKVKMALRTSGHLLLGVVRIYHRKAKYLLADCNEAFIKIKMAFRPGVVDLPEENREAAYNAITLPEEFHDFDQPLPDLDDIDVAQQFSLNQSRVEEITMREEVGNISILQENDFGDFGMDDREIMREGSAFEDDDMLVSTTTSNLLLESEQSTSNLNEKINHLEYEDQYKDDNFGEGNDGGILDDKLISNNDGGIFDDPPALSEAGVMLPEQPAHDDMDEDDNVSMGGPDSPDSVDPVEPMPTMTDQTTLVPNEEEAFALEPIDITVKETKAKRKRKLIVDSVKELDSKTIRAQLSDYSDIVTTLDLAPPTKKLMMWKETGGVEKLFSLPAQPLWNNRLLKLFTRCLTPLVPEDLRKRRKGGEADNLDEFLKEFENPEVPREDQQQQHQQRDVIDEPIIEEPSRLQESVMEASRTNIDESAMPPPPPQGVKRKAGQIDPEPVMPPQQVEQMEIPPVELPPEEPPNICQLIPELELLPEKEKEKEKEKEDDEEEEDEDASGGDQDQEERRWNKRTQQMLHGLQRALAKTGAESISLLELCRNTNRKQAAAKFYSFLVLKKQQAIELTQEEPYSDIIATPGPRFHII

SEQ ID NO: 810514 - protein, 374 aa, Homo sapiens
LVPNEEEVLFDQIMVGMVQRDPLNQDYQAHPLIHDQTTLVPNEEEAFALEPIDITVKETKAKRKRKLIVDSVKELDSKTIRAQLSDYSDIVTTLDLAPPTKKLMMWKETGGVEKLFSLPAQPLWNNRLLKLFTRCLTPLVPEDLRKRRKGGEADNLDEFLKEFENPEVPREDQQQQHQQRDVIDEPIIEEPSRLQESVMEASRTNIDESAMPPPPPQGVKRKAGQIDPEPVMPPQQVEQMEIPPVELPPEEPPNICQLIPELELLPEKEKEKEKEKEDDEEEEDEDASGGDQDQEERRWNKRTQQMLHGLQRALAKTGAESISLLELCRNTNRKQAAAKFYSFLVLKKQQAIELTQEEPYSDIIATPGPRFHII

SEQ ID NO: 810515 - protein, 325 aa, Homo sapiens
MNLAITVKETKAKRKRKLIVDSVKELDSKTIRAQLSDYSDIVTTLDLAPPTKKLMMWKETGGVEKLFSLPAQPLWNNRLLKLFTRCLTPLVPEDLRKRRKGGEADNLDEFLKEFENPEVPREDQQQQHQQRDVIDEPIIEEPSRLQESVMEASRTNIDESAMPPPPPQGVKRKAGQIDPEPVMPPQQVEQMEIPPVELPPEEPPNICQLIPELELLPEKEKEKEKEKEDDEEEEDEDASGGDQDQEERRWNKRTQQMLHGLQRALAKTGAESISLLELCRNTNRKQAAAKFYSFLVLKKQQAIELTQEEPYSDIIATPGPRFHII

SEQ ID NO: 810516 - protein, 621 aa, Homo sapiens
MFYAHFVLSKRGPLAKIWLAAHWDKKLTKAHVFECNLESSVESIISPKVKMALRTSGHLLLGVVRIYHRKAKYLLADCNEAFIKIKMAFRPGVVDLPEENREAAYNAITLPEEFHDFDQPLPDLDDIDVAQQFSLNQSRVEEITMREEVGNISILQENDFGDFGMDDREIMREGSAFEDDDMLVSTTTSNLLLESEQSTSNLNEKINHLEYEDQYKDDNFGEGNDGGILDDKLISNNDGGIFDDPPALSEAGVMLPEQPAHDDMDEDDNVSMGGPDSPDSVDPVEPMPTMTDQTTLVPNEEEAFALEPIDITVKETKAKRKRKLIVDSVKELDSKTIRAQLSDYSDIVTTLDLAPPTKKLMMWKETGGVEKLFSLPAQPLWNNRLLKLFTRCLTPLVPEDLRKRRKGGEADNLDEFLKEFENPEVPREDQQQQHQQRDVIDEPIIEEPSRLQESVMEASRTNIDESAMPPPPPQGVKRKAGQIDPEPVMPPQQVEQMEIPPVELPPEEPPNICQLIPELELLPEKEKEKEKEKEDDEEEEDEDASGGDQDQEERRWNKRTQQMLHGLQRALAKTGAESISLLELCRNTNRKQAAAKFYSFLVLKKQQAIETWTKVPYYIRS

SEQ ID NO: 810517 - protein, 198 aa, Homo sapiens
TSAADAIDEPIIEEPSRLQESVMEASRTNIDESAMPPPPPQGVKRKAGQIDPEPVMPPQQVEQMEIPPVELPPEEPPNICQLIPELELLPEKEKEKEKEKEDDEEEEDEDASGGDQDQEERRWNKRTQQMLHGLQRALAKTGAESISLLELCRNTNRKQAAAKFYSFLVLKKQQAIELTQEEPYSDIIATPGPRFHII

SEQ ID NO: 810518 - protein, 197 aa, Homo sapiens
MRNVTIDEPIIEEPSRLQESVMEASRTNIDESAMPPPPPQGVKRKAGQIDPEPVMPPQQVEQMEIPPVELPPEEPPNICQLIPELELLPEKEKEKEKEKEDDEEEEDEDASGGDQDQEERRWNKRTQQMLHGLQRALAKTGAESISLLELCRNTNRKQAAAKFYSFLVLKKQQAIELTQEEPYSDIIATPGPRFHII

SEQ ID NO: 810519 - protein, 631 aa, Homo sapiens; identical to SEQ ID NO: 810510

SEQ ID NO: 810520 - protein, 631 aa, Homo sapiens; identical to SEQ ID NO: 810510

SEQ ID NO: 810521 - protein, 631 aa, Homo sapiens; identical to SEQ ID NO: 810510

SEQ ID NO: 810522 - protein, 140 aa, Homo sapiens
NSYYRDQLSPGDTLSRNTHIIWELIPELELLPEKEKEKEKEKEDDEEEEDEDASGGDQDQEERRWNKRTQQMLHGLQRALAKTGAESISLLELCRNTNRKQAAAKFYSFLVLKKQQAIELTQEEPYSDIIATPGPRFHII

SEQ ID NO: 810523 - protein, 631 aa, Homo sapiens; identical to SEQ ID NO: 810510

SEQ ID NO: 810524 - protein, 497 aa, Homo sapiens
MFYAHFVLSKRGPLAKIWLAAHWDKKLTKAHVFECNLESSVESIISPKVKMALRTSGHLLLGVVRIYHRKAKYLLADCNEAFIKIKMAFRPGVVDLPEENREAAYNAITLPEEFHDFDQPLPDLDDIDVAQQFSLNQSRVEEITMREEVGNISILQENDFGDFGMDDREIMREGSAFEDDDMLVSTTTSNLLLESEQSTSNLNEKINHLEYEDQYKDDNFGEGNDGGILDDKLISNNDGGIFDDPPALSEAGVMLPEQPAHDDMDEDDNVSMGGPDSPDSVDPVEPMPTMTDQTTLVPNEEEAFALEPIDITVKETKAKRKRKLIVDSVKELDSKTIRAQLSDYSDIVTTLDLAPPTKKLMMWKETGGVEKLFSLPAQPLWNNRLLKLFTRCLTPLVPEDLRKRRKGGEADNLDEFLKEFENPEVPREDQQQQHQQRDVIDEPIIEEPSRLQESVMEASRTNIDESAMPPPPPQGVKRKAGQIDPEPVMPTEPFEKT

SEQ ID NO: 810525 - protein, 631 aa, Homo sapiens; identical to SEQ ID NO: 810510

SEQ ID NO: 810526 - protein, 631 aa, Homo sapiens; identical to SEQ ID NO: 810510

SEQ ID NO: 810527 - protein, 631 aa, Homo sapiens; identical to SEQ ID NO: 810510

SEQ ID NO: 810528 - protein, 631 aa, Homo sapiens; identical to SEQ ID NO: 810510

SEQ ID NO: 810529 - protein, 556 aa, Homo sapiens
MFYAHFVLSKRGPLAKIWLAAHWDKKLTKAHVFECNLESSVESIISPKVKMALRTSGHLLLGVVRIYHRKAKYLLADCNEAFIKIKMAFRPGVVDLPEENREAAYNAITLPEEFHDFDQPLPDLDDIDVAQQFSLNQSRVEEITMREEVGNISILQENDFGDFGMDDREIMREGSAFEDDDMLVSTTTSNLLLESEQSTSNLNEKINHLEYEDQYKDDNFGEGNDGGILDDKLISNNDGGIFDDPPALSEAGVMLPEQPAHDDMDEDDNVSMGGPDSPDSVDPVEPMPTMTDQTTLVPNEEEAFALEPIDITVKETKAKRKRKLIVDSVKELDSKTIRAQLSDYSDIVTTLDLAPPTKKLMMWKETGGVEKLFSLPAQPLWNNRLLKLFTRCLTPLVPEDLRKRRKGGEADNLDEFLKEFENPEVPREDQQQQHQQRDVIDEPIIEEPSRLQESVMEASRTNIDESAMPPPPPQGVKRKAGQIDPEPVMPPQQVEQMEIPPVELPPEEPPNICQLIPELELLPEKEKEKEKEKEDDEEEEDEDASGVDAAANLVVV

SEQ ID NO: 810530 - protein, 210 aa, Homo sapiens
MFYAHFVLSKRGPLAKIWLAAHWDKKLTKAHVFECNLESSVESIISPKVKMALRTSGHLLLGVVRIYHRKAKYLLADCNEAFIKIKMAFRPGVVDLPEENREAAYNAITLPEEFHDFDQPLPDLDDIDVAQQFSLNQSRVEEITMREEVGNISILQENDFGDFGMDDREIMREGSAFEDDDMLVSTTTSNLLLESEQSTSNLNEKINHLE

SEQ ID NO: 810531 - protein, 72 aa, Homo sapiens
VPQYADLHRGRQHGLQAWQLGLNAVHGLDDIRAGLAGDHQVDPGLCRRTRELYIQYDVPVNQGVFPVCKKTL

SEQ ID NO: 810532 - protein, 441 aa, Homo sapiens
TFSNVYRMKRNSLSVENKIVQLSGAAKQPKVGFYSSLNQTHTHTVLLDWGSLPHHVVLQIFQYLPLLDRACASSVCRRWNEVFHISDLWRKFEFELNQSATSSFKSTHPDLIQQIIKKHFAHLQYVSFKVDSSAESAEAACDILSQLVNCSIQTLGLISTAKPSFMNVSESHFVSALTVVFINSKSLSSIKIEDTPVDDPSLKILVANNSDTLRLPKMSSCPHVSSDGILCVADRCQGLRELALNYYILTDELFLALSSETHVNLEHLRIDVVSENPGQIKFHAVKKHSWDALIKHSPRVNVVMHFFLYEEEFETFFKEETPVTHLYFGRSVSKVVLGRVGLNCPRLIELVVCANDLQPLDNELICIAEHCTNLTALGLSKCEVSCSAFIRFVRLCERRLTQLSVMEEVLIPDEDYSLDEIHTEVSKYLGRVWFPDVMPLW

SEQ ID NO: 810533 - protein, 184 aa, Homo sapiens
MNVSESHFVSALTVVFINSKSLSSIKIEDTPVDDPSLKILVANNSDTLRLPKMSSCPHVSSDGILCVADRCQGLRELALNYYILTDELFLALSSETHVNLEHLRIDVVSENPGQIKFHAVKKHSWDALIKHSPRVNVVMHFFLYEEEFETFFKEETPVTHLYFGRSVSKVVLGRVKYLIVCKLS

SEQ ID NO: 810534 - protein, 196 aa, Homo sapiens
MAAEHLLPGPPPSLADFRLEAGGKGTERGSGSSKPTGSSRGPRMAKFLSQDQINEYKECFSLYDKQQRGKIKATDLMVAMRCLGASPTPGEVQRHLQTHGIDGNGELDFSTFLTIMHMQIKQEDPKKEILLAMLMVDKEKKGYVMASDLRSKLTSLGEKLTHKEVDDLFREADIEPNGKVKYDEFIHKITLPGRDY

SEQ ID NO: 810535 - protein, 117 aa, Homo sapiens
MRCLGASPTPGEVQRHLQTHGIDGNGELDFSTFLTIMHMQIKQEDPKKEILLAMLMVDKEKKGYVMASDLRSKLTSLGEKLTHKEVDDLFREADIEPNGKVKYDEFIHKITLPGRDY

SEQ ID NO: 810536 - protein, 117 aa, Homo sapiens; identical to SEQ ID NO: 810535

SEQ ID NO: 810537 - protein, 179 aa, Homo sapiens
RQGAGKPEPRNHSRANGECQPRVAARPEWQVLSKTNYEYKECFSLYDKQQRGKIKATDLMVAMRCLGASPTPGEVQRHLQTHGIDGNGELDFSTFLTIMHMQIKQEDPKKEILLAMLMVDKEKKGYVMASDLRSKLTSLGEKLTHKEVDDLFREADIEPNGKVKYDEFIHKITLPGRDY

SEQ ID NO: 810538 - protein, 117 aa, Homo sapiens [sequence omitted]

SEQ ID NO: 810539 - protein, 117 aa, Homo sapiens; identical to SEQ ID NO: 810535

SEQ ID NO: 810540 - protein, 134 aa, Homo sapiens
YSKGPTQTRTDLEKLRERRREGSRRWCGDPRRLVPGRADAAPLHTKRFSCTGRYFPKMPRLVGAQNPHRKVPRAARGGTHGVRVSQAPSIPPGPGPLQLIARGFSASALVGRSCSYPLPSCVPAGREGKEGLIF

SEQ ID NO: 810541 - protein, 119 aa, Homo sapiens
YSKGPTQTRTDLEKLRERRREGSRRWCGDPRRLVPGRADAAPLHTKRFSCTGRYFPKMPRLVGAQNPHRKVPRAARGGTHGVRVSQAPSIPPGPGPSSADPAPTHSLAVFPRGERGKRV

SEQ ID NO: 810542 - protein, 134 aa, Homo sapiens; identical to SEQ ID NO: 810540

SEQ ID NO: 810543 - protein, 134 aa, Homo sapiens; identical to SEQ ID NO: 810540

SEQ ID NO: 810544 - protein, 2096 aa, Homo sapiens
MAEVTVPRVYVVFGIHCIMAKASSDVQVSGFHRKIQHVKNELCHMLSLEEVAPVLQQTLLQDNLLGRVHFDQFKEALILILSRTLSNEEHFQEPDCSLEAQPKYVRGGKRYGRRSLPEFQESVEEFPEVTVIEPLDEEARPSHIPAGDCSEHWKTQRSEEYEAEGQLRFWNPDDLNASQSGSSPPQDWIEEKLQEVCEDLGITRDGHLNRKKLVSICEQYGLQNVDGEMLEEVFHNLDPDGTMSVEDFFYGLFKNGKSLTPSASTPYRQLKRHLSMQSFDESGRRTTTSSAMTSTIGFRVFSCLDDGMGHASVERILDTWQEEGIENSQEILKALDFSLDGNINLTELTLALENELLVTKNSIHQAALASFKAEIRHLLERVDQVVREKEKLRSDLDKAEKLKSLMASEVDDHHAAIERRNEYNLRKLDEEYKERIAALKNELRKEREQILQQAGKQRLELEQEIEKAKTEENYIRDRLALSLKENSRLENELLENAEKLAEYENLTNKLQRNLENVLAEKFGDLDPSSAEFFLQEERLTQMRNEYERQCRVLQDQVDELQSELEEYRAQGRVLRLPLKNSPSEEVEANSGGIEPEHGLGSEECNPLNMSIEAELVIEQMKEQHHRDICCLRLELEDKVRHYEKQLDETVVSCKKAQENMKQRHENETHTLEKQISDLKNEIAELQGQAAVLKEAHHEATCRHEEEKKQLQVKLEEEKTHLQEKLRLQHEMELKARLTQAQASFEREREGLQSSAWTEEKVRGLTQELEQFHQEQLTSLVEKHTLEKEELRKELLEKHQRELQEGREKMETECNRRTSQIEAQFQSDCQKVTERCESALQSLEGRYRQELKDLQEQQREEKSQWEFEKDELTQECAEAQELLKETLKREKTTSLVLTQEREMLEKTYKEHLNSMVVERQQLLQDLEDLRNVSETQQSLLSDQILELKSSHKRELREREEVLCQAGASEQLASQRLERLEMEHDQERQEMMSKLLAMENIHKATCETADRERAEMSTEISRLQSKIKEMQQATSPLSMLQSGCQVIGEEEVEGDGALSLLQQGEQLLEENGDVLLSLQRAHEQAVKENVKMATEISRLQQRLQKLEPGLVMSSCLDEPATEFFGNTAEQTEPFLQQNRTKQVEGVTRRHVLSDLEDDEVRDLGSTGTSSVQRQEVKIEESEASVEGFSELENSEETRTESWELKNQISQLQEQLMMLCADCDRASEKKQDLLFDVSVLKKKLKMLERIPEASPKYKLLYEDVSRENDCLQEELRMMETRYDEALENNKELTAEVFRLQDELKKMEEVTETFLSLEKSYDEVKIENEELNVLVLRLQGKIEKLQESVVQRCDCCLWEASLENLEIEPDGNILQLNQTLEECVPRVRSVHHVIEECKQENQYLEGNTQLLEKVKAHEIAWLHGTIQTHQERPRVQNQVILEENTTLLGFQDKHFQHQATIAELELEKTKLQELTRKLKERVTILVKQKDVLSHGEKEEELKAMMHDLQITCSEMQQKVELLRYESEKLQQENSILRNEITTLNEEDSISNLKLGTLNGSQEEMWQKTETVKQENAAVQKMVENLKKQISELKIKNQQLDLENTELSQKNSQNQEKLQELNQRLTEMLCQKEKEPGNSALEEREQEKFNLKEELERCKVQSSTLVSSLEAELSEVKIQTHIVQQENHLLKDELEKMKQLHRCPDLSDFQQKISSVLSYNEKLLKEKEALSEELNSCVDKLAKSSLLEHRIATMKQEQKSWEHQSASLKSQLVASQEKVQNLEDTVQNVNLQMSRMKSDLRVTQQEKEALKQEVMSLHKQLQNAGGKSWAPEIATHPSGLHNQQKRLSWDKLDHLMNEEQQLLWQENERLQTMVQNTKAELTHSREKVRQLESNLLPKHQKHLNPSGTMNPTEQEKLSLKRECDQFQKEQSPANRKVSQMNSLEQELETIHLENEGLKKKQVKLDEQLMEMQHLRSTATPSPSPHAWDLQLLQQQACPMVPREQFLQLQRQLLQAERINQHLQEELENRTSETNTPQGNQEQLVTVMEERMIEVEQKLKLVKRLLQEKVNQLKEQVSLPGHLCSPTSHSSFNSSFTSLYCH

SEQ ID NO: 810545 - protein, 2138 aa, Homo sapiens
SRPPEPGAERAGRGRPAAAAKPGVRQRPWFPRRRRAPEPRDASAGGGLPAVRALRRDRQKVSTVGYGMDELDQDQHGRLKDLFDSFDTTGTGSLGQEELTDLCHMLSLEEVAPVLQQTLLQDNLLGRVHFDQFKEALILILSRTLSNEEHFQEPDCSLEAQPKYVRGGKRYGRRSLPEFQESVEEFPEVTVIEPLDEEARPSHIPAGDCSEHWKTQRSEEYEAEGQLRFWNPDDLNASQSGSSPPQDWIEEKLQEVCEDLGITRDGHLNRKKLVSICEQYGLQNVDGEMLEEVFHNLDPDGTMSVEDFFYGLFKNGKSLTPSASTPYRQLKRHLSMQSFDESGRRTTTSSAMTSTIGFRVFSCLDDGMGHASVERILDTWQEEGIENSQEILKALDFSLDGNINLTELTLALENELLVTKNSIHQAALASFKAEIRHLLERVDQVVREKEKLRSDLDKAEKLKSLMASEVDDHHAAIERRNEYNLRKLDEEYKERIAALKNELRKEREQILQQAGKQRLELEQEIEKAKTEENYIRDRLALSLKENSRLENELLENAEKLAEMFGDLDPSSAEFFLQEERLTQMRNEYERQCRVLQDQVDELQSELEEYRAQGRVLRLPLKNSPSEEVEANSGGIEPEHGLGSEECNPLNMSIEAELVIEQMKEQHHRDICCLRLELEDKVRHYEKQLDETVVSCKKAQENMKQRHENETHTLEKQISDLKNEIAELQGQAAVLKEAHHEATCRHEEEKKQLQVKLEEEKTHLQEKLRLQHEMELKARLTQAQASFEREREGLQSSAWTEEKVRGLTQELEQFHQEQLTSLVEKHTLEKEELRKELLEKHQRELQEGREKMETECNRRTSQIEAQFQSDCQKVTERCESALQSLEGRYRQELKDLQEQQREEKSQWEFEKDELTQECAEAQELLKETLKREKTTSLVLTQEREMLEKTYKEHLNSMVVERQQLLQDLEDLRNVSETQQSLLSDQILELKSSHKRELREREEVLCQAGASEQLASQRLERLEMEHDQERQEMMSKLLAMENIHKATCETADRERAEMSTEISRLQSKIKEMQQATSPLSMLQSGCQVIGEEEVEGDGALSLLQQGEQLLEENGDVLLSLQRAHEQAVKENVKMATEISRLQQRLQKLEPGLVMSSCLDEPATEFFGNTAEQTEPFLQQNRTKQVEGVTRRHVLSDLEDDEVRDLGSTGTSSVQRQEVKIEESEASVEGFSELENSEETRTESWELKNQISQLQEQLMMLCADCDRASEKKQDLLFDVSVLKKKLKMLERIPEASPKYKLLYEDVSRENDCLQEELRMMETRYDEALENNKELTAEVFRLQDELKKMEEVTETFLSLEKSYDEVKIENEELNVLVLRLQGKIEKLQESVVQRCDCCLWEASLENLEIEPDGNILQLNQTLEECVPRVRSVHHVIEECKQENQYLEGNTQLLEKVKAHEIAWLHGTIQTHQERPRVQNQVILEENTTLLGFQDKHFQHQATIAELELEKTKLQELTRKLKERVTILVKQKDVLSHGEKEEELKAMMHDLQITCSEMQQKVELLRYESEKLQQENSILRNEITTLNEEDSISNLKLGTLNGSQEEMWQKTETVKQENAAVQKMVENLKKQISELKIKNQQLDLENTELSQKNSQNQEKLQELNQRLTEMLCQKEKEPGNSALEEREQEKFNLKEELERCKVQSSTLVSSLEAELSEVKIQTHIVQQENHLLKDELEKMKQLHRCPDLSDFQQKISSVLSYNEKLLKEKEALSEELNSCVDKLAKSSLLEHRIATMKQEQKSWEHQSASLKSQLVASQEKVQNLEDTVQNVNLQMSRMKSDLRVTQQEKEALKQEVMSLHKQLQNAGGKSWAPEIATHPSGLHNQQKRLSWDKLDHLMNEEQQLLWQENERLQTMVQNTKAELTHSREKVRQLESNLLPKHQKHLNPSGTMNPTEQEKLSLKRECDQFQKEQSPANRKVSQMNSLEQELETIHLENEGLKKKQVKLDEQLMEMQHLRSTATPSPSPHAWDLQLLQQQACPMVPREQFLQLQRQLLQAERINQHLQEELENRTSETNTPQGNQEQLVTVMEERMIEVEQKLKLVKRLLQEKVNQLKEQVSLPGHLCSPTSHSSFNSSFTSLYCH

SEQ ID NO: 810546 - protein, 2094 aa, Homo sapiens
SRPPEPGAERAGRGRPAAAAKPGVRQRPWFPRRRRAPEPRDASAGGGLPAVRALRRDRQKVSTVGYGMDELDQDQHGRLKDLFDSFDTTGTGSLGQEELTDLCHMLSLEEVAPVLQQTLLQDNLLGRVHFDQFKEALILILSRTLSNEEHFQEPDCSLEAQPKYVRGGKRYGRRSLPEFQESVEEFPEVTVIEPLDEEARPSHIPAGDCSEHWKTQRSEEYEAEGQLRFWNPDDLNASQSGSSPPQDWIEEKLQEVCEDLGITRDGHLNRKKLVSICEQYGLQNVDGEMLEEVFHNLDPDGTMSVEDFFYGLFKNGKSLTPSASTPYRQLKRHLSMQSFDESGRRTTTSSAMTSTIGFRVFSCLDDGMGHASVERILDTWQEEGIENSQEILKALDFSLDGNINLTELTLALENELLVTKNSIHQAALASFKAEIRHLLERVDQVVREKEKLRSDLDKAEKLKSLMASEVDDHHAAIERRNEYNLRKLDEEYKERIAALKNELRKEREQILQQAGKQRLELEQEIEKAKTEENYIRDRLALSLKENSRLENELLENAEKLAEMFGDLDPSSAEFFLQEERLTQMRNEYERQCRVLQDQVDELQSELEEYRAQGRVLRLPLKNSPSEEVEANSGGIEPEHGLGSEECNPLNMSIEAELVIEQMKEQHHRDICCLRLELEDKVRHYEKQLDETVVSCKKAQENMKQRHENETHTLEKQISDLKNEIAELQGQAAVLKEAHHEATCRHEEEKKQLQVKLEEEKTHLQEKLRLQHEMELKARLTQAQASFEREREGLQSSAWTEEKVRGLTQELEQFHQEQLTSLVEKHTLEKEELRKELLEKHQRELQEGREKMETECNRRTSQIEAQFQSDCQKVTERCESALQSLEGRYRQELKDLQEQQREEKSQWEFEKDELTQECAEAQELLKETLKREKTTSLVLTQEREMLEKTYKEHLNSMVVERQQLLQDLEDLRNVSETQQSLLSDQILELKSSHKRELREREEVLCQAGASEQLASQRLERLEMEHDQERQEMMSKLLAMENIHKATCETADRERAEMSTEISRLQSKIKEMQQATSPLSMLQSGCQVIGEEEVEGDGALSLLQQGEQLLEENGDVLLSLQRAHEQAVKENVKMATEISRLQQRLQKLEPGLVMSSCLDEPATEFFGNTAEQTEPFLQQNRTKQVEGVTRRHVLSDLEDDEVRDLGSTGTSSVQRQEVKIEESEASVEGFSELENSEETRTESWELKNQISQLQEQLMMLCADCDRASEKKQDLLFDVSVLKKKLKMLERIPEASPKYKLLYEDVSRENDCLQEELRMMETRYDEALENNKELTAEVFRLQDELKKMEEVTETFLSLEKSYDEVKIENEELNVLVLRLQGKIEKLQESVVQRCDCCLWEASLENLEIEPDGNILQLNQTLEECVPRVRSVHHVIEECKQENQYLEGNTQLLEKVKAHEIAWLHGTIQTHQERPRVQNQVILEENTTLLGFQDKHFQHQATIAELELEKTKLQELTRKLKERVTILVKQKDVLSHGEKEEELKAMMHDLQITCSEMQQKVELLRYESEKLQQENSILRNEITTLNEEDSISNLKLGTLNGSQEEMWQKTETVKQENAAVQKMVENLKKQISELKIKNQQLDLENTELSQKNSQNQEKLQELNQRLTEMLCQKEKEPGNSALEEREQEKFNLKEELERCKVQSSTLVSSLEAELSEVKIQTHIVQQENHLLKDELEKMKQLHRCPDLSDFQQKISSVLSYNEKLLKEKEALSEELNSCVDKLAKSSLLEHRIATMKQEQKSWEHQSASLKSQLVASQEKVQNLEDTVQNVNLQMSRMKSDLRVTQQEKEALKQEVMSLHKQLQNAGGKSWAPEIATHPSGLHNQQKRLSWDKLDHLMNEEQQLLWQENERLQTMVQNTKAELTHSREKVRQLESNLLPKHQKHLNPSGTMNPTEQEKLSLKRECDQFQKEQSPANRKVSQMNSLEQELETIHLENEGLKKKQVKLDEQLMEMQHLRSTATPSPSPHAWDLQLLQQQACPMVPREQFLQLQRQLLQAERINQHLQEELENRTSETNTPQALLPEQRAVHADSYRRIGHL

SEQ ID NO: 810547 - protein, 146 aa, Homo sapiens
GVSCQQVARVSGPLLNGHKLTHCLLIKDCSLEAQPKYVRGGKRYGRRSLPEFQESVEEFPEVTVIEPLDEEARPSHIPAGDCSECDKAARTLGFCLKILSLGCFPVPSSCHGSFCWIPCTQACLVLQHVESRQPPSSPIFSFCILP

SEQ ID NO: 810548 - protein, 2181 aa, Homo sapiens
SRPPEPGAERAGRGRPAAAAKPGVRQRPWFPRRRRAPEPRDASAGGGLPAVRALRRDRQKVSTVGYGMDELDQDQHGRLKDLFDSFDTTGTGSLGQEELTDLCHMLSLEEVAPVLQQTLLQDNLLGRVHFDQFKEALILILSRTLSNEEHFQEPDCSLEAQPKYVRGGKRYGRRSLPEFQESVEEFPEVTVIEPLDEEARPSHIPAGDCSEHWKTQRSEEYEAEGQLRFWNPDDLNASQSGSSPPQDWIEEKLQEVCEDLGITRDGHLNRKKLVSICEQYGLQNVDGEMLEEVFHNLDPDGTMSVEDFFYGLFKNGKSLTPSASTPYRQLKRHLSMQSFDESGRRTTTSSAMTSTIGFRVFSCLDDGMGHASVERILDTWQEEGIENSQEILKALDFSLDGNINLTELTLALENELLVTKNSIHQAALASFKAEIRHLLERVDQVVREKEKLRSDLDKAEKLKSLMASEVDDHHAAIERRNEYNLRKLDEEYKERIAALKNELRKEREQILQQAGKQRLELEQEIEKAKTEENYIRDRLALSLKENSRLENELLENAEKLAEMFGDLDPSSAEFFLQEERLTQMRNEYERQCRVLQDQVDELQSELEEYRAQGRVLRLPLKNSPSEEVEANSGGIEPEHGLGSEECNPLNMSIEAELVIEQMKEQHHRDICCLRLELEDKVRHYEKQLDETVVSCKKAQENMKQRHENETHTLEKQISDLKNEIAELQGQAAVLKEAHHEATCRHEEEKKQLQVKLEEEKTHLQEKLRLQHEMELKARLTQAQASFEREREGLQSSAWTEEKVRGLTQELEQFHQEQLTSLVEKHTLEKEELRKELLEKHQRELQEGREKMETECNRRTSQIEAQFQSDCQKVTERCESALQSLEGRYRQELKDLQEQQREEKSQWEFEKDELTQECAEAQELLKETLKREKTTSLVLTQEREMLEKTYKEHLNSMVVERQQLLQDLEDLRNVSETQQSLLSDQILELKSSHKRELREREEVLCQAGASEQLASQRLERLEMEHDQERQEMMSKLLAMENIHKATCETADRERAEMSTEISRLQSKIKEMQQATSPLSMLQSGCQVIGEEEVEGDGALSLLQQGEQLLEENGDVLLSLQRAHEQAVKENVKMATEISRLQQRLQKLEPGLVMSSCLDEPATEFFGNTAEQTEPFLQQNRTKQVEGVTRRHVLSDLEDDEVRDLGSTGTSSVQRQEVKIEESEASVEGFSELENSEETRTESWELKNQISQLQEQLMMLCADCDRASEKKQDLLFDVSVLKKKLKMLERIPEASPKYKLLYEDVSRENDCLQEELRMMETRYDEALENNKELTAEVFRLQDELKKMEEVTETFLSLEKSYDEVKIENEELNVLVLRLQGKIEKLQESVVQRCDCCLWEASLENLEIEPDGNILQLNQTLEECVPRVRSVHHVIEECKQENQYLEGNTQLLEKVKAHEIAWLHGTIQTHQERPRVQNQVILEENTTLLGFQDKHFQHQATIAELELEKTKLQELTRKLKERVTILVKQKDVLSHGEKEEELKAMMHDLQITCSEMQQKVELLRYESEKLQQENSILRNEITTLNEEDSISNLKLGTLNGSQEEMWQKTETVKQENAAVQKMVENLKKQISELKIKNQQLDLENTELSQKNSQNQEKLQELNQRLTEMLCQKEKEPGNSALEEREQEKFNLKEELERCKVQSSTLVSSLEAELSEVKIQTHIVQQENHLLKDELEKMKQLHRCPDLSDFQQKISSVLSYNEKLLKEKEALSEELNSCVDKLAKSSLLEHRIATMKQEQKSWEHQSASLKSQLVASQEKVQNLEDTVQNVNLQMSRMKSDLRVTQQEKEALKQEVMSLHKQLQNAGGKSWAPEIATHPSGLHNQQKRLSWDKLDHLMNEEQQLLWQENERLQTMVQNTKAELTHSREKVRQLESNLLPKHQKHLNPSGTMNPTEQEKLSLKRECDQFQKEQSPANRKVSQMNSLEQELETIHLENEGLKKKQVKLDEQLMEMQHLRSTATPSPSPHAWDLQLLQQQACPMVPREQFLQLQRQLLQAERINQHLQEELENRTSETNTPQGNQEQLVTVMEERMIEVEQKLKLVKRLLQEKVNQLKEQLCKNTKADAMVKDLYVENAQLLKALEVTEQRQKTAEKKNYLLEEKIASLSNIVRNLTPAPLTSTPPLRS

SEQ ID NO: 810549 - protein, 2181 aa, Homo sapiens; identical to SEQ ID NO: 810548

SEQ ID NO: 810550 - protein, 2139 aa, Homo sapiens
MAEVTVPRVYVVFGIHCIMAKASSDVQVSGFHRKIQHVKNELCHMLSLEEVAPVLQQTLLQDNLLGRVHFDQFKEALILILSRTLSNEEHFQEPDCSLEAQPKYVRGGKRYGRRSLPEFQESVEEFPEVTVIEPLDEEARPSHIPAGDCSEHWKTQRSEEYEAEGQLRFWNPDDLNASQSGSSPPQDWIEEKLQEVCEDLGITRDGHLNRKKLVSICEQYGLQNVDGEMLEEVFHNLDPDGTMSVEDFFYGLFKNGKSLTPSASTPYRQLKRHLSMQSFDESGRRTTTSSAMTSTIGFRVFSCLDDGMGHASVERILDTWQEEGIENSQEILKALDFSLDGNINLTELTLALENELLVTKNSIHQAALASFKAEIRHLLERVDQVVREKEKLRSDLDKAEKLKSLMASEVDDHHAAIERRNEYNLRKLDEEYKERIAALKNELRKEREQILQQAGKQRLELEQEIEKAKTEENYIRDRLALSLKENSRLENELLENAEKLAEYENLTNKLQRNLENVLAEKFGDLDPSSAEFFLQEERLTQMRNEYERQCRVLQDQVDELQSELEEYRAQGRVLRLPLKNSPSEEVEANSGGIEPEHGLGSEECNPLNMSIEAELVIEQMKEQHHRDICCLRLELEDKVRHYEKQLDETVVSCKKAQENMKQRHENETHTLEKQISDLKNEIAELQGQAAVLKEAHHEATCRHEEEKKQLQVKLEEEKTHLQEKLRLQHEMELKARLTQAQASFEREREGLQSSAWTEEKVRGLTQELEQFHQEQLTSLVEKHTLEKEELRKELLEKHQRELQEGREKMETECNRRTSQIEAQFQSDCQKVTERCESALQSLEGRYRQELKDLQEQQREEKSQWEFEKDELTQECAEAQELLKETLKREKTTSLVLTQEREMLEKTYKEHLNSMVVERQQLLQDLEDLRNVSETQQSLLSDQILELKSSHKRELREREEVLCQAGASEQLASQRLERLEMEHDQERQEMMSKLLAMENIHKATCETADRERAEMSTEISRLQSKIKEMQQATSPLSMLQSGCQVIGEEEVEGDGALSLLQQGEQLLEENGDVLLSLQRAHEQAVKENVKMATEISRLQQRLQKLEPGLVMSSCLDEPATEFFGNTAEQTEPFLQQNRTKQVEGVTRRHVLSDLEDDEVRDLGSTGTSSVQRQEVKIEESEASVEGFSELENSEETRTESWELKNQISQLQEQLMMLCADCDRASEKKQDLLFDVSVLKKKLKMLERIPEASPKYKLLYEDVSRENDCLQEELRMMETRYDEALENNKELTAEVFRLQDELKKMEEVTETFLSLEKSYDEVKIENEELNVLVLRLQGKIEKLQESVVQRCDCCLWEASLENLEIEPDGNILQLNQTLEECVPRVRSVHHVIEECKQENQYLEGNTQLLEKVKAHEIAWLHGTIQTHQERPRVQNQVILEENTTLLGFQDKHFQHQATIAELELEKTKLQELTRKLKERVTILVKQKDVLSHGEKEEELKAMMHDLQITCSEMQQKVELLRYESEKLQQENSILRNEITTLNEEDSISNLKLGTLNGSQEEMWQKTETVKQENAAVQKMVENLKKQISELKIKNQQLDLENTELSQKNSQNQEKLQELNQRLTEMLCQKEKEPGNSALEEREQEKFNLKEELERCKVQSSTLVSSLEAELSEVKIQTHIVQQENHLLKDELEKMKQLHRCPDLSDFQQKISSVLSYNEKLLKEKEALSEELNSCVDKLAKSSLLEHRIATMKQEQKSWEHQSASLKSQLVASQEKVQNLEDTVQNVNLQMSRMKSDLRVTQQEKEALKQEVMSLHKQLQNAGGKSWAPEIATHPSGLHNQQKRLSWDKLDHLMNEEQQLLWQENERLQTMVQNTKAELTHSREKVRQLESNLLPKHQKHLNPSGTMNPTEQEKLSLKRECDQFQKEQSPANRKVSQMNSLEQELETIHLENEGLKKKQVKLDEQLMEMQHLRSTATPSPSPHAWDLQLLQQQACPMVPREQFLQLQRQLLQAERINQHLQEELENRTSETNTPQGNQEQLVTVMEERMIEVEQKLKLVKRLLQEKVNQLKEQLCKNTKADAMVKDLYVENAQLLKALEVTEQRQKTAEKKNYLLEEKIASLSNIVRNLTPAPLTSTPPLRS

SEQ ID NO: 810551 - protein, 2055 aa, Homo sapiens
MWPQLLSPLSDCSLEAQPKYVRGGKRYGRRSLPEFQESVEEFPEVTVIEPLDEEARPSHIPAGDCSEHWKTQRSEEYEAEGQLRFWNPDDLNASQSGSSPPQDWIEEKLQEVCEDLGITRDGHLNRKKLVSICEQYGLQNVDGEMLEEVFHNLDPDGTMSVEDFFYGLFKNGKSLTPSASTPYRQLKRHLSMQSFDESGRRTTTSSAMTSTIGFRVFSCLDDGMGHASVERILDTWQEEGIENSQEILKALDFSLDGNINLTELTLALENELLVTKNSIHQAALASFKAEIRHLLERVDQVVREKEKLRSDLDKAEKLKSLMASEVDDHHAAIERRNEYNLRKLDEEYKERIAALKNELRKEREQILQQAGKQRLELEQEIEKAKTEENYIRDRLALSLKENSRLENELLENAEKLAEYENLTNKLQRNLENVLAEKFGDLDPSSAEFFLQEERLTQMRNEYERQCRVLQDQVDELQSELEEYRAQGRVLRLPLKNSPSEEVEANSGGIEPEHGLGSEECNPLNMSIEAELVIEQMKEQHHRDICCLRLELEDKVRHYEKQLDETVVSCKKAQENMKQRHENETHTLEKQISDLKNEIAELQGQAAVLKEAHHEATCRHEEEKKQLQVKLEEEKTHLQEKLRLQHEMELKARLTQAQASFEREREGLQSSAWTEEKVRGLTQELEQFHQEQLTSLVEKHTLEKEELRKELLEKHQRELQEGREKMETECNRRTSQIEAQFQSDCQKVTERCESALQSLEGRYRQELKDLQEQQREEKSQWEFEKDELTQECAEAQELLKETLKREKTTSLVLTQEREMLEKTYKEHLNSMVVERQQLLQDLEDLRNVSETQQSLLSDQILELKSSHKRELREREEVLCQAGASEQLASQRLERLEMEHDQERQEMMSKLLAMENIHKATCETADRERAEMSTEISRLQSKIKEMQQATSPLSMLQSGCQVIGEEEVEGDGALSLLQQGEQLLEENGDVLLSLQRAHEQAVKENVKMATEISRLQQRLQKLEPGLVMSSCLDEPATEFFGNTAEQTEPFLQQNRTKQVEGVTRRHVLSDLEDDEVRDLGSTGTSSVQRQEVKIEESEASVEGFSELENSEETRTESWELKNQISQLQEQLMMLCADCDRASEKKQDLLFDVSVLKKKLKMLERIPEASPKYKLLYEDVSRENDCLQEELRMMETRYDEALENNKELTAEVFRLQDELKKMEEVTETFLSLEKSYDEVKIENEELNVLVLRLQGKIEKLQESVVQRCDCCLWEASLENLEIEPDGNILQLNQTLEECVPRVRSVHHVIEECKQENQYLEGNTQLLEKVKAHEIAWLHGTIQTHQERPRVQNQVILEENTTLLGFQDKHFQHQATIAELELEKTKLQELTRKLKERVTILVKQKDVLSHGEKEEELKAMMHDLQITCSEMQQKVELLRYESEKLQQENSILRNEITTLNEEDSISNLKLGTLNGSQEEMWQKTETVKQENAAVQKMVENLKKQISELKIKNQQLDLENTELSQKNSQNQEKLQELNQRLTEMLCQKEKEPGNSALEEREQEKFNLKEELERCKVQSSTLVSSLEAELSEVKIQTHIVQQENHLLKDELEKMKQLHRCPDLSDFQQKISSVLSYNEKLLKEKEALSEELNSCVDKLAKSSLLEHRIATMKQEQKSWEHQSASLKSQLVASQEKVQNLEDTVQNVNLQMSRMKSDLRVTQQEKEALKQEVMSLHKQLQNAGGKSWAPEIATHPSGLHNQQKRLSWDKLDHLMNEEQQLLWQENERLQTMVQNTKAELTHSREKVRQLESNLLPKHQKHLNPSGTMNPTEQEKLSLKRECDQFQKEQSPANRKVSQMNSLEQELETIHLENEGLKKKQVKLDEQLMEMQHLRSTATPSPSPHAWDLQLLQQQACPMVPREQFLQLQRQLLQAERINQHLQEELENRTSETNTPQGNQEQLVTVMEERMIEVEQKLKLVKRLLQEKVNQLKEQLCKNTKADAMVKDLYVENAQLLKALEVTEQRQKTAEKKNYLLEEKIASLSNIVRNLTPAPLTSTPPLRS

SEQ ID NO: 810552 - protein, 1426 aa, Homo sapiens
MAEVTVPRVYVVFGIHCIMAKASSDVQVSGFHRKIQHVKNELCHMLSLEEVAPVLQQTLLQDNLLGRVHFDQFKEALILILSRTLSNEEHFQEPDCSLEAQPKYVRGGKRYGRRSLPEFQESVEEFPEVTVIEPLDEEARPSHIPAGDCSEHWKTQRSEEYEAEGQLRFWNPDDLNASQSGSSPPQDWIEEKLQEVCEDLGITRDGHLNRKKLVSICEQYGLQNVDGEMLEEVFHNLDPDGTMSVEDFFYGLFKNGKSLTPSASTPYRQLKRHLSMQSFDESGRRTTTSSAMTSTIGFRVFSCLDDGMGHASVERILDTWQEEGIENSQEILKALDFSLDGNINLTELTLALENELLVTKNSIHQAALASFKAEIRHLLERVDQVVREKEKLRSDLDKAEKLKSLMASEVDDHHAAIERRNEYNLRKLDEEYKERIAALKNELRKEREQILQQAGKQRLELEQEIEKAKTEENYIRDRLALSLKENSRLENELLENAEKLAEYENLTNKLQRNLENVLAEKFGDLDPSSAEFFLQEERLTQMRNEYERQCRVLQDQVDELQSELEEYRAQGRVLRLPLKNSPSEEVEANSGGIEPEHGLGSEECNPLNMSIEAELVIEQMKEQHHRDICCLRLELEDKVRHYEKQLDETVVSCKKAQENMKQRHENETHTLEKQISDLKNEIAELQGQAAVLKEAHHEATCRHEEEKKQLQVKLEEEKTHLQEKLRLQHEMELKARLTQAQASFEREREGLQSSAWTEEKVRGLTQELEQFHQEQLTSLVEKHTLEKEELRKELLEKHQRELQEGRYESEKLQQENSILRNEITTLNEEDSISNLKLGTLNGSQEEMWQKTETVKQENAAVQKMVENLKKQISELKIKNQQLDLENTELSQKNSQNQEKLQELNQRLTEMLCQKEKEPGNSALEEREQEKFNLKEELERCKVQSSTLVSSLEAELSEVKIQTHIVQQENHLLKDELEKMKQLHRCPDLSDFQQKISSVLSYNEKLLKEKEALSEELNSCVDKLAKSSLLEHRIATMKQEQKSWEHQSASLKSQLVASQEKVQNLEDTVQNVNLQMSRMKSDLRVTQQEKEALKQEVMSLHKQLQNAGGKSWAPEIATHPSGLHNQQKRLSWDKLDHLMNEEQQLLWQENERLQTMVQNTKAELTHSREKVRQLESNLLPKHQKHLNPSGTMNPTEQEKLSLKRECDQFQKEQSPANRKVSQMNSLEQELETIHLENEGLKKKQVKLDEQLMEMQHLRSTATPSPSPHAWDLQLLQQQACPMVPREQFLQLQRQLLQAERINQHLQEELENRTSETNTPQGNQEQLVTVMEERMIEVEQKLKLVKRLLQEKVNQLKEQLCKNTKADAMVKDLYVENAQLLKALEVTEQRQKTAEKKNYLLEEKIASLSNIVRNLTPAPLTSTPPLRS

SEQ ID NO: 810553 - protein, 2159 aa, Homo sapiens
MAEVTVPRVYVVFGIHCIMAKASSDVQVSGFHRKIQHVKNELCHMLSLEEVAPVLQQTLLQDNLLGRVHFDQFKEALILILSRTLSNEEHFQEPDCSLEAQPKYVRGGKRYGRRSLPEFQESVEEFPEVTVIEPLDEEARPSHIPAGDCSEHWKTQRSEEYEAEGQLRFWNPDDLNASQSGSSPPQDWIEEKLQEVCEDLGITRDGHLNRKKLVSICEQYGLQNVDGEMLEEVFHNLDPDGTMSVEDFFYGLFKNGKSLTPSASTPYRQLKRHLSMQSFDESGRRTTTSSAMTSTIGFRVFSCLDDGMGHASVERILDTWQEEGIENSQEILKALDFSLDGNINLTELTLALENELLVTKNSIHQAALASFKAEIRHLLERVDQVVREKEKLRSDLDKAEKLKSLMASEVDDHHAAIERRNEYNLRKLDEEYKERIAALKNELRKEREQILQQAGKQRLELEQEIEKAKTEENYIRDRLALSLKENSRLENELLENAEKLAEYENLTNKLQRNLENVLAEKFGDLDPSSAEFFLQEERLTQMRNEYERQCRVLQDQVDELQSELEEYRAQGRVLRLPLKNSPSEEVEANSGGIEPEHGLGSEECNPLNMSIEAELVIEQMKEQHHRDICCLRLELEDKVRHYEKQLDETVVSCKKAQENMKQRHENETHTLEKQISDLKNEIAELQGQAAVLKEAHHEATCRHEEEKKQLQVKLEEEKTHLQEKLRLQHEMELKARLTQAQASFEREREGLQSSAWTEEKVRGLTQELEQFHQEQLTSLVEKHTLEKEELRKELLEKHQRELQEGREKMETECNRRTSQIEAQFQSDCQKVTERCESALQSLEGRYRQELKDLQEQQREEKSQWEFEKDELTQECAEAQELLKETLKREKTTSLVLTQEREMLEKTYKEHLNSMVVERQQLLQDLEDLRNVSETQQSLLSDQILELKSSHKRELREREEVLCQAGASEQLASQRLERLEMEHDQERQEMMSKLLAMENIHKATCETADRERAEMSTEISRLQSKIKEMQQATSPLSMLQSGCQVIGEEEVEGDGALSLLQQGEQLLEENGDVLLSLQRAHEQAVKENVKMATEISRLQQRLQKLEPGLVMSSCLDEPATEFFGNTAEQTEPFLQQNRTKQVEGVTRRHVLSDLEDDEVRDLGSTGTSSVQRQEVKIEESEASVEGFSELENSEETRTESWELKNQISQLQEQLMMLCADCDRASEKKQDLLFDVSVLKKKLKMLERIPEASPKYKLLYEDVSRENDCLQEELRMMETRYDEALENNKELTAEVFRLQDELKKMEEVTETFLSLEKSYDEVKIENEELNVLVLRLQGKIEKLQESVVQRCDCCLWEASLENLEIEPDGNILQLNQTLEECVPRVRSVHHVIEECKQENQYLEGNTQLLEKVKAHEIAWLHGTIQTHQERPRVQNQVILEENTTLLGFQDKHFQHQATIAELELEKTKLQELTRKLKERVTILVKQKDVLSHGEKEEELKAMMHDLQITCSEMQQKVELLRYESEKLQQENSILRNEITTLNEEDSISNLKLGTLNGSQEEMWQKTETVKQENAAVQKMVENLKKQISELKIKNQQLDLENTELSQKNSQNQEKLQELNQRLTEMLCQKEKEPGNSALEEREQEKFNLKEELERCKVQSSTLVSSLEAELSEVKIQTHIVQQENHLLKDELEKMKQLHRCPDLSDFQQKISSVLSYNEKLLKEKEALSEELNSCVDKLAKSSLLEHRIATMKQEQKSWEHQSASLKSQLVASQEKVQNLEDTVQNVNLQMSRMKSDLRVTQQEKEALKQEVMSLHKQLQNAGGKSWAPEIATHPSGLHNQQKRLSWDKLDHLMNEEQQLLWQENERLQTMVQNTKAELTHSREKVRQLESNLLPKHQKHLNPSGTMNPTEQEKLSLKRECDQFQKEQSPANRKVSQMNSLEQELETIHLENEGLKKKQVKLDEQLMENSVVGSSREGCSSLPEMCVKMQHLRSTATPSPSPHAWDLQLLQQQACPMVPREQFLQLQRQLLQAERINQHLQEELENRTSETNTPQGNQEQLVTVMEERMIEVEQKLKLVKRLLQEKVNQLKEQLCKNTKADAMVKDLYVENAQLLKALEVTEQRQKTAEKKNYLLEEKIASLSNIVRNLTPAPLTSTPPLRS

SEQ ID NO: 810554 - protein, 2156 aa, Homo sapiens
SRPPEPGAERAGRGRPAAAAKPGVRQRPWFPRRRRAPEPRDASAGGGLPAVRALRRDRQKVSTVGYGMDELDQDQHGRLKDLFDSFDTTGTGSLGQEELTDLCHMLSLEEVAPVLQQTLLQDNLLGRVHFDQFKEALILILSRTLSNEEHFQEPDCSLEAQPKYVRGGKRYGRRSLPEFQESVEEFPEVTVIEPLDEEARPSHIPAGDCSEHWKTQRSEEYEAEGQLRFWNPDDLNASQSGSSPPQDWIEEKLQEVCEDLGITRDGHLNRKKLVSICEQYGLQNVDGEMLEEVFHNLDPDGTMSVEDFFYGLFKNGKSLTPSASTPYRQLKRHLSMQSFDESGRRTTTSSAMTSTIGFRVFSCLDDGMGHASVERILDTWQEEGIENSQEILKALDFSLDGNINLTELTLALENELLVTKNSIHQAALASFKAEIRHLLERVDQVVREKEKLRSDLDKAEKLKSLMASEVDDHHAAIERRNEYNLRKLDEEYKERIAALKNELRKEREQILQQAGKQRLELEQEIEKAKTEENYIRDRLALSLKENSRLENELLENAEKLAEYENLTNKLQRNLENVLAEKFGDLDPSSAEFFLQEERLTQMRNEYERQCRVLQDQVDELQSELEEYRAQGRVLRLPLKNSPSEEVEANSGGIEPEHGLGSEECNPLNMSIEAELVIEQMKEQHHRDICCLRLELEDKVRHYEKQLDETVVSCKKAQENMKQRHENETHTLEKQISDLKNEIAELQGQAAVLKEAHHEATCRHEEEKKQLQVKLEEEKTHLQEKLRLQHEMELKARLTQAQASFEREREGLQSSAWTEEKVRGLTQELEQFHQEQLTSLVEKHTLEKEELRKELLEKHQRELQEGREKMETECNRRTSQIEAQFQSDCQKVTERCESALQSLEGRYRQELKDLQEQQREEKSQWEFEKDELTQECAEAQELLKETLKREKTTSLVLTQEREMLEKTYKEHLNSMVVERQQLLQDLEDLRNVSETQQSLLSDQILELKSSHKRELREREEVLCQAGASEQLASQRLERLEMEHDQERQEMMSKLLAMENIHKATCETADRERAEMSTEISRLQSKIKEMQQATSPLSMLQSGCQVIGEEEVEGDGALSLLQQGEQLLEENGDVLLSLQRAHEQAVKENVKMATEISRLQQRLQKLEPGLVMSSCLDEPATEFFGNTAEQTEPFLQQNRTKQVEGVTRRHVLSDLEDDEVRDLGSTGTSSVQRQEVKIEESEASVEGFSELENSEETRTESWELKNQISQLQEQLMMLCADCDRASEKKQDLLFDVSVLKKKLKMLERIPEASPKYKLLYEDVSRENDCLQEELRMMETRYDEALENNKELTAEVFRLQDELKKMEEVTETFLSLEKSYDEVKIENEELNVLVLRLQGKIEKLQESVVQRCDCCLWEASLENLEIEPDGNILQLNQTLEECVPRVRSVHHVIEECKQENQYLEGNTQLLEKVKAHEIAWLHGTIQTHQERPRVQNQVILEENTTLLGFQDKHFQHQATIAELELEKTKLQELTRKLKERVTILVKQKDVLSHGEKEEELKAMMHDLQITCSEMQQKVELLRYESEKLQQENSILRNEITTLNEEDSISNLKLGTLNGSQEEMWQKTETVKQENAAVQKMVENLKKQISELKIKNQQLDLENTELSQKNSQNQEKLQELNQRLTEMLCQKEKEPGNSALEEREQEKFNLKEELERCKVQSSTLVSSLEAELSEVKIQTHIVQQENHLLKDELEKMKQLHRCPDLSDFQQKISSVLSYNEKLLKEKEALSEELNSCVDKLAKSSLLEHRIATMKQEQKSWEHQSASLKSQLVASQEKVQNLEDTVQNVNLQMSRMKSDLRVTQQEKEALKQEVMSLHKQLQNAGGKSWAPEIATHPSGLHNQQKRLSWDKLDHLMNEEQQLLWQENERLQTMVQNTKAELTHSREKVRQLESNLLPKHQKHLNPSGTMNPTEQEKLSLKRECDQFQKEQSPANRKVSQMNSLEQELETIHLENEGLKKKQVKLDEQLMEMQHLRSTATPSPSPHAWDLQLLQQQACPMVPREQFLQLQRQLLQAERINQHLQEELENRTSETNTPQGNQEQLVTVMEERMIEVEQKLKLVKRLLQEKVNQLKEQVSLPGHLCSPTSHSSFNSSFTSLYCH

SEQ ID NO: 810555 - protein, 521 aa, Homo sapiens
LKGSDRIVVIAVPRVTLHMEREQEKFNLKEELERCKVQSSTLVSSLEAELSEVKIQTHIVQQENHLLKDELEKMKQLHRCPDLSDFQQKISSVLSYNEKLLKEKEALSEELNSCVDKLAKSSLLEHRIATMKQEQKSWEHQSASLKSQLVASQEKVQNLEDTVQNVNLQMSRMKSDLRVTQQEKEALKQEVMSLHKQLQNAGGKSWAPEIATHPSGLHNQQKRLSWDKLDHLMNEEQQLLWQENERLQTMVQNTKAELTHSREKVRQLESNLLPKHQKHLNPSGTMNPTEQEKLSLKRECDQFQKEQSPANRKVSQMNSLEQELETIHLENEGLKKKQVKLDEQLMEMQHLRSTATPSPSPHAWDLQLLQQQACPMVPREQFLQLQRQLLQAERINQHLQEELENRTSETNTPQGNQEQLVTVMEERMIEVEQKLKLVKRLLQEKVNQLKEQLCKNTKADAMVKDLYVENAQLLKALEVTEQRQKTAEKKNYLLEEKIASLSNIVRNLTPAPLTSTPPLRS

SEQ ID NO: 810556 - protein, 341 aa, Homo sapiens
MTPVSNQQLPNSLFLRLTLCNSLKSWAPEIATHPSGLHNQQKRLSWDKLDHLMNEEQQLLWQENERLQTMVQNTKAELTHSREKVRQLESNLLPKHQKHLNPSGTMNPTEQEKLSLKRECDQFQKEQSPANRKVSQMNSLEQELETIHLENEGLKKKQVKLDEQLMEMQHLRSTATPSPSPHAWDLQLLQQQACPMVPREQFLQLQRQLLQAERINQHLQEELENRTSETNTPQGNQEQLVTVMEERMIEVEQKLKLVKRLLQEKVNQLKEQLCKNTKADAMVKDLYVENAQLLKALEVTEQRQKTAEKKNYLLEEKIASLSNIVRNLTPAPLTSTPPLRS

SEQ ID NO: 810557 - protein, 391 aa, Homo sapiens [sequence omitted]

SEQ ID NO: 810558 - protein, 1790 aa, Homo sapiens
MAEVTVPRVYVVFGIHCIMAKASSDVQVSGFHRKIQHVKNELCHMLSLEEVAPVLQQTLLQDNLLGRVHFDQFKEALILILSRTLSNEEHFQEPDCSLEAQPKYVRGGKRYGRRSLPEFQESVEEFPEVTVIEPLDEEARPSHIPAGDCSEHWKTQRSEEYEAEGQLRFWNPDDLNASQSGSSPPQDWIEEKLQEVCEDLGITRDGHLNRKKLVSICEQYGLQNVDGEMLEEVFHNLDPDGTMSVEDFFYGLFKNGKSLTPSASTPYRQLKRHLSMQSFDESGRRTTTSSAMTSTIGFRVFSCLDDGMGHASVERILDTWQEEGIENSQEILKALDFSLDGNINLTELTLALENELLVTKNSIHQAALASFKAEIRHLLERVDQVVREKEKLRSDLDKAEKLKSLMASEVDDHHAAIERRNEYNLRKLDEEYKERIAALKNELRKEREQILQQAGKQRLELEQEIEKAKTEENYIRDRLALSLKENSRLENELLENAEKLAEYENLTNKLQRNLENVLAEKFGDLDPSSAEFFLQEERLTQMRNEYERQCRVLQDQVDELQSELEEYRAQGRVLRLPLKNSPSEEVEANSGGIEPEHGLGSEECNPLNMSIEAELVIEQMKEQHHRDICCLRLELEDKVRHYEKQLDETVVSCKKAQENMKQRHENETHTLEKQISDLKNEIAELQGQAAVLKEAHHEATCRHEEEKKQLQVKLEEEKTHLQEKLRLQHEMELKARLTQAQASFEREREGLQSSAWTEEKVRGLTQELEQFHQEQLTSLVEKHTLEKEELRKELLEKHQRELQEGREKMETECNRRTSQIEAQFQSDCQKVTERCESALQSLEGRYRQELKDLQEQQREEKSQWEFEKDELTQECAEAQELLKETLKREKTTSLVLTQEREMLEKTYKEHLNSMVVERQQLLQDLEDLRNVSETQQSLLSDQILELKSSHKRELREREEVLCQAGASEQLASQRLERLEMEHDQERQEMMSKLLAMENIHKATCETADRERAEMSTEISRLQSKIKEMQQATSPLSMLQSGCQVIGEEEVEGDGALSLLQQGEQLLEENGDVLLSLQRAHEQAVKENVKMATEISRLQQRLQKLEPGLVMSSCLDEPATEFFGNTAEQTEPFLQQNRTKQVEGVTRRHVLSDLEDDEVRDLGSTGTSSVQRQEVKIEESEASVEGFSELENSEETRTESWELKNQISQLQEQLMMLCADCDRASEKKQDLLFDVSVLKKKLKMLERIPEASPKYKLLYEDVSRENDCLQEELRMMETRYDEALENNKELTAEVFRLQDELKKMEEVTETFLSLEKSYDEVKIENEELNVLVLRLQGKIEKLQESVVQRCDCCLWEASLENLEIEPDGNILQLNQTLEECVPRVRSVHHVIEECKQENQYLEGNTQLLEKVKAHEIAWLHGTIQTHQERPRVQNQVILEENTTLLGFQDKHFQHQATIAELELEKTKLQELTRKLKERVTILVKQKDVLSHGEKEEELKAMMHDLQITCSEMQQKVELLRYESEKLQQENSILRNEITTLNEEDSISNLKLGTLNGSQEEMWQKTETVKQENAAVQKMVENLKKQISELKIKNQQLDLENTELSQKNSQNQEKLQELNQRLTEMLCQKEKEPGNSALEEREQEKFNLKEELERCKVQSSTLVSSLEAELSEVKIQTHIVQQENHLLKDELEKMKQLHRCPDLSDFQQKISSVLSYNEKLLKEKEALSEELNSCVDKLAKSSLLEHRIATMKQEQKSWEHQSASLKSQLVASQEKVHELLVIFTYGMSRAYV

SEQ ID NO: 810559 - protein, 1662 aa, Homo sapiens
MAEVTVPRVYVVFGIHCIMAKASSDVQVSGFHRKIQHVKNELCHMLSLEEVAPVLQQTLLQDNLLGRVHFDQFKEALILILSRTLSNEEHFQEPDCSLEAQPKYVRGGKRYGRRSLPEFQESVEEFPEVTVIEPLDEEARPSHIPAGDCSEHWKTQRSEEYEAEGQLRFWNPDDLNASQSGSSPPQDWIEEKLQEVCEDLGITRDGHLNRKKLVSICEQYGLQNVDGEMLEEVFHNLDPDGTMSVEDFFYGLFKNGKSLTPSASTPYRQLKRHLSMQSFDESGRRTTTSSAMTSTIGFRVFSCLDDGMGHASVERILDTWQEEGIENSQEILKALDFSLDGNINLTELTLALENELLVTKNSIHQAALASFKAEIRHLLERVDQVVREKEKLRSDLDKAEKLKSLMASEVDDHHAAIERRNEYNLRKLDEEYKERIAALKNELRKEREQILQQAGKQRLELEQEIEKAKTEENYIRDRLALSLKENSRLENELLENAEKLAEYENLTNKLQRNLENVLAEKFGDLDPSSAEFFLQEERLTQMRNEYERQCRVLQDQVDELQSELEEYRAQGRVLRLPLKNSPSEEVEANSGGIEPEHGLGSEECNPLNMSIEAELVIEQMKEQHHRDICCLRLELEDKVRHYEKQLDETVVSCKKAQENMKQRHENETHTLEKQISDLKNEIAELQGQAAVLKEAHHEATCRHEEEKKQLQVKLEEEKTHLQEKLRLQHEMELKARLTQAQASFEREREGLQSSAWTEEKVRGLTQELEQFHQEQLTSLVEKHTLEKEELRKELLEKHQRELQEGREKMETECNRRTSQIEAQFQSDCQKVTERCESALQSLEGRYRQELKDLQEQQREEKSQWEFEKDELTQECAEAQELLKETLKREKTTSLVLTQEREMLEKTYKEHLNSMVVERQQLLQDLEDLRNVSETQQSLLSDQILELKSSHKRELREREEVLCQAGASEQLASQRLERLEMEHDQERQEMMSKLLAMENIHKATCETADRERAEMSTEISRLQSKIKEMQQATSPLSMLQSGCQVIGEEEVEGDGALSLLQQGEQLLEENGDVLLSLQRAHEQAVKENVKMATEISRLQQRLQKLEPGLVMSSCLDEPATEFFGNTAEQTEPFLQQNRTKQVEGVTRRHVLSDLEDDEVRDLGSTGTSSVQRQEVKIEESEASVEGFSELENSEETRTESWELKNQISQLQEQLMMLCADCDRASEKKQDLLFDVSVLKKKLKMLERIPEASPKYKLLYEDVSRENDCLQEELRMMETRYDEALENNKELTAEVFRLQDELKKMEEVTETFLSLEKSYDEVKIENEELNVLVLRLQGKIEKLQESVVQRCDCCLWEASLENLEIEPDGNILQLNQTLEECVPRVRSVHHVIEECKQENQYLEGNTQLLEKVKAHEIAWLHGTIQTHQERPRVQNQVILEENTTLLGFQDKHFQHQATIAELELEKTKLQELTRKLKERVTILVKQKDVLSHGEKEEELKAMMHDLQITCSEMQQKVELLRYESEKLQQENSILRNEITTLNEEDSISNLKLGTLNGSQEEMWQKTETVKQENAAVQKMVENLKKQISELKIKNQQLDLENTELSQKNSQNQEKLQELNQRLTEMLCQKEKEPGNSALEEREQEKFNLKEELERCKVQVWPVAT

SEQ ID NO: 810560 - protein, 606 aa, Homo sapiens
MAEVTVPRVYVVFGIHCIMAKASSDVQVSGFHRKIQHVKNELCHMLSLEEVAPVLQQTLLQDNLLGRVHFDQFKEALILILSRTLSNEEHFQEPDCSLEAQPKYVRGGKRYGRRSLPEFQESVEEFPEVTVIEPLDEEARPSHIPAGDCSEHWKTQRSEEYEAEGQLRFWNPDDLNASQSGSSPPQDWIEEKLQEVCEDLGITRDGHLNRKKLVSICEQYGLQNVDGEMLEEVFHNLDPDGTMSVEDFFYGLFKNGKSLTPSASTPYRQLKRHLSMQSFDESGRRTTTSSAMTSTIGFRVFSCLDDGMGHASVERILDTWQEEGIENSQEILKALDFSLDGNINLTELTLALENELLVTKNSIHQAALASFKAEIRHLLERVDQVVREKEKLRSDLDKAEKLKSLMASEVDDHHAAIERRNEYNLRKLDEEYKERIAALKNELRKEREQILQQAGKQRLELEQEIEKAKTEENYIRDRLALSLKENSRLENELLENAEKLAEYENLTNKLQRNLENVLAEKFGDLDPSSAEFFLQEERLTQMRNEYERQCRVLQDQVDELQSELEEYRAQGRVLRLPLKNSPSEEVEANSGGIEPEHGKHIRTGCR

SEQ ID NO: 810561 - protein, 155 aa, Homo sapiens
MAEVTVPRVYVVFGIHCIMAKASSDVQVSGFHRKIQHVKNELCHMLSLEEVAPVLQQTLLQDNLLGRVHFDQFKEALILILSRTLSNEEHFQEPDCSLEAQPKYVRGGKRYGRRSLPEFQESVEEFPEVTVIEPLDEEARPSHIPAGDCSELLES

SEQ ID NO: 810562 - protein, 330 aa, Homo sapiens
MEKNSMDIMKIREYFQKYGYSPRVKKNSVHEQEAINSDPELSNCENFQKTDVKDDLSDPPVASSCISEKSPRSPQLSDFGLERYIVSQVLPNPPQAVNNYKEEPVIVTPPTKQSLVKVLKTPKCALKMDDFECVTPKLEHFGISEYTMCLNEDYTMGLKNARNNKSEEAIDTESRLNDNVFATPSPIIQQLEKSDAEYTNSPLVPTFCTPGLKIPSTKNSIALVSTNYPLSKTNSSSNDLEVEDRTSLVLNSDTCFENLTDPSSPTISSYENLLRTPTPPEVTKIPEDILQLLSKYNSNLATPIAIKAVPPSKRFLKHGQNIRDVSNKEN

SEQ ID NO: 810563 - protein, 269 aa, Homo sapiens
MRILYDLHSEVQTLKDDVNILLDKARLENQEGIDFIKATKVLMEKNSMDIMKIREYFQKYGYSPRVKKNSVHEQEAINSDPELSNCENFQKTDVKDDLSDPPVASSCISEKSPRSPQLSDFGLERYIVSQVLPNPPQAVNNYKEEPVIVTPPTKQSLVKVLKTPKCALKMDDFECVTPKLEHFGISEYTMCLNEDYTMGLKNARNNKSEEAIDTESRLNDNVFATPSPIIQQLEKSGGEYPTLLVLHTGPVEIQLKKYSGFHSIMKHVY

SEQ ID NO: 810564 - protein, 412 aa, Homo sapiens
MDPIRSFCGKLRSLASTLDCETARLQRALDGEESDFEDYPMRILYDLHSEVQTLKDDVNILLDKARLENQEGIDFIKATKVLMEKNSMDIMKIREYFQKYGYSPRVKKNSVHEQEAINSDPELSNCENFQKTDVKDDLSDPPVASSCISEKSPRSPQLSDFGLERYIVSQVLPNPPQAVNNYKEEPVIVTPPTKQSLVKVLKTPKCALKMDDFECVTPKLEHFGISEYTMCLNEDYTMGLKNARNNKSEEAIDTESRLNDNVFATPSPIIQQLEKSDAEYTNSPLVPTFCTPGLKIPSTKNSIALVSTNYPLSKTNSSSNDLEVEDRTSLVLNSDTCFENLTDPSSPTISSYENLLRTPTPPEVTKIPEDILQLLSKYNSNLATPIAIKAVPPSKRFLKHGQNIRDVSNKEN

SEQ ID NO: 810565 - protein, 372 aa, Homo sapiens
MRILYDLHSEVQTLKDDVNILLDKARLENQEGIDFIKATKVLMEKNSMDIMKIREYFQKYGYSPRVKKNSVHEQEAINSDPELSNCENFQKTDVKDDLSDPPVASSCISEKSPRSPQLSDFGLERYIVSQVLPNPPQAVNNYKEEPVIVTPPTKQSLVKVLKTPKCALKMDDFECVTPKLEHFGISEYTMCLNEDYTMGLKNARNNKSEEAIDTESRLNDNVFATPSPIIQQLEKSDAEYTNSPLVPTFCTPGLKIPSTKNSIALVSTNYPLSKTNSSSNDLEVEDRTSLVLNSDTCFENLTDPSSPTISSYENLLRTPTPPEVTKIPEDILQLLSKYNSNLATPIAIKAVPPSKRFLKHGQNIRDVSNKEN

SEQ ID NO: 810566 - protein, 388 aa, Homo sapiens
MDPIRSFCGKLRSLASTLDCETARLQRALDGEESDFEDYPMRILYDLHSEVQTLKDDVNILLDKARLENQEGIDFIKATKVLMEKNSMDIMKIREYFQKYGYSPRVKKNSVHEQEAINSDPELSNCENFQKTDVKDDLSDPPVASSCISEKSPRSPQLSDFGLERYIVSQVLPNPPQAVNNYKEEPVIVTPPTKQSLVKVLKTPKCALKMDDFECVTPKLEHFGISEYTMCLNEDYTMGLKNARNNKSEEAIDTESRLNDNVFATPSPIIQQLEKSDAEYTNSPLVPTFCTPGLKIPSTKNSIALVSTNYPLSKTNSSSNDLEVEDRTSLVLNSDTCFENLTDPSSPTISSYENLLRTPTPPEVTKIPEDILQKFQWIYPTQKLNKMR

SEQ ID NO: 810567 - protein, 119 aa, Homo sapiens
AAASRRRGVSAPVSRGLLGPRRETSALAREDCACAEPRTRPAPRFKLVAGGCELSGGVCVRLESFPAVLSMDPIRSFCGKLRSLASTLDCETARLQRALDGEESAFIKIQLKPSYSNSN

SEQ ID NO: 810568 - protein, 309 aa, Homo sapiens
MDPIRSFCGKLRSLASTLDCETARLQRALDGEESDFEDYPMRILYDLHSEVQTLKDDVNILLDKARLENQEGIDFIKATKVLMEKNSMDIMKIREYFQKYGYSPRVKKNSVHEQEAINSDPELSNCENFQKTDVKDDLSDPPVASSCISEKSPRSPQLSDFGLERYIVSQVLPNPPQAVNNYKEEPVIVTPPTKQSLVKVLKTPKCALKMDDFECVTPKLEHFGISEYTMCLNEDYTMGLKNARNNKSEEAIDTESRLNDNVFATPSPIIQQLEKSDDEYPTLLVLHTGPVEIQLKKYSGFHSIMKHVY

SEQ ID NO: 810569 - protein, 437 aa, Homo sapiens
MLQGPRALASAAGQTPKVVPAMSPTELWPSGLSSPQLCPATATYYTPLYPQTAPPAAAPGTCLDATPHGPEGQVVRCLPAGRLPAKRKLDLEGIGRPVVPEFPTPKGKCIRVDGLPSPKTPKSPGEKTRYDTSLGLLTKKFIYLLSESEDGVLDLNWAAEVLDVQKRRIYDITNVLEGIQLIRKKAKNNIQWVGRGMFEDPTRPGKQQQLGQELKELMNTEQALDQLIQSCSLSFKHLTEDKANKRLAYVTYQDIRAVGNFKEQTVIAVKAPPQTRLEVPDRTEDNLQIYLKSTQGPIEVYLCPEEVQEPDSPSEEPLPSTSTLCPSPDSAQPSSSTDPSIMEPTASSVPAPAPTPQQAPPPPSLVPLEATDSLLELPHPLLQQTEDQFLSPTLACSSPLISFSPSLDQDDYLWGLEAGEGISDLFDSYDLGDLLIN

SEQ ID NO: 810570 - protein, 225 aa, Homo sapiens
MFRGLGEVGEGAPWQVWGLNFDQTVTFLDSPALTLAYVTYQDIRAVGNFKEQTVIAVKAPPQTRLEVPDRTEDNLQIYLKSTQGPIEVYLCPEEVQEPDSPSEEPLPSTSTLCPSPDSAQPSSSTDPSIMEPTASSVPAPAPTPQQAPPPPSLVPLEATDSLLELPHPLLQQTEDQFLSPTLACSSPLISFSPSLDQDDYLWGLEAGEGISDLFDSYDLGDLLIN

SEQ ID NO: 810571 - protein, 473 aa, Homo sapiens
MAPPAARLALLSAAALTLAARPAPSPGLGPECFTANGADYRGTQNWTALQGGKPCLFWNETFQHPYNTLKYPNGEGGLGEHNYCRNPDGDVSPWCYVAEHEDGVYWKYCEIPACQMPGNLGCYKDHGNPPPLTGTSKTSNKLTIQTCISFCRSQRFKFAGMESGYACFCGNNPDYWKYGEAASTECNSVCFGDHTQPCGGDGRIILFDTLVGACGGNYSAMSSVVYSPDFPDTYATGRVCYWTIRVPGASHIHFSFPLFDIRDSADMVELLDGYTHRVLARFHGRSRPPLSFNVSLDFVILYFFSDRINQAQGFAVLYQAVKEELPQERPAVNQTVAEVITEQANLSVSAARSSKVLYVITTSPSHPPQTVPGSNSWAPPMGAGSHRVEGWTVYGLATLLILTVTAIVAKILLHVTFKSHRVPASGDLRDCHQPGTSGEIWSIFYKPSTSISIFKKKLKGQSQQDDRNPLVSD

SEQ ID NO: 810572 - protein, 473 aa, Homo sapiens; identical to SEQ ID NO: 810571

SEQ ID NO: 810573 - protein, 456 aa, Homo sapiens
MAPPAARLALLSAAALTLAARPAPSPGLGPECFTANGADYRGTQNWTALQGGKPCLFWNETFQHPYNTLKYPNGEGGLGEHNYCRNPDGDVSPWCYVAEHEDGVYWKYCEIPACQMPGNLGCYKDHGNPPPLTGTSKTSNKLTIQTCISFCRSQRFKFAGMESGYACFCGNNPDYWKYGEAASTECNSVCFGDHTQPCGGDGRIILFDTLVGACGGNYSAMSSVVYSPDFPDTYATGRVCYWTIRVPGASHIHFSFPLFDIRDSADMVELLDGYTHRVLARFHGRSRPPLSFNVSLDFVILYFFSDRINQAQGFAVLYQAVKEELPQERPAVNQTVAEVITEQANLSVSAARSSKVLYVITTSPSHPPQTVPGWTVYGLATLLILTVTAIVAKILLHVTFKSHRVPASGDLRDCHQPGTSGEIWSIFYKPSTSISIFKKKLKGQSQQDDRNPLVSD

SEQ ID NO: 810574 - protein, 906 aa, Homo sapiens
ARGGASTGPMERAGATSRGGQAPGFLLRLHTEGRAEAARVQEQDLRQWGLTGIHLRSYQLEGVNWLAQRFHCQNGCILGDEMGLGKTCQTIALFIYLAGRLNDEGPFLILCPLSVLSNWKEEMQRFAPGLSCVTYAGDKEERACLQQDLKQESRFHVLLTTYEICLKDASFLKSFPWSVLVVDEAHRLKNQSSLLHKTLSEFSVVFSLLLTGTPIQNSLQELYSLLSFVEPDLFSKEEVGDFIQRYQDIEKESESASELHKLLQPFLLRRVKAEVATELPKKTEVVIYHGMSALQKKYYKAILMKDLDAFENETAKKVKLQNILSQLRKCVDHPYLFDGVEPEPFEVGDHLTEASGKLHLLDKLLAFLYSGGHRVLLFSQMTQMLDILQDYMDYRGYSYERVDGSVRGEERHLAIKNFGQQPIFVFLLSTRAGGVGMNLTAADTVIFVDSDFNPQNDLQAAARAHRIGQNKSVKVIRLIGRDTVEEIVYRKAASKLQLTNMIIEGGHFTLGAQKPAADADLQLSEILKFGLDKLLASEGSTMDEIDLESILGETKDGQWVSDALPAAEGGSRDQEEGKNHMYLFEGKDYSKEPSKEDRKSFEQLVNLQKTLLEKASQEGRSLRNKGSVLIPGLVEGSTKRKRVLSPEELEDRQKKRQEAAAKRRRLIEEKKRQKEEAEHKKKMAWWESNNYQSFCLPSEESEPEDLENGEESSAELDYQDPDATSLKYVSGDVTHPQAGAEDALIVHCVDDSGHWGRGGLFTALEKRSAEPRKIYELAGKMKDLSLGGVLLFPVDDKESRNKGQDLLALIVAQHRDRSNVLSGIKMAALEEGLKKIFLAAKKKKASVHLPRIGHATKGFNWYGTERLIRKHLAARGIPTYIYYFPRSKSAVLHSQSSSSSSRQLVP

SEQ ID NO: 810575 - protein, 784 aa, Homo sapiens
MQRFAPGLSCVTYAGDKEERACLQQDLKQESRFHVLLTTYEICLKDASFLKSFPWSVLVVDEAHRLKNQSSLLHKTLSEFSVVFSLLLTGTPIQNSLQELYSLLSFVEPDLFSKEEVGDFIQRYQDIEKESESASELHKLLQPFLLRRVKAEVATELPKKTEVVIYHGMSALQKKYYKAILMKDLDAFENETAKKVKLQNILSQLRKCVDHPYLFDGVEPEPFEVGDHLTEASGKLHLLDKLLAFLYSGGHRVLLFSQMTQMLDILQDYMDYRGYSYERVDGSVRGEERHLAIKNFGQQPIFVFLLSTRAGGVGMNLTAADTVIFVDSDFNPQNDLQAAARAHRIGQNKSVKVIRLIGRDTVEEIVYRKAASKLQLTNMIIEGGHFTLGAQKPAADADLQLSEILKFGLDKLLASEGSTMDEIDLESILGETKDGQWVSDALPAAEGGSRDQEEGKNHMYLFEGKDYSKEPSKEDRKSFEQLVNLQKTLLEKASQEGRSLRNKGSVLIPGLVEGSTKRKRVLSPEELEDRQKKRQEAAAKRRRLIEEKKRQKEEAEHKKKMAWWESNNYQSFCLPSEESEPEDLENGEESSAELDYQDPDATSLKYVSGDVTHPQAGAEDALIVHCVDDSGHWGRGGLFTALEKRSAEPRKIYELAGKMKDLSLGGVLLFPVDDKESRNKGQDLLALIVAQHRDRSNVLSGIKMAALEEGLKKIFLAAKKKKASVHLPRIGHATKGFNWYGTERLIRKHLAARGIPTYIYYFPRSKSAVLHSQSSSSSSRQLVP

SEQ ID NO: 810576 - protein, 139 aa, Homo sapiens
SELGVLYVAPFCFTSDLSLGGVLLFPVDDKESRNKGQDLLALIVAQHRDRSNVLSGIKMAALEEGLKKIFLAAKKKKASVHLPRIGHATKGFNWYGTERLIRKHLAARGIPTYIYYFPRSKSAVLHSQSSSSSSRQLVP

SEQ ID NO: 810577 - protein, 906 aa, Homo sapiens; identical to SEQ ID NO: 810574

SEQ ID NO: 810578 - protein, 906 aa, Homo sapiens; identical to SEQ ID NO: 810574

SEQ ID NO: 810579 - protein, 702 aa, Homo sapiens
ARGGASTGPMERAGATSRGGQAPGFLLRLHTEGRAEAARVQEQDLRQWGLTASELHKLLQPFLLRRVKAEVATELPKKTEVVIYHGMSALQKKYYKAILMKDLDAFENETAKKVKLQNILSQLRKCVDHPYLFDGVEPEPFEVGDHLTEASGKLHLLDKLLAFLYSGGHRVLLFSQMTQMLDILQDYMDYRGYSYERVDGSVRGEERHLAIKNFGQQPIFVFLLSTRAGGVGMNLTAADTVIFVDSDFNPQNDLQAAARAHRIGQNKSVKVIRLIGRDTVEEIVYRKAASKLQLTNMIIEGGHFTLGAQKPAADADLQLSEILKFGLDKLLASEGSTMDEIDLESILGETKDGQWVSDALPAAEGGSRDQEEGKNHMYLFEGKDYSKEPSKEDRKSFEQLVNLQKTLLEKASQEGRSLRNKGSVLIPGLVEGSTKRKRVLSPEELEDRQKKRQEAAAKRRRLIEEKKRQKEEAEHKKKMAWWESNNYQSFCLPSEESEPEDLENGEESSAELDYQDPDATSLKYVSGDVTHPQAGAEDALIVHCVDDSGHWGRGGLFTALEKRSAEPRKIYELAGKMKDLSLGGVLLFPVDDKESRNKGQDLLALIVAQHRDRSNVLSGIKMAALEEGLKKIFLAAKKKKASVHLPRIGHATKGFNWYGTERLIRKHLAARGIPTYIYYFPRSKSAVLHSQSSSSSSRQLVP

SEQ ID NO: 810580 - protein, 598 aa, Homo sapiens
EDTSLGKEESANRIVEDDASISSCNKLLTSGVEPEPFEVGDHLTEASGKLHLLDKLLAFLYSGGHRVLLFSQMTQMLDILQDYMDYRGYSYERVDGSVRGEERHLAIKNFGQQPIFVFLLSTRAGGVGMNLTAADTVIFVDSDFNPQNDLQAAARAHRIGQNKSVKVIRLIGRDTVEEIVYRKAASKLQLTNMIIEGGHFTLGAQKPAADADLQLSEILKFGLDKLLASEGSTMDEIDLESILGETKDGQWVSDALPAAEGGSRDQEEGKNHMYLFEGKDYSKEPSKEDRKSFEQLVNLQKTLLEKASQEGRSLRNKGSVLIPGLVEGSTKRKRVLSPEELEDRQKKRQEAAAKRRRLIEEKKRQKEEAEHKKKMAWWESNNYQSFCLPSEESEPEDLENGEESSAELDYQDPDATSLKYVSGDVTHPQAGAEDALIVHCVDDSGHWGRGGLFTALEKRSAEPRKIYELAGKMKDLSLGGVLLFPVDDKESRNKGQDLLALIVAQHRDRSNVLSGIKMAALEEGLKKIFLAAKKKKASVHLPRIGHATKGFNWYGTERLIRKHLAARGIPTYIYYFPRSKSAVLHSQSSSSSSRQLVP

SEQ ID NO: 810581 - protein, 611 aa, Homo sapiens
QNILSQLRIWVIHTLSKLDKMFCSLTFFASHFRKCVDHPYLFDGVEPEPFEVGDHLTEASGKLHLLDKLLAFLYSGGHRVLLFSQMTQMLDILQDYMDYRGYSYERVDGSVRGEERHLAIKNFGQQPIFVFLLSTRAGGVGMNLTAADTVIFVDSDFNPQNDLQAAARAHRIGQNKSVKVIRLIGRDTVEEIVYRKAASKLQLTNMIIEGGHFTLGAQKPAADADLQLSEILKFGLDKLLASEGSTMDEIDLESILGETKDGQWVSDALPAAEGGSRDQEEGKNHMYLFEGKDYSKEPSKEDRKSFEQLVNLQKTLLEKASQEGRSLRNKGSVLIPGLVEGSTKRKRVLSPEELEDRQKKRQEAAAKRRRLIEEKKRQKEEAEHKKKMAWWESNNYQSFCLPSEESEPEDLENGEESSAELDYQDPDATSLKYVSGDVTHPQAGAEDALIVHCVDDSGHWGRGGLFTALEKRSAEPRKIYELAGKMKDLSLGGVLLFPVDDKESRNKGQDLLALIVAQHRDRSNVLSGIKMAALEEGLKKIFLAAKKKKASVHLPRIGHATKGFNWYGTERLIRKHLAARGIPTYIYYFPRSKSAVLHSQSSSSSSRQLVP

SEQ ID NO: 810582 - protein, 706 aa, Homo sapiens
DLPGRGEQRYRILRRSESAASELHKLLQPFLLRRVKAEVATELPKKTEVVIYHGMSALQKKYYKAILMKDLDAFENETAKKVKLQNILSQLRKCVDHPYLFDGVEPEPFEVGDHLTEASGKLHLLDKLLAFLYSGGHRVLLFSQMTQMLDILQDYMDYRGDTFWPLHYQGSVRLNSPDRSMKNNMGYEKYYKGKQGYSYERVDGSVRGEERHLAIKNFGQQPIFVFLLSTRAGGVGMNLTAADTVIFVDSDFNPQNDLQAAARAHRIGQNKSVKVIRLIGRDTVEEIVYRKAASKLQLTNMIIEGGHFTLGAQKPAADADLQLSEILKFGLDKLLASEGSTMDEIDLESILGETKDGQWVSDALPAAEGGSRDQEEGKNHMYLFEGKDYSKEPSKEDRKSFEQLVNLQKTLLEKASQEGRSLRNKGSVLIPGLVEGSTKRKRVLSPEELEDRQKKRQEAAAKRRRLIEEKKRQKEEAEHKKKMAWWESNNYQSFCLPSEESEPEDLENGEESSAELDYQDPDATSLKYVSGDVTHPQAGAEDALIVHCVDDSGHWGRGGLFTALEKRSAEPRKIYELAGKMKDLSLGGVLLFPVDDKESRNKGQDLLALIVAQHRDRSNVLSGIKMAALEEGLKKIFLAAKKKKASVHLPRIGHATKGFNWYGTERLIRKHLAARGIPTYIYYFPRSKSAVLHSQSSSSSSRQLVP

SEQ ID NO: 810583 - protein, 470 aa, Homo sapiens
MNLTAADTVIFVDSDFNPQNDLQAAARAHRIGQNKSVKVIRLIGRDTVEEIVYRKAASKLQLTNMIIEGGHFTLGAQKPAADADLQLSEILKFGLDKLLASEGSTMDEIDLESILGETKDGQWVSDALPAAEGGSRDQEEGKNHMYLFEGKDYSKEPSKEDRKSFEQLVNLQKTLLEKASQEGRSLRNKGSVLIPGLVEGSTKRKRVLSPEELEDRQKKRQEAAAKRRRLIEEKKRQKEEAEHKKKMAWWESNNYQSFCLPSEESEPEDLENGEESSAELDYQDPDATSLKYVSGDVTHPQAGAEDALIVHCVDDSGHWGRGGLFTALEKRSAEPRKIYELAGKMKDLSLGGVLLFPVDDKESRNKGQDLLALIVAQHRDRSNVLSGIKMAALEEGLKKIFLAAKKKKASVHLPRIGHATKGFNWYGTERLIRKHLAARGIPTYIYYFPRSKSAVLHSQSSSSSSRQLVP

SEQ ID NO: 810584 - protein, 801 aa, Homo sapiens
ARGGASTGPMERAGATSRGGQAPGFLLRLHTEGRAEAARVQEQDLRQWGLTGIHLRSYQLEGVNWLAQRFHCQNGCILGDEMGLGKTCQTIALFIYLAGRLNDEGPFLILCPLSVLSNWKEEMQRFAPGLSCVTYAGDKEERACLQQDLKQESRFHVLLTTYEICLKDASFLKSFPWSVLVVDEAHRLKNQSSLLHKTLSEFSVVFSLLLTGTPIQNSLQELYSLLSFVEPDLFSKEEVGDFIQRYQDIEKESESASELHKLLQPFLLRRVKAEVATELPKKTEVVIYHGMSALQKKYYKAILMKDLDAFENETAKKVKLQNILSQLRKCVDHPYLFDGVEPEPFEVGDHLTEASGKLHLLDKLLAFLYSGGHRVLLFSQMTQMLDILQDYMDYRGYSYERVDGSVRGEERHLAIKNFGQQPIFVFLLSTRAGGVGMNLTAADTVIFVDSDFNPQNDLQAAARAHRIGQNKSVKVIRLIGRDTVEEIVYRKAASKLQLTNMIIEGGHFTLGAQKPAADADLQVLIPGLVEGSTKRKRVLSPEELEDRQKKRQEAAAKRRRLIEEKKRQKEEAEHKKKMAWWESNNYQSFCLPSEESEPEDLENGEESSAELDYQDPDATSLKYVSGDVTHPQAGAEDALIVHCVDDSGHWGRGGLFTALEKRSAEPRKIYELAGKMKDLSLGGVLLFPVDDKESRNKGQDLLALIVAQHRDRSNVLSGIKMAALEEGLKKIFLAAKKKKASVHLPRIGHATKGFNWYGTERLIRKHLAARGIPTYIYYFPRSKSAVLHSQSSSSSSRQLVP

SEQ ID NO: 810585 - protein, 273 aa, Homo sapiens
MKESCCCQNRRPRCPEDKHLPPPHSALGVAGQEESSDADGYPGTPALRDLSSSGHVEPRTRAPAEVALEIEGPWTLPMEIRGAEDGEPATARTEGLAPGSSQGVELAEDALIVHCVDDSGHWGRGGLFTALEKRSAEPRKIYELAGKMKDLSLGGVLLFPVDDKESRNKGQDLLALIVAQHRDRSNVLSGIKMAALEEGLKKIFLAAKKKKASVHLPRIGHATKGFNWYGTERLIRKHLAARGIPTYIYYFPRSKSAVLHSQSSSSSSRQLVP

SEQ ID NO: 810586 - protein, 315 aa, Homo sapiens
ARGGASTGPMERAGATSRGGQAPGFLLRLHTEGRAEAARVQEQDLRQWGLTGIHLRSYQLEGVNWLAQRFHCQNGCILGDEMGLGKTCQTIALFIYLAGRLNDEGPFLILCPLSVLSNWKEEMQRFAPGLSCVTYAGDKEERACLQQDLKQESRFHVLLTTYEICLKDASFLKSFPWSVLVVDEAHRLKNQSSLLHKTLSEFSVVFSLLLTGTPIQNSLQELYSLLSFVEPDLFSKEEVGDFIQRYQDIEKESESASELHKLLQPFLLRRVKAEVATELPKKTEVVIYHGMSALQKKYYKAILMKDLVCGSPIFV

SEQ ID NO: 810587 - protein, 417 aa, Homo sapiens
MLALLVLVTVALASAHHGGEHFEGEKVFRVNVEDENHINIIRELASTTQIDFWKPDSVTQIKPHSTVDFRVKAEDTVTVENVLKQNELQYKVLISNLRNVVEAQFDSRVRATGHSYEKYNKWETIEAWTQQVATENPALISRSVIGTTFEGRAIYLLKVGKAGQNKPAIFMDCGFHAREWISPAFCQWFVREAVRTYGREIQVTELLDKLDFYVLPVLNIDGYIYTWTKSRFWRKTRSTHTGSSCIGTDPNRNFDAGWCEIGASRNPCDETYCGPAAESEKETKALADFIRNKLSSIKAYLTIHSYSQMMIYPYSYAYKLGENNAELNALAKATVKELASLHGTKYTYGPGATTIYPAAGGSDDWAYDQGIRYSFTFELRDTGRYGFLLPESQIRATCEETFLAIKYVASYVLEHLY

SEQ ID NO: 810588 - protein, 417 aa, Homo sapiens; identical to SEQ ID NO: 810587

SEQ ID NO: 810589 - protein, 392 aa, Homo sapiens
GRVEPDGTATMLPLWTLSLLLGAVAGKEVCYERLGCFSDDSPWSGITERPLHILPWSPKDVNTRFLLYTNENPNNFQEVAADSSSISGSNFKTNRKTRFIEAWTQQVATENPALISRSVIGTTFEGRAIYLLKVGKAGQNKPAIFMDCGFHAREWISPAFCQWFVREAVRTYGREIQVTELLDKLDFYVLPVLNIDGYIYTWTKSRFWRKTRSTHTGSSCIGTDPNRNFDAGWCEIGASRNPCDETYCGPAAESEKETKALADFIRNKLSSIKAYLTIHSYSQMMIYPYSYAYKLGENNAELNALAKATVKELASLHGTKYTYGPGATTIYPAAGGSDDWAYDQGIRYSFTFELRDTGRYGFLLPESQIRATCEETFLAIKYVASYVLEHLY

SEQ ID NO: 810590 - protein, 417 aa, Homo sapiens; identical to SEQ ID NO: 810587

SEQ ID NO: 810591 - protein, 436 aa, Homo sapiens
MLALLVLVTVALASAHHGGEHFEGEKVFRVNVEDENHINIIRELASTTQIDFWKPDSVTQIKPHSTVDFRVKAEDTVTVENVLKQNELQYKVLISNLRNVVEAQFDSRVRATGHSYEKYNKWETIEAWTQQVATENPALISRSVIGTTFEGRAIYLLKVGKAGQNKPAIFMDCGFHAREWISPAFCQWFVREAVRTYGREIQVTELLDKLDFYVLPVLNIDGYIYTWTKSRFWRKTRSTHTGSSCIGTDPNRNFDAGWCEIGASRNPCDETYCGPAAESEKETKALADFIRNKLSSIKAYLTIHSYSQMMIYPYSYAYKLGENNAELNALAKATVKELASLHGTKYTYGPGATTICESWLQNCAKNHVPKKPTKDPAAGGSDDWAYDQGIRYSFTFELRDTGRYGFLLPESQIRATCEETFLAIKYVASYVLEHLY

SEQ ID NO: 810592 - protein, 108 aa, Homo sapiens
PTHLLPSLPAPFAPIAYHNALAKATVKELASLHGTKYTYGPGATTIYPAAGGSDDWAYDQGIRYSFTFELRDTGRYGFLLPESQIRATCEETFLAIKYVASYVLEHLY

SEQ ID NO: 810593 - protein, 108 aa, Homo sapiens
MRPTHYTWSDTMLALLVLVTVALASAHHGGEHFEGEKVFRVNVEDENHINIIRELASTTQIDFWKPDSVTQIKPHSTVDFRVKAEDTVTVENVLKQNELQYKSCCWGL

SEQ ID NO: 810594 - protein, 492 aa, Homo sapiens
MWRGLWTLAAQAARGPRRLCTRRSSGAPAPGSGATIFALSSGQGRCGIAVIRTSGPASGHALRILTAPRDLPLARHASLRLLSDPRSGEPLDRALVLWFPGPQSFTGEDCVEFHVHGGPAVVSGVLQALGSVPGLRPAEAGEFTRRAFANGKLNLTEVEGLADLIHAETEAQRRQALRQLDGELGHLCRGWAETLTKALAHVEAYIDFGEDDNLEEGVLEQADIEVRALQVALGAHLRDARRGQRLRSGAHVVVTGPPNAGKSSLVNLLSRKPVSIVSPEPGTTRDVLETPVDLAGFPVLLSDTAGLREGVGPVEQEGVRRARERLEQADLILAMLDASDLASPSSCNFLATVVASVGAQSPSDSSQRLLLVLNKSDLLSPEGPGPGPDLPPHLLLSCLTGEGLDGLLEALRKELAAVCGDPSTDPPLLTRARHQHHLQGCLDALGHYKQSKDLALAAEALRVARGHLTRLTGGGGTEEILDIIFQDFCVGK

SEQ ID NO: 810595 - protein, 68 aa, Homo sapiens
GSPRNAARASEGRCVVTSPPPGRPPGRAYDRGAVSMVNFPQEAFPSCSRMKGFPKPWNLQGHFPQFVY

SEQ ID NO: 810596 - protein, 471 aa, Homo sapiens [sequence omitted]

SEQ ID NO: 810597 - protein, 471 aa, Homo sapiens [sequence omitted]

SEQ ID NO: 810598 - protein, 471 aa, Homo sapiens [sequence omitted]

SEQ ID NO: 810599 - protein, 482 aa, Homo sapiens
MRKGIRSRGNGRRERWGGGENLESSGKSKLCTRRSSGAPAPGSGATIFALSSGQGRCGIAVIRTSGPASGHALRILTAPRDLPLARHASLRLLSDPRSGEPLDRALVLWFPGPQSFTGEDCVEFHVHGGPAVVSGVLQALGSVPGLRPAEAGEFTRRAFANGKLNLTEVEGLADLIHAETEAQRRQALRQLDGELGHLCRGWAETLTKALAHVEAYIDFGEDDNLEEGVLEQADIEVRALQVALGAHLRDARRGQRLRSGAHVVVTGPPNAGKSSLVNLLSRKPVSIVSPEPGTTRDVLETPVDLAGFPVLLSDTAGLREGVGPVEQEGVRRARESCNFLATVVASVGAQSPSDSSQRLLLVLNKSDLLSPEGPGPGPDLPPHLLLSCLTGEGLDGLLEALRKELAAVCGDPSTDPPLLTRARHQHHLQGCLDALGHYKQSKDLALAAEALRVARGHLTRLTGGGGTEEILDIIFQDFCVGK

SEQ ID NO: 810600 - protein, 487 aa, Homo sapiens
CPHPCFLLVPASEPQFPHLQTPDPGDAVWNVRWALCTRRSSGAPAPGSGATIFALSSGQGRCGIAVIRTSGPASGHALRILTAPRDLPLARHASLRLLSDPRSGEPLDRALVLWFPGPQSFTGEDCVEFHVHGGPAVVSGVLQALGSVPGLRPAEAGEFTRRAFANGKLNLTEVEGLADLIHAETEAQRRQALRQLDGELGHLCRGWAETLTKALAHVEAYIDFGEDDNLEEGVLEQADIEVRALQVALGAHLRDARRGQRLRSGAHVVVTGPPNAGKSSLVNLLSRKPVSIVSPEPGTTRDVLETPVDLAGFPVLLSDTAGLREGVGPVEQEGVRRARESCNFLATVVASVGAQSPSDSSQRLLLVLNKSDLLSPEGPGPGPDLPPHLLLSCLTGEGLDGLLEALRKELAAVCGDPSTDPPLLTRARHQHHLQGCLDALGHYKQSKDLALAAEALRVARGHLTRLTGGGGTEEILDIIFQDFCVGK

SEQ ID NO: 810601 - protein, 471 aa, Homo sapiens [sequence omitted]

SEQ ID NO: 810602 - protein, 366 aa, Homo sapiens
MWRGLWTLAAQAARGPRRLCTRRSSGAPAPGSGATIFALSSGQGRCGIAVIRTSGPASGHALRILTAPRDLPLARHASLRLLSDPRSGEPLDRALVLWFPGPQSFTGEDCVEFHVHGGPAVVSGVLQALGSVPGLRPAEAGEFTRRAFANGKLNLTEVEGLADLIHAETEAQRRQALRQLDGELGHLCRGWAETLTKALAHVEAYIDFGEDDNLEEGVLEQADIEVRALQVALGAHLRDARRGQRLRSGAHVVVTGPPNAGKSSLVNLLSRKPVSIVSPEPGTTRDVLETPVDLAGFPVLLSDTAGLREGVGPVEQEGVRRAREREQLTHAGMVMVLTALLSGLLARRSLGAKSVRAGSRVTVTGR

SEQ ID NO: 810603 - protein, 158 aa, Homo sapiens [sequence omitted]

SEQ ID NO: 810604 - protein, 237 aa, Homo sapiens
SLVSTLSSSSDPPPGRKPVSIVSPEPGTTRDVLETPVDLAGFPVLLSDTAGLREGVGPVEQEGVRRARERLEQADLILAMLDASDLASPSSCNFLATVVASVGAQSPSDSSQRLLLVLNKSDLLSPEGPGPGPDLPPHLLLSCLTGEGLDGLLEALRKELAAVCGDPSTDPPLLTRARHQHHLQGCLDALGHYKQSKDLALAAEALRVARGHLTRLTGGGGTEEILDIIFQDFCVGK

SEQ ID NO: 810605 - protein, 243 aa, Homo sapiens
MRKGIRSRGNGRRERWGGGENLESSGKSKLCTRRSSGAPAPGSGATIFALSSGQGRCGIAVIRTSGPASGHALRILTAPRDLPLARHASLRLLSDPRSGEPLDRALVLWFPGPQSFTGEDCVEFHVHGGPAVVSGVLQALGSVPGLRPAEAGEFTRRAFANGKLNLTEVEGLADLIHAETEAQRRQALRQLDGELGHLCRGWAETLTKASPPFVHSLPQRPHLCNPCMRPPLNPAFIRCVEML

SEQ ID NO: 810606 - protein, 947 aa, Homo sapiens
MCVDSLVRICSGLSYGRIRNIKSLSDIQIVQVACGYYHSLALSKASEVFCWGQNKYGQLGLGTDCKKQTSPQLLKSLLGIPFMQVAAGGAHSFVLTLSGAIFGWGRNKFGQLGLNDENDRYVPNLLKSLRSQKIVYICCGEDHTAALTKEGGVFTFGAGGYGQLGHNSTSHEINPRKVFELMGSIVTEIACGRQHTSAFVPSSGRIYSFGLGGNGQLGTGSTSNRKSPFTVKGNWYPYNGQCLPDIDSEEYFCVKRIFSGGDQSFSHYSSPQNCGPPDDFRCPNPTKQIWTVNEALIQKWLSYPSGRFPVEIANEIDGTFSSSGCLNGSFLAVSNDDHYRTGTRFSGVDMNAARLLFHKLIQPDHPQISQQVAASLEKNLIPKLTSSLPDVEALRFYLTLPECPLMSDSNNFTTIAIPFGTALVNLEKAPLKVLENWWSVLEPPLFLKIVELFKEVVVHLLKLYKIGIPPSERRIFNSFLHTALKVLEILHRVNEKMGQIIQYDKFYIHEVQELIDIRNDYINWVQQQAYGMDVNHGLTELADIPVTICTYPFVFDAQAKTTLLQTDAVLQMQMAIDQAHRQNVSSLFLPVIESVNPCLILVVRRENIVGDAMEVLRKTKNIDYKKPLKVIFVGEDAVDAGGVRKEFFLLIMRELLDPKYGMFRYYEDSRLIWFSDKTFEDSDLFHLIGVICGLAIYNCTIVDLHFPLALYKKLLKKKPSLDDLKELMPDVGRSMQQLLDYPEDDIEETFCLNFTITVENFGATEVKELVLNGADTAVNKQNRQEFVDAYVDYIFNKSVASLFDAFHAGFHKVCGGKVLLLFQPNELQAMVIGNTNYDWKELEKNTEYKGEYWAEHPTIKIFWEVFHELPLEKKKQFLLFLTGSDRIPILGMKSLKLVIQSTGGGEEYLPVSHTCFNLLDLPKYTEKETLRSKLIQAIDHNEGFSLI

SEQ ID NO: 810607 - protein, 110 aa, Homo sapiens
MLCWGNASFGQLGLGGIDEEIVLEPRKSDFFINKRVRDVGCGLRHTVFVLDDGTVYTCGCNDLGQLGHEKSRKKPEFRSCFPGRSAMAPSRLTATSASQVQAILLPQPPE

SEQ ID NO: 810608 - protein, 1049 aa, Homo sapiens
MLCWGNASFGQLGLGGIDEEIVLEPRKSDFFINKRVRDVGCGLRHTVFVLDDGTVYTCGCNDLGQLGHEKSRKKPEQVVALDAQNIVAVSCGEAHTLALNDKGQVYAWGLDSDGQLGLVGSEECIRVPRNIKSLSDIQIVQVACGYYHSLALSKASEVFCWGQNKYGQLGLGTDCKKQTSPQLLKSLLGIPFMQVAAGGAHSFVLTLSGAIFGWGRNKFGQLGLNDENDRYVPNLLKSLRSQKIVYICCGEDHTAALTKEGGVFTFGAGGYGQLGHNSTSHEINPRKVFELMGSIVTEIACGRQHTSAFVPSSGRIYSFGLGGNGQLGTGSTSNRKSPFTVKGNWYPYNGQCLPDIDSEEYFCVKRIFSGGDQSFSHYSSPQNCGPPDDFRCPNPTKQIWTVNEALIQKWLSYPSGRFPVEIANEIDGTFSSSGCLNGSFLAVSNDDHYRTGTRFSGVDMNAARLLFHKLIQPDHPQISQQVAASLEKNLIPKLTSSLPDVEALRFYLTLPECPLMSDSNNFTTIAIPFGTALVNLEKAPLKVLENWWSVLEPPLFLKIVELFKEVVVHLLKLYKIGIPPSERRIFNSFLHTALKVLEILHRVNEKMGQIIQYDKFYIHEVQELIDIRNDYINWVQQQAYGMLADIPVTICTYPFVFDAQAKTTLLQTDAVLQMQMAIDQAHRQNVSSLFLPVIESVNPCLILVVRRENIVGDAMEVLRKTKNIDYKKPLKVIFVGEDAVDAGGVRKEFFLLIMRELLDPKYGMFRYYEDSRLIWFSDKTFEDSDLFHLIGVICGLAIYNCTIVDLHFPLALYKKLLKKKPSLDDLKELMPDVGRSMQQLLDYPEDDIEETFCLNFTITVENFGATEVKELVLNGADTAVNKQNRQEFVDAYVDYIFNKSVASLFDAFHAGFHKVCGGKVLLLFQPNELQAMVIGNTNYDWKELEKNTEYKGEYWAEHPTIKIFWEVFHELPLEKKKQFLLFLTGSDRIPILGMKSLKLVIQSTGGGEEYLPVSHTCFNLLDLPKYTEKETLRSKLIQAIDHNEGFSLI

SEQ ID NO: 810609 - protein, 996 aa, Homo sapiens
MLCWGNASFGQLGLGGIDEEIVLEPRKSDFFINKRVRDVGCGLRHTVFVLDDGTVYTCGCNDLGQLGHEKSRKKPEILKVCQISRLYRLLVVTIIHLHFLKQVKSSVGDRINMANWVYGTDCKKQTSPQLLKSLLGIPFMQVAAGGAHSFVLTLSGAIFGWGRNKFGQLGLNDENDRYVPNLLKSLRSQKIVYICCGEDHTAALTKEGGVFTFGAGGYGQLGHNSTSHEINPRKVFELMGSIVTEIACGRQHTSAFVPSSGRIYSFGLGGNGQLGTGSTSNRKSPFTVKGNWYPYNGQCLPDIDSEEYFCVKRIFSGGDQSFSHYSSPQNCGPPDDFRCPNPTKQIWTVNEALIQKWLSYPSGRFPVEIANEIDGTFSSSGCLNGSFLAVSNDDHYRTGTRFSGVDMNAARLLFHKLIQPDHPQISQQVAASLEKNLIPKLTSSLPDVEALRFYLTLPECPLMSDSNNFTTIAIPFGTALVNLEKAPLKVLENWWSVLEPPLFLKIVELFKEVVVHLLKLYKIGIPPSERRIFNSFLHTALKVLEILHRVNEKMGQIIQYDKFYIHEVQELIDIRNDYINWVQQQAYGMLADIPVTICTYPFVFDAQAKTTLLQTDAVLQMQMAIDQAHRQNVSSLFLPVIESVNPCLILVVRRENIVGDAMEVLRKTKNIDYKKPLKVIFVGEDAVDAGGVRKEFFLLIMRELLDPKYGMFRYYEDSRLIWFSDKTFEDSDLFHLIGVICGLAIYNCTIVDLHFPLALYKKLLKKKPSLDDLKELMPDVGRSMQQLLDYPEDDIEETFCLNFTITVENFGATEVKELVLNGADTAVNKQNRQEFVDAYVDYIFNKSVASLFDAFHAGFHKVCGGKVLLLFQPNELQAMVIGNTNYDWKELEKNTEYKGEYWAEHPTIKIFWEVFHELPLEKKKQFLLFLTGSDRIPILGMKSLKLVIQSTGGGEEYLPVSHTCFNLLDLPKYTEKETLRSKLIQAIDHNEGFSLI

SEQ ID NO: 810610 - protein, 1049 aa, Homo sapiens; identical to SEQ ID NO: 810608

SEQ ID NO: 810611 - protein, 857 aa, Homo sapiens
MQVAAGGAHSFVLTLSGAIFGWGRNKFGQLGLNDENDRYVPNLLKSLRSQKIVYICCGEDHTAALTKEGGVFTFGAGGYGQLGHNSTSHEINPRKVFELMGSIVTEIACGRQHTSAFVPSSGRIYSFGLGGNGQLGTGSTSNRKSPFTVKGNWYPYNGQCLPDIDSEEYFCVKRIFSGGDQSFSHYSSPQNCGPPDDFRCPNPTKQIWTVNEALIQKWLSYPSGRFPVEIANEIDGTFSSSGCLNGSFLAVSNDDHYRTGTRFSGVDMNAARLLFHKLIQPDHPQISQQVAASLEKNLIPKLTSSLPDVEALRFYLTLPECPLMSDSNNFTTIAIPFGTALVNLEKAPLKVLENWWSVLEPPLFLKIVELFKEVVVHLLKLYKIGIPPSERRIFNSFLHTALKVLEILHRVNEKMGQIIQYDKFYIHEVQELIDIRNDYINWVQQQAYGMLADIPVTICTYPFVFDAQAKTTLLQTDAVLQMQMAIDQAHRQNVSSLFLPVIESVNPCLILVVRRENIVGDAMEVLRKTKNIDYKKPLKVIFVGEDAVDAGGVRKEFFLLIMRELLDPKYGMFRYYEDSRLIWFSDKTFEDSDLFHLIGVICGLAIYNCTIVDLHFPLALYKKLLKKKPSLDDLKELMPDVGRSMQQLLDYPEDDIEETFCLNFTITVENFGATEVKELVLNGADTAVNKQNRQEFVDAYVDYIFNKSVASLFDAFHAGFHKVCGGKVLLLFQPNELQAMVIGNTNYDWKELEKNTEYKGEYWAEHPTIKIFWEVFHELPLEKKKQFLLFLTGSDRIPILGMKSLKLVIQSTGGGEEYLPVSHTCFNLLDLPKYTEKETLRSKLIQAIDHNEGFSLI

SEQ ID NO: 810612 - protein, 1031 aa, Homo sapiens
MLCWGNASFGQLGLGGIDEEIVLEPRKSDFFINKRVRDVGCGLRHTVFVLDDGTVYTCGCNDLGQLGHEKSRKKPEQVVALDAQNIVAVSCGEAHTLALNDKGQVYAWGLDSDGQLGLVGSEECIRVPRNIKSLSDIQIVQVACGYYHSLALSKASEVFCWGQNKYGQLGLGTDCKKQTSPQLLKSLLGIPFMQVAAGGAHSFVLTLSGAIFGWGRNKFGQLGLNDENDRYVPNLLKSLRSQKIVYICCGEDHTAALTKEGGVFTFGAGGYGQLGHNSTSHEINPRKVFELMGSIVTEIACGRQHTSAFVPSSGRIYSFGLGGNGQLGTGSTSNRKSPFTVKGNWYPYNGQCLPDIDSEEYFCVNCGPPDDFRCPNPTKQIWTVNEALIQKWLSYPSGRFPVEIANEIDGTFSSSGCLNGSFLAVSNDDHYRTGTRFSGVDMNAARLLFHKLIQPDHPQISQQVAASLEKNLIPKLTSSLPDVEALRFYLTLPECPLMSDSNNFTTIAIPFGTALVNLEKAPLKVLENWWSVLEPPLFLKIVELFKEVVVHLLKLYKIGIPPSERRIFNSFLHTALKVLEILHRVNEKMGQIIQYDKFYIHEVQELIDIRNDYINWVQQQAYGMLADIPVTICTYPFVFDAQAKTTLLQTDAVLQMQMAIDQAHRQNVSSLFLPVIESVNPCLILVVRRENIVGDAMEVLRKTKNIDYKKPLKVIFVGEDAVDAGGVRKEFFLLIMRELLDPKYGMFRYYEDSRLIWFSDKTFEDSDLFHLIGVICGLAIYNCTIVDLHFPLALYKKLLKKKPSLDDLKELMPDVGRSMQQLLDYPEDDIEETFCLNFTITVENFGATEVKELVLNGADTAVNKQNRQEFVDAYVDYIFNKSVASLFDAFHAGFHKVCGGKVLLLFQPNELQAMVIGNTNYDWKELEKNTEYKGEYWAEHPTIKIFWEVFHELPLEKKKQFLLFLTGSDRIPILGMKSLKLVIQSTGGGEEYLPVSHTCFNLLDLPKYTEKETLRSKLIQAIDHNEGFSLI

SEQ ID NO: 810613 - protein, 649 aa, Homo sapiens
MLCWGNASFGQLGLGGIDEEIVLEPRKSDFFINKRVRDVGCGLRHTVFVLDDGTVYTCGCNDLGQLGHEKSRKKPEQVVALDAQNIVAVSCGEAHTLALNDKGQVYAWGLDSDGQLGLVGSEECIRVPRNIKSLSDIQIVQVACGYYHSLALSKASEVFCWGQNKYGQLGLGTDCKKQTSPQLLKSLLGIPFMQVAAGGAHSFVLTLSGAIFGWGRNKFGQLGLNDENDRYVPNLLKSLRSQKIVYICCGEDHTAALTKEGGVFTFGAGGYGQLGHNSTSHEINPRKVFELMGSIVTEIACGRQHTSAFVPSSGRIYSFGLGGNGQLGTGSTSNRKSPFTVKGNWYPYNGQCLPDIDSEEYFCVKRIFSGGDQSFSHYSSPQNCGPPDDFRCPNPTKQIWTVNEALIQKWLSYPSGRFPVEIANEIDGTFSSSGCLNGSFLAVSNDDHYRTGTRFSGVDMNAARLLFHKLIQPDHPQISQQVAASLEKNLIPKLTSSLPDVEALRFYLTLPECPLMSDSNNFTTIAIPFGTALVNLEKAPLKVLENWWSVLEPPLFLKIVELFKEVVVHLLKLYKIGIPPSERRIFNSFLHTALKVLEILHRVNEKMGQIIQYDKFYIHEVQELIDIRNDYINWVQQQAYGMVGFLCNL

SEQ ID NO: 810614 - protein, 380 aa, Homo sapiens
MLILVVRRENIEEMQNVSSLFLPVIESVNPCLILVVRRENIVGDAMEVLRKTKNIDYKKPLKVIFVGEDAVDAGGVRKEFFLLIMRELLDPKYGMFRYYEDSRLIWFSDKTFEDSDLFHLIGVICGLAIYNCTIVDLHFPLALYKKLLKKKPSLDDLKELMPDVGRSMQQLLDYPEDDIEETFCLNFTITVENFGATEVKELVLNGADTAVNKQNRQEFVDAYVDYIFNKSVASLFDAFHAGFHKVCGGKVLLLFQPNELQAMVIGNTNYDWKELEKNTEYKGEYWAEHPTIKIFWEVFHELPLEKKKQFLLFLTGSDRIPILGMKSLKLVIQSTGGGEEYLPVSHTCFNLLDLPKYTEKETLRSKLIQAIDHNEGFSLI

SEQ ID NO: 810615 - protein, 785 aa, Homo sapiens
MLCWGNASFGQLGLGGIDEEIVLEPRKSDFFINKRVRDVGCGLRHTVFVLDDGTVYTCGCNDLGQLGHEKSRKKPEQVVALDAQNIVAVSCGEAHTLALNDKGQVYAWGLDSDGQLGLVGSEECIRVPRNIKSLSDIQIVQVACGYYHSLALSKASEVFCWGQNKYGQLGLGTDCKKQTSPQLLKSLLGIPFMQVAAGGAHSFVLTLSGAIFGWGRNKFGQLGLNDENDRYVPNLLKSLRSQKIVYICCGEDHTAALTKEGGVFTFGAGGYGQLGHNSTSHEINPRKVFELMGSIVTEIACGRQHTSAFVPSSGRIYSFGLGGNGQLGTGSTSNRKSPFTVKGNWYPYNGQCLPDIDSEEYFCVKRIFSGGDQSFSHYSSPQNCGPPDDFRCPNPTKQIWTVNEALIQKWLSYPSGRFPVEIANEIDGTFSSSGCLNGSFLAVSNDDHYRTGTRFSGVDMNAARLLFHKLIQPDHPQISQQVAASLEKNLIPKLTSSLPDVEALRFYLTLPECPLMSDSNNFTTIAIPFGTALVNLEKAPLKVLENWWSVLEPPLFLKIVELFKEVVVHLLKLYKIGIPPSERRIFNSFLHTALKVLEILHRVNEKMGQIIQYDKFYIHEVQELIDIRNDYINWVQQQAYGMLADIPVTICTYPFVFDAQAKTTLLQTDAVLQMQMAIDQAHRQNVSSLFLPVIESVNPCLILVVRRENIVGDAMEVLRKTKNIDYKKPLKVIFVGEDAVDAGGVRKEFFLLIMRELLDPKYGMFRYYEDSRLIWFSDKVKCPTI

SEQ ID NO: 810616 - protein, 236 aa, Homo sapiens [sequence omitted]

SEQ ID NO: 810617 - protein, 110 aa, Homo sapiens
MAIDQAHRQNVSSLFLPVIESVNPCLILVVRRENIVGDAMEVLRKAKNIDYKKPLKVIFVGEDAVDAGGVRKEFFLLIMRELLDPKYGMFRYYEDSRLIWFSDKVKCPTI

SEQ ID NO: 810618 - protein, 572 aa, Homo sapiens
MEPEAPRRRHTHQRGYLLTRNPHLNKDLAFTLEERQQLNIHGLLPPSFNSQEIQVLRVVKNFEHLNSDFDRYLLLMDLQDRNEKLFYRVLTSDIEKFMPIVYTPTVGLACQQYSLVFRKPRGLFITIHDRGHIASVLNAWPEDVIKAIVVTDGERILGLGDLGCNGMGIPVGKLALYTACGGMNPQECLPVILDVGTENEELLKDPLYIGLRQRRVRGSEYDDFLDEFMEAVSSKYGMNCLIQFEDFANVNAFRLLNKYRNQYCTFNDDIQGTASVAVAGLLAALRITKNKLSDQTILFQGAGEAALGIAHLIVMALEKEGLPKEKAIKKIWLVDSKGLIVKGRASLTQEKEKFAHEHEEMKNLEAIVQEIKPTALIGVAAIGGAFSEQILKDMAAFNERPIIFALSNPTSKAECSAEQCYKITKGRAIFASGSPFDPVTLPNGQTLYPGQGNNSYVFPGVALGVVACGLRQITDNIFLTTAEVIAQQVSDKHLEEGRLYPPLNTIRDVSLKIAEKIVKDAYQEKTATVYPEPQNKEAFVRSQMYSTDYDQILPDCYSWPEEVQKIQTKVDQ

SEQ ID NO: 810619 - protein, 572 aa, Homo sapiens; identical to SEQ ID NO: 810618

SEQ ID NO: 810620 - protein, 106 aa, Homo sapiens
YPYLRTRRRKQSFQAYSVIAQQVSDKHLEEGRLYPPLNTIRDVSLKIAEKIVKDAYQEKTATVYPEPQNKEAFVRSQMYSTDYDQILPDCYSWPEEVQKIQTKVDQ

SEQ ID NO: 810621 - protein, 110 aa, Homo sapiens
LAARAKILNTTKKLINELEFNVIAQQVSDKHLEEGRLYPPLNTIRDVSLKIAEKIVKDAYQEKTATVYPEPQNKEAFVRSQMYSTDYDQILPDCYSWPEEVQKIQTKVDQ

SEQ ID NO: 810622 - protein, 206 aa, Homo sapiens
EHLNSVNFDRYLLLMDLQDRNEKLFYRVLTSDIEKFMPIVYTPTVGLACQQYSLVFRKPRNLLSVHCMPGTLPSIENRGLFITIHDRGHIASVLNAWPEDVIKAIVVTDGERILGLGDLGCNGMGIPVGKLALYTACGGMNPQECLPVILDVGTENEELLKDPLYIGLRQRRVRGSEYDDFLDEFMEAVSSKVFNAKKSVLRFNRK

SEQ ID NO: 810623 - protein, 572 aa, Homo sapiens; identical to SEQ ID NO: 810618

SEQ ID NO: 810624 - protein, 572 aa, Homo sapiens; identical to SEQ ID NO: 810618

SEQ ID NO: 810625 - protein, 584 aa, Homo sapiens
MEPEAPRRRHTHQRGYLLTRNPHLNKDLAFTLEERQQLNIHGLLPPSFNSQEIQVLRVVKNFEHLNSDFDRYLLLMDLQDRNEKLFYRVLTSDIEKFMPIVYTPTVGLACQQYSLVFRKPRGLFITIHDRGHIASVLNAWPEDVIKAIVVTDGERILGLGDLGCNGMGIPVGKLALYTACGGMNPQECLPVILDVGTENEELLKDPLYIGLRQRRVRGSEYDDFLDEFMEAVSSKVFNAKKSVLLFQYGMNCLIQFEDFANVNAFRLLNKYRNQYCTFNDDIQGTASVAVAGLLAALRITKNKLSDQTILFQGAGEAALGIAHLIVMALEKEGLPKEKAIKKIWLVDSKGLIVKGRASLTQEKEKFAHEHEEMKNLEAIVQEIKPTALIGVAAIGGAFSEQILKDMAAFNERPIIFALSNPTSKAECSAEQCYKITKGRAIFASGSPFDPVTLPNGQTLYPGQGNNSYVFPGVALGVVACGLRQITDNIFLTTAEVIAQQVSDKHLEEGRLYPPLNTIRDVSLKIAEKIVKDAYQEKTATVYPEPQNKEAFVRSQMYSTDYDQILPDCYSWPEEVQKIQTKVDQ

SEQ ID NO: 810626 - protein, 559 aa, Homo sapiens
MFVIHQFSLDVLMDLAFTLEERQQLNIHGLLPPSFNSQEIQVLRVVKNFEHLNSDFDRYLLLMDLQDRNEKLFYRVLTSDIEKFMPIVYTPTVGLACQQYSLVFRKPRGLFITIHDRGHIASVLNAWPEDVIKAIVVTDGERILGLGDLGCNGMGIPVGKLALYTACGGMNPQECLPVILDVGTENEELLKDPLYIGLRQRRVRGSEYDDFLDEFMEAVSSKYGMNCLIQFEDFANVNAFRLLNKYRNQYCTFNDDIQGTASVAVAGLLAALRITKNKLSDQTILFQGAGEAALGIAHLIVMALEKEGLPKEKAIKKIWLVDSKGLIVKGRASLTQEKEKFAHEHEEMKNLEAIVQEIKPTALIGVAAIGGAFSEQILKDMAAFNERPIIFALSNPTSKAECSAEQCYKITKGRAIFASGSPFDPVTLPNGQTLYPGQGNNSYVFPGVALGVVACGLRQITDNIFLTTAEVIAQQVSDKHLEEGRLYPPLNTIRDVSLKIAEKIVKDAYQEKTATVYPEPQNKEAFVRSQMYSTDYDQILPDCYSWPEEVQKIQTKVDQ

SEQ ID NO: 810627 - protein, 514 aa, Homo sapiens
MEPEAPRRRHTHQRGYLLTRNPHLNKDLAFTLEERQQLNIHGLLPPSFNSQEIQVLRVVKNFEHLNSDFDRYLLLMDLQDRNEKLFYRVLTSDIEKFMPIVYTPTVGLACQQYSLVFRKPRGLFITIHDRGHIASVLNAWPEDVIKAIVVTDGERILGLGDLGCNGMGIPVGKLALYTACGGMNPQECLPVILDVGTENEELLKDPLYIGLRQRRVRGSEYDDFLDEFMEAVSSKYGMNCLIQFEDFANVNAFRLLNKYRNQYCTFNDDIQGTASVAVAGLLAALRITKNKLSDQTILFQGAGEAALGIAHLIVMALEKEGLPKEKAIKKIWLVDSKGLIVKGRASLTQEKEKFAHEHEEMKNLEAIVQEIKPTALIGVAAIGGAFSEQILKDMAAFNERPIIFALSNPTSKAECSAEQCYKITKVIAQQVSDKHLEEGRLYPPLNTIRDVSLKIAEKIVKDAYQEKTATVYPEPQNKEAFVRSQMYSTDYDQILPDCYSWPEEVQKIQTKVDQ

SEQ ID NO: 810628 - protein, 151 aa, Homo sapiens
WHNVCGQRIPVIYGIPRVTLPNGQTLYPGQGNNSYVFPGVALGVVACGLRQITDNIFLTTAEVIAQQVSDKHLEEGRLYPPLNTIRDVSLKIAEKIVKDAYQEKTATVYPEPQNKEAFVRSQMYSTDYDQILPDCYSWPEEVQKIQTKVDQ

SEQ ID NO: 810629 - protein, 106 aa, Homo sapiens
FFSIVPAPERKRLPGSHVIAQQVSDKHLEEGRLYPPLNTIRDVSLKIAEKIVKDAYQEKTATVYPEPQNKEAFVRSQMYSTDYDQILPDCYSWPEEVQKIQTKVDQ

SEQ ID NO: 810630 - protein, 110 aa, Homo sapiens; identical to SEQ ID NO: 810621

SEQ ID NO: 810631 - protein, 572 aa, Homo sapiens; identical to SEQ ID NO: 810618

SEQ ID NO: 810632 - protein, 572 aa, Homo sapiens; identical to SEQ ID NO: 810618

SEQ ID NO: 810633 - protein, 457 aa, Homo sapiens
MEPEAPRRRHTHQRGYLLTRNPHLNKDLAFTLEERQQLNIHGLLPPSFNSQEIQVLRVVKNFEHLNSDFDRYLLLMDLQDRNEKLFYRVLTSDIEKFMPIVYTPTVGLACQQYSLVFRKPRGLFITIHDRGHIASVLNAWPEDVIKAIVVTDGERILGLGDLGCNGMGIPVGKLALYTACGGMNPQECLPVILDVGTENEELLKDPLYIGLRQRRVRGSEYDDFLDEFMEAVSSKYGMNCLIQFEDFANVNAFRLLNKYRNQYCTFNDDIQGTASVAVAGLLAALRITKNKLSDQTILFQGAGEAALGIAHLIVMALEKEGLPKEKAIKKIWLVDSKGLIVKGRASLTQEKEKFAHEHEEMKNLEAIVQEIKPTALIGVAAIGGAFSEQILKDMAAFNERPIIFALSNPTSKAECSAEQCYKITKGRAIFASGSPFDPASIHTATTPRATPRYTVRR

SEQ ID NO: 810634 - protein, 228 aa, Homo sapiens
MPTNCAAAGCATTYNKHINISFHRFPLDPKRRKEWVRLVRRKNFVPGKHTFLCSKHFEASCFDLTGQTRRLKMDAVPTIFDFCTHIKSMKLKSRNLLKKNNSCSPAGPSNLKSNISSQQVLLEHSYAFRNPMEAKKRIIKLEKEIASLRRKMKTCLQKERRATRRWIKATCLVKNLEANSVLPKGTSEHMLPTALSSLPLEDFKILEQDQQDKTLLSLNLKQTKSTFI

SEQ ID NO: 810635 - protein, 228 aa, Homo sapiens; identical to SEQ ID NO: 810634

SEQ ID NO: 810636 - protein, 779 aa, Homo sapiens
MAPGVQGSLLHVPWRGGGQLDLLGVSLASLKKQVDGERRERLLQEAQRLSDTLHSLRSGEEEAAQPLGAPEEEPTDGQDASSHCLWVDEFAPRHYTELLSDDFTNRCLLKWLKLWDLVVFGHERPSRKPRPSVEPARVSKEATAPGKWKSHEQVLEEMLEAGLDPSQRPKQKVALLCGPPGLGKTTLAHVIARHAGYSVVEMNASDDRSPEVFRTRIEAATQMESVLGAGGKPNCLVIDEIDGAPVAAINVLLSILNRKGPQEVGPQGPAVPSGGGRRRRAEGGLLMRPIICICNDQFAPSLRQLKQQAFLLHFPPTLPSRLVQRLQEVSLRQGMRADPGVLAALCEKTDNDIRACINTLQFLYSRGQRELSVRDVQATRVGLKDQRRGLFSVWQEVFQLPRAQRRRVGQDPALPADTLLLGDGDAGSLTSASQRFYRVLHAAASAGEHEKVVQGLFDNFLRLRLRDSSLGAVCVALDWLAFDDLLAGAAHHSQSFQLLRYPPFLPVAFHVLFASSHTPRITFPSSQQEAQNRMSQMRNLIQTLVSGIAPATRSRATPQALLLDALCLLLDILAPKLRPVSTQLYSTREKQQLASLVGTMLAYSLTYRQERTPDGQYIYRLEPNVEELCRFPELPARKPLTYQTKQLIAREIEVEKMRRAEASARVENSPQVDGSPPGLEGLLGGIGEKGVHRPAPRNHEQRLEHIMRRAAREEQPEKDFFGRVVVRSTAVPSAGDTAPEQDSVERRMGTAVGRSEVWFRFNEGVSNAVRRSLYIRDLL

SEQ ID NO: 810637 - protein, 557 aa, Homo sapiens
MESVLGAGGKPNCLVIDEIDGAPVAAINVLLSILNRKGPQEVGPQGPAVPSGGGRRRRAEGGLLMRPIICICNDQFAPSLRQLKQQAFLLHFPPTLPSRLVQRLQEVSLRQGMRADPGVLAALCEKTDNDIRACINTLQFLYSRGQRELSVRDVQATRVGLKDQRRGLFSVWQEVFQLPRAQRRRVGQDPALPADTLLLGDGDAGSLTSASQRFYRVLHAAASAGEHEKVVQGLFDNFLRLRLRDSSLGAVCVALDWLAFDDLLAGAAHHSQSFQLLRYPPFLPVAFHVLFASSHTPRITFPSSQQEAQNRMSQMRNLIQTLVSGIAPATRSRATPQALLLDALCLLLDILAPKLRPVSTQLYSTREKQQLASLVGTMLAYSLTYRQERTPDGQYIYRLEPNVEELCRFPELPARKPLTYQTKQLIAREIEVEKMRRAEASARVENSPQVDGSPPGLEGLLGGIGEKGVHRPAPRNHEQRLEHIMRRAAREEQPEKDFFGRVVVRSTAVPSAGDTAPEQDSVERRMGTAVGRSEVWFRFNEGVSNAVRRSLYIRDLL

SEQ ID NO: 810638 - protein, 779 aa, Homo sapiens; identical to SEQ ID NO: 810636

SEQ ID NO: 810639 - protein, 705 aa, Homo sapiens
MAPGVQGSLLHVPWRGGGQLDLLGVSLASLKKQVDGERRERLLQEAQRLSDTLHSLRSGEEEAAQPLGAPEEEPTDGQDASSHCLWVDEFAPRHYTELLSDDFTNRCLLKWLKLWDLVVFGHERPSRKPRPSVEPARVSKEATAPGKWKSHEQVLEEMLEAGLDPSQRPKQKAAINVLLSILNRKGPQEVGPQGPAVPSGGGRRRRAEGGLLMRPIICICNDQFAPSLRQLKQQAFLLHFPPTLPSRLVQRLQEVSLRQGMRADPGVLAALCEKTDNDIRACINTLQFLYSRGQRELSVRDVQATRVGLKDQRRGLFSVWQEVFQLPRAQRRRVGQDPALPADTLLLGDGDAGSLTSASQRFYRVLHAAASAGEHEKVVQGLFDNFLRLRLRDSSLGAVCVALDWLAFDDLLAGAAHHSQSFQLLRYPPFLPVAFHVLFASSHTPRITFPSSQQEAQNRMSQMRNLIQTLVSGIAPATRSRATPQALLLDALCLLLDILAPKLRPVSTQLYSTREKQQLASLVGTMLAYSLTYRQERTPDGQYIYRLEPNVEELCRFPELPARKPLTYQTKQLIAREIEVEKMRRAEASARVENSPQVDGSPPGLEGLLGGIGEKGVHRPAPRNHEQRLEHIMRRAAREEQPEKDFFGRVVVRSTAVPSAGDTAPEQDSVERRMGTAVGRSEVWFRFNEGVSNAVRRSLYIRDLL

SEQ ID NO: 810640 - protein, 557 aa, Homo sapiens; identical to SEQ ID NO: 810637

SEQ ID NO: 810641 - protein, 350 aa, Homo sapiens
MESVLGAGGKPNCLVIDEIDGAPVAAINVLLSILNRKGPQEVGPQGPAVPSGGGRRRRAEGGLLMRPIICICNDQFAPSLRQLKQQAFLLHFPPTLPSRLVQRLQEVSLRQGMRADPGVLAALCEKTDNDIRACINTLQVLDILAPKLRPVSTQLYSTREKQQLASLVGTMLAYSLTYRQERTPDGQYIYRLEPNVEELCRFPELPARKPLTYQTKQLIAREIEVEKMRRAEASARVENSPQVDGSPPGLEGLLGGIGEKGVHRPAPRNHEQRLEHIMRRAAREEQPEKDFFGRVVVRSTAVPSAGDTAPEQDSVERRMGTAVGRSEVWFRFNEGVSNAVRRSLYIRDLL

SEQ ID NO: 810642 - protein, 557 aa, Homo sapiens; identical to SEQ ID NO: 810637

SEQ ID NO: 810643 - protein, 469 aa, Homo sapiens
MESVLGAGGKPNCLVIDEIDGAPVAAINVLLSILNRKGPQEVGPQGPAVPSGGGRRRRAEGGLLMRPIICICNDQFAPSLRQLKQQAFLLHFPPTLPSRLVQRLQEVSLRQGMRADPGVLAALCEKTDNDIRACINTLQFLYSRGQRELSVRDVQATRVGLKDQRRGLFSVWQEVFQLPRAQRRRVGQDPALPADTLLLGDGDAGSLTSASQRFYRVLHAAASAGEHEKVVQGLFDNFLRLRLRDSSLGAVCVALDWLAFDDLLAGAAHHSQSFQLLRYPPFLPVAFHVLFASSHTPRITFPSSQQEAQNRMSQMRNLIQTLVSGIAPATRSRATPQALLLDALCLLLDILAPKLRPVSTQLYSTREKQQLASLVGTMLAYSLTYRQERTPDGQYIYRLEPNVEELCRFPELPARKPLTYQTKQLIAREIEVEKMRRAEASARVENSPQWLEPQGRSRWGMGKGATARK

SEQ ID NO: 810644 - protein, 408 aa, Homo sapiens
MESVLGAGGKPNCLVIDEIDGAPVAAINVLLSILNRKGPQEVGPQGPAVPSGGGRRRRAEGGLLMRPIICICNDQFAPSLRQLKQQAFLLHFPPTLPSRLVQRLQEVSLRQGMRADPGVLAALCEKTDNDIRACINTLQFLYSRGQRELSVRDVQATRVGLKDQRRGLFSVWQEVFQLPRAQRRRVGQDPALPADTLLLGDGDAGSLTSASQRFYRVLHAAASAGEHEKVVQGLFDNFLRLRLRDSSLGAVCVALDWLAFDDLLAGAAHHSQSFQLLRYPPFLPVAFHVLFASSHTPRITFPSSQQEAQNRMSQMRNLIQTLVSGIAPATRSRATPQALLLDALCLLLDILAPKLRPQPCGPAGDTAPEQDSVERRMGTAVGRSEVWFRFNEGVSNAVRRSLYIRDLL

SEQ ID NO: 810645 - protein, 500 aa, Homo sapiens
MESVLGAGGKPNCLVIDEIDGAPVAAINVLLSILNRKGPQEVGPQGPAVPSGGGRRRRAEGGLLMRPIICICNDQFAPSLRQLKQQAFLLHFPPTLPSRLVQRLQEVSLRQGMRADPGVLAALCEKTDNDIRACINTLQFLYSRGQRELSVRDVQATRVGLKDQRRGLFSVWQEVFQLPRAQRRRVGQDPALPADTLLLGDGDAGSLTSASQRFYRVLHAAASAGEHEKVVQGLFDNFLRLRLRDSSLGAVCVALDWLAFDDLLAGAAHHSQSFQLLRYPPFLPVAFHVLFASSHTPRITFPSSQQEAQNRMSQMRNLIQTLVSGIAPATRSRATPQALLLDALCLLLDILAPKLRPVSTQLYSTREKQQLASLVGTMLAYSLTYRQERTPDGQYIYRLEPNVEELCPQAPHLPDKNHTALTAILAPVEACWERDFIKGAMSGRLWSKAIFAGYKRGLRIQREHTALLQIEGVYARDETEFYLGKRCAYVYKAKNITVPP

SEQ ID NO: 810646 - protein, 249 aa, Homo sapiens
MESVLGAGGKPNCLVIDEIDGAPVAAINVLLSILNRKGPQEVGPQGPAVPSGGGRRRRAEGGLLMRPIICICNDQFAPSLRQLKQQAFLLHFPPTLPSRLVQRLQEVSLRQGMRADPGVLAALCEKTDNDIRACINTLQFLYSRGQRELSVRDVQATRVGLKDQRRGLFSVWQEVFQLPRAQRRRVGQDPALPADTLLLGDGDAGSLTSASQRFYRVLHAAASAGEHEKVVQLQRRAAQPVHQGLALVL

SEQ ID NO: 810647 - protein, 173 aa, Homo sapiens
PSGVPLFTAGRPPRTFEEALARGDAASSPAPAASVGSSQGGARKRQVDADLQPAGSLPHGRLAALPQGLRSGREAEEASGSLHVSPPAPRIKRPRLQVVKRLNFRSEEMEEPPLPTPRRRTSPRRRALRTSQSFGATGVWLGHGRPIPSVQWDSDGAHPVPWMRPGGWGGFHG

SEQ ID NO: 810648 - protein, 296 aa, Homo sapiens
PGTVRSFGTTVWGWRPAGEAAGLDWPERDPGSQNRPRRRPRGRTAGRASMPRLLHPALPLLLGATLTFRALRRALCRLPLPVHVRADPLRTWRWHNLLVSFAHSIVSGIWALLCVWQTPDMLVEIETAWSLSGYLLVCFSAGYFIHDTVDIVASGQTRASWEYLVHHVMAMGAFFSGIFWSSFVGGGVLTLLVEVSNIFLTIRMMMKISNAQDHLLYRVNKYVNLVMYFLFRLAPQAYLTHFFLRYVNQRTLGTFLLGILLMLDVMIIIYFSRLLRSDFCPEHVPKKQHKDKFLTE

SEQ ID NO: 810649 - protein, 247 aa, Homo sapiens
MPRLLHPALPLLLGATLTFRALRRALCRLPLPVHVRADPLRTWRWHNLLVSFAHSIVSGIWALLCVWQTPDMLVEIETAWSLSGYLLVCFSAGYFIHDTVDIVASGQTRASWEYLVHHVMAMGAFFSGIFWSSFVGGGVLTLLVEVSNIFLTIRMMMKISNAQDHLLYRVNKYVNLVMYFLFRLAPQAYLTHFFLRYVNQRTLGTFLLGILLMLDVMIIIYFSRLLRSDFCPEHVPKKQHKDKFLTE

SEQ ID NO: 810650 - protein, 200 aa, Homo sapiens
MGYSAVPKCPPRGRGRDSVWQTPDMLVEIETAWSLSGYLLVCFSAGYFIHDTVDIVASGQTRASWEYLVHHVMAMGAFFSGIFWSSFVGGGVLTLLVEVSNIFLTIRMMMKISNAQDHLLYRVNKYVNLVMYFLFRLAPQAYLTHFFLRYVNQRTLGTFLLGILLMLDVMIIIYFSRLLRSDFCPEHVPKKQHKDKFLTE

SEQ ID NO: 810651 - protein, 140 aa, Homo sapiens
MGYSAVPKCPPRGRGRDSVWQTPDMLVEIETAWSLSGYLLVCFSAGYFIHDTVDIVASGQTRASWEYLVHHVMAMGAFFSGIFWSSFVGGGVLTLLVEVSNIFLTIRMMMKISNAQDHLLYRVNKGPWAPSCWVSCSCWT

SEQ ID NO: 810652 - protein, 198 aa, Homo sapiens
LGEAVFYRQRTTVWGWRPAGEAAGLDWPERDPGSQNRPRRRPRGRTAGRASMPRLLHPALPLLLGATLTFRALRRALCRLPLPVHVRADPLRTWRWHNLLVSFAHSIVSGIWALLCVWQTPDMLVEIETAWSLSGYLLVCFSAGYFIHDTVDIVASGQTRASWEYLVHHVMAMGAFFSGIFWSSFVGGGVLIGCWYLL

SEQ ID NO: 810653 - protein, 185 aa, Homo sapiens
LGEAVFYRQRTTVWGWRPAGEAAGLDWPERDPGSQNRPRRRPRGRTAGRASMPRLLHPALPLLLGATLTFRALRRALCRLPLPVHVRADPLRTWRWHNLLVSFAHSIVSGIWALLCVWQTPDMLVEIETAWSLSGYLLVCFSAGYFIHDTVDIVASGQTRASWEYLVHHVMHMDTRTGHGHRNGG

SEQ ID NO: 810654 - protein, 583 aa, Homo sapiens
MKLLHVFLLFLCFHLRFCKVTYTSQEDLVEKKCLAKKYTHLSCDKVFCQPWQRCIEGTCVCKLPYQCPKNGTAVCATNRRSFPTYCQQKSLECLHPGTKFLNNGTCTAEGKFSVSLKHGNTDSEGIVEVKLVDQDKTMFICKSSWSMREANVACLDLGFQQGADTQRRFKLSDLSINSTECLHVHCRGLETSLAECTFTKRRTMGYQDFADVVCYTQKADSPMDDFFQCVNGKYISQMKACDGINDCGDQSDELCCKACQGKGFHCKSGVCIPSQYQCNGEVDCITGEDEVGCAGFASVAQEETEILTADMDAERRRIKSLLPKLSCGVKNRMHIRRKRIVGGKRAQLGDLPWQVAIKDASGITCGGIYIGGCWILTAAHCLRASKTHRYQIWTTVVDWIHPDLKRIVIEYVDRIIFHENYNAGTYQNDIALIEMKKDGNKKDCELPRSIPACVPWSPYLFQPNDTCIVSGWGREKDNERVFSLQWGEVKLISNCSKFYGNRFYEKEMECAGTYDGSIDACKGDSGGPLVCMDANNVTYVWGVVSWGENCGKPEFPGVYTKVANYFDWISYHVGRPFISQYNV

SEQ ID NO: 810655 - protein, 161 aa, Homo sapiens
MKLLHVFLLFLCFHLRFCKVTYTSQEDLVEKKCLAKKYTHLSCDKVFCQPWQRCIEGTCVCKLPYQCPKNGTAVCATNRRSFPTYCQQKSLECLHPGTKFLNNGTCTAEGKFSVSLKHGNTDSEGIVEVKLVDQDKTMFICKSSWSMREANVACLDLGFQQ

SEQ ID NO: 810656 - protein, 224 aa, Homo sapiens
MKLLHVFLLFLCFHLRFCKVTYTSQEDLVEKKCLAKKYTHLSCDKVFCQPWQRCIEGTCVCKLPYQCPKNGTAVCATNRRSFPTYCQQKSLECLHPGTKFLNNGTCTAEGKFSVSLKHGNTDSEGIVEVKLVDQDKTMFICKSSWSMREANVACLDLGFQQGADTQRRFKLSDLSINSTECLHVHCRGLETSLAECTFTKRRTMGYQDFADVVCYTPESRFSNG

SEQ ID NO: 810657 - protein, 583 aa, Homo sapiens; identical to SEQ ID NO: 810654

SEQ ID NO: 810658 - protein, 256 aa, Homo sapiens
RYHYSRLAHKKETNVRKRAQLGDLPWQVAIKDASGITCGGIYIGGCWILTAAHCLRASKTHRYQIWTTVVDWIHPDLKRIVIEYVDRIIFHENYNAGTYQNDIALIEMKKDGNKKDCELPRSIPACVPWSPYLFQPNDTCIVSGWGREKDNERVFSLQWGEVKLISNCSKFYGNRFYEKEMECAGTYDGSIDACKGDSGGPLVCMDANNVTYVWGVVSWGENCGKPEFPGVYTKVANYFDWISYHVGRPFISQYNV

SEQ ID NO: 810659 - protein, 506 aa, Homo sapiens
MKLLHVFLLFLCFHLRFCKVTYTSQEDLVEKKCLAKKYTHLSCDKVFCQPWQRCIEGTCVCKLPYQCPKNGTAVCATNRRSFPTYCQQKSLECLHPGTKFLNNGTCTAEGKFSVSLKHGNTDSEGIVEVKLVDQDKTMFICKSSWSMREANVACLDLGFQQGADTQRRFKLSDLSINSTECLHVHCRGLETSLAECTFTKRRTMGYQDFADVVCYTQKADSPMDDFFQCVNGKYISQMKACDGINDCGDQSDELCCKACQGKGFHCKSGVCIPSQYQCNGEVDCITGEDEVGCAGFASVAQEETEILTADMDAERRRIKSLLPKLSCGVKNRMHIRRKRIVGGKRAQLGDLPWQVAIKDASGITCGGIYIGGCWILTAAHCLRASKTHRYQIWTTVVDWIHPDLKRIVIEYVDRIIFHENYNAGTYQNDIALIEMKKDGNKKDCELPRSIPACVPWSPYLFQPNDTCIVSGWGREKDNERVFSLQWGEVKLISNCSKLPANRSEPL

SEQ ID NO: 810660 - protein, 231 aa, Homo sapiens
EAPLTLSPGGITCGGIYIGGCWILTAAHCLRASKTHRYQIWTTVVDWIHPDLKRIVIEYVDRIIFHENYNAGTYQNDIALIEMKKDGNKKDCELPRSIPACVPWSPYLFQPNDTCIVSGWGREKDNERVFSLQWGEVKLISNCSKFYGNRFYEKEMECAGTYDGSIDACKGDSGGPLVCMDANNVTYVWGVVSWGENCGKPEFPGVYTKVANYFDWISYHVGRPFISQYNV

SEQ ID NO: 810661 - protein, 217 aa, Homo sapiens
ITRSIWGVNSDCYHCLTASKTHRYQIWTTVVDWIHPDLKRIVIEYVDRIIFHENYNAGTYQNDIALIEMKKDGNKKDCELPRSIPACVPWSPYLFQPNDTCIVSGWGREKDNERVFSLQWGEVKLISNCSKFYGNRFYEKEMECAGTYDGSIDACKGDSGGPLVCMDANNVTYVWGVVSWGENCGKPEFPGVYTKVANYFDWISYHVGRPFISQYNV

SEQ ID NO: 810662 - protein, 438 aa, Homo sapiens
MKLLHVFLLFLCFHLRFCKVTYTSQEDLVEKKCLAKKYTHLSCDKVFCQPWQRCIEGTCVCKLPYQCPKNGTAVCATNRRSFPTYCQQKSLECLHPGTKFLNNGTCTAEGKFSVSLKHGNTDSEGIVEVKLVDQDKTMFICKSSWSMREANVACLDLGFQQGADTQRRFKLSDLSINSTECLHVHCRGLETSLAECTFTKRRTMGYQDFADVVCYTQKADSPMDDFFQCVNGKYISQMKACDGINDCGDQSDELCCKACQGKGFHCKSGVCIPSQYQCNGEVDCITGEDEVGCAGFASVAQEETEILTADMDAERRRIKSLLPKLSCGVKNRMHIRRKRIVGGKRAQLGDLPWQVAIKDASGITCGGIYIGGCWILTAAHCLRASKTHRYQIWTTVVDWIHPDLKRIVIEYVDRIIFHENYNAGHLTMALIRAGRAKS

SEQ ID NO: 810663 - protein, 224 aa, Homo sapiens; identical to SEQ ID NO: 810656

SEQ ID NO: 810664 - protein, 104 aa, Homo sapiens
MLVNGENFGVSLNIFPSVAINKSSGAPRRVPAQGSIKDHTAGLRLTALSPEHQSPAESGDNTSSLQRGTSPPAATSLRLLLSSKDSLGFKCHFPCFRDPGVLIA

SEQ ID NO: 810665 - protein, 122 aa, Homo sapiens
RPPAQGGEPGSGAARRSRLPPIPAPGSRTGRPGDAGGLLACARLPCAPGARHDPCRPCPKCPLPSLRRNWRPATKPQSLPQFPHLYTGPITLVPALGRSQHVEVPCGAIPAIVLIFPELELP

SEQ ID NO: 810666 - protein, 125 aa, Homo sapiens
ERLPPGCSAGASAMSELPGDVRAFLREHPSLRLQTDARKVRCILTGHELPCRLPELQVYTRGKKYQRLVRASPAFDYAEFEPHIVPSTKNPHQLFCKLTLRHINKCPEHVLRHTQGRRYQRALCK

SEQ ID NO: 810667 - protein, 269 aa, Homo sapiens
ERLPPGCSAGASAMSELPGDVRAFLREHPSLRLQTDARKVRCILTGHELPCRLPELQVYTRGKKYQRLVRASPAFDYAEFEPHIVPSTKNPHQLFCKLTLRHINKCPEHVLRHTQGRRYQRALCKYEECQKQGVEYVPACLVHRRRRREDQMDGDGPRPREAFWEPTSSDEGGAASDDSMTDLYPPELFTRKDLGSTEDGDGTDDFLTDKEDEKAKPPREKATDESRRETTVYRGLVQKRGKKQLGSLKKKFKSHHRKPKSFSSCKQPG

SEQ ID NO: 810668 - protein, 324 aa, Homo sapiens
ERLPPGCSAGASAMSELPGDVRAFLREHPSLRLQTDARKVRCILTGHELPCRLPELQVYTRGKKYQRLVRASPAFDYAEFEPHIVPSTKNPWWSAAARGGPGQLGQPLRWTPPVLQPLLFQSWEPWDPGGRPGAGITCGPSGEASWHQLFCKLTLRHINKCPEHVLRHTQGRRYQRALCKYEECQKQGVEYVPACLVHRRRRREDQMDGDGPRPREAFWEPTSSDEGGAASDDSMTDLYPPELFTRKDLGSTEDGDGTDDFLTDKEDEKAKPPREKATDESRRETTVYRGLVQKRGKKQLGSLKKKFKSHHRKPKSFSSCKQPG

SEQ ID NO: 810669 - protein, 72 aa, Homo sapiens
QAMGYRMRTCQGQEDTFQKEALKGQAKKQEHGFTSHWLRVLQEFLTQKREWLKRREWTWSPPGRAPLTSSYP

SEQ ID NO: 810670 - protein, 50 aa, Homo sapiens
MRHISSCLYAEVPSSFHWLVDRRERSKVPYIVRQCVEEIERRGMEEVGIY

SEQ ID NO: 810671 - protein, 381 aa, Homo sapiens
MSGVVRTLSRCLLPAEAGGARERRAGSGARDAEREARRRSRDIDALLARERRAVRRLVKILLLGAGESGKSTFLKQMRIIHGREFDQKALLEFRDTIFDNILKGSRVLVDARDKLGIPWQYSENEKHGMFLMAFENKAGLPVEPATFQLYVPALSALWRDSGIREAFSRRSEFQLGESVKYFLDNLDRIGQLNYFPSKQDILLARKATKGIVEHDFVIKKIPFKMVDVGGQRSQRQKWFQCFDGITSILFMVSSSEYDQVLMEDRRTNRLVESMNIFETIVNNKLFFNVSIILFLNKMDLLVEKVKTVSIKKHFPDFRGDPHRLEDVQRYLVQCFDRKRRNRSKPLFHHFTTAIDTENVRFVFHAVKDTILQENLKDIMLQ

SEQ ID NO: 810672 - protein, 102 aa, Homo sapiens
MPFFLTPFEPAHIDGHKRRQEIQCGKLGTYSWPPCPELPFLCSGPSPRSRRTHCRRDQLDGLLALAPVPFRTLNTERNRVLCAAPPRRSLQRQHHLRRAIMP

SEQ ID NO: 810673 - protein, 102 aa, Homo sapiens; identical to SEQ ID NO: 810672

SEQ ID NO: 810674 - protein, 232 aa, Homo sapiens
MINNQNTGWSRCYIKGSRGEGARATQGESVKYFLDNLDRIGQLNYFPSKQDILLARKATKGIVEHDFVIKKIPFKMVDVGGQRSQRQKWFQCFDGITSILFMVSSSEYDQVLMEDRRTNRLVESMNIFETIVNNKLFFNVSIILFLNKMDLLVEKVKTVSIKKHFPDFRGDPHRLEDVQRYLVQCFDRKRRNRSKPLFHHFTTAIDTENVRFVFHAVKDTILQENLKDIMLQ

SEQ ID NO: 810675 - protein, 196 aa, Homo sapiens
MSGVVRTLSRCLLPAEAGGARERRAGSGARDAEREARRRSRDIDALLARERRAVRRLVKILLLGAGESGKSTFLKQMRIIHGREFDQKALLEFRDTIFDNILKGSRVLVDARDKLGIPWQYSENEKHGMFLMAFENKAGLPVEPATFQLYVPALSALWRDSGIREAFSRRSEFQLAPAHAAGGHTAEGTSWTAFWL

SEQ ID NO: 810676 - protein, 94 aa, Homo sapiens
MQGCGQQREPLETVAPLLLLSPTAGSQGISRSLGVMQEIFATNVFPICAPQRRSVQTRPRTLGQVGDFETRASRTEPDLHLEITRMKLVLCGSP

SEQ ID NO: 810677 - protein, 102 aa, Homo sapiens; identical to SEQ ID NO: 810672

SEQ ID NO: 810678 - protein, 217 aa, Homo sapiens
MCSEIILRQEVLKDGFHRDLLIKVKFGESIEDLHTCRLLIKQDIPAGLYVDPYELASLRERNITEAVMVSENFDIEAPNYLSKESEVLIYARRDSQCIDCFQAFLPVHCRYHRPHSEDGEASIVVNNPDLLMFCDQEFPILKCWAHSEVAAPCALENEDICQWNKMKYKSVYKNVILQVPVGLTVHTSLVCSVTLLITILCSTLILVAVFKYGHFSL

SEQ ID NO: 810679 - protein, 150 aa, Homo sapiens
MCSEIILRQEVLKDGFHRDLLIKVKFGESIEDLHTCRLLIKQDIPAGLYVDPYELASLRERNITEAVMVSENFDIEAPNYLSKESEVLIYARRDSQCIDCFQAFLPVHCRYHRPHSEDGEASIVVNNPDLLMFCDQGEGCKCFLRVETSE

SEQ ID NO: 810680 - protein, 235 aa, Homo sapiens
MCSEIILRQEVLKDGFHRDLLIKVKFGESIEDLHTCRLLIKQDIPAGLYVDPYELASLRERNITEAVMVSENFDIEAPNYLSKESEVLIYARRDSQCIDCFQAFLPVHCRYHRPHSEDGEASIVVNNPDLLMFCDQAGSRRMIRFRFDSFDKTIEFPILKCWAHSEVAAPCALENEDICQWNKMKYKSVYKNVILQVPVGLTVHTSLVCSVTLLITILCSTLILVAVFKYGHFSL

SEQ ID NO: 810681 - protein, 692 aa, Homo sapiens
MELLPLWLCLGFHFLTVGWRNRSGTATAASQGVCKLVGGAADCRGQSLASVPSSLPPHARMLTLDANPLKTLWNHSLQPYPLLESLSLHSCHLERISRGAFQEQGHLRSLVLGDNCLSENYEETAAALHALPGLRRLDLSGNALTEDMAALMLQNLSSLRSVSLAGNTIMRLDDSVFEGLERLRELDLQRNYIFEIEGGAFDGLAELRHLNLAFNNLPCIVDFGLTRLRVLNVSYNVLEWFLATGGEAAFELETLDLSHNQLLFFPLLPQYSKLRTLLLRDNNMGFYRDLYNTSSPREMVAQFLLVDGNVTNITTVSLWEEFSSSDLADLRFLDMSQNQFQYLPDGFLRKMPSLSHLNLHQNCLMTLHIREHEPPGALTELDLSHNQLSELHLAPGLASCLGSLRLFNLSSNQLLGVPPGLFANARNITTLDMSHNQISLCPLPAASDRVGPPSCVDFRNMASLRSLSLEGCGLGALPDCPFQGTSLTYLDLSSNWGVLNGSLAPLQDVAPMLQVLSLRNMGLHSSFMALDFSGFGNLRDLDLSGNCLTTFPRFGGSLALETLDLRRNSLTALPQKAVSEQLSRGLRTIYLSQNPYDCCGVDGWGALQHGQTVADWAMVTCNLSSKIIRVTELPGGVPRDCKWERLDLGLLYLVLILPSCLTLLVACTVIVLTFKKPLLQVIKSRCHWSSVY

SEQ ID NO: 810682 - protein, 217 aa, Homo sapiens; identical to SEQ ID NO: 810678

SEQ ID NO: 810683 - protein, 217 aa, Homo sapiens; identical to SEQ ID NO: 810678

SEQ ID NO: 810684 - protein, 217 aa, Homo sapiens; identical to SEQ ID NO: 810678

SEQ ID NO: 810685 - protein, 150 aa, Homo sapiens [sequence omitted]

SEQ ID NO: 810686 - protein, 150 aa, Homo sapiens [sequence omitted]

SEQ ID NO: 810687 - protein, 150 aa, Homo sapiens [sequence omitted]

SEQ ID NO: 810688 - protein, 201 aa, Homo sapiens
MAEQRLRDVVTLCTSSLLIQGHFSARNFNVVSRDEVGIPFTEQEKTIHRAVMVSENFDIEAPNYLSKESEVLIYARRDSQCIDCFQAFLPVHCRYHRPHSEDGEASIVVNNPDLLMFCDQEFPILKCWAHSEVAAPCALENEDICQWNKMKYKSVYKNVILQVPVGLTVHTSLVCSVTLLITILCSTLILVAVFKYGHFSL

SEQ ID NO: 810689 - protein, 107 aa, Homo sapiens
MGVGWRGRRRPSWGCRVGSIRKPRLHSLGSGAGRRLTPRTSPCPASPTLVAGEVLLCCAGGAEPLQQHGRPGDARAGGAAEAEHPPRAPLLPGRGSTSPRAGPWAGV

SEQ ID NO: 810690 - protein, 146 aa, Homo sapiens
MRCPRIVPSGHLDVGLELKGHPGSPAALARRDPRRVRQRGPAEQDLPADLRGGLGEAGGHLHWARAAPPLPQPRPQPVAGGEGGTIGTARALFFPDAAAGHGTGWAGTVTTRVRRPLGKSSDDWSFGGRGWGWGGEVAVGLAGAAG

SEQ ID NO: 810691 - protein, 127 aa, Homo sapiens
LWGEDSITTLGVRGLTGAGNPCWGSRRGEVGPGGVHREEPGPDQGLLVTWTPKGAPRRGLCTVCLPLTRNFFPQIKQRAGCTPHLPQALFKYHHTGKAFPDHPSLPLPATGQALSISLPSWKVSSRQ

SEQ ID NO: 810692 - protein, 251 aa, Homo sapiens
MAHRLQIRLLTWDVKDTLLRLRHPLGEAYATKARAHGLEVEPSALEQGFRQAYRAQSHSFPNYGLSHGLTSRQWWLDVVLQTFHLAGVQDAQAVAPIAEQLYKDFSHPCTWQVLDGAEDTLRECRTRGLRLAVISNFDRRLEGILEGLGLREHFDFVLTSEAAGWPKPDPRIFQEALRLAHMEPVVAAHVGDNYLCDYQGPRAVGMHSFLVVGPQALDPVVRDSVPKEHILPSLAHLLPALDCLEGSTPGL

SEQ ID NO: 810693 - protein, 251 aa, Homo sapiens; identical to SEQ ID NO: 810692

SEQ ID NO: 810694 - protein, 251 aa, Homo sapiens; identical to SEQ ID NO: 810692

SEQ ID NO: 810695 - protein, 252 aa, Homo sapiens
MAHRLQIRLLTWDVKDTLLRLRHPLGEAYATKARAHGLEVEPSALEQGFRQAYRAQSHSFPNYGLSHGLTSRQWWLDVVLQTFHLAGVQDAQAVAPIAEQLYKDFSHPCTWQVLDGAEDTLRECRTRGLRLAVISNFDRRLEGILEGLGLREHFDFVLTSEAAGWPKPDPRIFQEALRLAHMEPVVAAHVGDNYLCDYQGPRAVGMHSFLVVGPQALDPVVRDSVPKEHILPSLAQGPATSLTGLVLDRERP

SEQ ID NO: 810696 - protein, 113 aa, Homo sapiens
GVEAHWGIWCLEENQDLILPPVRAAGWPKPDPRIFQEALRLAHMEPVVAAHVGDNYLCDYQGPRAVGMHSFLVVGPQALDPVVRDSVPKEHILPSLAHLLPALDCLEGSTPGL

SEQ ID NO: 810697 - protein, 72 aa, Homo sapiens
PGACAPPPELAGLAAAFSICFLVSQVGPGPRNRPGAVDALQLRRGPKGSAAAKAPRTAAPAHAADGSYRHSA

SEQ ID NO: 810698 - protein, 135 aa, Homo sapiens
HPALKPRAKHPRTLTSSSSRAAGASPAPWPGASSRPPPPPVSPPWPPCKATWVSAGGRCLYAALPRRPFGLEGGRGHLAEADLGTTTLGPKLLCCRHCRGRRLAVRGAGAAEPQDPGSRAGGRPALGEAFVEPAA

SEQ ID NO: 810699 - protein, 112 aa, Homo sapiens
RPRPRWGGRSKDGGKPFVLLPGVLGFMDSKEWNFGPCDSLAQLPRLECSGVIMAHCSLELLGSSYPPTSASLVAGTTSAGHAWLLWIVDFLFHELDTISHDIMHLAPMLLLL

SEQ ID NO: 810700 - protein, 734 aa, Homo sapiens
MLLWLLLLILTPGREQSGVAPKAVLLLNPPWSTAFKGEKVALICSSISHSLAQGDTYWYHDEKLLKIKHDKIQITEPGNYQCKTRGSSLSDAVHVEFSPDWLILQALHPVFEGDNVILRCQGKDNKNTHQKVYYKDGKQLPNSYNLEKITVNSVSRDNSKYHCTAYRKFYILDIEVTSKPLNIQVQELFLHPVLRASSSTPIEGSPMTLTCETQLSPQRPDVQLQFSLFRDSQTLGLGWSRSPRLQIPAMWTEDSGSYWCEVETVTHSIKKRSLRSQIRVQRVPVSNVNLEIRPTGGQLIEGENMVLICSVAQGSGTVTFSWHKEGRVRSLGRKTQRSLLAELHVLTVKESDAGRYYCAADNVHSPILSTWIRVTVRIPVSHPVLTFRAPRAHTVVGDLLELHCESLRGSPPILYRFYHEDVTLGNSSAPSGGGASFNLSLTAEHSGNYSCDADNGLGAQHSHGVSLRVTVPVSRPVLTLRAPGAQAVVGDLLELHCESLRGSFPILYWFYHEDDTLGNISAHSGGGASFNLSLTTEHSGNYSCEADNGLGAQHSKVVTLNVTGTSRNRTGLTAAGITGLVLSILVLAAAAALLHYARARRKPGGLSATGTSSHSPSECQEPSSSRPSRIDPQEPTHSKPLAPMELEPMYSNVNPGDSNPIYSQIWSIQHTKENSANCPMMHQEHEELTVLYSELKKTHPDDSAGEASSRGRAHEEDDEENYENVPRVLLASDH

SEQ ID NO: 810701 - protein, 812 aa, Homo sapiens
MLLWLLLLILTPGREQSGVAPKAVLLLNPPWSTAFKGEKVALICSSISHSLAQGDTYWYHDEKLLKIKHDKIQITEPGNYQCKTRGSSLSDAVHVEFSPDWLILQALHPVFEGDNVILRCQGKDNKNTHQKVYYKDGKQLPNSYNLEKITVNSVSRDNSKYHCTAYRKFYILDIEVTSKPLNIQVQGNGRFLWITGFVRETGDKGKMFISGEFHKESPMAQPWEGDGSFCMLLYLLMAGAEDDKCISLGTLSLTTLETMLFLFIELFLHPVLRASSSTPIEGSPMTLTCETQLSPQRPDVQLQFSLFRDSQTLGLGWSRSPRLQIPAMWTEDSGSYWCEVETVTHSIKKRSLRSQIRVQRVPVSNVNLEIRPTGGQLIEGENMVLICSVAQGSGTVTFSWHKEGRVRSLGRKTQRSLLAELHVLTVKESDAGRYYCAADNVHSPILSTWIRVTVRIPVSHPVLTFRAPRAHTVVGDLLELHCESLRGSPPILYRFYHEDVTLGNSSAPSGGGASFNLSLTAEHSGNYSCDADNGLGAQHSHGVSLRVTVPVSRPVLTLRAPGAQAVVGDLLELHCESLRGSFPILYWFYHEDDTLGNISAHSGGGASFNLSLTTEHSGNYSCEADNGLGAQHSKVVTLNVTGTSRNRTGLTAAGITGLVLSILVLAAAAALLHYARARRKPGGLSATGTSSHSPSECQEPSSSRPSRIDPQEPTHSKPLAPMELEPMYSNVNPGDSNPIYSQIWSIQHTKENSANCPMMHQEHEELTVLYSELKKTHPDDSAGEASSRGRAHEEDDEENYENVPRVLLASDH

SEQ ID NO: 810702 - protein, 740 aa, Homo sapiens
MLLWLLLLILTPGREQSGVAPKAVLLLNPPWSTAFKGEKVALICSSISHSLAQGDTYWYHDEKLLKIKHDKIQITEPGNYQCKTRGSSLSDAVHVEFSPDWLILQALHPVFEGDNVILRCQGKDNKNTHQKVYYKDGKQLPNSYNLEKITVNSVSRDNSKYHCTAYRKFYILDIEVTSKPLNIQVQELFLHPVLRASSSTPIEGSPMTLTCETQLSPQRPDVQLQFSLFRDSQTLGLGWSRSPRLQIPAMWTEDSGSYWCEVETVTHSIKKRSLRSQIRVQRVPVSNVNLEIRPTGGQLIEGENMVLICSVAQGSGTVTFSWHKEGRVRSLGRKTQRSLLAELHVLTVKESDAGRYYCAADNVHSPILSTWIRVTVRTLLSPSVPVSHPVLTFRAPRAHTVVGDLLELHCESLRGSPPILYRFYHEDVTLGNSSAPSGGGASFNLSLTAEHSGNYSCDADNGLGAQHSHGVSLRVTVPVSRPVLTLRAPGAQAVVGDLLELHCESLRGSFPILYWFYHEDDTLGNISAHSGGGASFNLSLTTEHSGNYSCEADNGLGAQHSKVVTLNVTGTSRNRTGLTAAGITGLVLSILVLAAAAALLHYARARRKPGGLSATGTSSHSPSECQEPSSSRPSRIDPQEPTHSKPLAPMELEPMYSNVNPGDSNPIYSQIWSIQHTKENSANCPMMHQEHEELTVLYSELKKTHPDDSAGEASSRGRAHEEDDEENYENVPRVLLASDH

SEQ ID NO: 810703 - protein, 485 aa, Homo sapiens
MWTEDSGSYWCEVETVTHSIKKRSLRSQIRVQRVPVSNVNLEIRPTGGQLIEGENMVLICSVAQGSGTVTFSWHKEGRVRSLGRKTQRSLLAELHVLTVKESDAGRYYCAADNVHSPILSTWIRVTVRIPVSHPVLTFRAPRAHTVVGDLLELHCESLRGSPPILYRFYHEDVTLGNSSAPSGGGASFNLSLTAEHSGNYSCDADNGLGAQHSHGVSLRVTVPVSRPVLTLRAPGAQAVVGDLLELHCESLRGSFPILYWFYHEDDTLGNISAHSGGGASFNLSLTTEHSGNYSCEADNGLGAQHSKVVTLNVTGTSRNRTGLTAAGITGLVLSILVLAAAAALLHYARARRKPGGLSATGTSSHSPSECQEPSSSRPSRIDPQEPTHSKPLAPMELEPMYSNVNPGDSNPIYSQIWSIQHTKENSANCPMMHQEHEELTVLYSELKKTHPDDSAGEASSRGRAHEEDDEENYENVPRVLLASDH

SEQ ID NO: 810704 - protein, 639 aa, Homo sapiens
MLLWLLLLILTPGREQSGVAPKAVLLLNPPWSTAFKGEKVALICSSISHSLAQGDTYWYHDEKLLKIKHDKIQITEPGNYQCKTRGSSLSDAVHVEFSPDWLILQALHPVFEGDNVILRCQGKDNKNTHQKVYYKDGKQLPNSYNLEKITVNSVSRDNSKYHCTAYRKFYILDIEVTSKPLNIQVQGVPVSNVNLEIRPTGGQLIEGENMVLICSVAQGSGTVTFSWHKEGRVRSLGRKTQRSLLAELHVLTVKESDAGRYYCAADNVHSPILSTWIRVTVRIPVSHPVLTFRAPRAHTVVGDLLELHCESLRGSPPILYRFYHEDVTLGNSSAPSGGGASFNLSLTAEHSGNYSCDADNGLGAQHSHGVSLRVTVPVSRPVLTLRAPGAQAVVGDLLELHCESLRGSFPILYWFYHEDDTLGNISAHSGGGASFNLSLTTEHSGNYSCEADNGLGAQHSKVVTLNVTGTSRNRTGLTAAGITGLVLSILVLAAAAALLHYARARRKPGGLSATGTSSHSPSECQEPSSSRPSRIDPQEPTHSKPLAPMELEPMYSNVNPGDSNPIYSQIWSIQHTKENSANCPMMHQEHEELTVLYSELKKTHPDDSAGEASSRGRAHEEDDEENYENVPRVLLASDH

SEQ ID NO: 810705 - protein, 734 aa, Homo sapiens; identical to SEQ ID NO: 810700

SEQ ID NO: 810706 - protein, 734 aa, Homo sapiens; identical to SEQ ID NO: 810700

SEQ ID NO: 810707 - protein, 750 aa, Homo sapiens
MLLWLLLLILTPGREQSGVAPKAVLLLNPPWSTAFKGEKVALICSSISHSLAQGDTYWYHDEKLLKIKHDKIQITEPGNYQCKTRGSSLSDAVHVEFSPDWLILQALHPVFEGDNVILRCQGKDNKNTHQKVYYKDGKQLPNSYNLEKITVNSVSRDNSKYHCTAYRKFYILDIEVTSKPLNIQVQELFLHPVLRASSSTPIEGSPMTLTCETQLSPQRPDVQLQFSLFRDSQTLGLGWSRSPRLQIPAMWTEDSGSYWCEVETVTHSIKKRSLRSQIRVQRVPVSNVNLEIRPTGGQLIEGENMVLICSVAQGSGTVTFSWHKEGRVRSLGRKTQRSLLAELHVLTVKESDAGRYYCAADNVHSPILSTWIRVTVRIPVSHPVLTFRAPRAHTVVGDLLELHCESLRGSPPILYRFYHEDVTLGNSSAPSGGGASFNLSLTAEHSGNYSCDADNGLGAQHSHGVSLRVTVPVSRPVLTLRAPGAQAVVGDLLELHCESLRGSFPILYWFYHEDDTLGNISAHSGGGASFNLSLTTEHSGNYSCEADNGLGAQHSKVVTLNVTGTSRNRTGLTAAGITGLVLSILVLAAAAALLHYARARRKPGGLSATGTSSHSPSECQEPSSSRPSRIDPQEPTHSKPLAPMELEPMYSNVNPGDSNPIYSQIWSIQHTKENSESNRGNSQEIKQIKKIGLEYFFYVGLEESSRGNSKRSSKSRRLVWNAVCVRCKLEYIAHSLILFFATPTQQLIVQ

SEQ ID NO: 810708 - protein, 707 aa, Homo sapiens
MLLWLLLLILTPGREQSGVAPKAVLLLNPPWSTAFKGEKVALICSSISHSLAQGDTYWYHDEKLLKIKHDKIQITEPGNYQCKTRGSSLSDAVHVEFSPDWLILQALHPVFEGDNVILRCQGKDNKNTHQKVYYKDGKQLPNSYNLEKITVNSVSRDNSKYHCTAYRKFYILDIEVTSKPLNIQVQEIARPSDWAGAGPPDSRSLPCGLKTQGLTGVEVETVTHSIKKRSLRSQIRVQRVPVSNVNLEIRPTGGQLIEGENMVLICSVAQGSGTVTFSWHKEGRVRSLGRKTQRSLLAELHVLTVKESDAGRYYCAADNVHSPILSTWIRVTVRIPVSHPVLTFRAPRAHTVVGDLLELHCESLRGSPPILYRFYHEDVTLGNSSAPSGGGASFNLSLTAEHSGNYSCDADNGLGAQHSHGVSLRVTVPVSRPVLTLRAPGAQAVVGDLLELHCESLRGSFPILYWFYHEDDTLGNISAHSGGGASFNLSLTTEHSGNYSCEADNGLGAQHSKVVTLNVTGTSRNRTGLTAAGITGLVLSILVLAAAAALLHYARARRKPGGLSATGTSSHSPSECQEPSSSRPSRIDPQEPTHSKPLAPMELEPMYSNVNPGDSNPIYSQIWSIQHTKENSESNRGNSQEIKQIKKIGLEYFFYVGLEESSRGNSKRSSKSRRLVWNAVCVRCKLEYIAHSLILFFATPTQQLIVQ

SEQ ID NO: 810709 - protein, 169 aa, Homo sapiens
MEVYIPSFRYEESDLERGYTVFKIEVLMNGRKHFVEKRYSEFHALHKKLKKCIKTPEIPSKHVRNWVPKVLEQRRQGLETYLQAVILENEELPKLFLDFLNVRHLPSLPKAESCGSFDETESEESSKLSHQPVLLFLRDPYVLPAASDFPNVVIEGVLHGIFYPHLQPR

SEQ ID NO: 810710 - protein, 159 aa, Homo sapiens
MEVYIPSFRYEESDLERGYTVFKIEVLMNGRKHFVEKRYSEFHALHKKLKKCIKTPEIPSKHVRNWVPKVLEQRRQGLETYLQAVILENEELPKLFLDFLNVRHLPSLPKAESCGSFDETESEESSKLSHQPVLLFLRDPYVLPAASGNQTCHLLTALY

SEQ ID NO: 810711 - protein, 89 aa, Homo sapiens
RPESGPQPRGPASAAGREAGRPGRGRSGGRGREPAPNSPSAGWPARPWRSTSRPFAMKRATWSGDTRYLTSPISTINSHGGLTIFGTFI

SEQ ID NO: 810712 - protein, 155 aa, Homo sapiens
MEVYIPSFRYEESDLERGYTVFKIEVLMNGRKHFVEKRYSEFHALHKKLKKCIKTPEIPSKHVRNWVPKVLEQRRQGLETYLQMIIFIFGFKERRPNLKEIKLRHTSPVARATKFSTVLGTTFPKRPITILPTSLSPILTSKKTCVQLKGKVEGY

SEQ ID NO: 810713 - protein, 169 aa, Homo sapiens; identical to SEQ ID NO: 810709

SEQ ID NO: 810714 - protein, 169 aa, Homo sapiens; identical to SEQ ID NO: 810709

SEQ ID NO: 810715 - protein, 169 aa, Homo sapiens; identical to SEQ ID NO: 810709

SEQ ID NO: 810716 - protein, 172 aa, Homo sapiens
RQVRGRVIPSFRYEESDLERGYTVFKIEVLMNGRKHFVEKRYSEFHALHKKLKKCIKTPEIPSKHVRNWVPKVLEQRRQGLETYLQAVILENEELPKLFLDFLNVRHLPSLPKAESCGSFDETESEESSKLSHQPVLLFLRDPYVLPAASDFPNVVIEGVLHGIFYPHLQPR

SEQ ID NO: 810717 - protein, 142 aa, Homo sapiens
MNGRKHFVEKRYSEFHALHKKLKKCIKTPEIPSKHVRNWVPKVLEQRRQGLETYLQAVILENEELPKLFLDFLNVRHLPSLPKAESCGSFDETESEESSKLSHQPVLLFLRDPYVLPAASDFPNVVIEGVLHGIFYPHLQPR

SEQ ID NO: 810718 - protein, 102 aa, Homo sapiens
MEVYIPSFRYEESDLERGYTVFKIEVLMNGRKHFVEKRYSEFHALHKKLKKCIKTPEIPSKHVRNWVPKVLEQRRQGLETYLQEKVNTYTHMDGERDRGMDG

SEQ ID NO: 810719 - protein, 159 aa, Homo sapiens; identical to SEQ ID NO: 810710

SEQ ID NO: 810720 - protein, 102 aa, Homo sapiens; identical to SEQ ID NO: 810718

SEQ ID NO: 810721 - protein, 73 aa, Homo sapiens
MEVYIPSFRYEESDLERGYTVGAGRGRTGPREPGLRLLRPGNTLGRRRLGAGGPLVFSPLPRPRGRAAPLARL

SEQ ID NO: 810722 - protein, 115 aa, Homo sapiens
MYFNCSEDNPSRERCSVPYSCCLPTPDQAVINTMCGQGMQAFDYLEASKVIYTNGCIDKLVNWIHSNLFLLGGVALGLAIPQLVGILLSQILVNQIKDQIKLQLYNQQHRADPWY

SEQ ID NO: 810723 - protein, 283 aa, Homo sapiens
MARRPRAPAASGEEFSFVSPLVKYLLFFFNMLFWVISMVMVAVGVYARLMKHAEAALACLAVDPAILLIVVGVLMFLLTFCGCIGSLRENICLLQTFSLCLTAVFLLQLAAGILGFVFSDKARGKVSEIINNAIVHYRDDLDLQNLIDFGQKKFSCCGGISYKDWSQNMYFNCSEDNPSRERCSVPYSCCLPTPDQAVINTMCGQGMQAFDYLEASKVIYTNGCIDKLVNWIHSNLFLLGGVALGLAIPQLVGILLSQILVNQIKDQIKLQLYNQQHRADPWY

SEQ ID NO: 810724 - protein, 120 aa, Homo sapiens
METGKPHKRTAVGAESSTKWRFGFQPPSDSPVGRSKLQMGRRQGAQVAPVSGGCASSPPSQPSALCQSDTLKCLGLCFQFCLGNSSCTESWGYCCCLFTEALPPPALAGMLLSLADILRS

SEQ ID NO: 810725 - protein, 283 aa, Homo sapiens; identical to SEQ ID NO: 810723

SEQ ID NO: 810726 - protein, 283 aa, Homo sapiens; identical to SEQ ID NO: 810723

SEQ ID NO: 810727 - protein, 283 aa, Homo sapiens; identical to SEQ ID NO: 810723

SEQ ID NO: 810728 - protein, 283 aa, Homo sapiens; identical to SEQ ID NO: 810723

SEQ ID NO: 810729 - protein, 283 aa, Homo sapiens; identical to SEQ ID NO: 810723

SEQ ID NO: 810730 - protein, 299 aa, Homo sapiens
MARRPRAPAASGEEFSFVSPLVKYLLFFFNMLFWVISMVMVAVGVYARLMKHAEAALACLAVDPAILLIVVGVLMFLLTFCGCIGSLRENICLLQTFSLCLTAVFLLQLAAGILGFVFSDKARGKVSEIINNAIVHYRDDLDLQNLIDFGQKKFSCCGGISYKDWSQNMYFNCSEDNPSRERCSVPYSCCLPTPDQAVINTMCGQGMQAFDYLEASKVIYTNGCIDKLVNWIHSNLFLLGGVALGLAIPQLVGILLSQILVNQIKDQIKLQLYNQQHHQDSSTTRQQHHQTAAHHDTAP

SEQ ID NO: 810731 - protein, 185 aa, Homo sapiens
MARRPRAPAASGEEFSFVSPLVKYLLFFFNMLFWVISMVMVAVGVYARLMKHAEAALACLAVDPAILLIVVGVLMFLLTFCGCIGSLRENICLLQTFSLCLTAVFLLQLAAGILGFVFSDKARGKVSEIINNAIVHYRDDLDLQNLIDFGQKKPNSSPPPLLRKKVWNPGPYTLQSEVGLSHTCP

SEQ ID NO: 810732 - protein, 113 aa, Homo sapiens
MRRKKALSSPTRALQDLLPESAVGRTPRKLGAVRWASWRREERARQAGRARPGRGAGLRGWSPPPRRPRPAPASPNPEEMGGCASCLPSECSRSLLAAPRYRALRPGARPGGK

SEQ ID NO: 810733 - protein, 216 aa, Homo sapiens
MARRPRAPAASGEEFSFVSPLVKYLLFFFNMLFWVISMVMVAVGVYARLMKHAEAALACLAVDPAILLIVVGVLMFLLTFCGCIGSLRENICLLQTFSLCLTAVFLLQLAAGILGFVFSDKARGKVSEIINNAIVHYRDDLDLQNLIDFGQKEKVWVSQWSGGLWVKVNVIPRDASPSMPVGLFITCQVMASGKGFGKKAHVAECFKCTFKDTEQY

SEQ ID NO: 810734 - protein, 548 aa, Homo sapiens
MATSSEEVLLIVKKVRQKKQDGALYLMAERIAWAPEGKDRFTISHMYADIKCQKISPEGKAKIQLQLVLHAGDTTNFHFSNESTAVKERDAVKDLLQQLLPKFKRKANKELEEKNRMLQEDPVLFQLYKDLVVSQVISAEEFWANRLNVNATDSSSTSNHKQDVGISAAFLADVRPQTDGCNGLRYNLTSDIIESIFRTYPAVKMKYAENVPHNMTEKEFWTRFFQSHYFHRDRLNTGSKDLFAECAKIDEKGLKTMVSLGVKNPLLDLTALEDKPLDEGYGISSVPSASNSKSIKENSNAAIIKRFNHHSAMVLAAGLRKQEAQNEQTSEPSNMDGNSGDADCFQPAVKRAKLQESIEYEDLGKNNSVKTIALNLKKSDRYYHGPTPIQSLQYATSQDIINSFQSIRQEMEAYTPKLTQVLSSSAASSTITALSPGGALMQGGTQQAINQMVPNDIQSELKHLYVAVGELLRHFWSCFPVNTPFLEEKVVKMKSNLERFQVTKLCPFQEKIRRQYLSTNLVSHIEEMLQTAYNKLHTWQSRRLMKKT

SEQ ID NO: 810735 - protein, 548 aa, Homo sapiens; identical to SEQ ID NO: 810734

SEQ ID NO: 810736 - protein, 131 aa, Homo sapiens
SAWSLPLRPRSRLRSLRPATAGPLRAGDTAPTGTGGALGQMVGPARIPGPFAARDRREETKQAGTRGGGRELAEGVMAAALLSHVPRARLATSGHVPSDSSQPAMEARPPSNRGGGYCCGHWVSASSQQRL

SEQ ID NO: 810737 - protein, 131 aa, Homo sapiens; identical to SEQ ID NO: 810736

SEQ ID NO: 810738 - protein, 548 aa, Homo sapiens; identical to SEQ ID NO: 810734

SEQ ID NO: 810739 - protein, 548 aa, Homo sapiens; identical to SEQ ID NO: 810734

SEQ ID NO: 810740 - protein, 548 aa, Homo sapiens; identical to SEQ ID NO: 810734

SEQ ID NO: 810741 - protein, 432 aa, Homo sapiens
MLQEDPVLFQLYKDLVVSQVISAEEFWANRLNVNATDSSSTSNHKQDVGISAAFLADVRPQTDGCNGLRYNLTSDIIESIFRTYPAVKMKYAENVPHNMTEKEFWTRFFQSHYFHRDRLNTGSKDLFAECAKIDEKGLKTMVSLGVKNPLLDLTALEDKPLDEGYGISSVPSASNSKSIKENSNAAIIKRFNHHSAMVLAAGLRKQEAQNEQTSEPSNMDGNSGDADCFQPAVKRAKLQESIEYEDLGKNNSVKTIALNLKKSDRYYHGPTPIQSLQYATSQDIINSFQSIRQEMEAYTPKLTQVLSSSAASSTITALSPGGALMQGGTQQAINQMVPNDIQSELKHLYVAVGELLRHFWSCFPVNTPFLEEKVVKMKSNLERFQVTKLCPFQEKIRRQYLSTNLVSHIEEMLQTAYNKLHTWQSRRLMKKT

SEQ ID NO: 810742 - protein, 138 aa, Homo sapiens
MEAYTPKLTQVLSSSAASSTITALSPGGALMQGGTQQAINQMVPNDIQSELKHLYVAVGELLRHFWSCFPVNTPFLEEKVVKMKSNLERFQVTKLCPFQEKIRRQYLSTNLVSHIEEMLQTAYNKLHTWQSRRLMKKT

SEQ ID NO: 810743 - protein, 385 aa, Homo sapiens [sequence omitted]

SEQ ID NO: 810744 - protein, 131 aa, Homo sapiens; identical to SEQ ID NO: 810736

SEQ ID NO: 810745 - protein, 189 aa, Homo sapiens
MATSSEEVLLIVKKVRQKKQDGALYLMAERIAWAPEGKDRFTISHMYADIKCQKISPEGKAKIQLQLVLHAGDTTNFHFSNESTAVKERDAVKDLLQQLLPKFKRKANKELEEKNRMLQEDPVLFQLYKDLVVSQVISAEEFWANRLNVNATDSSSTSNHKQDVGISAAFLVCEPSRFLKKIKIQTPKC

SEQ ID NO: 810746 - protein, 81 aa, Homo sapiens
RLQSAEMAPLYPSLGDKTETSLGCQRLRKPGASGRGSSVTLQRLPHRLLFAKWYQDFLVVVSKRVGFLTSHRPWLEVKSMF

SEQ ID NO: 810747 - protein, 147 aa, Homo sapiens
MLVRDSDQAQETTMSSRKSERERPLFLSRRYLLLRTQEAWGRAAPWTRRLGAGPAGPAGERKHKLQLLSCGTLRARCTATSSDGYLRIYRTDLDQTESREEGELHLTVHHPRQPQRRLFTSCLGTITPPHDRSEVSEKRSADFRNRV

SEQ ID NO: 810748 - protein, 147 aa, Homo sapiens; identical to SEQ ID NO: 810747

SEQ ID NO: 810749 - protein, 147 aa, Homo sapiens; identical to SEQ ID NO: 810747

SEQ ID NO: 810750 - protein, 102 aa, Homo sapiens
MKKRHREGCDMPGPWSTLRSHRGHHCPHLHPVLRRPTLTDVEACLQCLDVCGHPRHAVDAHLLHASALDLLHALTHDVGHLGPLSPAGGGNVLSVLTALLGP

SEQ ID NO: 810751 - protein, 437 aa, Homo sapiens
PSWANPLGGGSSADSRLTREGSKGWRSGPGVQWVQPACELRPDRGAPTDGKEKLITNGTIFCFEMEPAVSEPMRDQVARTHLTEDTPKVNADIEKVNQNQAKRCTVIGGSGFLGQHMVEQLLARGYAVNVFDIQQGFDNPQVRFFLGDLCSRQDLYPALKGVNTVFHCASPPPSSNNKELFYRVNYIGTKNVIETCKEAGVQKLILTSSASVIFEGVDIKNGTEDLPYAMKPIDYYTETKILQERAVLGANDPEKNFLTTAIRPHGIFGPRDPQLVPILIEAARNGKMKFVIGNGKNLVDFTFVENVVHGHILAAEQLSRDSTLGGKAFHITNDEPIPFWTFLSRILTGLNYEAPKYHIPYWVAYYLALLLSLLVMVISPVIQLQPTFTPMRVALAGTFHYYSCERAKKAMGYQPLVTMDDAMERTVQSFRHLRRVK

SEQ ID NO: 810752 - protein, 437 aa, Homo sapiens; identical to SEQ ID NO: 810751

SEQ ID NO: 810753 - protein, 437 aa, Homo sapiens; identical to SEQ ID NO: 810751

SEQ ID NO: 810754 - protein, 437 aa, Homo sapiens; identical to SEQ ID NO: 810751

SEQ ID NO: 810755 - protein, 373 aa, Homo sapiens
MEPAVSEPMRDQVARTHLTEDTPKVNADIEKVNQNQAKRCTVIGGSGFLGQHMVEQLLARGYAVNVFDIQQGFDNPQVRFFLGDLCSRQDLYPALKGVNTVFHCASPPPSSNNKELFYRVNYIGTKNVIETCKEAGVQKLILTSSASVIFEGVDIKNGTEDLPYAMKPIDYYTETKILQERAVLGANDPEKNFLTTAIRPHGIFGPRDPQLVPILIEAARNGKMKFVIGNGKNLVDFTFVENVVHGHILAAEQLSRDSTLGGKAFHITNDEPIPFWTFLSRILTGLNYEAPKYHIPYWVAYYLALLLSLLVMVISPVIQLQPTFTPMRVALAGTFHYYSCERAKKAMGYQPLVTMDDAMERTVQSFRHLRRVK

SEQ ID NO: 810756 - protein, 425 aa, Homo sapiens
PSWANPLGGGSSADSRLTREGSKGWRSGPGVQWVQPACELRPDRGAPTDGKEKLITNGTIFCFEMEPAVSEPMRDQVARTHLTEDTPKVNADIEKVNQNQAKRCTVIGGSGFLGQHMVEQLLARGYAVNVFDIQQGFDNPQDLYPALKGVNTVFHCASPPPSSNNKELFYRVNYIGTKNVIETCKEAGVQKLILTSSASVIFEGVDIKNGTEDLPYAMKPIDYYTETKILQERAVLGANDPEKNFLTTAIRPHGIFGPRDPQLVPILIEAARNGKMKFVIGNGKNLVDFTFVENVVHGHILAAEQLSRDSTLGGKAFHITNDEPIPFWTFLSRILTGLNYEAPKYHIPYWVAYYLALLLSLLVMVISPVIQLQPTFTPMRVALAGTFHYYSCERAKKAMGYQPLVTMDDAMERTVQSFRHLRRVK

SEQ ID NO: 810757 - protein, 372 aa, Homo sapiens
PSWANPLGGGSSADSRLTREGSKGWRSGPGVQWVQPACELRPDRGAPTDGKEKLITNGTIFCFEMEPAVSEPMRDQVARTHLTEDTPKVNADIEKVNQNQAKRCTVIGGSGFLGQHMVEQLLARGYAVNVFDIQQGFDNPQVRFFLGDLCSRQDLYPALKGVNTVFHCASPPPSSNNKELFYRVNYIGTKNVIETSIRPHGIFGPRDPQLVPILIEAARNGKMKFVIGNGKNLVDFTFVENVVHGHILAAEQLSRDSTLGGKAFHITNDEPIPFWTFLSRILTGLNYEAPKYHIPYWVAYYLALLLSLLVMVISPVIQLQPTFTPMRVALAGTFHYYSCERAKKAMGYQPLVTMDDAMERTVQSFRHLRRVK

SEQ ID NO: 810758 - protein, 368 aa, Homo sapiens
PSWANPLGGGSSADSRLTREGSKGWRSGPGVQWVQPACELRPDRGAPTDGKEKLITNGTIFCFEMEPAVSEPMRDQVARTHLTEDTPKVNADIEKVNQNQAKRCTVIGGSGFLGQHMVEQLLARGYAVNVFDIQQGFDNPQVRFFLGDLCSRQDLYPALKGVNTVFHCASPPPSSNNKELFYRVNYIGTKNVIETCKEAGVQKLILTSSASVIFEGVDIKNGTEDLPYAMKPIDYYTETKILQERAVLGANDPEKNFLTTAIRPHGIFGPRDPQLVPILIEAATKNSNSLINKLKFKKISHQPTRETQDKSPPPQGTRKKPPKRKGAQRKRDKKPPKKGAPKRRNKKRSPPSSKPKKQKQPLPLIEAK

SEQ ID NO: 810759 - protein, 161 aa, Homo sapiens
DAHGPVRTPGWRRKGPAAPVPPGSGRLGCKTSWGERHAVGAGARPSPQRPQGRAGVPPVGGLLEPQPALLHLSLELGAESRGRAWDLSGPSVPNPVPHPERPGRPRDLLSVRGCPQGGLLQWRQLSGNVTSCCLDPRKPSGVWTPEESLSSSRIALRPGAL

SEQ ID NO: 810760 - protein, 404 aa, Homo sapiens
HPGATQTPGTSTGSPLQVKALNTGVLRTRGCALQQGLCWDRPSCEAAVDLPEGHGSAAPETRPCQEGSVSAHSPLGFPGAGPPLAQHSPSQHRPRWALALYLCSWQASTPSQCPVPLRAQGDPSPAQLPCRTPASPIHAGLPPACPRRTPASPFHAGLPPACPRRTPASPFHAGLPPACHFRGSLGNQCSNDHCPGQNLRGGHRSPVCSDGAASVGDPWALNTLLSHCPSLPCEGHPQLLLKPGALWWETARQAVLNTLYCKLHTVLRRQKDPKFLFKKTVPVSVPANLKGRDKRTVCPSCNFISSVTVKLRAESTPGDRAATAAATESNPRSSSQRRPAFRSGTGLPTQRPPHPTLAPPPRDNLSSAQKRHLLMLDSLGPTCAKGAWFWGRRVLPDAQRVTGC

SEQ ID NO: 810761 - protein, 360 aa, Homo sapiens
HPGATQTPGTSTGSPLQVKALNTGVLRTRGCALQQGLCWDRPSCEAAVDLPEGHGSAAPETRPCQEGSVSAHSPLGFPGAGPPLAQHSPSQHRPRWALALYLCSWQASTPSQCPVPLRAQGDPSPAQLPCRTPASPIHAGLPPACPRRTPASPFHAGLPPACPRRTPASPFHAGLPPACHFRGSLGNQCSNDHCPGQNLRGGHRSPPRQAVLNTLYCKLHTVLRRQKDPKFLFKKTVPVSVPANLKGRDKRTVCPSCNFISSVTVKLRAESTPGDRAATAAATESNPRSSSQRRPAFRSGTGLPTQRPPHPTLAPPPRDNLSSAQKRHLLMLDSLGPTCAKGAWFWGRRVLPDAQRVTGC

SEQ ID NO: 810762 - protein, 493 aa, Homo sapiens
MDQDYERRLLRQIVIQNENTMPRVTEMRRTLTPASSPVSSPSKHGDRFIPSRAGANWSVNFHRINENEKSPSQNRKAKDATSDNGKDGLAYSALLKNELLGAGIEKVQDPQTEDRRLQPSTPEKKGLFTYSLSTKRSSPDDGNDVSPYSLSPVSNKSQKLLRSPRKPTRKISKIPFKVLDAPELQDDFYLNLVDWSSLNVLSVGLGTCVYLWSACTSQVTRLCDLSVEGDSVTSVGWSERGNLVAVGTHKGFVQIWDAAAGKKLSMLEGHTARVGALAWNAEQLSSGSRDRMILQRDIRTPPLQSERRLQGHRQEVCGLKWSTDHQLLASGGNDNKLLVWNHSSLSPVQQYTEHLAAVKAIAWSPHQHGLLASGGGTADRCIRFWNTLTGQPLQCIDTGSQVCNLAWSKHANELVSTHGYSQNQILVWKYPSLTQVAKLTGHSYRVLYLAMSPDGEAIVTGAGDETLRFWNVFSKTRSTKESVSVLNLFTRIR

SEQ ID NO: 810763 - protein, 377 aa, Homo sapiens
MDQDYERRLLRQIVIQNENTMPRVTEMRRTLTPASSPVSSPSKHGDRFIPSRAGANWSVNFHRINENEKSPSQNRKAKDATSDNGKDGLAYSALLKNELLGAGIEKVQDPQTEDRRLQPSTPEKKGLFTYSLSTKRSSPDDGNDVSPYSLSPVSNKSQKLLRSPRKPTRKISKIPFKVLDAPELQDDFYLNLVDWSSLNVLSVGLGTCVYLWSACTSQVTRLCDLSVEGDSVTSVGWSERGNLVAVGTHKGFVQIWDAAAGKKLSMLEGHTARVGALAWNAEQLSSGSRDRMILQRDIRTPPLQSERRLQGHRQEVCGLKWSTDHQLLASGGNDNKLLVWNHSSLSPVQQYTEHLAAVKAIAWCSVSIHCSGPRAEF

SEQ ID NO: 810764 - protein, 493 aa, Homo sapiens; identical to SEQ ID NO: 810762

SEQ ID NO: 810765 - protein, 493 aa, Homo sapiens; identical to SEQ ID NO: 810762

SEQ ID NO: 810766 - protein, 404 aa, Homo sapiens
MDQDYERRLLRQIVIQNENTMPRVTEMRRTLTPASSPVSSPSKHGDRFIPSRAGANWSVNFHRINENEKSPSQNRKAKDATSDNGKDGLAYSALLKNELLGAGIEKVQDPQTEDRRLQPSTPEKKGLFTVTRLCDLSVEGDSVTSVGWSERGNLVAVGTHKGFVQIWDAAAGKKLSMLEGHTARVGALAWNAEQLSSGSRDRMILQRDIRTPPLQSERRLQGHRQEVCGLKWSTDHQLLASGGNDNKLLVWNHSSLSPVQQYTEHLAAVKAIAWSPHQHGLLASGGGTADRCIRFWNTLTGQPLQCIDTGSQVCNLAWSKHANELVSTHGYSQNQILVWKYPSLTQVAKLTGHSYRVLYLAMSPDGEAIVTGAGDETLRFWNVFSKTRSTKESVSVLNLFTRIR

SEQ ID NO: 810767 - protein, 364 aa, Homo sapiens
IEDACKQHDSIGSTDVRSYSLSPVSNKSQKLLRSPRKPTRKISKIPFKVLDAPELQDDFYLNLVDWSSLNVLSVGLGTCVYLWSACTSQVTRLCDLSVEGDSVTSVGWSERGNLVAVGTHKGFVQIWDAAAGKKLSMLEGHTARVGALAWNAEQLSSGSRDRMILQRDIRTPPLQSERRLQGHRQEVCGLKWSTDHQLLASGGNDNKLLVWNHSSLSPVQQYTEHLAAVKAIAWSPHQHGLLASGGGTADRCIRFWNTLTGQPLQCIDTGSQVCNLAWSKHANELVSTHGYSQNQILVWKYPSLTQVAKLTGHSYRVLYLAMSPDGEAIVTGAGDETLRFWNVFSKTRSTKESVSVLNLFTRIR

SEQ ID NO: 810768 - protein, 310 aa, Homo sapiens [sequence omitted]

SEQ ID NO: 810769 - protein, 30 aa, Homo sapiens
MSPDGEAIVTGAGDETLRFWNVFSKTRSTK

SEQ ID NO: 810770 - protein, 217 aa, Homo sapiens [sequence omitted]

SEQ ID NO: 810771 - protein, 217 aa, Homo sapiens [sequence omitted]

SEQ ID NO: 810772 - protein, 217 aa, Homo sapiens [sequence omitted]

SEQ ID NO: 810773 - protein, 217 aa, Homo sapiens [sequence omitted]

SEQ ID NO: 810774 - protein, 217 aa, Homo sapiens [sequence omitted]

SEQ ID NO: 810775 - protein, 217 aa, Homo sapiens [sequence omitted]

SEQ ID NO: 810776 - protein, 217 aa, Homo sapiens [sequence omitted]

SEQ ID NO: 810777 - protein, 267 aa, Homo sapiens
RGEVLAGHRRGAEARRYCCFGDRAAAAAAAAVAESVPVAVTAAGASAALAEQPWGRRPLAALWRGGPDAERSSCATVLNEECDQNWYKAELNGKDGFIPKNYIEMKPHPWFFGKIPRAKAEEMLSKQRHDGAFLIRESESAPGDFSLSVKFGNDVQHFKVLRDGAGKYFLWVVKFNSLNELVDYHRSTSVSRNQQIFLRDIEQVPQQPTYVQALFDFDPQEDGELGFRRGDFIHVMDNSDPNWWKGACHGQTGMFPRNYVTPVNRNV

SEQ ID NO: 810778 - protein, 176 aa, Homo sapiens
MEAIAKYDFKATADDELSFKRGDILKVLNEECDQNWYKAELNGKDGFIPKNYIEMKPHPFGNDVQHFKVLRDGAGKYFLWVVKFNSLNELVDYHRSTSVSRNQQIFLRDIEQVPQQPTYVQALFDFDPQEDGELGFRRGDFIHVMDNSDPNWWKGACHGQTGMFPRNYVTPVNRNV

SEQ ID NO: 810779 - protein, 198 aa, Homo sapiens
ELFPRRLCHESVGSPVGFGLGGPFSNVSLYRKSDPRLVPWWFFGKIPRAKAEEMLSKQRHDGAFLIRESESAPGDFSLSVKFGNDVQHFKVLRDGAGKYFLWVVKFNSLNELVDYHRSTSVSRNQQIFLRDIEQVPQQPTYVQALFDFDPQEDGELGFRRGDFIHVMDNSDPNWWKGACHGQTGMFPRNYVTPVNRNV

SEQ ID NO: 810780 - protein, 73 aa, Homo sapiens
AIAKYDFKATADDELSFKRGDILKVSADAEHNAEILSLCSPTFFRPDYTQRSCVFHCTLLTFTIIFVLESFRC

SEQ ID NO: 810781 - protein, 1353 aa, Homo sapiens
TGEAGGPPSTREAELKLRLKLVEEEANILGRKIVELEVENRGLKAEMEDMRGQQEREGPGRDHAPSIPTSPFGDSLESSTELRRHLQFVEEEAELLRRSISEIEDHNRQLTHELSKFKFEPPREPGWLGEGASPGAGGGAPLQEELKSARLQISELSGKVLKLQHENHALLSNIQRCDLAAHLGLRAPSPRDSDAESDAGKKESDGEESRLPQPKREGPVGGESDSEEMFEKTSGFGSGKPSEASEPCPTELLKAREDSEYLVTLKHEAQRLERTVERLITDTDSFLHDAGLRGGAPLPGPGLQGEEEQGEGDQQEPQLLGTINAKMKAFKKELQAFLEQVNRIGDGLSPLPHLTESSSFLSTVTSVSRDSPIGNLGKELGPDLQSRLKEQLEWQLGPARGDERESLRLRAARELHRRADGDTGSHGLGGQTCFSLEMEEEHLYALRWKELEMHSLALQNTLHERTWSDEKNLMQQELRSLKQNIFLFYVKLRWLLKHWRQGKQMEEEGEEFTEGEHPETLSRLGELGVQGGHQADGPDHDSDRGCGFPVGEHSPHSRVQIGDHSLRLQTADRGQPHKQVVENQQLFSAFKALLEDFRAELREDERARLRLQQQYASDKAAWDVEWAVLKCRLEQLEEKTENKLGELGSSAESKGALKKEREVHQKLLADSHSLVMDLRWQIHHSEKNWNREKVELLDRLDRDRQEWERQKKEFLWRIEQLQKENSPRRGGSFLCDQKDGNVRPFPHQGSLRMPRPVAMWPCADADSIPFEDRPLSKLKESDRCSASENLYLDALSLDDEPEEPPAHRPEREFRNRLPEEEENHKGNLQRAVSVSSMSEFQRLMDISPFLPEKGLPSTSSKEDVTPPLSPDDLKYIEEFNKSWDYTPNRGHNGGGPDLWADRTEVGRAGHEDSTEPFPDSSWYLTTSVTMTTDTMTSPEHCQKQPLRSHVLTEQSGLRVLHSPPAVRRVDSITAAGGEGPFPTSRARGSPGDTKGGPPEPMLSRWPCTSPRHSRDYVEGARRPLDSPLCTSLGFASPLHSLEMSKNLSDDMKEVAFSVRNAICSGPGELQVKDMACQTNGSRTMGTQTVQTISVGLQTEALRGSGVTSSPHKCLTPKAGGGATPVSSPSRSLRSRQVAPAIEKVQAKFERTCCSPKYGSPKLQRKPLPKADQPNNRTSPGMAQKGYSESAWARSTTTRESPVHTTINDGLSSLFNIIDHSPVVQDPFQKGLRAGSRSRSAEPRPELGPGQETGTNSRGRSPSPIGVGSEMCREEGGEGTPVKQDLSAPPGYTLTENVARILNKKLLEHALKEERRQAAHGPPGLHSDSHSLGDTAEPGPMENQTVLLTAPWGL

SEQ ID NO: 810782 - protein, 981 aa, Homo sapiens [sequence omitted]

SEQ ID NO: 810783 - protein, 981 aa, Homo sapiens [sequence omitted]

SEQ ID NO: 810784 - protein, 142 aa, Homo sapiens
DGSVPEILISLLYNATNGRLSAEVIKGSHLKNWAANRPPNTYVKLTLRKSTDQEMSKCKISIRRGRPNPVYKETFVFKVTLFQLSHVTLMLSVYNKSSMRRKMIGWIYLGLNSSGEELNHWTEMKESKGRQVRRWQALLESR

SEQ ID NO: 810785 - protein, 138 aa, Homo sapiens
LAGSHCQPRKGRTNEAEETAGLQMKYPDLCILMWDEWVPAKFKRLMMGWRGWQQHSIAEFSDSLPLLVLQRERDLKTKRLYRIIVTSTGGVSATRVRELWRLSAITGRIVESTGEKEKWSKRAQRVPGGKHTAAQTYS

SEQ ID NO: 810786 - protein, 138 aa, Homo sapiens; identical to SEQ ID NO: 810785

SEQ ID NO: 810787 - protein, 161 aa, Homo sapiens
RGSAPRAAILEAEAAAAALRRVRWAQSRGGAAVSGAGPAFPHPAPASTTASLSAAAAHAQRQGEMSSTSSKRAPTTATQRLKQDYLRIKKDPVPYICAEPLPSNILEWHYVVRGPEMTPYEGKDSVLRRRTPGGFYILSQPCLFNIFYLQTAAFLLWMCAS

SEQ ID NO: 810788 - protein, 323 aa, Homo sapiens
RGSAPRAAILEAEAAAAALRRVRWAQSRGGAAVSGAGPAFPHPAPASTTASLSAAAAHAQRQGEMSSTSSKRAPTTATQRLKQDYLRIKKDPVPYICAEPLPSNILEWHYVVRGPEMTPYEGGYYHGKLIFPREFPFKPPSIYMITPNGRFKCNTRLCLSITDFHPDTWNPAWSVSTILTGLLSFMVEKGPTLGSIETSDFTKRQLAVQSLAFNLKDKVFCELFPEVVEEIKQKQKAQDELSSRPQTLPLPDVVPDGETHLVQNGIQLLNGHAPGAVPNLAGLQQANRHHGLLGGALANLFVIVGFAAFAYTVKYVLRSIAQE

SEQ ID NO: 810789 - protein, 323 aa, Homo sapiens; identical to SEQ ID NO: 810788

SEQ ID NO: 810790 - protein, 322 aa, Homo sapiens
IRLGTRLGLNLAAAAAALRRVRWAQSRGGAAVSGAGPAFPHPAPASTTASLSAAAAHAQRQGEMSSTSSKRAPTTATQRLKQDYLRIKKDPVPYICAEPLPSNILEWHYVVRGPEMTPYEGGYYHGKLIFPREFPFKPPSIYMITPNGRFKCNTRLCLSITDFHPDTWNPAWSVSTILTGLLSFMVEKGPTLGSIETSDFTKRQLAVQSLAFNLKDKVFCELFPEVVEEIKQKQKAQDELSSRPQTLPLPDVVPDGETHLVQNGIQLLNGHAPGAVPNLAGLQQANRHHGLLGGALANLFVIVGFAAFAYTVKYVLRSIAQE

SEQ ID NO: 810791 - protein, 323 aa, Homo sapiens; identical to SEQ ID NO: 810788

SEQ ID NO: 810792 - protein, 418 aa, Homo sapiens
MRLGTRLGLNLAAAAAALRRVRWAQSRGGAAVSGAGPAFPHPAPASTTASLSAAAAHAQRQGEVSALAGLRRVLGPARPPCRSRPQRRPGAAGDPARRFSVRARRPRGPGPSLPARNPRSVTAGSRSSGSGHVGDLTTRPGFPSAGTLAAAPGRAASILMSSTSSKRAPTTATQRLKQDYLRIKKDPVPYICAEPLPSNILEWHYVVRGPEMTPYEGGYYHGKLIFPREFPFKPPSIYMITPNGRFKCNTRLCLSITDFHPDTWNPAWSVSTILTGLLSFMVEKGPTLGSIETSDFTKRQLAVQSLAFNLKDKVFCELFPEVVEEIKQKQKAQDELSSRPQTLPLPDVVPDGETHLVQNGIQLLNGHAPGAVPNLAGLQQANRHHGLLGGALANLFVIVGFAAFAYTVKYVLRSIAQE

SEQ ID NO: 810793 - protein, 259 aa, Homo sapiens
MSSTSSKRAPTTATQRLKQDYLRIKKDPVPYICAEPLPSNILEWHYVVRGPEMTPYEGGYYHGKLIFPREFPFKPPSIYMITPNGRFKCNTRLCLSITDFHPDTWNPAWSVSTILTGLLSFMVEKGPTLGSIETSDFTKRQLAVQSLAFNLKDKVFCELFPEVVEEIKQKQKAQDELSSRPQTLPLPDVVPDGETHLVQNGIQLLNGHAPGAVPNLAGLQQANRHHGLLGGALANLFVIVGFAAFAYTVKYVLRSIAQE

SEQ ID NO: 810794 - protein, 207 aa, Homo sapiens
MTPYEGGYYHGKLIFPREFPFKPPSIYMITPNGRFKCNTRLCLSITDFHPDTWNPAWSVSTILTGLLSFMVEKGPTLGSIETSDFTKRQLAVQSLAFNLKDKVFCELFPEVVEEIKQKQKAQDELSSRPQTLPLPDVVPDGETHLVQNGIQLLNGHAPGAVPNLAGLQQANRHHGLLGGALANLFVIVGFAAFAYTVKYVLRSIAQE

SEQ ID NO: 810795 - protein, 275 aa, Homo sapiens
MSSTSSKRAPTTATQRLKQDYLRIKKDPVPYICAEPLPSNILEWFKRFSWLSLLSSWDYRHYVVRGPEMTPYEGGYYHGKLIFPREFPFKPPSIYMITPNGRFKCNTRLCLSITDFHPDTWNPAWSVSTILTGLLSFMVEKGPTLGSIETSDFTKRQLAVQSLAFNLKDKVFCELFPEVVEEIKQKQKAQDELSSRPQTLPLPDVVPDGETHLVQNGIQLLNGHAPGAVPNLAGLQQANRHHGLLGGALANLFVIVGFAAFAYTVKYVLRSIAQE

SEQ ID NO: 810796 - protein, 323 aa, Homo sapiens; identical to SEQ ID NO: 810788

SEQ ID NO: 810797 - protein, 207 aa, Homo sapiens; identical to SEQ ID NO: 810794

SEQ ID NO: 810798 - protein, 363 aa, Homo sapiens
MRLGTRLGLNLAAAAAALRRVRWAQSRGGAAVSGAGPAFPHPAPASTTASLSAAAAHAQRQGEMSSTSSKRAPTTATQRLKQDYLRIKKDPVPYICAEPLPSNILEWHYVVRGPEMTPYEGIPVLDHLQLGQPECGSTSVGWALHHRVIAHDQRVGMPAGRGGYYHGKLIFPREFPFKPPSIYMITPNGRFKCNTRLCLSITDFHPDTWNPAWSVSTILTGLLSFMVEKGPTLGSIETSDFTKRQLAVQSLAFNLKDKVFCELFPEVVEEIKQKQKAQDELSSRPQTLPLPDVVPDGETHLVQNGIQLLNGHAPGAVPNLAGLQQANRHHGLLGGALANLFVIVGFAAFAYTVKYVLRSIAQE

SEQ ID NO: 810799 - protein, 397 aa, Homo sapiens
RGSAPRAAILEAEAAAAALRRVRWAQSRGGAAVSGAGPAFPHPAPASTTASLSAAAAHAQRQGEMSSTSSKRAPTTATQRLKQDYLRIKKDPVPYICAEPLPSNILEWHYVVRGPEMTPYEGIPVLDHLQLGQPECGSTSVGWALHHRVIAHDQRWGCQQAVVREGPGAGVQGVLKYLLRCVCVPSADLKNIYHLSGYYHGKLIFPREFPFKPPSIYMITPNGRFKCNTRLCLSITDFHPDTWNPAWSVSTILTGLLSFMVEKGPTLGSIETSDFTKRQLAVQSLAFNLKDKVFCELFPEVVEEIKQKQKAQDELSSRPQTLPLPDVVPDGETHLVQNGIQLLNGHAPGAVPNLAGLQQANRHHGLLGGALANLFVIVGFAAFAYTVKYVLRSIAQE

SEQ ID NO: 810800 - protein, 323 aa, Homo sapiens; identical to SEQ ID NO: 810788

SEQ ID NO: 810801 - protein, 115 aa, Homo sapiens
MWSLRNANLLPTAGCSCVLGAPGAFLGAPGSSAGGNLGAQGWSWRPRVLVWPGRVVMRLSGASDGRGSGSISRGLVSAFTNVFTVRMKHIPSRKCLGVFAALEARSLLTPTTSRP

SEQ ID NO: 810802 - protein, 115 aa, Homo sapiens; identical to SEQ ID NO: 810801

SEQ ID NO: 810803 - protein, 123 aa, Homo sapiens
LGLRLFQRRAHRLTGPEDRGYNSGITVTVSCGPVPQGRGARGSEQPTLPLPDVVPDGETHLVQNGIQLLNGHAPGAVPNLAGLQQANRHHGLLGGALANLFVIVGFAAFAYTVKYVLRSIAQE

SEQ ID NO: 810804 - protein, 291 aa, Homo sapiens
RGSAPRAAILEAEAAAAALRRVRWAQSRGGAAVSGAGPAFPHPAPASTTASLSAAAAHAQRQGEMSSTSSKRAPTTATQRLKQDYLRIKKDPVPYICAEPLPSNILEWHYVVRGPEMTPYEGGYYHGKLIFPREFPFKPPSIYMITPNGRFKCNTRLCLSITDFHPDTWNPAWSVSTILTGLLSFMVEKGPTLGSIETSDFTKRQLAVQSLAFNLKDKVFCELFPEVVEEIKQKQKAQDELSSRPQTLPLPDVVPDGETHLVQNGIQLLNGHAPGAVPNLAGLAWPCGDEA

SEQ ID NO: 810805 - protein, 112 aa, Homo sapiens
MITPNGRFKCNTRLCLSITDFHPDTWNPAWSVSTILTGLLSFMVEKGPTLGSIETSDFTKRQLAVQSLAFKNLKGEAKTKMCDWALEETGASALSWPRAAGAGVGGPCVLDL

SEQ ID NO: 810806 - protein, 255 aa, Homo sapiens
RGSAPRAAILEAEAAAAALRRVRWAQSRGGAAVSGAGPAFPHPAPASTTASLSAAAAHAQRQGEMSSTSSKRAPTTATQRLKQDYLRIKKDPVPYICAEPLPSNILEWHYVVRGPEMTPYEGGYYHGKLIFPREFPFKPPSIYMITPNGRFKCNTRLCLSITDFHPDTWNPAWSVSTILTGLLSFMVEKGPTLGSIETSDFTKRQLAVQSLAFKNLKGEAKTKMCDWALEETGASALSWPRAAGAGVGGPCVLDL

SEQ ID NO: 810807 - protein, 222 aa, Homo sapiens
RGSAPRAAILEAEAAAAALRRVRWAQSRGGAAVSGAGPAFPHPAPASTTASLSAAAAHAQRQGEMSSTSSKRAPTTATQRLKQDYLRIKKDPVPYICAEPLPSNILEWHYVVRGPEMTPYEGGYYHGKLIFPREFPFKPPSIYMITPNGRFKCNTRLCLSITDFHPDTWNPAWSVSTILTGLLSFMVEKGPTLGSIETSDFTLRSFACNRGQDEFCLTSLMS

SEQ ID NO: 810808 - protein, 146 aa, Homo sapiens
MTPYEGGYYHGKLIFPREFPFKPPSIYMITPNGRFKCNTRLCLSITDFHPDTWNPAWSVSTILTGLLSFMVEKGPTLGSIETSDFTKQTTGKCSSSAFYSLDPIKVFGGILSLKSVQDDETKSGLSSRTRSRPQTLPCQTCPDGHS

SEQ ID NO: 810809 - protein, 76 aa, Homo sapiens
GSGWGSGSASGGRRRRPEAAVRALRAHREALPNAWLSARGRLLGANTRPRQTGGAGLRKTPRIENECILTIRENNH

SEQ ID NO: 810810 - protein, 143 aa, Homo sapiens
GSGWGSGSASGGRRRRPEAAVRALRAHREALPNAWLSARGRLLGANTRPRQTGGAGLRKTPRVSSHFPTASLPDSGPRPGVAAPTSFLLRTGVKRENPRPWRARWAGSGEAGPAPPRTPHAGSRGNQKERRGLSFPHLAGGRR

SEQ ID NO: 810811 - protein, 475 aa, Homo sapiens
RPRRASAPPGGSGSAHAPGPPPLRGRARPPSLPPSPAVLARPARPALRVSSLVPSLPGRARAAAALPALEPRCRSRPPPEEEVEGAGGARRGGGGGGKMADFLPSRSVLSVCFPGCLLTSGEAEQQRKSKEIDKCLSREKTYVKRLVKILLLGAGESGKSTFLKQMRIIHGQDFDQRAREEFRPTIYSNVIKGMRVLVDAREKLHIPWGDNSNQQHGDKMMSFDTRAPMAAQGMVETRVFLQYLPAIRALWADSGIQNAYDRRREFQLGESVKYFLDNLDKLGEPDYIPSQQDILLARRPTKGIHEYDFEIKNVPFKMVDVGGQRSERKRWFECFDSVTSILFLVSSSEFDQVLMEDRLTNRLTESLNIFETIVNNRVFSNVSIILFLNKTDLLEEKVQIVSIKDYFLEFEGDPHCLRDVQKFLVECFRNKRRDQQQKPLYHHFTTAINTENIRLVFRDVKDTILHDNLKQLMLQ

SEQ ID NO: 810812 - protein, 475 aa, Homo sapiens; identical to SEQ ID NO: 810811

SEQ ID NO: 810813 - protein, 475 aa, Homo sapiens; identical to SEQ ID NO: 810811

SEQ ID NO: 810814 - protein, 475 aa, Homo sapiens; identical to SEQ ID NO: 810811

SEQ ID NO: 810815 - protein, 475 aa, Homo sapiens; identical to SEQ ID NO: 810811

SEQ ID NO: 810816 - protein, 475 aa, Homo sapiens; identical to SEQ ID NO: 810811

SEQ ID NO: 810817 - protein, 475 aa, Homo sapiens; identical to SEQ ID NO: 810811

SEQ ID NO: 810818 - protein, 475 aa, Homo sapiens; identical to SEQ ID NO: 810811

SEQ ID NO: 810819 - protein, 492 aa, Homo sapiens
RPRRASAPPGGSGSAHAPGPPPLRGRARPPSLPPSPAVLARPARPALRVSSLVPSLPGRARAAAALPALEPRCRSRPPPEEEVEGAGGARRGGGGGGKMADFLPSRSVLSVCFPGCLLTSGEAEQQRKSKEIDKCLSREKTYVKRLVKILLLGAGESGKSTFLKQMRIIHGQDFDQRAREEFRPTIYSNVIKGMRVLVDAREKLHIPWGDNSNQQHGDKMMSFDTRAPMAAQGMVETRVFLQYLPAIRALWADSGIQNAYDRRREFQLGESVKYFLDNLDKLGEPDYIPSQQDILLARRPTKGIHEYDFEIKNVPFKMVDVGGQRSERKRWFECFDSVTSILFLVSSSEFDQVLMEDRLTNRLTESLNIFETIVNNRVFSNVSIILFLNKTDLLEEKVQIVSIKDYFLEFEGDPHCLRDVQKFLVECFRNKRRDQQQKPLYHHFTTAINTENIRLVFRDVKDTILHDNLKQRGSTGMAILTGDFPSLEPRAC

SEQ ID NO: 810820 - protein, 101 aa, Homo sapiens
MWLPSFCVSAASFWLTTRSHQVRVGVIGRVRREATHLWAGWGWQTQLLRGGHLCNNTQGALSHKPLTPCRCQGKKLQGPPFSKLGYKALVCSSIQVLPEKP

SEQ ID NO: 810821 - protein, 1234 aa, Homo sapiens
SHKDYIFELFKLPLVLVLIFLFTITKIKFIKKKAHAVGGFGLDIGTRALLLRARSFIKPSWPLNARSSSSPTQLGNSRRGEPTLPESGFRDSAGAQPNGSGGAGPLCGKRIESPWQPAGRAATPFPPEVGVRTSTCCPSPSPFRPSSGGSVAAMESAGLEQLLRELLLPDTERIRRATEQLQIVLRAPAALPALCDLLASAADPQIRQFAAVLTRRRLNTRWRRLAAEQRESLKSLILTALQRETEHCVSLSLAQLSATIFRKEGLEAWPQLLQLLQHSTHSPHSPEREMGLLLLSVVVTSRPEAFQPHHRELLRLLNETLGEVGSPGLLFYSLRTLTTMAPYLSTEDVPLARMLVPKLIMAMQTLIPIDEAKACEALEALDELLESEVPVITPYLSEVLTFCLEVARNVALGNAIRIRILCCLTFLVKVKSKALLKNRLLPPLLHTLFPIVAAEPPPGQLDPEDQDSEEEELEIELMGETPKHFAVQVVDMLALHLPPEKLCPQLMPMLEEALRSESPYQRKAGLLVLAVLSDGAGDHIRQRLLPPLLQIVCKGLEDPSQVVRNAALFALGQFSENLQPHISSYSREVMPLLLAYLKSVPLGHTHHLAKACYALENFVENLGPKVQPYLPELMECMLQLLRNPSSPRAKELAVSALGAIATAAQASLLPYFPAIMEHLREFLLTGREDLQPVQIQSLETLGVLARAVGEPMRPLAEECCQLGLGLCDQVDDPDLRRCTYSLFAALSGLMGEGLAPHLEQITTLMLLSLRSTEGIVPQYDGSSSFLLFDDESDGEEEEELMDEDVEEEDDSEISGYSVENAFFDEKEDTCAAVGEISVNTSVAFLPYMESVFEEVFKLLECPHLNVRKAAHEALGQFCCALHKACQSCPSEPNTAALQAALARVVPSYMQAVNRERERQVVMAVLEALTGVLRSCGTLTLKPPGRLAELCGVLKAVLQRKTACQDTDEEEEEEDDDQAEYDAMLLEHAGEAIPALAAAAGGDSFAPFFAGFLPLLVCKTKQGCTVAEKSFAVGTLAETIQGLGAASAQFVSRLLPVLLSTAQEADPEVRSNAIFGMGVLAEHGGHPAQEHFPKLLGLLFPLLARERHDRVRDNICGALARLLMASPTRKPEPQVLAALLHALPLKEDLEEWVTIGRLFSFLYQSSPDQVIDVAPELLRICSLILADNKIPPDTKAALLLLLTFLAKQHTDSFQAALGSLPVDKAQELQAVLGLS

SEQ ID NO: 810822 - protein, 1081 aa, Homo sapiens
MESAGLEQLLRELLLPDTERIRRATEQLQIVLRAPAALPALCDLLASAADPQIRQFAAVLTRRRLNTRWRRLAAEQRESLKSLILTALQRETEHCVSLSLAQLSATIFRKEGLEAWPQLLQLLQHSTHSPHSPEREMGLLLLSVVVTSRPEAFQPHHRELLRLLNETLGEVGSPGLLFYSLRTLTTMAPYLSTEDVPLARMLVPKLIMAMQTLIPIDEAKACEALEALDELLESEVPVITPYLSEVLTFCLEVARNVALGNAIRIRILCCLTFLVKVKSKALLKNRLLPPLLHTLFPIVAAEPPPGQLDPEDQDSEEEELEIELMGETPKHFAVQVVDMLALHLPPEKLCPQLMPMLEEALRSESPYQRKAGLLVLAVLSDGAGDHIRQRLLPPLLQIVCKGLEDPSQVVRNAALFALGQFSENLQPHISSYSREVMPLLLAYLKSVPLGHTHHLAKACYALENFVENLGPKVQPYLPELMECMLQLLRNPSSPRAKELAVSALGAIATAAQASLLPYFPAIMEHLREFLLTGREDLQPVQIQSLETLGVLARAVGEPMRPLAEECCQLGLGLCDQVDDPDLRRCTYSLFAALSGLMGEGLAPHLEQITTLMLLSLRSTEGIVPQYDGSSSFLLFDDESDGEEEEELMDEDVEEEDDSEISGYSVENAFFDEKEDTCAAVGEISVNTSVAFLPYMESVFEEVFKLLECPHLNVRKAAHEALGQFCCALHKACQSCPSEPNTAALQAALARVVPSYMQAVNRERERQVVMAVLEALTGVLRSCGTLTLKPPGRLAELCGVLKAVLQRKTACQDTDEEEEEEDDDQAEYDAMLLEHAGEAIPALAAAAGGDSFAPFFAGFLPLLVCKTKQGCTVAEKSFAVGTLAETIQGLGAASAQFVSRLLPVLLSTAQEADPEVRSNAIFGMGVLAEHGGHPAQEHFPKLLGLLFPLLARERHDRVRDNICGALARLLMASPTRKPEPQVLAALLHALPLKEDLEEWVTIGRLFSFLYQSSPDQVIDVAPELLRICSLILADNKIPPDTKAALLLLLTFLAKQHTDSFQAALGSLPVDKAQELQAVLGLS

SEQ ID NO: 810823 - protein, 1098 aa, Homo sapiens
SEYNARGLGMLQWEGIQDTRELRQQLLRELLLPDTERIRRATEQLQIVLRAPAALPALCDLLASAADPQIRQFAAVLTRRRLNTRWRRLAAEQRESLKSLILTALQRETEHCVSLSLAQLSATIFRKEGLEAWPQLLQLLQHSTHSPHSPEREMGLLLLSVVVTSRPEAFQPHHRELLRLLNETLGEVGSPGLLFYSLRTLTTMAPYLSTEDVPLARMLVPKLIMAMQTLIPIDEAKACEALEALDELLESEVPVITPYLSEVLTFCLEVARNVALGNAIRIRILCCLTFLVKVKSKALLKNRLLPPLLHTLFPIVAAEPPPGQLDPEDQDSEEEELEIELMGETPKHFAVQVVDMLALHLPPEKLCPQLMPMLEEALRSESPYQRKAGLLVLAVLSDGAGDHIRQRLLPPLLQIVCKGLEDPSQVVRNAALFALGQFSENLQPHISSYSREVMPLLLAYLKSVPLGHTHHLAKACYALENFVENLGPKVQPYLPELMECMLQLLRNPSSPRAKELAVSALGAIATAAQASLLPYFPAIMEHLREFLLTGREDLQPVQIQSLETLGVLARAVGEPMRPLAEECCQLGLGLCDQVDDPDLRRCTYSLFAALSGLMGEGLAPHLEQITTLMLLSLRSTEGIVPQYDGSSSFLLFDDESDGEEEEELMDEDVEEEDDSEISGYSVENAFFDEKEDTCAAVGEISVNTSVAFLPYMESVFEEVFKLLECPHLNVRKAAHEALGQFCCALHKACQSCPSEPNTAALQAALARVVPSYMQAVNRERERQVVMAVLEALTGVLRSCGTLTLKPPGRLAELCGVLKAVLQRKTACQDTDEEEEEEDDDQAEYDAMLLEHAGEAIPALAAAAGGDSFAPFFAGFLPLLVCKTKQGCTVAEKSFAVGTLAETIQGLGAASAQFVSRLLPVLLSTAQEADPEVRSNAIFGMGVLAEHGGHPAQEHFPKLLGLLFPLLARERHDRVRDNICGALARLLMASPTRKPEPQVLAALLHALPLKEDLEEWVTIGRLFSFLYQSSPDQVIDVAPELLRICSLILADNKIPPDTKAALLLLLTFLAKQHTDSFQAALGSLPVDKAQELQAVLGLS

SEQ ID NO: 810824 - protein, 877 aa, Homo sapiens
RLGEAGLNRTRIDEAKACEALEALDELLESEVPVITPYLSEVLTFCLEVARNVALGNAIRIRILCCLTFLVKVKSKALLKNRLLPPLLHTLFPIVAAEPPPGQLDPEDQDSEEEELEIELMGETPKHFAVQVVDMLALHLPPEKLCPQLMPMLEEALRSESPYQRKAGLLVLAVLSDGAGDHIRQRLLPPLLQIVCKGLEDPSQVVRNAALFALGQFSENLQPHISSYSREVMPLLLAYLKSVPLGHTHHLAKACYALENFVENLGPKVQPYLPELMECMLQLLRNPSSPRAKELAVSALGAIATAAQASLLPYFPAIMEHLREFLLTGREDLQPVQIQSLETLGVLARAVGEPMRPLAEECCQLGLGLCDQVDDPDLRRCTYSLFAALSGLMGEGLAPHLEQITTLMLLSLRSTEGIVPQYDGSSSFLLFDDESDGEEEEELMDEDVEEEDDSEISGYSVENAFFDEKEDTCAAVGEISVNTSVAFLPYMESVFEEVFKLLECPHLNVRKAAHEALGQFCCALHKACQSCPSEPNTAALQAALARVVPSYMQAVNRERERQVVMAVLEALTGVLRSCGTLTLKPPGRLAELCGVLKAVLQRKTACQDTDEEEEEEDDDQAEYDAMLLEHAGEAIPALAAAAGGDSFAPFFAGFLPLLVCKTKQGCTVAEKSFAVGTLAETIQGLGAASAQFVSRLLPVLLSTAQEADPEVRSNAIFGMGVLAEHGGHPAQEHFPKLLGLLFPLLARERHDRVRDNICGALARLLMASPTRKPEPQVLAALLHALPLKEDLEEWVTIGRLFSFLYQSSPDQVIDVAPELLRICSLILADNKIPPDTKAALLLLLTFLAKQHTDSFQAALGSLPVDKAQELQAVLGLS

SEQ ID NO: 810825 - protein, 1234 aa, Homo sapiens; identical to SEQ ID NO: 810821

SEQ ID NO: 810826 - protein, 1261 aa, Homo sapiens
SHKDYIFELFKLPLVLVLIFLFTITKIKFIKKKAHAVGGFGLDIGTRALLLRARSFIKPSWPLNARSSSSPTQLGNSRRGEPTLPESGFRDSAGAQPNGSGGAGPLCGKRIESPWQPAGRAATPFPPEVGVRTSTCCPSPSPFRPSSGGSVAAMESAGLEQLLRELLLPDTERIRRATEQLQIVLRAPAALPALCDLLASAADPQIRQFAAVLTRRRLNTRWRRLAAEQRESLKSLILTALQRETEHCVSLSLAQLSATIFRKEGLEAWPQLLQLLQHSTHSPHSPEREMGLLLLSVVVTSRPEAFQPHHRELLRLLNETLGEVGSPGLLFYSLRTLTTMAPYLSTEDVPLARMLVPKLIMAMQTLIPIDEAKACEALEALDELLESEVPVITPYLSEVLTFCLEVARNVALGNAIRIRILCCLTFLVKVKSKALLKNRLLPPLLHTLFPIVAAEPPPGQLDPEDQDSEEEELEIELMGETPKHFAVQVVDMLALHLPPEKLCPQLMPMLEEALRSESPYQRKAGLLVLAVLSDGAGDHIRQRLLPPLLQIVCKGLEDPSQVVRNAALFALGQFSENLQPHISSYSREVMPLLLAYLKSVPLGHTHHLAKACYALENFVENLGPKVQPYLPELMECMLQLLRNPSSPRAKELAVSALGAIATAAQASLLPYFPAIMEHLREFLLTGREDLQPVQIQSLETLGVLARAVGEPMRPLAEECCQLGLGLCDQVDDPDLRRCTYSLFAALSGLMGEGLAPHLEQITTLMLLSLRSTEGIVPQYDGSSSFLLFDDESDGEEEEELMDEDVEEEDDSEISGYSVENAFFDEKEDTCAAVGEISVNTSVAFLPYMESVFEEVFKLLECPHLNVRKAAHEALGQFCCALHKACQSCPSEPNTAGEERLGQAGGSWGGAGPELVLQPIMSPALQAALARVVPSYMQAVNRERERQVVMAVLEALTGVLRSCGTLTLKPPGRLAELCGVLKAVLQRKTACQDTDEEEEEEDDDQAEYDAMLLEHAGEAIPALAAAAGGDSFAPFFAGFLPLLVCKTKQGCTVAEKSFAVGTLAETIQGLGAASAQFVSRLLPVLLSTAQEADPEVRSNAIFGMGVLAEHGGHPAQEHFPKLLGLLFPLLARERHDRVRDNICGALARLLMASPTRKPEPQVLAALLHALPLKEDLEEWVTIGRLFSFLYQSSPDQVIDVAPELLRICSLILADNKIPPDTKAALLLLLTFLAKQHTDSFQAALGSLPVDKAQELQAVLGLS

SEQ ID NO: 810827 - protein, 769 aa, Homo sapiens
GRVGRPTRRIELMGETPKHFAVQVVDMLALHLPPEKLCPQLMPMLEEALRSESPYQRKAGLLVLAVLSDGAGDHIRQRLLPPLLQIVCKGLEDPSQVVRNAALFALGQFSENLQPHISSYSREVMPLLLAYLKSVPLGHTHHLAKACYALENFVENLGPKVQPYLPELMECMLQLLRNPSSPRAKELAVSALGAIATAAQASLLPYFPAIMEHLREFLLTGREDLQPVQIQSLETLGVLARAVGEPMRPLAEECCQLGLGLCDQVDDPDLRRCTYSLFAALSGLMGEGLAPHLEQITTLMLLSLRSTEGIVPQYDGSSSFLLFDDESDGEEEEELMDEDVEEEDDSEISGYSVENAFFDEKEDTCAAVGEISVNTSVAFLPYMESVFEEVFKLLECPHLNVRKAAHEALGQFCCALHKACQSCPSEPNTAALQAALARVVPSYMQAVNRERERQVVMAVLEALTGVLRSCGTLTLKPPGRLAELCGVLKAVLQRKTACQDTDEEEEEEDDDQAEYDAMLLEHAGEAIPALAAAAGGDSFAPFFAGFLPLLVCKTKQGCTVAEKSFAVGTLAETIQGLGAASAQFVSRLLPVLLSTAQEADPEVRSNAIFGMGVLAEHGGHPAQEHFPKLLGLLFPLLARERHDRVRDNICGALARLLMASPTRKPEPQVLAALLHALPLKEDLEEWVTIGRLFSFLYQSSPDQVIDVAPELLRICSLILADNKIPPDTKAALLLLLTFLAKQHTDSFQAALGSLPVDKAQELQAVLGLS

SEQ ID NO: 810828 - protein, 894 aa, Homo sapiens
SHKDYIFELFKLPLVLVLIFLFTITKIKFIKKKAHAVGGFGLDIGTRALLLRARSFIKPSWPLNARSSSSPTQLGNSRRGEPTLPESGFRDSAGAQPNGSGGAGPLCGKRIESPWQPAGRAATPFPPEVGVRTSTCCPSPSPFRPSSGGSVAAMESAGLEQLLRELLLPDTERIRRATEQLQIVLRAPAALPALCDLLASAADPQIRQFAAVLTRRRLNTRWRRLAAEQRESLKSLILTALQRETEHCVSLSLAQLSATIFRKEGLEAWPQLLQLLQHSTHSPHSPEREMGLLLLSVVVTSRPEAFQPHHRELLRLLNETLGEVGSPGLLFYSLRTLTTMAPYLSTEDVPLARMLVPKLIMAMQTLIPIDEAKACEALEALDELLESEVPVITPYLSEVLTFCLEVARNVALGNAIRIRILCCLTFLVKVKSKALLKNRLLPPLLHTLFPIVAAEPPPGQLDPEDQDSEEEELEIELMGETPKHFAVQVVDMLALHLPPEKLCPQLMPMLEEALRSESPYQRKAGLLVLAVLSDGAGDHIRQRLLPPLLQIVCKGLEDPSQVVRNAALFALGQFSENLQPHISSYSREVMPLLLAYLKSVPLGHTHHLAKACYALENFVENLGPKVQPYLPELMECMLQLLRNPSSPRAKELAVSALGAIATAAQASLLPYFPAIMEHLREFLLTGREDLQPVQIQSLETLGVLARAVGEPMRPLAEECCQLGLGLCDQVDDPDLRRCTYSLFAALSGLMGEGLAPHLEQITTLMLLSLRSTEGIVPQYDGSSSFLLFDDESDGEEEEELMDEDVEEEDDSEISGYSVENAFFDEKEDTCAAVGEISVNTSVAFLPYMESVFEEVFKLLELTFLAKQHTDSFQAALGSLPVDKAQELQAVLGLS

SEQ ID NO: 810829 - protein, 150 aa, Homo sapiens
SPEPDGSDAGGHAQDENLGHRADELAHHGDRKEMRLQAAQLHPGPQAVESRASESNGAQAELLQQPSHWQEQRDVSQHVAHGQPVNGKGTDTVEVHEDVIDGAVLDPLKGVAHGVAAKHQDHGPTAPAHLDHAEVLRARATGVSQATGLG

SEQ ID NO: 810830 - protein, 129 aa, Homo sapiens
MRLKVGFQGGGCFRKDALCLEGGVSARWARAPHSAPLRPPRELHAAPPPATPTQTVVRPAGFPRRTRLMVRSAPPTQRPPTGSGCVSGLWRKGLGLRPQTLLRVGSVVLSSAPALRPRLGPCLRPPPSD

SEQ ID NO: 810831 - protein, 315 aa, Homo sapiens
CSAAATMEAARTAVLRVKRKRSAEPAEALVLACKRLRSDAVESAAQKTSEDLERAAENNVFHLVATVCSQEEPVQPLLREVLRPSRDSQQRVRRNLRASAREVRQEGRYRVLSSRRSLGTTSSGQESEYTPGNPEAAGNSGFQLLDLVHEEGEPEAASAGSCKTSDPDVILCNSVELIRERLTVSEDGPGVRRQEEQKHDDYVYDIYYLETATPGWIENILSVQPYSQEWELVNDDQEPEDIYDDEDDENSENNWRNEYPEEESSDGDEDSRGSADYNSLSEEERGSSRQRMWSKYPLDVQKEFGYDSPHDLDSD

SEQ ID NO: 810832 - protein, 249 aa, Homo sapiens
CSAAATMEAARTAVLRVKRKRSAEPAEALVLACKRLRSDAVESAAQKTSEDLERAAENNVFHLVATVCSQEEPVQPLLREVLRPSRDSQQRVRRNLRASAREVRQEGRYRVLSSRRSLGTTSSGQESEYTPGNPEAAGNSGFQLLDLVHEEGEPEAASAGSCKTSDPDVILCNSVELIRERLTVSEDGPGVRRQEEQKHDDYVYDIYYLETATPGWIENILSVQPYSQEWELVRGPMSRRGMRHPKLLI

SEQ ID NO: 810833 - protein, 315 aa, Homo sapiens; identical to SEQ ID NO: 810831

SEQ ID NO: 810834 - protein, 283 aa, Homo sapiens
CSAAATMEAARTAVLRVKRKRSAEPAEALVLACKRLRSDAVESAAQKTSEDLERAAENNVFHLVATVCSQEEPVQPLLREVLRPSRDSQQRVRRNLRASAREVRQEGRYRVLSSRRSLGTTSSGQESEYTPGNPEAAGNSGFQLLDLVHEEGEPEAASAGSCKTSDPDVILCNSVELIRERLTVSEDGPGVRRQEEQKHDDYVYDIYYLETATPGWIENILSVQPYSQEWELVNDDQEPEDIYDDEDDENSENNWRNEYPEEESSDGDEDSRGGWQPQTGRDW

SEQ ID NO: 810835 - protein, 283 aa, Homo sapiens; identical to SEQ ID NO: 810834

SEQ ID NO: 810836 - protein, 956 aa, Homo sapiens
MGLEQIIKIPDQPDTLCFQIRGAAPPYVYAVGRGSEAMAAGLCAGQCILKVNGSNVMNDGAPEVLEHFQAFRSRREEALGLYQWIYHTHEDAQEARASQEASTEDPSGEQAQEEDQADSAFPLLSLGPRLSLCEDSPMVTLTVDNVHLEHGVVYEYVSTAGVRCHVLEKIVEPRGCFGLTAKILEAFAANDSVFVENCRRLMALSSAIVTMPHFEFRNICDTKLESIGQRIACYQEFAAQLKSRVSPPFKQAPLEPHPLCGLDFCPTNCHINLMEVSYPKTTPSVGRSFSIRFGRKPSLIGLDPEQGHLNPMSYTQHCITTMAAPSWKCLPAAEGDPQGQGLHDGSFGPASGTLGQEDRGLSFLLKQEDREIQDAYLQLFTKLDVALKEMKQYVTQINRLLSTITEPTSGGSCDASLAEEASSLPLVSEESEMDRSDHGGIKKVCFKVAEEDQEDSGHDTMSYRDSYSECNSNRDSVLSYTSVRSNSSYLGSDEMGSGDELPCDMRIPSDKQDKLHGCLEHLFNQVDSINALLKGPVMSRAFEETKHFPMNHSLQEFKQKEECTIRGRSLIQISIQEDPWNLPNSIKTLVDNIQRYVEDGKNQLLLALLKCTDTELQLRRDAIFCQALVAAVCTFSEQLLAALGYRYNNNGEYEESSRDASRKWLEQVAATGVLLHCQSLLSPATVKEERTMLEDIWVTLSELDNVTFSFKQLDENYVANTNVFYHIEGSRQALKVIFYLDSYHFSKLPSRLEGGASLRLHTALFTKVLENVEGLPSPGSQAAEDLQQDINAQSLEKVQQYYRKLRAFYLERSNLPTDASTTAVKIDQLIRPINALDELCRLMKSFVHPKPGAAGSVGAGLIPISSELCYRLGACQMVMCGTGMQRSTLSVSLEQAAILARSHGLLPKCIMQATDIMRKQGPRVEILAKNLRVKDQMPQGAPRLYRLCQPPVDGDL

SEQ ID NO: 810837 - protein, 110 aa, Homo sapiens
CVVIQRIPHAMSQCQQCSHLNPMSYTQHCITTMAAPSWKCLPAAEGDPQGQGLHDGSFGPASGTLGQEDRGLSFLLKQEDREIQDAYLQLFTKLDVALKEMKQYVTQINR

SEQ ID NO: 810838 - protein, 1636 aa, Homo sapiens
SNRNRSYENRCPLLAAARESERQLRLRLCVLNEILGTERDYVGTLRFLQSAFLHRIRQNVADSVEKGLTEENVKVLFSNIEDILEVHKDFLAALEYCLHPEPQSQHELGNVFLKFKDKFCVYEEYCSNHEKALRLLVELNKIPTVRAFLLSCMLLGGRKTTDIPLEGYLLSPIQRICKYPLLLKELAKRTPGKHPDHPAVQSALQAMKTVCSNINETKRQMEKLEALEQLQSHIEGWEGSNLTDICTQLLLQGTLLKISAGNIQERAFFLFDNLLVYCKRKSRVTGSKKSTKRTKSINGSLYIFRGRINTEVMEVENVEDGTADYHSNGYTVTNGWKIHNTAKNKWFVCMAKTAEEKQKWLDAIIREREQRESLKLGMERDAYVMIAEKGEKLYHMMMNKKVNLIKDRRRKLSTVPKCFLGNEFVAWLLEIGEISKTEEGVNLGQALLENGIIHHVSDKHQFKNEQVMYRFRYDDGTYKARSELEDIMSKGVRLYCRLHSLYTPVIKDRDYHLKTYKSVLPGSKLVDWLLAQGDCQTREEAVALGVGLCNNGFMHHVLEKSEFRDESQYFRFHADEEMEGTSSKNKQLRNDFKLVENILAKRLLILPQEEDYGFDIEEKNKAVVVKSVQRGSLAEVAGLQVGRKIYSINEDLVFLRPFSEVESILNQSFCSRRPLRLLVATKAKEIIKIPDQPDTLCFQIRGAAPPYVYAVGRGSEAMAAGLCAGQCILKVNGSNVMNDGAPEVLEHFQAFRSRREEALGLYQWIYHTHEDAQEARASQEASTEDPSGEQAQEEDQADSAFPLLSLGPRLSLCEDSPMVTLTVDNVHLEHGVVYEYVSTAGVRCHVLEKIVEPRGCFGLTAKILEAFAANDSVFVENCRRLMALSSAIVTMPHFEFRNICDTKLESIGQRIACYQEFAAQLKSRVSPPFKQAPLEPHPLCGLDFCPTNCHINLMEVSYPKTTPSVGRSFSIRFGRKPSLIGLDPEQGHLNPMSYTQHCITTMAAPSWKCLPAAEGDPQGQGLHDGSFGPASGTLGQEDRGLSFLLKQEDREIQDAYLQLFTKLDVALKEMKQYVTQINRLLSTITEPTSGGSCDASLAEEASSLPLVSEESEMDRSDHGGIKKVCFKVAEEDQEDSGHDTMSYRDSYSECNSNRDSVLSYTSVRSNSSYLGSDEMGSGDELPCDMRIPSDKQDKLHGCLEHLFNQVDSINALLKGPVMSRAFEETKHFPMNHSLQEFKQKEECTIRGRSLIQISIQEDPWNLPNSIKTLVDNIQRYVEDGKNQLLLALLKCTDTELQLRRDAIFCQALVAAVCTFSEQLLAALGYRYNNNGEYEESSRDASRKWLEQVAATGVLLHCQSLLSPATVKEERTMLEDIWVTLSELDNVTFSFKQLDENYVANTNVFYHIEGSRQALKVIFYLDSYHFSKLPSRLEGGASLRLHTALFTKVLENVEGLPSPGSQAAEDLQQDINAQSLEKVQQYYRKLRAFYLERSNLPTDASTTAVKIDQLIRPINALDELCRLMKSFVHPKPGAAGSVGAGLIPISSELCYRLGACQMVMCGTGMQRSTLSVSLEQAAILARSHGLLPKCIMQATDIMRKQGPRVEILAKNLRVKDQMPQGAPRLYRLCQPPVDGDL

SEQ ID NO: 810839 - protein, 1612 aa, Homo sapiens
SNRNRSYENRCPLLAAARESERQLRLRLCVLNEILGTERDYVGTLRFLQSVLFSNIEDILEVHKDFLAALEYCLHPEPQSQHELGNVFLKFKDKFCVYEEYCSNHEKALRLLVELNKIPTVRAFLLSCMLLGGRKTTDIPLEGYLLSPIQRICKYPLLLKELAKRTPGKHPDHPAVQSALQAMKTVCSNINETKRQMEKLEALEQLQSHIEGWEGSNLTDICTQLLLQGTLLKISAGNIQERAFFLFDNLLVYCKRKSRVTGSKKSTKRTKSINGSLYIFRGRINTEVMEVENVEDGTADYHSNGYTVTNGWKIHNTAKNKWFVCMAKTAEEKQKWLDAIIREREQRESLKLGMERDAYVMIAEKGEKLYHMMMNKKVNLIKDRRRKLSTVPKCFLGNEFVAWLLEIGEISKTEEGVNLGQALLENGIIHHVSDKHQFKNEQVMYRFRYDDGTYKARSELEDIMSKGVRLYCRLHSLYTPVIKDRDYHLKTYKSVLPGSKLVDWLLAQGDCQTREEAVALGVGLCNNGFMHHVLEKSEFRDESQYFRFHADEEMEGTSSKNKQLRNDFKLVENILAKRLLILPQEEDYGFDIEEKNKAVVVKSVQRGSLAEVAGLQVGRKIYSINEDLVFLRPFSEVESILNQSFCSRRPLRLLVATKAKEIIKIPDQPDTLCFQIRGAAPPYVYAVGRGSEAMAAGLCAGQCILKVNGSNVMNDGAPEVLEHFQAFRSRREEALGLYQWIYHTHEDAQEARASQEASTEDPSGEQAQEEDQADSAFPLLSLGPRLSLCEDSPMVTLTVDNVHLEHGVVYEYVSTAGVRCHVLEKIVEPRGCFGLTAKILEAFAANDSVFVENCRRLMALSSAIVTMPHFEFRNICDTKLESIGQRIACYQEFAAQLKSRVSPPFKQAPLEPHPLCGLDFCPTNCHINLMEVSYPKTTPSVGRSFSIRFGRKPSLIGLDPEQGHLNPMSYTQHCITTMAAPSWKCLPAAEGDPQGQGLHDGSFGPASGTLGQEDRGLSFLLKQEDREIQDAYLQLFTKLDVALKEMKQYVTQINRLLSTITEPTSGGSCDASLAEEASSLPLVSEESEMDRSDHGGIKKVCFKVAEEDQEDSGHDTMSYRDSYSECNSNRDSVLSYTSVRSNSSYLGSDEMGSGDELPCDMRIPSDKQDKLHGCLEHLFNQVDSINALLKGPVMSRAFEETKHFPMNHSLQEFKQKEECTIRGRSLIQISIQEDPWNLPNSIKTLVDNIQRYVEDGKNQLLLALLKCTDTELQLRRDAIFCQALVAAVCTFSEQLLAALGYRYNNNGEYEESSRDASRKWLEQVAATGVLLHCQSLLSPATVKEERTMLEDIWVTLSELDNVTFSFKQLDENYVANTNVFYHIEGSRQALKVIFYLDSYHFSKLPSRLEGGASLRLHTALFTKVLENVEGLPSPGSQAAEDLQQDINAQSLEKVQQYYRKLRAFYLERSNLPTDASTTAVKIDQLIRPINALDELCRLMKSFVHPKPGAAGSVGAGLIPISSELCYRLGACQMVMCGTGMQRSTLSVSLEQAAILARSHGLLPKCIMQATDIMRKQGPRVEILAKNLRVKDQMPQGAPRLYRLCQPPVDGDL

SEQ ID NO: 810840 - protein, 1637 aa, Homo sapiens
MILRNSPDMGTILMEQPLYAGHWESSSEQNKFPAPAELNILGRESNNTAWVAFLHRIRQNVADSVEKGLTEENVKVLFSNIEDILEVHKDFLAALEYCLHPEPQSQHELGNVFLKFKDKFCVYEEYCSNHEKALRLLVELNKIPTVRAFLLSCMLLGGRKTTDIPLEGYLLSPIQRICKYPLLLKELAKRTPGKHPDHPAVQSALQAMKTVCSNINETKRQMEKLEALEQLQSHIEGWEGSNLTDICTQLLLQGTLLKISAGNIQERAFFLFDNLLVYCKRKSRVTGSKKSTKRTKSINGSLYIFRGRINTEVMEVENVEDGTADYHSNGYTVTNGWKIHNTAKNKWFVCMAKTAEEKQKWLDAIIREREQRESLKLGMERDAYVMIAEKGEKLYHMMMNKKVNLIKDRRRKLSTVPKCFLGNEFVAWLLEIGEISKTEEGVNLGQALLENGIIHHVSDKHQFKNEQVMYRFRYDDGTYKARSELEDIMSKGVRLYCRLHSLYTPVIKDRDYHLKTYKSVLPGSKLVDWLLAQGDCQTREEAVALGVGLCNNGFMHHVLEKSEFRDESQYFRFHADEEMEGTSSKNKQLRNDFKLVENILAKRLLILPQEEDYGFDIEEKNKAVVVKSVQRGSLAEVAGLQVGRKIYSINEDLVFLRPFSEVESILNQSFCSRRPLRLLVATKAKEIIKIPDQPDTLCFQIRGAAPPYVYAVGRGSEAMAAGLCAGQCILKVNGSNVMNDGAPEVLEHFQAFRSRREEALGLYQWIYHTHEDAQEARASQEASTEDPSGEQAQEEDQADSAFPLLSLGPRLSLCEDSPMVTLTVDNVHLEHGVVYEYVSTAGVRCHVLEKIVEPRGCFGLTAKILEAFAANDSVFVENCRRLMALSSAIVTMPHFEFRNICDTKLESIGQRIACYQEFAAQLKSRVSPPFKQAPLEPHPLCGLDFCPTNCHINLMEVSYPKTTPSVGRSFSIRFGRKPSLIGLDPEQGHLNPMSYTQHCITTMAAPSWKCLPAAEGDPQGQGLHDGSFGPASGTLGQEDRGLSFLLKQEDREIQDAYLQLFTKLDVALKEMKQYVTQINRLLSTITEPTSGGSCDASLAEEASSLPLVSEESEMDRSDHGGIKKVCFKVAEEDQEDSGHDTMSYRDSYSECNSNRDSVLSYTSVRSNSSYLGSDEMGSGDELPCDMRIPSDKQDKLHGCLEHLFNQVDSINALLKGPVMSRAFEETKHFPMNHSLQEFKQKEECTIRGRSLIQISIQEDPWNLPNSIKTLVDNIQRYVEDGKNQLLLALLKCTDTELQLRRDAIFCQALVAAVCTFSEQLLAALGYRYNNNGEYEESSRDASRKWLEQVAATGVLLHCQSLLSPATVKEERTMLEDIWVTLSELDNVTFSFKQLDENYVANTNVFYHIEGSRQALKVIFYLDSYHFSKLPSRLEGGASLRLHTALFTKVLENVEGLPSPGSQAAEDLQQDINAQSLEKVQQYYRKLRAFYLERSNLPTDASTTAVKIDQLIRPINALDELCRLMKSFVHPKPGAAGSVGAGLIPISSELCYRLGACQMVMCGTGMQRSTLSVSLEQAAILARSHGLLPKCIMQATDIMRKQGPRVEILAKNLRVKDQMPQGAPRLYRLCQPPVDGDL

SEQ ID NO: 810841 - protein, 1592 aa, Homo sapiens
LTIGLDRYSYRARSPTGQVSVQTGLTEEKSVLFSNIEDILEVHKDFLAALEYCLHPEPQSQHELGNVFLKFKDKFCVYEEYCSNHEKALRLLVELNKIPTVRAFLLSCMLLGGRKTTDIPLEGYLLSPIQRICKYPLLLKELAKRTPGKHPDHPAVQSALQAMKTVCSNINETKRQMEKLEALEQLQSHIEGWEGSNLTDICTQLLLQGTLLKISAGNIQERAFFLFDNLLVYCKRKSRVTGSKKSTKRTKSINGSLYIFRGRINTEVMEVENVEDGTADYHSNGYTVTNGWKIHNTAKNKWFVCMAKTAEEKQKWLDAIIREREQRESLKLGMERDAYVMIAEKGEKLYHMMMNKKVNLIKDRRRKLSTVPKCFLGNEFVAWLLEIGEISKTEEGVNLGQALLENGIIHHVSDKHQFKNEQVMYRFRYDDGTYKARSELEDIMSKGVRLYCRLHSLYTPVIKDRDYHLKTYKSVLPGSKLVDWLLAQGDCQTREEAVALGVGLCNNGFMHHVLEKSEFRDESQYFRFHADEEMEGTSSKNKQLRNDFKLVENILAKRLLILPQEEDYGFDIEEKNKAVVVKSVQRGSLAEVAGLQVGRKIYSINEDLVFLRPFSEVESILNQSFCSRRPLRLLVATKAKEIIKIPDQPDTLCFQIRGAAPPYVYAVGRGSEAMAAGLCAGQCILKVNGSNVMNDGAPEVLEHFQAFRSRREEALGLYQWIYHTHEDAQEARASQEASTEDPSGEQAQEEDQADSAFPLLSLGPRLSLCEDSPMVTLTVDNVHLEHGVVYEYVSTAGVRCHVLEKIVEPRGCFGLTAKILEAFAANDSVFVENCRRLMALSSAIVTMPHFEFRNICDTKLESIGQRIACYQEFAAQLKSRVSPPFKQAPLEPHPLCGLDFCPTNCHINLMEVSYPKTTPSVGRSFSIRFGRKPSLIGLDPEQGHLNPMSYTQHCITTMAAPSWKCLPAAEGDPQGQGLHDGSFGPASGTLGQEDRGLSFLLKQEDREIQDAYLQLFTKLDVALKEMKQYVTQINRLLSTITEPTSGGSCDASLAEEASSLPLVSEESEMDRSDHGGIKKVCFKVAEEDQEDSGHDTMSYRDSYSECNSNRDSVLSYTSVRSNSSYLGSDEMGSGDELPCDMRIPSDKQDKLHGCLEHLFNQVDSINALLKGPVMSRAFEETKHFPMNHSLQEFKQKEECTIRGRSLIQISIQEDPWNLPNSIKTLVDNIQRYVEDGKNQLLLALLKCTDTELQLRRDAIFCQALVAAVCTFSEQLLAALGYRYNNNGEYEESSRDASRKWLEQVAATGVLLHCQSLLSPATVKEERTMLEDIWVTLSELDNVTFSFKQLDENYVANTNVFYHIEGSRQALKVIFYLDSYHFSKLPSRLEGGASLRLHTALFTKVLENVEGLPSPGSQAAEDLQQDINAQSLEKVQQYYRKLRAFYLERSNLPTDASTTAVKIDQLIRPINALDELCRLMKSFVHPKPGAAGSVGAGLIPISSELCYRLGACQMVMCGTGMQRSTLSVSLEQAAILARSHGLLPKCIMQATDIMRKQGPRVEILAKNLRVKDQMPQGAPRLYRLCQPPVDGDL

SEQ ID NO: 810842 - protein, 1671 aa, Homo sapiens
SNRNRSYENRCPLLAAARESERQLRLRLCVLNEILGTERDYVGTLRFLQSAFLHRIRQNVADSVEKGLTEENVKVLFSNIEDILEVHKDFLAALEYCLHPEPQSQHELGNVFLKFKDKFCVYEEYCSNHEKALRLLVELNKIPTVRAFLLSCMLLGGRKTTDIPLEGYLLSPIQRICKYPLLLKELAKRTPGKHPDHPAVQSALQAMKTVCSNINETKRQMEKLEALEQLQSHIEGWEGSNLTDICTQLLLQGTLLKISAGNIQERAFFLFDNLLVYCKRKSRVTGSKKSTKRTKSINGSLYIFRGRINTEVMEVENVEDGTADYHSNGYTVTNGWKIHNTAKNKWFVCMAKTAEEKQKWLDAIIREREQRESLKLGMERDAYVMIAEKGEKLYHMMMNKKVNLIKDRRRKLSTVPKCFLGNEFVAWLLEIGEISKTEEGVNLGQALLENGIIHHVSDKHQFKNEQVMYRFRYDDGTYKARSELEDIMSKGVRLYCRLHSLYTPVIKDRDYHLKTYKSVLPGSKLVDWLLAQGDCQTREEAVALGVGLCNNGFMHHVLEKSEFRDESQYFRFHADEEMEGTSSKNKQLRNDFKLVENILAKRLLILPQEEDYGFDIEEKNKAVVVKSVQRGSLAEVAGLQVGRKIYSINEDLVFLRPFSEVESILNQSFCSRRPLRLLVATKAKEIIKIPDQPDTLCFQIRGAAPPYVYAVGRGSEAMAAGLCAGQCILKVNGSNVMNDGAPEVLEHFQAFRSRREEALGLYQWIYHTHEDAQEARASQEASTEDPSGEQAQEEDQADSAFPLLSLGPRLSLCEDSPMVTLTVDNVHLEHGVVYEYVSTAGVRCHVLEKIVEPRGCFGLTAKILEAFAANDSVFVENCRRLMALSSAIVTMPHFEFRNICDTKLESIGQRIACYQEFAAQLKSRVSPPFKQAPLEPHPLCGLDFCPTNCHINLMEVSYPKTTPSVGRSFSIRFGRKPSLIGLDPEQGHLNPMSYTQHCITTMAAPSWKCLPAAEGDPQGQGLHDGSFGPASGTLGQEDRGLSFLLKQEDREIQDAYLQLFTKLDVALKEMKQYVTQINRLLSTITEPTSGGSCDASLAEEASSLPLVSEESEMDRSDHGGIKKVCFKVAEEDQEDSGHDTMSYRDSYSECNSNRDSVLSYTSVRSNSSYLGSDEMGSGDELPCDMRIPSDKQDKLHGCLEHLFNQVDSINALLKGPVMSRAFEETKHFPMNHSLQEFKQKEECTIRGRSLIQISIQEDPWNLPNSIKTLVDNIQRYVEDGKNQLLLALLKCTDTELQLRRDAIFCQALVAAVCTFSEQLLAALGYRYNNNGEYEESSRDASRKWLEQVAATGVLLHCQSLLSPATVKEERTMLEDIWVTLSELDNVTFSFKQLDENYVANTNVFYHIEGSRQALKVIFYLDSYHFSKLPSRLEGGASLRLHTALFTKGELQAWGREDHGGRAKATKHTGSQPPARPRHLPSQVLENVEGLPSPGSQAAEDLQQDINAQSLEKVQQYYRKLRAFYLERSNLPTDASTTAVKIDQLIRPINALDELCRLMKSFVHPKPGAAGSVGAGLIPISSELCYRLGACQMVMCGTGMQRSTLSVSLEQAAILARSHGLLPKCIMQATDIMRKQGPRVEILAKNLRVKDQMPQGAPRLYRLCQPPVDGDL

SEQ ID NO: 810843 - protein, 1598 aa, Homo sapiens
SNRNRSYENRCPLLAAARESERQLRLRLCVLNEILGTERDYVGTLRFLQSAFLHRIRQNVADSVEKGLTEENVKVLFSNIEDILEVHKDFLAALEYCLHPEPQSQHELGNVFLKFKDKFCVYEEYCSNHEKALRLLVELNKIPTVRAFLLSCMLLGGRKTTDIPLEGYLLSPIQRICKYPLLLKELAKRTPGKHPDHPAVQSALQAMKTVCSNINETKRQMEKLEALEQLQSHIEGWEGSNLTDICTQLLLQGTLLKISAGNIQERAFFLFDNLLVYCKRKSRVTGSKKSTKRTKSINGSLYIFRGRINTEVMEVENVEDGTADYHSNGYTVTNGWKIHNTAKNKWFVCMAKTAEEKQKWLDAIIREREQRESLKLGMERDAYVMIAEKGEKLYHMMMNKKVNLIKDRRRKLSTVPKCFLGNEFVAWLLEIGEISKTEEGVNLGQALLENGIIHHVSDKHQFKNEQVMYRFRYDDGTYKARSELEDIMSKGVRLYCRLHSLYTPVIKDRDYHLKTYKSVLPGSKLVDWLLAQGDCQTREEAVALGVGLCNNGFMHHVLEKSEFRDESQYFRFHADEEMEGTSSKNKQLRNDFKLVENILAKRLLILPQEEDYGFDIEEKNKAVVVKSVQRGSLAEVAGLQVGRKIYSINEDLVFLRPFSEVESILNQSFCSRRPLRLLVATKAKEIIKIPDQPDTLCFQIRGAAPPYVYAVGRGSEAMAAGLCAGQCILKVNGSNVMNDGAPEVLEHFQAFRSRREEALGLYQWIYHTHEDAQEARASQEASTEDPSGEQAQEEDQADSAFPLLSLGPRLSLCEDSPMVTLTVDNVHLEHGVVYEYVSTAGVRCHVLEKIVEPRGCFGLTAKILEAFAANDSVFVENCRRLMALSSAIVTMPHFEFRNICDTKLESIGQRIACYQEFAAQLKSRVSPPFKQAPLEPHPLCGLDFCPTNCHLNPMSYTQHCITTMAAPSWKCLPAAEGDPQGQGLHDGSFGPASGTLGQEDRGLSFLLKQEDREIQDAYLQLFTKLDVALKEMKQYVTQINRLLSTITEPTSGGSCDASLAEEASSLPLVSEESEMDRSDHGGIKKVCFKVAEEDQEDSGHDTMSYRDSYSECNSNRDSVLSYTSVRSNSSYLGSDEMGSGDELPCDMRIPSDKQDKLHGCLEHLFNQVDSINALLKGPVMSRAFEETKHFPMNHSLQEFKQKEECTIRGRSLIQISIQEDPWNLPNSIKTLVDNIQRYVEDGKNQLLLALLKCTDTELQLRRDAIFCQALVAAVCTFSEQLLAALGYRYNNNGEYEESSRDASRKWLEQVAATGVLLHCQSLLSPATVKEERTMLEDIWVTLSELDNVTFSFKQLDENYVANTNVFYHIEGSRQALKVIFYLDSYHFSKLPSRLEGGASLRLHTALFTKVLENVEGLPSPGSQAAEDLQQDINAQSLEKVQQYYRKLRAFYLERSNLPTDASTTAVKIDQLIRPINALDELCRLMKSFVHPKPGAAGSVGAGLIPISSELCYRLGACQMVMCGTGMQRSTLSVSLEQAAILARSHGLLPKCIMQATDIMRKQGPRVEILAKNLRVKDQMPQGAPRLYRLCQPPVDGDL

SEQ ID NO: 810844 - protein, 1636 aa, Homo sapiens; identical to SEQ ID NO: 810838

SEQ ID NO: 810845 - protein, 1622 aa, Homo sapiens
SNRNRSYENRCPLLAAARESERQLRLRLCVLNEILGTERDYVGTLRFLQSAFLHRIRQNVADSVEKGLTEENVKVLFSNIEDILEVHKDFLAALEYCLHPEPQSQHELGNVFLKFKDKFCVYEEYCSNHEKALRLLVELNKIPTVRAFLLSCMLLGGRKTTDIPLEGYLLSPIQRICKYPLLLKELAKRTPGKHPDHPAVQSALQAMKTVCSNINETKRQMEKLEALEQLQSHIEGWEGSNLTDICTQLLLQGTLLKISAGNIQERAFFLFDNLLVYCKRKSRVTGSKKSTKRTKSINGSLYIFRGRINTEVMEVENVEDGTADYHSNGYTVTNGWKIHNTAKNKWFVCMAKTAEEKQKWLDAIIREREQRESLKLGMERDAYVMIAEKGEKLYHMMMNKKVNLIKDRRRKLSTVPKCFLGNEFVAWLLEIGEISKTEEGVNLGQALLENGIIHHVSDKHQFKNEQVMYRFRYDDGTYKARSELEDIMSKGVRLYCRLHSLYTPVIKDRDYHLKTYKSVLPGSKLVDWLLAQGDCQTREEAVALGVGLCNNGFMHHVLEKSEFRDESQYFRFHADEEMEGTSSKNKQLRNDFKLVENILAKRLLILPQEEDYGFDIEEKNKAVVVKSVQRGSLAEVAGLQVGRKIYSINEDLVFLRPFSEVESILNQSFCSRRPLRLLVATKAKEIIKIPDQPDTLCFQIRGAAPPYVYAVGRGSEAMAAGLCAGQCILKVNGSNVMNDGAPEVLEHFQAFRSRREEALGLYQWIYHTHEDAQEARASQEASTEDPSGEQAQEEDQADSAFPLLSLGPRLSLCEDSPMVTLTVDNVHLEHGVVYEYVSTAGVRCHVLEKIVEPRGCFGLTAKILEAFAANDSVFVENCRRLMALSSAIVTMPHFEFRNICDTKLESIGQRIACYQEFAAQLKSRVSPPFKQAPLEPHPLCGLDFCPTNCHINLMEVSYPKTTPSVGRSFSIRFGRKPSLIGLDPEQGHLNPMSYTQHCITTMAAPSWKCLPAAEGDPQGQGLHDGSFGPASGTLGQEDRGLSFLLKQEDREIQDAYLQLFTKLDVALKEMKQYVTQINRLLSTITEPTSGGSCDASLAEEASSLPLVSEESEMDRSDHGGIKKVCFKVAEEDQEDSGHDTMSYRDSYSECNSNRDSVLSYTSVRSNSSYLGSDEMGSGDELPCDMRIPSDKQDKLHGCLEHLFNQVDSINALLKGPVMSRAFEETKHFPMNHSLQEFKQKEECTIRGRSLIQISIQEDPWNLPNSIKTLVDNIQRYVEDGKNQLLLALLKCTDTELQLRRDAIFCQALVAAVCTFSEQLLAALGYRYNNNGEYEESSRDASRKWLEQVAATGVLLHCQSLLSPATVKEERTMLEDIWVTLSELDNVTFSFKQLDENYVANTNVFYHIEGSRQALKVIFYLDSYHFSKLPSRLEGGASLRLHTALFTKVLENVEGLPSPGSQAAEDLQQDINAQSLEKVQQYYRKLSTTAVKIDQLIRPINALDELCRLMKSFVHPKPGAAGSVGAGLIPISSELCYRLGACQMVMCGTGMQRSTLSVSLEQAAILARSHGLLPKCIMQATDIMRKQGPRVEILAKNLRVKDQMPQGAPRLYRLCQPPVDGDL

SEQ ID NO: 810846 - protein, 1636 aa, Homo sapiens; identical to SEQ ID NO: 810838

SEQ ID NO: 810847 - protein, 956 aa, Homo sapiens; identical to SEQ ID NO: 810836

SEQ ID NO: 810848 - protein, 883 aa, Homo sapiens
YSGFWQGLYQWIYHTHEDAQEARASQEASTEDPSGEQAQEEDQADSAFPLLSLGPRLSLCEDSPMVTLTVDNVHLEHGVVYEYVSTAGVRCHVLEKIVEPRGCFGLTAKILEAFAANDSVFVENCRRLMALSSAIVTMPHFEFRNICDTKLESIGQRIACYQEFAAQLKSRVSPPFKQAPLEPHPLCGLDFCPTNCHINLMEVSYPKTTPSVGRSFSIRFGRKPSLIGLDPEQGHLNPMSYTQHCITTMAAPSWKCLPAAEGDPQGQGLHDGSFGPASGTLGQEDRGLSFLLKQEDREIQDAYLQLFTKLDVALKEMKQYVTQINRLLSTITEPTSGGSCDASLAEEASSLPLVSEESEMDRSDHGGIKKVCFKVAEEDQEDSGHDTMSYRDSYSECNSNRDSVLSYTSVRSNSSYLGSDEMGSGDELPCDMRIPSDKQDKLHGCLEHLFNQVDSINALLKGPVMSRAFEETKHFPMNHSLQEFKQKEECTIRGRSLIQISIQEDPWNLPNSIKTLVDNIQRYVEDGKNQLLLALLKCTDTELQLRRDAIFCQALVAAVCTFSEQLLAALGYRYNNNGEYEESSRDASRKWLEQVAATGVLLHCQSLLSPATVKEERTMLEDIWVTLSELDNVTFSFKQLDENYVANTNVFYHIEGSRQALKVIFYLDSYHFSKLPSRLEGGASLRLHTALFTKVLENVEGLPSPGSQAAEDLQQDINAQSLEKVQQYYRKLRAFYLERSNLPTDASTTAVKIDQLIRPINALDELCRLMKSFVHPKPGAAGSVGAGLIPISSELCYRLGACQMVMCGTGMQRSTLSVSLEQAAILARSHGLLPKCIMQATDIMRKQGPRVEILAKNLRVKDQMPQGAPRLYRLCQPPVDGDL

SEQ ID NO: 810849 - protein, 1636 aa, Homo sapiens; identical to SEQ ID NO: 810838

SEQ ID NO: 810850 - protein, 1691 aa, Homo sapiens
SNRNRSYENRCPLLAAARESERQLRLRLCVLNEILGTERDYVGTLRFLQSAFLHRIRQNVADSVEKGLTEENVKVLFSNIEDILEVHKDFLAALEYCLHPEPQSQHELGNVFLKFKDKFCVYEEYCSNHEKALRLLVELNKIPTVRAFLLSCMLLGGRKTTDIPLEGYLLSPIQRICKYPLLLKELAKRTPGKHPDHPAVQSALQAMKTVCSNINETKRQMEKLEALEQLQSHIEGWEGSNLTDICTQLLLQGTLLKISAGNIQERAFFLFDNLLVYCKRKSRVTGSKKSTKRTKSINGSLYIFRGRINTEVMEVENVEDGTADYHSNGYTVTNGWKIHNTAKNKWFVCMAKTAEEKQKWLDAIIREREQRESLKLGMERDAYVMIAEKGEKLYHMMMNKKVNLIKDRRRKLSTVPKCFLGNEFVAWLLEIGEISKTEEGVNLGQALLENGIIHHVSDKHQFKNEQVMYRFRYDDGTYKARSELEDIMSKGVRLYCRLHSLYTPVIKDRDYHLKTYKSVLPGSKLVDWLLAQGDCQTREEAVALGVGLCNNGFMHHVLEKSEFRDESQYFRFHADEEMEGTSSKNKQLRNDFKLVENILAKRLLILPQEEDYGFDIEEKNKAVVVKSVQRGSLAEVAGLQVGRKIYSINEDLVFLRPFSEVESILNQSFCSRRPLRLLVATKAKEIIKIPDQPDTLCFQIRGAAPPYVYAVGRGSEAMAAGLCAGQCILKVNGSNVMNDGAPEVLEHFQAFRSRREEALGLYQWIYHTHEDAQEARASQEASTEDPSGEQAQEEDQADSAFPLLSLGPRLSLCEDSPMVTLTVDNVHLEHGVVYEYVSTAGVRCHVLEKIVEPRGCFGLTAKILEAFAANDSVFVENCRRLMALSSAIVTMPHFEFRNICDTKLESIGQRIACYQEFAAQLKSRVSPPFKQAPLEPHPLCGLDFCPTNCHINLMEVSYPKTTPSVGRSFSIRFGRKPSLIGLDPEQGHLNPMSYTQHCITTMAAPSWKCLPAAEGDPQGQGLHDGSFGPASGTLGQEDRGLSFLLKQEDREIQDAYLQLFTKLDVALKEMKQYVTQINRLLSTITEPTSGGSCDASLAEEASSLPLVSEESEMDRSDHGGIKKVCFKVAEEDQEDSGHDTMSYRDSYSECNSNRDSVLSYTSVRSNSSYLGSDEMGSGDELPCDMRIPSDKQDKLHGCLEHLFNQVDSINALLKGPVMSRAFEETKHFPMNHSLQEFKQKEECTIRGRSLIQISIQEDPWNLPNSIKTLVDNIQRYVEDGKNQLLLALLKCTDTELQLRRDAIFCQALVAAVCTFSEQLLAALGYRYNNNGEYEESSRDASRKWLEQVAATGVLLHCQSLLSPATVKEERTMLEDIWVTLSELDNVTFSFKQLDENYVANTNVFYHIEGSRQALKVIFYLDSYHFSKLPSRLEGGASLRLHTALFTKVLENVEGLPSPGSQAAEDLQQDINAQSLEKVQQYYRKLRAFYLERSNLPTDASTTAVKIDQLIRPINALDELCRLMKSFVHPKPGAAGSVGAGLIPISSELCYRLGACQMVMCGTGMQRSTLSVSLEQAAILARSHGLLPKCIMQATDIMRKQGPRVEILAKNLRVKDQMPQGAPRFQVHPNPVLTCLVDLEKTWLCRERRDGASITPVTRGSPRATPALDITAPGTGATSPGHEICSDFIYMA

SEQ ID NO: 810851 - protein, 1401 aa, Homo sapiens
SNRNRSYENRCPLLAAARESERQLRLRLCVLNEILGTERDYVGTLRFLQSAFLHRIRQNVADSVEKGLTEENVKVLFSNIEDILEVHKDFLAALEYCLHPEPQSQHELGNVFLKFKDKFCVYEEYCSNHEKALRLLVELNKIPTVRAFLLSCMLLGGRKTTDIPLEGYLLSPIQRICKYPLLLKELAKRTPGKHPDHPAVQSALQAMKTVCSNINETKRQMEKLEALEQLQSHIEGWEGSNLTDICTQLLLQGTLLKISAGNIQERAFFLFDNLLVYCKRKSRVTGSKKSTKRTKSINGSLYIFRGRINTEVMEVENVEDGTADYHSNGYTVTNGWKIHNTAKNKWFVCMAKTAEEKQKWLDAIIREREQRESLKLGMERDAYVMIAEKGEKLYHMMMNKKVNLIKDRRRKLSTVPKCFLGNEFVAWLLEIGEISKTEEGVNLGQALLENGIIHHVSDKHQFKNEQVMYRFRYDDGTYKARSELEDIMSKGVRLYCRLHSLYTPVIKDRDYHLKTYKSVLPGSKLVDWLLAQGDCQTREEAVALGVGLCNNGFMHHVLEKSEFRDESQYFRFHADEEMEGTSSKNKQLRNDFKLVENILAKRLLILPQEEDYGFDIEEKNKAVVVKSVQRGSLAEVAGLQVGRKIYSINEDLVFLRPFSEVESILNQSFCSRRPLRLLVATKAKEIIKIPDQPDTLCFQIRGAAPPYVYAVGRGSEAMAAGLCAGQCILKVNGSNVMNDGAPEVLEHFQAFRSRREEALGLYQWIYHTHEDAQEARASQEASTEDPSGEQAQEEDQADSAFPLLSLGPRLSLCEDSPMVTLTVDNVHLEHGVVYEYVSTAGVRCHVLEKIVEPRGCFGLTAKILEAFAANDSVFVENCRRLMALSSAIVTMPHFEFRNICDTKLESIGQRIACYQEFAAQLKSRVSPPFKQAPLEPHPLCGLDFCPTNCHINLMEVSYPKTTPSVGRSFSIRFGRKPSLIGLDPEQGHLNPMSYTQHCITTMAAPSWKCLPAAEGDPQGQGLHDGSFGPASGTLGQEDRGLSFLLKQEDREIQDAYLQLFTKLDVALKEMKQYVTQINRLLSTITEPTSGGSCDASLAEEASSLPLVSEESEMDRSDHGGIKKVCFKVAEEDQEDSGHDTMSYRDSYSECNSNRDSVLSYTSVRSNSSYLGSDEMGSGDELPCDMRIPSDKQDKLHGCLEHLFNQVDSINALLKGPVMSRAFEETKHFPMNHSLQEFKQKEECTIRGRSLIQISIQEDPWNLPNSIKTLVDNIQRYVEDGKNQLLLALLKCTDTELQLRRDAIFCQALVAAVCTFSEQLLAALGYRYNNNGEYEESSRDASRKWLEQVAATGVLLHCQSLLSPATVKEERTMLEDIWVTLSELDNVTFSFKQLDENYVASE

SEQ ID NO: 810852 - protein, 1314 aa, Homo sapiens
SNRNRSYENRCPLLAAARESERQLRLRLCVLNEILGTERDYVGTLRFLQSAFLHRIRQNVADSVEKGLTEENVKVLFSNIEDILEVHKDFLAALEYCLHPEPQSQHELGNVFLKFKDKFCVYEEYCSNHEKALRLLVELNKIPTVRAFLLSCMLLGGRKTTDIPLEGYLLSPIQRICKYPLLLKELAKRTPGKHPDHPAVQSALQAMKTVCSNINETKRQMEKLEALEQLQSHIEGWEGSNLTDICTQLLLQGTLLKISAGNIQERAFFLFDNLLVYCKRKSRVTGSKKSTKRTKSINGSLYIFRGRINTEVMEVENVEDGTADYHSNGYTVTNGWKIHNTAKNKWFVCMAKTAEEKQKWLDAIIREREQRESLKLGMERDAYVMIAEKGEKLYHMMMNKKVNLIKDRRRKLSTVPKCFLGNEFVAWLLEIGEISKTEEGVNLGQALLENGIIHHVSDKHQFKNEQVMYRFRYDDGTYKARSELEDIMSKGVRLYCRLHSLYTPVIKDRDYHLKTYKSVLPGSKLVDWLLAQGDCQTREEAVALGVGLCNNGFMHHVLEKSEFRDESQYFRFHADEEMEGTSSKNKQLRNDFKLVENILAKRLLILPQEEDYGFDIEEKNKAVVVKSVQRGSLAEVAGLQVGRKIYSINEDLVFLRPFSEVESILNQSFCSRRPLRLLVATKAKEIIKIPDQPDTLCFQIRGAAPPYVYAVGRGSEAMAAGLCAGQCILKVNGSNVMNDGAPEVLEHFQAFRSRREEALGLYQWIYHTHEDAQEARASQEASTEDPSGEQAQEEDQADSAFPLLSLGPRLSLCEDSPMVTLTVDNVHLEHGVVYEYVSTAGVRCHVLEKIVEPRGCFGLTAKILEAFAANDSVFVENCRRLMALSSAIVTMPHFEFRNICDTKLESIGQRIACYQEFAAQLKSRVSPPFKQAPLEPHPLCGLDFCPTNCHINLMEVSYPKTTPSVGRSFSIRFGRKPSLIGLDPEQGHLNPMSYTQHCITTMAAPSWKCLPAAEGDPQGQGLHDGSFGPASGTLGQEDRGLSFLLKQEDREIQDAYLQLFTKLDVALKEMKQYVTQINRLLSTITEPTSGGSCDASLAEEASSLPLVSEESEMDRSDHGGIKKVCFKVAEEDQEDSGHDTMSYRDSYSECNSNRDSVLSYTSVRSNSSYLGSDEMGSGDELPCDMRIPSDKQDKLHGCLEHLFNQVDSINALLKGPVMSRAFEETKHFPMNHSLQEFKQKEECTIRGRSLIQISIQEDPWNLPNSIKTLVDNIQRYVEGRWAGRVHHGGEGAMAFGVEPERIRNGSSSVTPVSP

SEQ ID NO: 810853 - protein, 864 aa, Homo sapiens
SNRNRSYENRCPLLAAARESERQLRLRLCVLNEILGTERDYVGTLRFLQSAFLHRIRQNVADSVEKGLTEENVKVLFSNIEDILEVHKDFLAALEYCLHPEPQSQHELGNVFLKFKDKFCVYEEYCSNHEKALRLLVELNKIPTVRAFLLSCMLLGGRKTTDIPLEGYLLSPIQRICKYPLLLKELAKRTPGKHPDHPAVQSALQAMKTVCSNINETKRQMEKLEALEQLQSHIEGWEGSNLTDICTQLLLQGTLLKISAGNIQERAFFLFDNLLVYCKRKSRVTGSKKSTKRTKSINGSLYIFRGRINTEVMEVENVEDGTADYHSNGYTVTNGWKIHNTAKNKWFVCMAKTAEEKQKWLDAIIREREQRESLKLGMERDAYVMIAEKGEKLYHMMMNKKVNLIKDRRRKLSTVPKCFLGNEFVAWLLEIGEISKTEEGVNLGQALLENGIIHHVSDKHQFKNEQVMYRFRYDDGTYKARSELEDIMSKGVRLYCRLHSLYTPVIKDRDYHLKTYKSVLPGSKLVDWLLAQGDCQTREEAVALGVGLCNNGFMHHVLEKSEFRDESQYFRFHADEEMEGTSSKNKQLRNDFKLVENILAKRLLILPQEEDYGFDIEEKNKAVVVKSVQRGSLAEVAGLQVGRKIYSINEDLVFLRPFSEVESILNQSFCSRRPLRLLVATKAKEIIKIPDQPDTLCFQIRGAAPPYVYAVGRGSEAMAAGLCAGQCILKVNGSNVMNDGAPEVLEHFQAFRSRREEALGLYQWIYHTHEDAQEARASQEASTEDPSGEQAQEEDQADSAFPLLSLGPRLSLCEDSPMVTLTVDNVHLEHGVVYEYVSTAGVRCHVLEKIVEPRGCFGLTAKRV

SEQ ID NO: 810854 - protein, 330 aa, Homo sapiens
SNRNRSYENRCPLLAAARESERQLRLRLCVLNEILGTERDYVGTLRFLQSAFLHRIRQNVADSVEKGLTEENVKVLFSNIEDILEVHKDFLAALEYCLHPEPQSQHELGNVFLKFKDKFCVYEEYCSNHEKALRLLVELNKIPTVRAFLLSCMLLGGRKTTDIPLEGYLLSPIQRICKYPLLLKELAKRTPGKHPDHPAVQSALQAMKTVCSNINETKRQMEKLEALEQLQSHIEGWEGSNLTDICTQLLLQGTLLKISAGNIQERAFFLFDNLLVYCKRKSRVTGSKKSTKRTKSINGSLYIFRGRINTEVMEVENVEDGTGSPSPSLA

SEQ ID NO: 810855 - protein, 104 aa, Homo sapiens
LPFFLSGCEALLPSSQPLHPGDQVSYSFQAPISPLPLLSCVALGWQLNLSELQSPSPLNGACSGTYPLDLSLGLTELNCGKHCSVVMQVSVLEPDRLSLNLPPS

SEQ ID NO: 810856 - protein, 773 aa, Homo sapiens
MDLLKITMKELISLAGPTDDIQSTVPQVHALNILRALFRDTRLGENIIPYVADGAKAAILGFTSPVWAVRNSSTLLFSALITRIFGVKRAKDEHSKTNRMTGREFFSRFPELYPFLLKQLETVANTVDSDMGEPNRHPSMFLLLLVLERLYASPMDGTSSALSMGPFVPFIMRCGHSPVYHSREMAARALVPFVMIDHIPNTIRTLLSTLPSCTDQCFRQNHIHGTLLQVFHLLQAYSDSKHGTNSDFQHELTDITVCTKAKLWLAKRQNPCLVTRAVYIDILFLLTCCLNRSAKDNQPVLESLGFWEEVRGIISGSELITGFPWAFKVPGLPQYLQSLTRLAIAAVWAAAAKSGERETNVPISFSQLLESAFPEVRSLTLEALLEKFLAAASGLGEKGVPPLLCNMGEKFLLLAMKENHPECFCKILKILHCMDPGEWLPQTEHCVHLTPKEFLIWTMDIASNERSEIQSVALRLASKVISHHMQTCVENRELIAAELKQWVQLVILSCEDHLPTESRLAVVEVLTSTTPLFLTNPHPILELQDTLALWKCVLTLLQSEEQAVRDAATETVTTAMSQENTCQSTEFAFCQVDASIALALALAVLCDLLQQWDQLAPGLPILLGWLLGESDDLVACVESMHQVEEDYLFEKAEVNFWAETLIFVKYLCKHLFCLLSKSGWRPPSPEMLCHLQRMVSEQCHLLSQFFRELPPAAEFVKTVEFTRLRIQEERTLACLRLLAFLEGKEGEDTLVLSVWDSYAESRQLTLPRTEAAC

SEQ ID NO: 810857 - protein, 207 aa, Homo sapiens
MTGREFFSRFPELYPFLLKQLETVANTVDSDMGEPNRHPSMFLLLLVLERLYASPMDGTSSALSMGPFVPFIMRCGHSPVYHSREMAARALVPFVMIDHIPNTIRTLLSTLPSCTDQCFRQNHIHGTLLQVFHLLQAYSDSKHGTNSDFQHELTDITVCTKAKLWLAKRQNPCLVTRAVYIDILFLLTCCLNRSAKDNQPGMIHSYT

SEQ ID NO: 810858 - protein, 268 aa, Homo sapiens
AGNELSKAGALACGMASAKARSPSAEFAFCQVDASIALALALAVLCDLLQQWDQLAPGLPILLGWLLGESDDLVACVESMHQVEEDYLFEKAEVNFWAETLIFVKYLCKHLFCLLSKSGWRPPSPEMLFSVTFSKKGGGNLGGGGVGGVFPPKGGRKKGGPPKKGGFLWGGAPQKKTKHPPFFFFPPPARGWVGGYFPPRFFPTQNEEGEYYIMSATTTPSDFVCFAPTTSKRRGGRNNKNAGPGPTNKQRDGGGGTHHHYYVFVVVS

SEQ ID NO: 810859 - protein, 1311 aa, Homo sapiens
DSRDPLEMGTEIVSMEEMQWIQFFITYNLNSQSPGVRQQICSLLKKLFCRIQESSQVLYKLEQSKSKREPENELTKQHPSVSLQQYKNFMSSICNSLFEALFPGSSYSTRFSALTILGSIAEVFHVPEGRIYTVYQLSHDIDVGRFQTLMECFTSTFEDVKILAFDLLMKLSKTAVHFQDSGKLQGLFQAALELSTSTKPYDCVTASYLLNFLIWQDALPSSLSAYLTQQVACDNGDRPAAVVERNTLMVIKCLMENLEEEVSQAENSLLQAAAAFPMYGRVHCITGALQKLSLNSLQLVSEWRPVVEKLLLMSYRLSTVVSPVIQSSSPEGLIPMDTDSESASRLQMILNEIQPRDTNDYFNQAKILKEHDSFDMKDLNASVVNIDTSTEIKGKEVKTCDVTAQMVLVCCWRSMKEVALLLGMLCQLLPMQPVPESSDGLLTVEQVKEIGDYFKQHLLQSRHRGAFELAYTGFVKLTEVLNRCPNVSLQKLPEQWLWSVLEEIKCSDPSSKLCATRRSAGIPFYIQALLASEPKKGRMDLLKITMKELISLAGPTDDIQSTVPQVHALNILRALFRDTRLGENIIPYVADGAKAAILGFTSPVWAVRNSSTLLFSALITRIFGVKRAKDEHSKTNRMTGREFFSRFPELYPFLLKQLETVANTVDSDMGEPNRHPSMFLLLLVLERLYASPMDGTSSALSMGPFVPFIMRCGHSPVYHSREMAARALVPFVMIDHIPNTIRTLLSTLPSCTDQCFRQNHIHGTLLQVFHLLQAYSDSKHGTNSDFQHELTDITVCTKAKLWLAKRQNPCLVTRAVYIDILFLLTCCLNRSAKDNQPVLESLGFWEEVRGIISGSELITGFPWAFKVPGLPQYLQSLTRLAIAAVWAAAAKSGERETNVPISFSQLLESAFPEVRSLTLEALLEKFLAAASGLGEKGVPPLLCNMGEKFLLLAMKENHPECFCKILKILHCMDPGEWLPQTEHCVHLTPKEFLIWTMDIASNERSEIQSVALRLASKVISHHMQTCVENRELIAAELKQWVQLVILSCEDHLPTESRLAVVEVLTSTTPLFLTNPHPILELQDTLALWKCVLTLLQSEEQAVRDAATETVTTAMSQENTCQSTEFAFCQVDASIALALALAVLCDLLQQWDQLAPGLPILLGWLLGESDDLVACVESMHQVEEDYLFEKAEVNFWAETLIFVKYLCKHLFCLLSKSGWRPPSPEMLCHLQRMVSEQCHLLSQFFRELPPAAEFVKTVEFTRLRIQEERTLACLRLLAFLEGKEGEDTLVLSVWDSYAESRQLTLPRTEAAC

SEQ ID NO: 810860 - protein, 1237 aa, Homo sapiens
DSRDPLEMGTEIVSMEEMQWIQFFITYNLNSQSPGVRQQICSLLKKLFCRIQESSQVLYKLEQSKSKREPENELTKQHPSVSLQQYKNFMSSICNSLFEALFPGSSYSTRFSALTILGSIAEVFHVPEGRIYTVYQLSHDIDVGRFQTLMECFTSTFEDVKILAFDLLMKLSKTAVHFQDSGKLQGLFQAALELSTSTKPYDCVTASYLLNFLIWQDALPSSLSAYLTQQVACDNGDRPAAVVERNTLMVIKCLMENLEEEVSQAENSLLQAAAAFPMYGRVHCITGALQKLSLNSLQLVSEWRPVVEKLLLMSYRLSTVVSPVIQSSSPEGLIPMDTDSESASRLQMILNEIQPRDTNDYFNQAKILKEHDSFDMKDLNASVVNIDTSTEIKGKEVKTCDVTAQMVLVCCWRSMKEVALLLGMLCQLLPMQPVPESSDGLLTVEQVKEIGDYFKQHLLQSRHRGAFELAYTGFVKLTEVLNRCPNVSLQKLPEQWLWSVLEEIKCSDPSSKLCATRRSAGIPFYIQALLASEPKKGRMDLLKITMKELISLAGPTDDIQSTVPQVHALNILRALFRDTRLGENIIPYVADGAKAAILGFTSPVWAVRNSSTLLFSALITRIFGVKRAKDEHSKTNRCGHSPVYHSREMAARALVPFVMIDHIPNTIRTLLSTLPSCTDQCFRQNHIHGTLLQVFHLLQAYSDSKHGTNSDFQHELTDITVCTKAKLWLAKRQNPCLVTRAVYIDILFLLTCCLNRSAKDNQPVLESLGFWEEVRGIISGSELITGFPWAFKVPGLPQYLQSLTRLAIAAVWAAAAKSGERETNVPISFSQLLESAFPEVRSLTLEALLEKFLAAASGLGEKGVPPLLCNMGEKFLLLAMKENHPECFCKILKILHCMDPGEWLPQTEHCVHLTPKEFLIWTMDIASNERSEIQSVALRLASKVISHHMQTCVENRELIAAELKQWVQLVILSCEDHLPTESRLAVVEVLTSTTPLFLTNPHPILELQDTLALWKCVLTLLQSEEQAVRDAATETVTTAMSQENTCQSTEFAFCQVDASIALALALAVLCDLLQQWDQLAPGLPILLGWLLGESDDLVACVESMHQVEEDYLFEKAEVNFWAETLIFVKYLCKHLFCLLSKSGWRPPSPEMLCHLQRMVSEQCHLLSQFFRELPPAAEFVKTVEFTRLRIQEERTLACLRLLAFLEGKEGEDTLVLSVWDSYAESRQLTLPRTEAAC

SEQ ID NO: 810861 - protein, 686 aa, Homo sapiens
MGCEMNIPRHKSMTGREFFSRFPELYPFLLKQLETVANTVDSDMGEPNRHPSMFLLLLVLERLYASPMDGTSSALSMGPFVPFIMRCGHSPVYHSREMAARALVPFVMIDHIPNTIRTLLSTLPSCTDQCFRQNHIHGTLLQVFHLLQAYSDSKHGTNSDFQHELTDITVCTKAKLWLAKRQNPCLVTRAVYIDILFLLTCCLNRSAKDNQPVLESLGFWEEVRGIISGSELITGFPWAFKVPGLPQYLQSLTRLAIAAVWAAAAKSGERETNVPISFSQLLESAFPEVRSLTLEALLEKFLAAASGLGEKGVPPLLCNMGEKFLLLAMKENHPECFCKILKILHCMDPGEWLPQTEHCVHLTPKEFLIWTMDIASNERSEIQSVALRLASKVISHHMQTCVENRELIAAELKQWVQLVILSCEDHLPTESRLAVVEVLTSTTPLFLTNPHPILELQDTLALWKCVLTLLQSEEQAVRDAATETVTTAMSQENTCQSTEFAFCQVDASIALALALAVLCDLLQQWDQLAPGLPILLGWLLGESDDLVACVESMHQVEEDYLFEKAEVNFWAETLIFVKYLCKHLFCLLSKSGWRPPSPEMLCHLQRMVSEQCHLLSQFFRELPPAAEFVKTVEFTRLRIQEERTLACLRLLAFLEGKEGEDTLVLSVWDSYAESRQLTLPRTEAAC

SEQ ID NO: 810862 - protein, 289 aa, Homo sapiens [sequence omitted]

SEQ ID NO: 810863 - protein, 290 aa, Homo sapiens
PGLQEFGNRELIAAELKQWVQLVILSCEDHLPTESRLAVVEVLTSTTPLFLTNPHPILELQDTLALWKCVLTLLQSEEQAVRDAATETVTTAMSQENTCQSTEFAFCQVDASIALALALAVLCDLLQQWDQLAPGLPILLGWLLGESDDLVACVESMHQVEEDYLFEKAEVNFWAETLIFVKYLCKHLFCLLSKSGWRPPSPEMLCHLQRMVSEQCHLLSQFFRELPPAAEFVKTVEFTRLRIQEERTLACLRLLAFLEGKEGEDTLVLSVWDSYAESRQLTLPRTEAAC

SEQ ID NO: 810864 - protein, 405 aa, Homo sapiens
DSRDPLEMGTEIVSMEEMQWIQFFITYNLNSQSPGVRQQICSLLKKLFCRIQESSQVLYKLEQSKSKREPENELTKQHPSVSLQQYKNFMSSICNSLFEALFPGSSYSTRFSALTILGSIAEVFHVPEGRIYTVYQLSHDIDVGRFQTLMECFTSTFEDVKILAFDLLMKLSKTAVHFQDSGKLQGLFQAALELSTSTKPYDCVTASYLLNFLIWQDALPSSLSAYLTQQVACDNGDRPAAVVERNTLMVIKCLMENLEEEVSQAENSLLQAAAAFPMYGRVHCITGALQKLSLNSLQLVSEWRPVVEKLLLMSYRLSTVVSPVIQSSSPEGLIPMDTDSESASRLQMILNEIQPRDTNDYFNQAKILKEHDSFDMKDLNASVVNIDTSTEIKGNLYKMDTVIHV

SEQ ID NO: 810865 - protein, 649 aa, Homo sapiens
DSRDPLEMGTEIVSMEEMQWIQFFITYNLNSQSPGVRQQICSLLKKLFCRIQESSQVLYKLEQSKSKREPENELTKQHPSVSLQQYKNFMSSICNSLFEALFPGSSYSTRFSALTILGSIAEVFHVPEGRIYTVYQLSHDIDVGRFQTLMECFTSTFEDVKILAFDLLMKLSKTAVHFQDSGKLQGLFQAALELSTSTKPYDCVTASYLLNFLIWQDALPSSLSAYLTQQVACDNGDRPAAVVERNTLMVIKCLMENLEEEVSQAENSLLQAAAAFPMYGRVHCITGALQKLSLNSLQLVSEWRPVVEKLLLMSYRLSTVVSPVIQSSSPEGLIPMDTDSESASRLQMILNEIQPRDTNDYFNQAKILKEHDSFDMKDLNASVVNIDTSTEIKGKEVKTCDVTAQMVLVCCWRSMKEVALLLGMLCQLLPMQPVPESSDGLLTVEQVKEIGDYFKQHLLQSRHRGAFELAYTGFVKLTEVLNRCPNVSLQKLPEQWLWSVLEEIKCSDPSSKLCATRRSAGIPFYIQALLASEPKKGRMDLLKITMKELISLAGPTDDIQSTVPQVHALNILRALFRDTRLGENIIPYVADGAKAAILGFTSPVWAVRNSSTLLFSALITRIFGVKRAKDEHSKTNRIQFGPVVFLLRI

SEQ ID NO: 810866 - protein, 616 aa, Homo sapiens
DSRDPLEMGTEIVSMEEMQWIQFFITYNLNSQSPGVRQQICSLLKKLFCRIQESSQVLYKLEQSKSKREPENELTKQHPSVSLQQYKNFMSSICNSLFEALFPGSSYSTRFSALTILGSIAEVFHVPEGRIYTVYQLSHDIDVGRFQTLMECFTSTFEDVKILAFDLLMKLSKTAVHFQDSGKLQGLFQAALELSTSTKPYDCVTASYLLNFLIWQDALPSSLSAYLTQQVACDNGDRPAAVVERNTLMVIKCLMENLEEEVSQAENSLLQAAAAFPMYGRVHCITGALQKLSLNSLQLVSEWRPVVEKLLLMSYRLSTVVSPVIQSSSPEGLIPMDTDSESASRLQMILNEIQPRDTNDYFNQAKILKEHDSFDMKDLNASVVNIDTSTEIKGKEVKTCDVTAQMVLVCCWRSMKEVALLLGMLCQLLPMQPVPESSDGLLTVEQVKEIGDYFKQHLLQSRHRGAFELAYTGFVKLTEVLNRCPNVSLQKLPEQWLWSVLEEIKCSDPSSKLCATRRSAGIPFYIQALLASEPKKGRMDLLKITMKELISLAGPTDDIQSTVPQVHALNILRALFRDTRLGENIIPYVADGAKAAILGFTSPVWAVWSLTCLPLP

SEQ ID NO: 810867 - protein, 295 aa, Homo sapiens
DSRDPLEMGTEIVSMEEMQWIQFFITYNLNSQSPGVRQQICSLLKKLFCRIQESSQVLYKLEQSKSKREPENELTKQHPSVSLQQYKNFMSSICNSLFEALFPGSSYSTRFSALTILGSIAEVFHVPEGRIYTVYQLSHDIDVGRFQTLMECFTSTFEDVKILAFDLLMKLSKTAVHFQDSGKLQGLFQAALELSTSTKPYDCVTASYLLNFLIWQDALPSSLSAYLTQQVACDNGDRPAAVVERNTLMVIKCLMENLEEEVSQAENSLLQAAAAFPMYGRVHCITGALQKLSLK

SEQ ID NO: 810868 - protein, 341 aa, Homo sapiens
DSRDPLEMGTEIVSMEEMQWIQFFITYNLNSQSPGVRQQICSLLKKLFCRIQESSQVLYKLEQSKSKREPENELTKQHPSVSLQQYKNFMSSICNSLFEALFPGSSYSTRFSALTILGSIAEVFHVPEGRIYTVYQLSHDIDVGRFQTLMECFTSTFEDVKILAFDLLMKLSKTAVHFQDSGKLQGLFQAALELSTSTKPYDCVTASYLLNFLIWQDALPSSLSAYLTQQVACDNGDRPAAVVERNTLMVIKCLMENLEEEVSQAENSLLQAAAAFPMYGRVHCITGALQKLSLNSLQLVSEWRPVVEKLLLMSYRLSTVVSPVIQSSSPEGLIPMDTDSG

SEQ ID NO: 810869 - protein, 510 aa, Homo sapiens
MDGFYDQQVPFMVPGKSRSEECRGRPVIDRKRKFLDTDLAHDSEELFQDLSQLQEAWLAEAQVPDDEQFVPDFQSDNLVLHAPPPTKIKRELHSPSSELSSCSHEQALGANYGEKCLYNYCAYDRKPPSGFKPLTPPTTPLSPTHQNPLFPPPQATLPTSGHAPAAGPVQGVGPAPAPHSLPEPGPQQQTFAVPRPPHQPLQMPKMMPENQYPSEQRFQRQLSEPCHPFPPQPGVPGDNRPSYHRQMSEPIVPAAPPPPQGFKQEYHDPLYEHGVPGMPGPPAHGFQSPMGIKQEPRDYCVDSEVPNCQSSYMRGGYFSSSHEGFSYEKDPRLYFDDTCVVPERLEGKVKQEPTMYREGPPYQRRGSLQLWQFLVTLLDDPANAHFIAWTGRGMEFKLIEPEEVARRWGIQKNRPAMNYDKLSRSLRYYYEKGIMQKVAGERYVYKFVCDPDALFSMAFPDNQRPFLKAESECHLSEEDTLPLTHFEDSPAYLLDMDRCSSLPYAEGFAY

SEQ ID NO: 810870 - protein, 552 aa, Homo sapiens
MSERRCPPEHREGVNDTGGSLFPQKLLNAETSQSGIRDAESTMDGFYDQQVPFMVPGKSRSEECRGRPVIDRKRKFLDTDLAHDSEELFQDLSQLQEAWLAEAQVPDDEQFVPDFQSDNLVLHAPPPTKIKRELHSPSSELSSCSHEQALGANYGEKCLYNYCAYDRKPPSGFKPLTPPTTPLSPTHQNPLFPPPQATLPTSGHAPAAGPVQGVGPAPAPHSLPEPGPQQQTFAVPRPPHQPLQMPKMMPENQYPSEQRFQRQLSEPCHPFPPQPGVPGDNRPSYHRQMSEPIVPAAPPPPQGFKQEYHDPLYEHGVPGMPGPPAHGFQSPMGIKQEPRDYCVDSEVPNCQSSYMRGGYFSSSHEGFSYEKDPRLYFDDTCVVPERLEGKVKQEPTMYREGPPYQRRGSLQLWQFLVTLLDDPANAHFIAWTGRGMEFKLIEPEEVARRWGIQKNRPAMNYDKLSRSLRYYYEKGIMQKVAGERYVYKFVCDPDALFSMAFPDNQRPFLKAESECHLSEEDTLPLTHFEDSPAYLLDMDRCSSLPYAEGFAY

SEQ ID NO: 810871 - protein, 256 aa, Homo sapiens
SLNRLFLPTRSWVAGPRTQRARVPGWSQRRQRGSLRLLGEGGVVPAHIGRVHVVIVDVDPVRADAQALGQQAAQQLAVGAVLRAADLADAVQAAERARLAGAAEGHELVRDHVHRDVLGGLAGGLRQLLGELERNPSGTEARGTLVFTMNIGMMAEGPGPLVRGAVHRLRSGSAQPFAQAPRPAARVRERACAARAAARGGERPPQEDPFSPRNYSMLKPLKVVLETLKAPWTGFMISKSLLWSQGNLNHRPPSAF

SEQ ID NO: 810872 - protein, 510 aa, Homo sapiens; identical to SEQ ID NO: 810869

SEQ ID NO: 810873 - protein, 510 aa, Homo sapiens; identical to SEQ ID NO: 810869

SEQ ID NO: 810874 - protein, 190 aa, Homo sapiens
MDGFYDQQVPFMVPGKSRSEECRGRPVIDRKRKFLDTDLAHDSEELFQDLSQLQEAWLAEAQVPDDEQFVPDFQSDNLVLHAPPPTKIKRELHSPSSELSSCSHEQALGANYGEKCLYNYCAYDRKPPSGFKPLTPPTKPRASQGQANHEIPVILPPNIQGQLYPKLKGRCPLQRGQVPGASREPAVAPR

SEQ ID NO: 810875 - protein, 687 aa, Homo sapiens
TGDAVVTVQFEGMHKNEAISQQLHVLRKEVKQLQAEKRAKRTTHLHIGGSVLYMANLITALVNAYKLQPTPGIQKVGISLFFTIVDYVSDETQRHPPTRQFFTSCIEIMGQIYTGLKSAGRRLAQCASVTIRTNKLLPMQVDGDTLDAAMLHGGSLFPQKLLNAETSQSGIRDAESTMDGFYDQQVPFMVPGKSRSEECRGRPVIDRKRKFLDTDLAHDSEELFQDLSQLQEAWLAEAQVPDDEQFVPDFQSDNLVLHAPPPTKIKRELHSPSSELSSCSHEQALGANYGEKCLYNYCAYDRKPPSGFKPLTPPTTPLSPTHQNPLFPPPQATLPTSGHAPAAGPVQGVGPAPAPHSLPEPGPQQQTFAVPRPPHQPLQMPKMMPENQYPSEQRFQRQLSEPCHPFPPQPGVPGDNRPSYHRQMSEPIVPAAPPPPQGFKQEYHDPLYEHGVPGMPGPPAHGFQSPMGIKQEPRDYCVDSEVPNCQSSYMRGGYFSSSHEGFSYEKDPRLYFDDTCVVPERLEGKVKQEPTMYREGPPYQRRGSLQLWQFLVTLLDDPANAHFIAWTGRGMEFKLIEPEEVARRWGIQKNRPAMNYDKLSRSLRYYYEKGIMQKVAGERYVYKFVCDPDALFSMAFPDNQRPFLKAESECHLSEEDTLPLTHFEDSPAYLLDMDRCSSLPYAEGFAY

SEQ ID NO: 810876 - protein, 108 aa, Homo sapiens
MDGFYDQQVPFMVPGKSRSEECRGRPVIDRKRKFLDTDLAHDSEELFQDLSQLQEAWLAEAQVPDDEQFVPDFQSDNQKCPVSPYPDCVIQCEQPFMIKSTVVDVRSQ

SEQ ID NO: 810877 - protein, 109 aa, Homo sapiens
MLKPLKVVLETLKAPWNYDKLSRSLRYYYEKGIMQKVAGERYVYKFVCDPDALFSMAFPDNQRPFLKAESECHLSEEDTLPLTHFEDSPAYLLDMDRCSSLPYAEGFAY

SEQ ID NO: 810878 - protein, 592 aa, Homo sapiens
RDAPRLAVAVAGQRAVHVAGLAGTPWEMRPRGLPPLLVVLLGCWASVSAQTDATPAVTTEGLNSTEAALATFGTFPSTRPPGTPRAPGPSSGPRPTPVTDGSHSVTQAGVYGMITAHCGLDLLGSVAVLCVCDLSPAQCDINCCCDPDCSSVDFSVFSACSVPVVTGDSQFCSQKAVIYSLNFTANPPQRVFELVDQINPSIFCIHITNYKPALSFINPEVPDENNFDTLMKTSDGFTLNAESYVSFTTKLDIPTAAKYEYGVPLQTSDSFLRFPSSLTSSLCTDNNPAAFLVNQAVKCTRKINLEQCEEIEALSMAFYSSPEILRVPDSRKKVPITVQSIVIQSLNKTLTRREDTDVLQPTLVNAGHFSLCVNVVLEVKYSLTYTDAGEVTKADLSFVLGTVSSVVVPLQQKFEIHFLQENTQPVPLSGNPGYVVGLPLAAGFQPHKGLTGALPCQLVAQKVKSLLWGQGFPDYVAPFGNSQAQDMLDWVPIHFITQSFNRKDSCQLPGALVIEVKWTKYGSLLNPQAKIVNVTANLISSSFPEANSGNERTILISTAVTFVDVSAPAEAGFRAPPAINARLPFNFFFPFV

SEQ ID NO: 810879 - protein, 292 aa, Homo sapiens
RDAPRLAVAVAGQRAVHVAGLAGTPWEMRPRGLPPLLVVLLGCWASVSAQTDATPAVTTEGLNSTEAALATFGTFPSTRPPGTPRAPGPSSGPRPTPVTDGGYQCQLLESTVIQPQGDSPVAVLCVCDLSPAQCDINCCCDPDCSSVDFSVFSACSVPVVTGDSQFCSQKAVIYSLNFTANPPQRVFELVDQINPSIFCIHITNYKPALSFINPEVPDENNFDTLMKTSDGFTLNAESYVSFTTKLDIPTAAKYEVSLNLIDSFHPITNIFPCKLIFKVTRKTGFLETELIL

SEQ ID NO: 810880 - protein, 189 aa, Homo sapiens
RDAPRLAVAVAGQRAVHVAGLAGTPWEMRPRGLPPLLVVLLGCWASVSAQTDATPAVTTEGLNSTEAALATFGTFPSTRPPGTPRAPGPSSGPRPTPVTDVAVLCVCDLSPAQCDINCCCDPDCSSVDFSVFSACSVPVVTGDSQFCSQKAVIYSLNFTANPPQRVFELVDQINPSIFCIHITNCRCSV

SEQ ID NO: 810881 - protein, 209 aa, Homo sapiens
RDAPRLAVAVAGQRAVHVAGLAGTPWEMRPRGLPPLLVVLLGCWASVSAQTDATPAVTTEGLNSTEAALATFGTFPSTRPPGTPRAPGPSSGPRPTPVTDGGYQCQLLESTVIQPQGDSPVAVLCVCDLSPAQCDINCCCDPDCSSVDFSVFSACSVPVVTGDSQFCSQKAVIYSLNFTANPPQRVFELVDQINPSIFCIHITNCRCSV

SEQ ID NO: 810882 - protein, 115 aa, Homo sapiens
RDAPRLAVAVAGQRAVHVAGLAGTPWEMRPRGLPPLLVVLLGCWASVSAQTDATPAVTTEGLNSTEAALATFGTFPSTRPPGTPRAPGPSSGPRPTPVTDGATASFVVKKQSSIH

SEQ ID NO: 810883 - protein, 85 aa, Homo sapiens
MQSGCKLRLTGALPCQLVAQKVKSLLWGQGFPDYVAPFGNSQAQDMLDWVPIHFITQSFNRKDSCQLPGALVIEVQEARPGILKS

SEQ ID NO: 810884 - protein, 614 aa, Homo sapiens
RDAPRLAVAVAGQRAVHVAGLAGTPWEMRPRGLPPLLVVLLGCWASVSAQTDATPAVTTEGLNSTEAALATFGTFPSTRPPGTPRAPGPSSGPRPTPVTDVAVLCVCDLSPAQCDINCCCDPDCSSVDFSVFSACSVPVVTGDSQFCSQKAVIYSLNFTANPPQRVFELVDQINPSIFCIHITNYKPALSFINPEVPDENNFDTLMKTSDGFTLNAESYVSFTTKLDIPTAAKYEYGVPLQTSDSFLRFPSSLTSSLCTDNNPAAFLVNQAVKCTRKINLEQCEEIEALSMAFYSSPEILRVPDSRKKVPITVQSIVIQSLNKTLTRREDTDVLQPTLVNAGHFSLCVNVVLEVKYSLTYTDAGEVTKADLSFVLGTVSSVVVPLQQKFEIHFLQENTQPVPLSGNPGYVVGLPLAAGFQPHKGSGIIQTTNRYGQLTILHSTTEQDCLALEGVRTPVLFGYTMQSGCKLRLTGALPCQLVAQKVKSLLWGQGFPDYVAPFGNSQAQDMLDWVPIHFITQSFNRKDSCQLPGALVIEVKWTKYGSLLNPQAKIVNVTANLISSSFPEANSGNERTILISTAVTFVDVSAPAEAGFRAPPAINARLPFNFFFPFV

SEQ ID NO: 810885 - protein, 596 aa, Homo sapiens
RDAPRLAVAVAGQRAVHVAGLAGTPWEMRPRGLPPLLVVLLGCWASVSAQTDATPAVTTEGLNSTEAALATFGTFPSTRPPGTPRAPGPSSGPRPTPVTDVAVLCVCDLSPAQCDINCCCDPDCSSVDFSVFSACSVPVVTGDSQFCSQKAVIYSLNFTANPPQRVFELVDQINPSIFCIHITNYKPALSFINPEVPDENNFDTLMKTSDGFTLNAESYVSFTTKLDIPTAAKYEYGVPLQTSDSFLRFPSSLTSSLCTDNNPAAFLVNQAVKCTRKINLEQCEEIEALSMAFYSSPEILRVPDSRKKVPITVQSIVIQSLNKTLTRREDTDVLQPTLVNAGHFSLCVNVVLEVKYSLTYTDAGEVTKADLSFVLGTVSSVVVPLQQKFEIHFLQPLAAGFQPHKGSGIIQTTNRYGQLTILHSTTEQDCLALEGVRTPVLFGYTMQSGCKLRLTGALPCQLVAQKVKSLLWGQGFPDYVAPFGNSQAQDMLDWVPIHFITQSFNRKDSCQLPGALVIEVKWTKYGSLLNPQAKIVNVTANLISSSFPEANSGNERTILISTAVTFVDVSAPAEAGFRAPPAINARLPFNFFFPFV

SEQ ID NO: 810886 - protein, 472 aa, Homo sapiens
RDAPRLAVAVAGQRAVHVAGLAGTPWEMRPRGLPPLLVVLLGCWASVSAQTDATPAVTTEGLNSTEAALATFGTFPSTRPPGTPRAPGPSSGPRPTPVTDVAVLCVCDLSPAQCDINCCCDPDCSSVDFSVFSACSVPVVTGDSQFCSQKAVIYSLNFTANPPQRVFELVDQINPSIFCIHITNYKPALSFINPEVPDENNFDTLMKTSDGFTLNAESYVSFTTKLDIPTAAKYEYGVPLQTSDSFLRFPSSLTSSLCTDNNPAAFLVNQAVKCTRKINLEQCEEIEALSMAFYSSPEILRVPDSRKKVPITVQSIVIQSLNKTLTRREDTDVLQPTLVNAGHFSLCVNVVLEVKYSLTYTDAGEVTKADLSFVLGTVSSVVVPLQQKFEIHFLQENTQPVPLSGNPGYVVGLPLAAGFQPHKGSGIIQTTNRYGQLTILHSTTEQDCLALEGVRTPVLFGYTMQSGCKLRR

SEQ ID NO: 810887 - protein, 567 aa, Homo sapiens
RDAPRLAVAVAGQRAVHVAGLAGTPWEMRPRGLPPLLVVLLGCWASVSAQTDATPAVTTEGLNSTEAALATFGTFPSTRPPGTPRAPGPSSGPRPTPVTDVAVLCVCDLSPAQCDINCCCDPDCSSVDFSVFSACSVPVVTGDSQFCSQKAVIYSLNFTANPPQRVFELVDQINPSIFCIHITNYKPALSFINPEVPDENNFDTLMKTSDGFTLNAESYVSFTTKLDIPTAAKYEYGVPLQTSDSFLRFPSSLTSSLCTDNNPAAFLVNQAVKCTRKINLEQCEEIEALSMAFYSSPEILRVPDSRKKVPITVQSIVIQSLNKTLTRREDTDVLQPTLVNAGHFSLCVNVVLEVKYSLTYTDAGEVTKADLSFVLGTVSSVVVPLQQKFEIHFLQENTQPVPLSGNPGYVVGLPLAAGFQPHKGLTGALPCQLVAQKVKSLLWGQGFPDYVAPFGNSQAQDMLDWVPIHFITQSFNRKDSCQLPGALVIEVKWTKYGSLLNPQAKIVNVTANLISSSFPEANSGNERTILISTAVTFVDVSAPAEAGFRAPPAINARLPFNFFFPFV

SEQ ID NO: 810888 - protein, 423 aa, Homo sapiens
RDAPRLAVAVAGQRAVHVAGLAGTPWEMRPRGLPPLLVVLLGCWASVSAQTDATPAVTTEGLNSTEAALATFGTFPSTRPPGTPRAPGPSSGPRPTPVTDVAVLCVCDLSPAQCDINCCCDPDCSSVDFSVFSACSVPVVTGDSQFCSQKAVIYSLNFTANPPQRVFELVDQINPSIFCIHITNYKPALSFINPEVPDENNFDTLMKTSDGFTLNAESYVSFTTKLDIPTAAKYEYGVPLQTSDSFLRFPSSLTSSLCTDNNPAAFLVNQAVKCTRKINLEQCEEIEALSMAFYSSPEILRVPDSRKKVPITVQSIVIQSLNKTLTRREDTDVLQPTLVNAGHFSLCVNVVLETDWSSPVSARSTEGEEPAVGPGLPRLRGPFWKFPGPGHAGLGAHPLHHPVIQQEGFLPAPRGFGYRSEVD

SEQ ID NO: 810889 - protein, 637 aa, Homo sapiens
RDAPRLAVAVAGQRAVHVAGLAGTPWEMRPRGLPPLLVVLLGCWASVSAQTDATPAVTTEGLNSTEAALATFGTFPSTRPPGTPRAPGPSSGPRPTPVTDVAVLCVCDLSPAQCDINCCCDPDCSSVDFSVFSACSVPVVTGDSQFCSQKAVIYSLNFTANPPQRVFELVDQINPSIFCIHITNYKPALSFINPEVPDENNFDTLMKTSDGFTLNAESYVSFTTKLDIPTAAKYEYGVPLQTSDSFLRFPSSLTSSLCTDNNPAGQAYWFTPVIPALWEAEARGSLEAFLVNQAVKCTRKINLEQCEEIEALSMAFYSSPEILRVPDSRKKVPITVQSIVIQSLNKTLTRREDTDVLQPTLVNAGHFSLCVNVVLEVKYSLTYTDAGEVTKADLSFVLGTVSSVVVPLQQKFEIHFLQENTQPVPLSGNPGYVVGLPLAAGFQPHKGSGIIQTTNRYGQLTILHSTTEQDCLALEGVRTPVLFGYTMQSGCKLRLTGALPCQLVAQKVKSLLWGQGFPDYVAPFGNSQAQDMLDWVPIHFITQSFNRKDSCQLPGALVIEVKWTKYGSLLNPQAKIVNVTANLISSSFPEANSGNERTILISTAVTFVDVSAPAEAGFRAPPAINARLPFNFFFPFV

SEQ ID NO: 810890 - protein, 599 aa, Homo sapiens
GCTRLSCAARDPGNSASLPPLLVVLLGCWASVSAQTDATPAVTTEGLNSTEAALATFGTFPSTRPPGTPRAPGPSSGPRPTPVTDVAVLCVCDLSPAQCDINCCCDPDCSSVDFSVFSACSVPVVTGDSQFCSQKAVIYSLNFTANPPQRVFELVDQINPSIFCIHITNYKPALSFINPEVPDENNFDTLMKTSDGFTLNAESYVSFTTKLDIPTAAKYEYGVPLQTSDSFLRFPSSLTSSLCTDNNPAAFLVNQAVKCTRKINLEQCEEIEALSMAFYSSPEILRVPDSRKKVPITVQSIVIQSLNKTLTRREDTDVLQPTLVNAGHFSLCVNVVLEVKYSLTYTDAGEVTKADLSFVLGTVSSVVVPLQQKFEIHFLQENTQPVPLSGNPGYVVGLPLAAGFQPHKGSGIIQTTNRYGQLTILHSTTEQDCLALEGVRTPVLFGYTMQSGCKLRLTGALPCQLVAQKVKSLLWGQGFPDYVAPFGNSQAQDMLDWVPIHFITQSFNRKDSCQLPGALVIEVKWTKYGSLLNPQAKIVNVTANLISSSFPEANSGNERTILISTAVTFVDVSAPAEAGFRAPPAINARLPFNFFFPFV

SEQ ID NO: 810891 - protein, 600 aa, Homo sapiens
RDAPRLAVAVAGQRAVHVAGLAGTPWEMRPRGLPPLLVVLLGCWASVSAQTDATPAVTTEGLNSTEAALATFGTFPSTRPPGTPRAPGPSSGPRPTPVTDVAVLCVCDLSPAQCDINCCCDPDCSSVDFSVFSACSVPVVTGDSQFCSQKAVIYSLNFTANPPQRVFELVDQINPSIFCIHITNYKPALSFINPEVPDENNFDTLMKTSDGFTLNAESYVSFTTKLDIPTAAKYEYGVPLQTSDSFLRFPSSLTSSLCTDNNPAGQAYWFTPVIPALWEAEARGSLEVPDSRKKVPITVQSIVIQSLNKTLTRREDTDVLQPTLVNAGHFSLCVNVVLEVKYSLTYTDAGEVTKADLSFVLGTVSSVVVPLQQKFEIHFLQENTQPVPLSGNPGYVVGLPLAAGFQPHKGSGIIQTTNRYGQLTILHSTTEQDCLALEGVRTPVLFGYTMQSGCKLRLTGALPCQLVAQKVKSLLWGQGFPDYVAPFGNSQAQDMLDWVPIHFITQSFNRKDSCQLPGALVIEVKWTKYGSLLNPQAKIVNVTANLISSSFPEANSGNERTILISTAVTFVDVSAPAEAGFRAPPAINARLPFNFFFPFV

SEQ ID NO: 810892 - protein, 389 aa, Homo sapiens
MDIPTAAKYEYGVPLQTSDSFLRFPSSLTSSLCTDNNPAAFLVNQAVKCTRKINLEQCEEIEALSMAFYSSPEILRVPDSRKKVPITVQSIVIQSLNKTLTRREDTDVLQPTLVNAGHFSLCVNVVLEVKYSLTYTDAGEVTKADLSFVLGTVSSVVVPLQQKFEIHFLQENTQPVPLSGNPGYVVGLPLAAGFQPHKGSGIIQTTNRYGQLTILHSTTEQDCLALEGVRTPVLFGYTMQSGCKLRLTGALPCQLVAQKVKSLLWGQGFPDYVAPFGNSQAQDMLDWVPIHFITQSFNRKDSCQLPGALVIEVKWTKYGSLLNPQAKIVNVTANLISSSFPEANSGNERTILISTAVTFVDVSAPAEAGFRAPPAINARLPFNFFFPFV

SEQ ID NO: 810893 - protein, 266 aa, Homo sapiens
RDAPRLAVAVAGQRAVHVAGLAGTPWEMRPRGLPPLLVVLLGCWASVSAQTDATPAVTTEGLNSTEAALATFGTFPSTRPPGTPRAPGPSSGPRPTPVTDVAVLCVCDLSPAQCDINCCCDPDCSSVDFSVFSACSVPVVTGDSQFCSQKAVIYSLNFTANPPQRVFELVDQINPSIFCIHITNYKPALSFINPEVPDENNFDTLMKTSDGFTLNAESYVSFTTKLDIPTAAKYEYGVPLQTSDSFLRFPSSLTSSLCTDNNPAGT

SEQ ID NO: 810894 - protein, 292 aa, Homo sapiens
GKKSYWVEGVLKGEEFRVWVNVVVEVKERVKVKYSLTYTDAGEVTKADLSFVLGTVSSVVVPLQQKFEIHFLQENTQPVPLSGNPGYVVGLPLAAGFQPHKGSGIIQTTNRYGQLTILHSTTEQDCLALEGVRTPVLFGYTMQSGCKLRLTGALPCQLVAQKVKSLLWGQGFPDYVAPFGNSQAQDMLDWVPIHFITQSFNRKDSCQLPGALVIEVKWTKYGSLLNPQAKIVNVTANLISSSFPEANSGNERTILISTAVTFVDVSAPAEAGFRAPPAINARLPFNFFFPFV

SEQ ID NO: 810895 - protein, 148 aa, Homo sapiens
MLFLRLTGALPCQLVAQKVKSLLWGQGFPDYVAPFGNSQAQDMLDWVPIHFITQSFNRKDSCQLPGALVIEVKWTKYGSLLNPQAKIVNVTANLISSSFPEANSGNERTILISTAVTFVDVSAPAEAGFRAPPAINARLPFNFFFPFV

SEQ ID NO: 810896 - protein, 614 aa, Homo sapiens; identical to SEQ ID NO: 810884

SEQ ID NO: 810897 - protein, 614 aa, Homo sapiens; identical to SEQ ID NO: 810884

SEQ ID NO: 810898 - protein, 442 aa, Homo sapiens
RDAPRLAVAVAGQRAVHVAGLAGTPWEMRPRGLPPLLVVLLGCWASVSAQTDATPAVTTEGLNSTEAALATFGTFPSTRPPGTPRAPGPSSGPRPTPVTDVAVLCVCDLSPAQCDINCCCDPDCSSVDFSVFSACSVPVVTGDSQFCSQKAVIYSLNFTANPPQRVFELVDQINPSIFCIHITNYKPALSFINPEVPDENNFDTLMKTSDGFTLNAESYVSFTTKLDIPTAAKYEYGVPLQTSDSFLRFPSSLTSSLCTDNNPAAFLVNQAVKCTRKINLEQCEEIEALSMAFYSSPEILRVPDSRKKVPITVQSIVIQSLNKTLTRREDTDVLQPTLVNAGHFSLCVNVVLEDSCQLPGALVIEVKWTKYGSLLNPQAKIVNVTANLISSSFPEANSGNERTILISTAVTFVDVSAPAEAGFRAPPAINARLPFNFFFPFV

SEQ ID NO: 810899 - protein, 548 aa, Homo sapiens
RDAPRLAVAVAGQRAVHVAGLAGTPWEMRPRGLPPLLVVLLGCWASVSAQTDATPAVTTEGLNSTEAALATFGTFPSTRPPGTPRAPGPSSGPRPTPVTDVAVLCVCDLSPAQCDINCCCDPDCSSVDFSVFSACSVPVVTGDSQFCSQKAVIYSLNFTANPPQRVFELVDQINPSIFCIHITNYKPALSFINPEVPDENNFDTLMKTSDGFTLNAESYVSFTTKLDIPTAAKYEYGVPLQTSDSFLRFPSSLTSSLCTDNNPAAFLVNQAVKCTRKINLEQCEEIEALSMAFYSSPEILRVPDSRKKVPITVQSIVIQSLNKTLTRREDTDVLQPTLVNAGHFSLCVNVVLEVKYSLTYTDAGEVTKADLSFVLGTVSSVVVPLQQKFEIHFLQENTQPVPLSGNPGYVVGLPLAAGFQPHKGSGIIQTTNRYGQLTILHSTTEQDCLALEGVRTPVLFGYTMQSGCKLRLTGALPCQLVAQKVKSLLWGQGFPDYVAPFGNSQAQDMLDWVPIHFITQSFNRKDSCQLPGALVIEVQEARPGNLKS

SEQ ID NO: 810900 - protein, 602 aa, Homo sapiens
RDAPRLAVAVAGQRAVHVAGLAGTPWEMRPRGLPPLLVVLLGCWASVSAQTDATPAVTTEGLNSTEAALATFGTFPSTRPPGTPRAPGPSSGPRPTPVTDVAVLCVCDLSPAQCDINCCCDPDCSSVDFSVFSACSVPVVTGDSQFCSQKAVIYSLNFTANPPQRVFELVDQINPSIFCIHITNYKPALSFINPEVPDENNFDTLMKTSDGFTLNAESYVSFTTKLDIPTAAKYEYGVPLQTSDSFLRFPSSLTSSLCTDNNPAAFLVNQAVKCTRKINLEQCEEIEALSMAFYSSPEILRVPDSRKKVPITVQSIVIQSLNKTLTRREDTDVLQPTLVNAGHFSLCVNVVLEVKYSLTYTDAGEVTKADLSFVLGTVSSVVVPLQQKFEIHFLQENTQPVPLSGNPGYVVGLPLAAGFQPHKGSGIIQTTNRYGQLTILHSTTEQDCLALEGVRTPVLFGYTMQSGCKLRLTGALPCQLVAQKVKSLLWGQGFPDYVAPFGNSQAQDMLDWVPIHFITQSFNRKDSCQLPGALVIEVKWTKYGSLLNPQAKIVNANSGNERTILISTAVTFVDVSAPAEAGFRAPPAINARLPFNFFFPFV

SEQ ID NO: 810901 - protein, 481 aa, Homo sapiens
RDAPRLAVAVAGQRAVHVAGLAGTPWEMRPRGLPPLLVVLLGCWASVSAQTDATPAVTTEGLNSTEAALATFGTFPSTRPPGTPRAPGPSSGPRPTPVTDVAVLCVCDLSPAQCDINCCCDPDCSSVDFSVFSACSVPVVTGDSQFCSQKAVIYSLNFTANPPQRVFELVDQINPSIFCIHITNYKPALSFINPEVPDENNFDTLMKTSDGFTLNAESYVSFTTKLDIPTAAKYEYGVPLQTSDSFLRFPSSLTSSLCTDNNPAAFLVNQAVKCTRKINLEQCEEIEALSMAFYSSPEILRVPDSRKKVPITVQSIVIQSLNKTLTRREDTDVLQPTLVNAGHFSLCVNVVLEVKYSLTYTDAGEVTKADLSFVLGTVSSVVVPLQQKFEIHFLQENTQPVPLSGNPGYVVGLPLAAGFQPHKGSGIIQTTNRYGQLTILHSTTEQDCLALEGVRTPVLFGYTMQSGCKLRLPFNFFFPFV

SEQ ID NO: 810902 - protein, 280 aa, Homo sapiens
RDAPRLAVAVAGQRAVHVAGLAGTPWEMRPRGLPPLLVVLLGCWASVSAQTDATPAVTTEGLNSTEAALATFGTFPSTRPPGTPRAPGPSSGPRPTPVTDVAVLCVCDLSPAQCDINCCCDPDCSSVDFSVFSACSVPVVTGDSQFCSQKAVIYSLNFTANPPQRVFELVDQINPSIFCIHITNYKPALSFINPEVPDENNFDTLMKTSDGFTLNAESYVSFTTKLDIPTAAKYEYGVPLQTSDSFLRFPSSLTSSLCTDNNPAGKKVVILLSLDICCYY

SEQ ID NO: 810903 - protein, 23 aa, Homo sapiens
MHWEKVDVNNSIKQPYFLIKNDK

SEQ ID NO: 810904 - protein, 135 aa, Homo sapiens
PPPPTRQGSREMAGAFLVAPRPPYSRSPGGPESAPTPASVLPELRRGKQDLLSADSGLPAVDQGEVAGPRLQPAQPLRPGAVPSASRARAPDTKAGTRARDPAPGASQLRAAHSPHRGGGGAPRTQLAAPPRPPL

SEQ ID NO: 810905 - protein, 161 aa, Homo sapiens
MQAPSIWQWGQENKVYACMMVFFLSNMIENQCMSTGAFEITLNDVPVWSKLESGHLPSMQQLCSNFLTMKMKLNVHIGFNPTPSIIAPPISTENSFALRDHCKSSVTDIMKACTEDSKLLVQTRCFLGRLVVPLGKPQCKIVFQCWHILEFCTFMECNNTV

SEQ ID NO: 810906 - protein, 105 aa, Homo sapiens
MQAPSIWQWGQENKVYACMMVFFLSNMIENQCMSTGAFEITLNDVPVWSKLESGHLPSMQQLCSNFLTMKMKLNVHIGFNPTPSIIAPPISTENSFALRDHCRAA

SEQ ID NO: 810907 - protein, 85 aa, Homo sapiens
TLADRACAVGSSSLLGFGLAAVCLRAAEVAGSFKMRLLLLLLVAASAMVRSEASANLGGVPSKRLKMQYATGPLLKFQIVCFLRL

SEQ ID NO: 810908 - protein, 161 aa, Homo sapiens; identical to SEQ ID NO: 810905

SEQ ID NO: 810909 - protein, 161 aa, Homo sapiens; identical to SEQ ID NO: 810905

SEQ ID NO: 810910 - protein, 161 aa, Homo sapiens; identical to SEQ ID NO: 810905

SEQ ID NO: 810911 - protein, 161 aa, Homo sapiens; identical to SEQ ID NO: 810905

SEQ ID NO: 810912 - protein, 161 aa, Homo sapiens; identical to SEQ ID NO: 810905

SEQ ID NO: 810913 - protein, 161 aa, Homo sapiens; identical to SEQ ID NO: 810905

SEQ ID NO: 810914 - protein, 161 aa, Homo sapiens; identical to SEQ ID NO: 810905

SEQ ID NO: 810915 - protein, 161 aa, Homo sapiens; identical to SEQ ID NO: 810905

SEQ ID NO: 810916 - protein, 181 aa, Homo sapiens
TLADRACAVGSSSLLGFGLAAVCLRAAEVAGSFKMRLLLLLLVAASAMVRSEASANLGGVPSKRLKMQYATGPLLKFQIVVSMCTGPRPPRRASARRHWLREAPASRPKWPHLRWPRRTVPAPFHSQPSRGPLARSGRPPFPVFPEVIGGCLRSTCGLLASGTQTSALKERITSLNQYIDT

SEQ ID NO: 810917 - protein, 112 aa, Homo sapiens
TLADRACAVGSSSLLGFGLAAVCLRAAEVAGSFKMRLLLLLLVAASAMVRSEASANLGGVPSKRLKMQYATGPLLKFQIVRWSLTVLPRLVLNSWDQVNLLPQPPKVLGLQM

SEQ ID NO: 810918 - protein, 114 aa, Homo sapiens
TLADRACAVGSSSLLGFGLAAVCLRAAEVAGSFKMRLLLLLLVAASAMVRSEASANLGGVPSKRLKMQYATGPLLKFQIVRWSLTVLPRLVLNSWDQVNLLPQPPKVLGLQIVS

SEQ ID NO: 810919 - protein, 161 aa, Homo sapiens; identical to SEQ ID NO: 810905

SEQ ID NO: 810920 - protein, 161 aa, Homo sapiens; identical to SEQ ID NO: 810905

SEQ ID NO: 810921 - protein, 161 aa, Homo sapiens; identical to SEQ ID NO: 810905

SEQ ID NO: 810922 - protein, 146 aa, Homo sapiens
MQAPSIWQWGQENKNQCMSTGAFEITLNDVPVWSKLESGHLPSMQQLCSNFLTMKMKLNVHIGFNPTPSIIAPPISTENSFALRDHCKSSVTDIMKACTEDSKLLVQTRCFLGRLVVPLGKPQCKIVFQCWHILEFCTFMECNNTV

SEQ ID NO: 810923 - protein, 85 aa, Homo sapiens; identical to SEQ ID NO: 810907

SEQ ID NO: 810924 - protein, 55 aa, Homo sapiens
IPIYYTPNFKSLPTPILIYFIFNHSIIYPPPPRPPGNGGGRGGGGGGITPCGGLS

SEQ ID NO: 810925 - protein, 85 aa, Homo sapiens; identical to SEQ ID NO: 810907

SEQ ID NO: 810926 - protein, 722 aa, Homo sapiens
HTSDPVASSLLVLPRKPALPSLLGAQRLSQLRAQPGADPEGRRKPSGRASFLCCLPGLGRPIPRPELRSLPPHPSLGFTRTEPGAGCRPRLESTFQHFGQRPGRPGPFGLAMASVQQGEKQLFEKFWRGTFKAVATPRPESIIVASITARKPLPRTEPQNNPVVPAQDGPSEKLGQHLATEPLGTNSWERDKTCRELGATRGHSASHDKDLTPPPSSRGKKKKKKSTRKKRRRSSSYSPSPVKKKKKKSSKKHKRRRSFSKKRRHSSSSPKSKRRDEKRHKKQSRSRPRKSHRHRHHRCPSRSQSSESRPSSCESRHRGRSPEEGQKSRRRHSRRCSKTLCKDSPEAQSSRPPSQPLQMLGYLSARGVITGSGSAADLFTKTASPLTTSRGRSQEYDSGNDTSSPPSTQTSSARSRGQEKGSPSGGLSKSRELNSGNTSDSGNSFTTSSPQNKGAMLENLSPTSRGRESRGFQSPCLECAEVKKSSLVPSTARSSPMKGCSRSSSYASTRSSSHSSRSPNPRASPRYTQSRSTSSEKRSYSRSPSYSSKSGKRSPPSRSSRSRRSPSYSRYSPSRERDPKYSEKDSQQRERERARRRRRSYSPMRKRRRDSPSHLEARRITSARKRPIPYYRPSPSSSGSLSSTSSWYSSSSSRSASRSYSRSRSRSRSRRRSRTRTSSSSSSRSPSPGSRSRSRSRSRSRSRSRSQSRSYSSADSYSSTRR

SEQ ID NO: 810927 - protein, 210 aa, Homo sapiens
MRPGRSRTRGLRSLELCGVFKRFSCLSLPSSWDYRSSWELPDLQEGKIQAISDSDGVNYPWYGNTTETCTIVGPTKRDSKFIISMNDNFYPSVTWAVPVSESNVAKLTNIYRDQSFTTWLVATNTSTNDMIILQTLHWRMQLSIEVNPNRPLGQRARLREPIAQDQPKILSKNEPIPPSALVKPNANDAQVLMWRPKYGQPLVVIPPKHR

SEQ ID NO: 810928 - protein, 252 aa, Homo sapiens
GQGIAAALIHLPSTGNKHWRPRSPEASTDCCWLHQATGSGSVTQAGVQWYDLGSLQPLPPRFKRFSCLSLPSSWDYRSSWELPDLQEGKIQAISDSDGVNYPWYGNTTETCTIVGPTKRDSKFIISMNDNFYPSVTWAVPVSESNVAKLTNIYRDQSFTTWLVATNTSTNDMIILQTLHWRMQLSIEVNPNRPLGQRARLREPIAQDQPKILSKNEPIPPSALVKPNANDAQVLMWRPKYGQPLVVIPPKHR

SEQ ID NO: 810929 - protein, 191 aa, Homo sapiens; identical to SEQ ID NO: 760997

SEQ ID NO: 810930 - protein, 261 aa, Homo sapiens
FTKVSPKVCRKMGPKTLSGKTKHFRRNPRYENIPRDFYRFLYYKTRLPFVCRKIGALTGFFHKEWQTTFGAGGTSSPRVLVPSPREGFPKKGAREKGYRGPYNTSEFRGPPMKRARSATAMKTKFAVNHPGGESTQWERPVVRSPQYPIGALWVCDQIPKPKPLSQPRYLNQWNSIPSLGSDLHMAGNCMRQRNTMVNPNRPLGQRARLREPIAQDQPKILSKNEPIPPSALVKPNANDAQVLMWRPKYGQPLVVIPPKHR

SEQ ID NO: 810931 - protein, 103 aa, Homo sapiens
MGAYHVDAEAFVRGSPDHLLDLIYRYEDSDASTPRLGGRVIQVGSRLVDVPYVIQRAGAGSSLPWQLVPLSPASSFPLFFVCLLVFVFHFYLLQIDLNIFYNH

SEQ ID NO: 810932 - protein, 98 aa, Homo sapiens
IEISCAKASEMSSRGSPTAMHVTILSTASSSRSPLNLGSVGSFSKKSENTYSVARWSLTWQVIIHFPGFSAIISVVRKVAGNRLTTSVRCPLLMKVLP

SEQ ID NO: 810933 - protein, 174 aa, Homo sapiens
NRDLLREGQRDEQQGQPHRNARDHLVHSQLQSQPLELGLRGLLQQEIREHVLRGQLSDGHGCGAPGSTRRSGYSRRRESCAAPSPSHRPGARLSLSLCLLPHPACLCVSVPQAPSDSAGLSRSLPPPPAGRGGAGTRELRFLRFHPARPCKSPGRARHSDSRLSRAPPGAGTTR

SEQ ID NO: 810934 - protein, 98 aa, Homo sapiens; identical to SEQ ID NO: 810932

SEQ ID NO: 810935 - protein, 192 aa, Homo sapiens
MQAIKCVVVGDGAVGKTCLLISYTTNAFPGEYIPTVFDNYSANVMVDSKPVNLGLWDTAGQEDYDRLRPLSYPQTDVFLICFSLVSPASYENVRAKWFPEVRHHCPSTPIILVGTKLDLRDDKDTIEKLKEKKLAPITYPQGLALAKEIDSVKYLECSALTQRGLKTVFDEAIRAVLCPQPTRQQKRACSLL

SEQ ID NO: 810936 - protein, 115 aa, Homo sapiens
VSGGVRLPASERRFLSCCPLPARPLLQRLASRHPASLPCSQQLLWRSSRAPPLLPSLPLGVLITDPLTRHPGHHHPAPFHSAALLVPVKPPTAWEGKSRLARPCLSQALEACQLT

SEQ ID NO: 810937 - protein, 115 aa, Homo sapiens; identical to SEQ ID NO: 810936

SEQ ID NO: 810938 - protein, 521 aa, Homo sapiens
MAAHLVKRCTCLLREAARQAPAMAPVGRLRLAWVAHKTLTSSATSPISHLPGSLMEPVEKERASTPYIEKQVDHLIKKATRPEELLELLGGSHDLDSNQAAMVLIRLSHLLSEKPEDKGLLIQDAHFHQLLCLLNSQIASVWHGTLSKLLGSLYALGIPKASKELQSVEQEVRWRMRKLKYKHLAFLAESCATLSQEQHSQELLAELLTHLERRWTEIEDSHTLVTVMMKVGHLSEPLMNRLEDKHVLNRAQDITLPHLCSVLLAFARLNFHPDQEDQFFSLVHEKLGSELPGLEPALQVDLVWALCVLQQAREAELQAVLHPEFHIQFLGGKSQKDQNTFQKLLHINATALLEYPEYSGPLLPASAVAPGPSALDRKVTPLQKELQETLKGLLGSADKGSLEVATQYGWVLDAEVLLDSDGEFLPVRDFVAPHLAQPTGSQSPPPGSKRLAFLRWEFPNFNSRSKDLLGRFVLARRHIVAAGFLIVDVPFYEWLELKSEWQKGAYLKDKMRKAVAEELAK

SEQ ID NO: 810939 - protein, 631 aa, Homo sapiens
MAAHLVKRCTCLLREAARQAPAMAPVGRLRLAWVAHKTLTSSATSPISHLPGSLMEPVEKERASTPYIEKQVDHLIKKATRPEELLELLGGSHDLDSNQAAMVLIRLSHLLSEKPEDKGLLIQDAHFHQLLCLLNSQIASVWHGTLSKLLGSLYALGIPKASKELQSVEQEVRWRMRKLKYKHLAFLAESCATLSQEQHSQELLAELLTHLERRWTEIEDSHTLVTVMMKVGHLSEPLMNRLEDKCLELVEHFGPNELRKVLVMLAAQSRRSVPLLRAISYHLVQKPFSLTKDVLLDVAYAYGKLSFHQTQVSQRLATDLLSLMPSLTSGEVAHCAKSFALLKWLSLPLFEAFAQHVLNRAQDITLPHLCSVLLAFARLNFHPDQEDQFFSLVHEKLGSELPGLEPALQVDLVWALCVLQQAREAELQAVLHPEFHIQFLGGKSQKDQNTFQKLLHINATALLEYPEYSGPLLPASAVAPGPSALDRKVTPLQKELQETLKGLLGSADKGSLEVATQYGWVLDAEVLLDSDGEFLPVRDFVAPHLAQPTGSQSPPPGSKRLAFLRWEFPNFNSRSKDLLGRFVLARRHIVAAGFLIVDVPFYEWLELKSEWQKGAYLKDKMRKAVAEELAK

SEQ ID NO: 810940 - protein, 631 aa, Homo sapiens; identical to SEQ ID NO: 810939

SEQ ID NO: 810941 - protein, 631 aa, Homo sapiens; identical to SEQ ID NO: 810939

SEQ ID NO: 810942 - protein, 527 aa, Homo sapiens
MAAHLVKRCTCLLREAARQAPAMAPVGRLRLAWVAHKTLTSSATSPISHLPGSLMEPVEKERASTPYIEKQVDHLIKKATRPEELLELLGGSHDLDSNQAAMVLIRLSHLLSEKPEDKGLLIQDAHFHQLLCLLNSQIASVWHGTLSKLLGSLYALGIPKASKELQSVEQEVRWRMRKLKYKHLAFLAESCATLSQEQHSQELLAELLTHLERRWTEIEDSHTLVTVMMKVGHLSEPLMNRLEDKCLELVEHFGPNELRKVLVMLAAQSRRSVPLLRAISYHLVQKPFSLTKDVLLDVAYAYGKLSFHQTQVSQRLATDLLSLMPSLTSGEVAHCAKSFALLKWLSLPLFEAFAQHVLNRAQDITLPHLCSVLLAFARLNFHPDQEDQFFSLVHEKLGSELPGLEPALQVDLVWALCVLQQAREAELQAVLHPEFHIQFLGGKSQKDQNTFQKLLHINATALLEYPEYSGPLLPASAVAPGPSALDRKVTPLQKELQETLKGLLGSADKGSLEMLRCCWTVTASFCP

SEQ ID NO: 810943 - protein, 631 aa, Homo sapiens; identical to SEQ ID NO: 810939

SEQ ID NO: 810944 - protein, 521 aa, Homo sapiens; identical to SEQ ID NO: 810938

SEQ ID NO: 810945 - protein, 551 aa, Homo sapiens
MAAHLVKRCTCLLREAARQAPAMAPVGRLRLAWVAHKTLTSSATSPISHLPGSLMEPVEKERASTPYIEKQVDHLIKKATRPEELLELLGGSHDLDSNQAAMVLIRLSHLLSEKPEDKGLLIQDAHFHQLLCLLNSQIASVWHGTLSKLLGSLYALGIPKASKELQSVEQEVRWRMRKLKYKHLAFLAESCATLSQEQHSQELLAELLTHLERRWTEIEDSHTLVTVMMKVGHLSEPLMNRLEDKCLELVEHFGPNELRKVLVMLAAQSRRSVPLLRAISYHLVQKPFSLTKDVLLDVAYAYGKLSFHQTQVSQRLATDLLSLMPSLTSGEVAHCAKSFALLKWLSLPLFEAFAQHVLNRAQDITLPHLCSVLLAFARLNFHPDQEDQFFSLVHEKLGSELPGLEPALQVDLVWALCVLQQAREAELQAVLHPEFHIQFLGGKSQKDQNTFQKLLHINATALLEYPEYSGPLLPASAVAPGPSALDRKVTPLQKELQETLKGLLGSADKGSLEVATQYGWVLGEGSPWLAQGLALPESNGTLLTHPVCSKY

SEQ ID NO: 810946 - protein, 488 aa, Homo sapiens
MAAHLVKRCTCLLREAARQAPAMAPVGRLRLAWVAHKTLTSSATSPISHLPGSLMEPVEKERASTPYIEKQVDHLIKKATRPEELLELLGGSHDLDSNQAAMVLIRLSHLLSEKPEDKGLLIQDAHFHQLLCLLNSQIASVWHGTLSKLLGSLYALGIPKASKELQSVEQEVRWRMRKLKYKHLAFLAESCATLSQEQHSQELLAELLTHLERRWTEIEDSHTLVTVMMKVGHLSEPLMNRLEDKCLELVEHFGPNELRKVLVMLAAQSRRSVPLLRAISYHLVQKPFSLTKDVLLDVAYAYGKLSFHQTQVSQRLATDLLSLMPSLTSGEVAHCAKSFALLKWLSLPLFEAFAQHVLNRAQDITLPHLCSVLLAFARLNFHPDQEDQFFSLVHEKLGSELPGLEPALQVDLVWALCVLQQAREAELQAVLHPEFHIQFLGGKSQKDQNTFQKLLVPFYEWLELKSEWQKGAYLKDKMRKAVAEELAK

SEQ ID NO: 810947 - protein, 521 aa, Homo sapiens; identical to SEQ ID NO: 810938

SEQ ID NO: 810948 - protein, 371 aa, Homo sapiens
MAAHLVKRCTCLLREAARQAPAMAPVGRLRLAWVAHKTLTSSATSPISHLPGSLMEPVEKERASTPYIEKQVAHCAKSFALLKWLSLPLFEAFAQHVLNRAQDITLPHLCSVLLAFARLNFHPDQEDQFFSLVHEKLGSELPGLEPALQVDLVWALCVLQQAREAELQAVLHPEFHIQFLGGKSQKDQNTFQKLLHINATALLEYPEYSGPLLPASAVAPGPSALDRKVTPLQKELQETLKGLLGSADKGSLEVATQYGWVLDAEVLLDSDGEFLPVRDFVAPHLAQPTGSQSPPPGSKRLAFLRWEFPNFNSRSKDLLGRFVLARRHIVAAGFLIVDVPFYEWLELKSEWQKGAYLKDKMRKAVAEELAK

SEQ ID NO: 810949 - protein, 307 aa, Homo sapiens
MQALLRLRARQEDSVLGRELILSLCYFCPTQHVLNRAQDITLPHLCSVLLAFARLNFHPDQEDQFFSLVHEKLGSELPGLEPALQVDLVWALCVLQQAREAELQAVLHPEFHIQFLGGKSQKDQNTFQKLLHINATALLEYPEYSGPLLPASAVAPGPSALDRKVTPLQKELQETLKGLLGSADKGSLEVATQYGWVLDAEVLLDSDGEFLPVRDFVAPHLAQPTGSQSPPPGSKRLAFLRWEFPNFNSRSKDLLGRFVLARRHIVAAGFLIVDVPFYEWLELKSEWQKGAYLKDKMRKAVAEELAK

SEQ ID NO: 810950 - protein, 252 aa, Homo sapiens
DAWVRTRGQFFSLVHEKLGSELPGLEPALQVDLVWALCVLQQAREAELQAVLHPEFHIQFLGGKSQKDQNTFQKLLHINATALLEYPEYSGPLLPASAVAPGPSALDRKVTPLQKELQETLKGLLGSADKGSLEVATQYGWVLDAEVLLDSDGEFLPVRDFVAPHLAQPTGSQSPPPGSKRLAFLRWEFPNFNSRSKDLLGRFVLARRHIVAAGFLIVDVPFYEWLELKSEWQKGAYLKDKMRKAVAEELAK

SEQ ID NO: 810951 - protein, 248 aa, Homo sapiens
MAAHLVKRCTCLLREAARQAPAMAPVGRLRLALCVLQQAREAELQAVLHPEFHIQFLGGKSQKDQNTFQKLLHINATALLEYPEYSGPLLPASAVAPGPSALDRKVTPLQKELQETLKGLLGSADKGSLEVATQYGWVLDAEVLLDSDGEFLPVRDFVAPHLAQPTGSQSPPPGSKRLAFLRWEFPNFNSRSKDLLGRFVLARRHIVAAGFLIVDVPFYEWLELKSEWQKGAYLKDKMRKAVAEELAK

SEQ ID NO: 810952 - protein, 631 aa, Homo sapiens; identical to SEQ ID NO: 810939

SEQ ID NO: 810953 - protein, 653 aa, Homo sapiens
MAAHLVKRCTCLLREAARQAPAMAPVGRLRLAWVAHKTLTSSATSPISHLPGSLMEPVEKERASTPYIEKQVDHLIKKATRPEELLELLGGSHDLDSNQAAMVLIRLSHLLSEKPEDKGLLIQDAHFHQLLCLLNSQIASVWHGTLSKLLGSLYALGIPKASKELQSVEQEVRWRMRKLKYKHLAFLAESCATLSQEQHSQELLAELLTHLERRWTEIEDSHTLVTVMMKVGHLSEPLMNRLEDKCLELVEHFGPNELRKVLVMLAAQSRRSVPLLRAISYHLVQKPFSLTKDVLLDVAYAYGKLSFHQTQVSQRLATDLLSLMPSLTSGEVAHCAKSFALLKWLSLPLFEAFAQHVLNRAQDITLPHLCSVLLAFARLNFHPDQEDQFFSLVHEKLGSELPGLEPALQVDLVWALCVLQQAREAELQAVLHPEFHIQFLGEPPAPSTTGTGKLPGLVCLVPGGKSQKDQNTFQKLLHINATALLEYPEYSGPLLPASAVAPGPSALDRKVTPLQKELQETLKGLLGSADKGSLEVATQYGWVLDAEVLLDSDGEFLPVRDFVAPHLAQPTGSQSPPPGSKRLAFLRWEFPNFNSRSKDLLGRFVLARRHIVAAGFLIVDVPFYEWLELKSEWQKGAYLKDKMRKAVAEELAK

SEQ ID NO: 810954 - protein, 551 aa, Homo sapiens; identical to SEQ ID NO: 810945

SEQ ID NO: 810955 - protein, 642 aa, Homo sapiens
MEVSGGARCDIMAAHLVKRCTCLLREAARQAPAMAPVGRLRLAWVAHKTLTSSATSPISHLPGSLMEPVEKERASTPYIEKQVDHLIKKATRPEELLELLGGSHDLDSNQAAMVLIRLSHLLSEKPEDKGLLIQDAHFHQLLCLLNSQIASVWHGTLSKLLGSLYALGIPKASKELQSVEQEVRWRMRKLKYKHLAFLAESCATLSQEQHSQELLAELLTHLERRWTEIEDSHTLVTVMMKVGHLSEPLMNRLEDKCLELVEHFGPNELRKVLVMLAAQSRRSVPLLRAISYHLVQKPFSLTKDVLLDVAYAYGKLSFHQTQVSQRLATDLLSLMPSLTSGEVAHCAKSFALLKWLSLPLFEAFAQHVLNRAQDITLPHLCSVLLAFARLNFHPDQEDQFFSLVHEKLGSELPGLEPALQVDLVWALCVLQQAREAELQAVLHPEFHIQFLGGKSQKDQNTFQKLLHINATALLEYPEYSGPLLPASAVAPGPSALDRKVTPLQKELQETLKGLLGSADKGSLEVATQYGWVLDAEVLLDSDGEFLPVRDFVAPHLAQPTGSQSPPPGSKRLAFLRWEFPNFNSRSKDLLGRFVLARRHIVAAGFLIVDVPFYEWLELKSEWQKGAYLKDKMRKAVAEELAK

SEQ ID NO: 810956 - protein, 665 aa, Homo sapiens
MAAHLVKRCTCLLREAARQAPAMAPVGRLRLAWVAHKTLTSSATSPISHLPGSLMEPVEKERASTPYIEKQVDHLIKKATRPEELLELLGGSHDLDSNQAAMVLIRLSHLLSEKPEDKGLLIQDAHFHQLLCLLNSQIASVWHGTLSKLLGSLYALGIPKASKELQSVEQEVRWRMRKLKYKHLAFLAESCATLSQEQHSQELLAELLTHLERRWTEIEDSHTLVTVMMKVGHLSEPLMNRLEDKCLELVEHFGPNELRKVLVMLAAQSRRSVPLLRAISYHLVQKPFSLTKDVLLDVAYAYGKLSFHQTQVSQRLATDLLSLMPSLTSGEVAHCAKSFALLKWLSLPLFEAFAQHVLNRAQDITLPHLCSVLLAFARLNFHPDQEDQFFSLVHEKLGSELPGLEPALQVDLVWALCVLQQAREAELQAVLHPEFHIQFLGGKSQKDQNTFQKLLHINATALLEYPEYSGPLLPASAVAPGPSALDRKVTPLQKELQETLKGLLGSADKGSLEVATQYGWVLDAEVLLDSDGEFLPVRDFVAPHLAQPTGSQSPPPGSKRLAFLRWEFPNFNSRSKDLLGRFVLARRHIVAAGFLIVDVPFYEWLELKLTCASSMDCVPLRRRSSCGRPRRVTLEDKPLCRTLARVGRVASHSEGQNVLLCIINL

SEQ ID NO: 810957 - protein, 527 aa, Homo sapiens; identical to SEQ ID NO: 810942

SEQ ID NO: 810958 - protein, 596 aa, Homo sapiens
MAAHLVKRCTCLLREAARQAPAMAPVGRLRLAWVAHKTLTSSATSPISHLPGSLMEPVEKERASTPYIEKQVDHLIKKATRPEELLELLGGSHDLDSNQAAMIASVWHGTLSKLLGSLYALGIPKASKELQSVEQEVRWRMRKLKYKHLAFLAESCATLSQEQHSQELLAELLTHLERRWTEIEDSHTLVTVMMKVGHLSEPLMNRLEDKCLELVEHFGPNELRKVLVMLAAQSRRSVPLLRAISYHLVQKPFSLTKDVLLDVAYAYGKLSFHQTQVSQRLATDLLSLMPSLTSGEVAHCAKSFALLKWLSLPLFEAFAQHVLNRAQDITLPHLCSVLLAFARLNFHPDQEDQFFSLVHEKLGSELPGLEPALQVDLVWALCVLQQAREAELQAVLHPEFHIQFLGGKSQKDQNTFQKLLHINATALLEYPEYSGPLLPASAVAPGPSALDRKVTPLQKELQETLKGLLGSADKGSLEVATQYGWVLDAEVLLDSDGEFLPVRDFVAPHLAQPTGSQSPPPGSKRLAFLRWEFPNFNSRSKDLLGRFVLARRHIVAAGFLIVDVPFYEWLELKSEWQKGAYLKDKMRKAVAEELAK

SEQ ID NO: 810959 - protein, 393 aa, Homo sapiens
MVGTGPEGCHRNTVTHGPCSCVPGSGINLVTDIKYLDLEAEVGWSCWVIADSLQLNPVICSVLKGKLSFHQTQVSQRLATDLLSLMPSLTSGEVAHCAKSFALLKWLSLPLFEAFAQHVLNRAQDITLPHLCSVLLAFARLNFHPDQEDQFFSLVHEKLGSELPGLEPALQVDLVWALCVLQQAREAELQAVLHPEFHIQFLGGKSQKDQNTFQKLLHINATALLEYPEYSGPLLPASAVAPGPSALDRKVTPLQKELQETLKGLLGSADKGSLEVATQYGWVLDAEVLLDSDGEFLPVRDFVAPHLAQPTGSQSPPPGSKRLAFLRWEFPNFNSRSKDLLGRFVLARRHIVAAGFLIVDVPFYEWLELKSEWQKGAYLKDKMRKAVAEELAK

SEQ ID NO: 810960 - protein, 255 aa, Homo sapiens
MAAHLVKRCTCLLREAARQAPAMAPVGRLRLAWVAHKTLTSSATSPISHLPGSLMEPVEKERASTPYIEKQVDHLIKKATRPEELLELLGGSHDLDSNQAAMVLIRLSHLLSEKPEDKGLLIQDAHFHQLLCLLNSQIASVWHGTLSKLLGSLYALGIPKASKELQSVEQEVRWRMRKLKYKHLAFLAESCATLSQEQHSQELLAELLTHLERRWTEIEDSHTLVTVMMKVGHLSEPLMNRLEDKAIELTSARLW

SEQ ID NO: 810961 - protein, 130 aa, Homo sapiens
MEGPAIAPGHAGSPQTQSQAGGQRAGQRAYSVPLLFLTHPARPEQSAGHHPAPPVQRTSGFCASELPSRPRGSVLQPGRASGLPLLDLYPPLQLMAHEPSSQDQLGLGGGGRGHYVWHGRAGGTDWSQAS

SEQ ID NO: 810962 - protein, 980 aa, Homo sapiens
MKSLKAKFRKSDTNEWNKNDDRLLQAVENGDAEKVASLLGKKGASATKHDSEGKTAFHLAAAKGHVECLRVMITHGVDVTAQDTTGHSALHLAAKNSHHECIRKLLQSKCPAESVDSSGKTALHYAAAQGCLQAVQILCEHKSPINLKDLDGNIPLLLAVQNGHSEICHFLLDHGADVNSRNKSGRTALMLACEIGSSNAVEALIKKGADLNLVDSLGYNALHYSKLSENAGIQSLLLSKISQDADLKTPTKPKQHDQVSKISSERSGTPKKRKAPPPPISPTQLSDVSSPRSITSTPLSGKESVFFAEPPFKAEISSIRENKDRLSDSTTGADSLLDISSEADQQDLLSLLQAKVASLTLHNKELQDKLQAKSPKEAEADLSFDSYHSTQTDLGPSLGKPGETSPPDSKSSPSVLIHSLGKSTTDNDVRIQQLQEILQDLQKRLESSEAERKQLQVELQSRRAELVCLNNTEISENSSDLSQKLKETQSKYEEAMKEVLSVQKQMKLGLVSPESMDNYSHFHELRVTEEEINVLKQDLQNALEESERNKEKVRELEEKLVEREKGTVIKPPVEEYEEMKSSYCSVIENMNKEKAFLFEKYQEAQEEIMKLKDTLKSQMTQEASDEAEDMKEAMNRMIDELNKQVSELSQLYKEAQAELEDYRKRKSLEDVTAEYIHKAEHEKLMQLTNVSRAKAEDALSEMKSQYSKVLNELTQLKQLVDAQKENSVSITEHLQVITTLRTAAKEMEEKISNLKEHLASKEVEVAKLEKQLLEEKAAMTDAMVPRSSYEKLQSSLESEVSVLASKLKESVKEKEKVHSEVVQIRSEVSQVKREKENIQTLLKSKEQEVNELLQKFQQAQEELAEMKRYAESSSKLEEDKDKKINEMSKEVTKLKEALNSLSQLSYSTSSSKRQSQQLEALQQQVKQLQNQLAECKKQHQEVISVYRMHLLYAVQGQMDEDVQKVLKQILTMCKNQSQKK

SEQ ID NO: 810963 - protein, 980 aa, Homo sapiens; identical to SEQ ID NO: 810962

SEQ ID NO: 810964 - protein, 980 aa, Homo sapiens; identical to SEQ ID NO: 810962

SEQ ID NO: 810965 - protein, 979 aa, Homo sapiens
AFLGVSMVKGKTNEWNKNDDRLLQAVENGDAEKVASLLGKKGASATKHDSEGKTAFHLAAAKGHVECLRVMITHGVDVTAQDTTGHSALHLAAKNSHHECIRKLLQSKCPAESVDSSGKTALHYAAAQGCLQAVQILCEHKSPINLKDLDGNIPLLLAVQNGHSEICHFLLDHGADVNSRNKSGRTALMLACEIGSSNAVEALIKKGADLNLVDSLGYNALHYSKLSENAGIQSLLLSKISQDADLKTPTKPKQHDQVSKISSERSGTPKKRKAPPPPISPTQLSDVSSPRSITSTPLSGKESVFFAEPPFKAEISSIRENKDRLSDSTTGADSLLDISSEADQQDLLSLLQAKVASLTLHNKELQDKLQAKSPKEAEADLSFDSYHSTQTDLGPSLGKPGETSPPDSKSSPSVLIHSLGKSTTDNDVRIQQLQEILQDLQKRLESSEAERKQLQVELQSRRAELVCLNNTEISENSSDLSQKLKETQSKYEEAMKEVLSVQKQMKLGLVSPESMDNYSHFHELRVTEEEINVLKQDLQNALEESERNKEKVRELEEKLVEREKGTVIKPPVEEYEEMKSSYCSVIENMNKEKAFLFEKYQEAQEEIMKLKDTLKSQMTQEASDEAEDMKEAMNRMIDELNKQVSELSQLYKEAQAELEDYRKRKSLEDVTAEYIHKAEHEKLMQLTNVSRAKAEDALSEMKSQYSKVLNELTQLKQLVDAQKENSVSITEHLQVITTLRTAAKEMEEKISNLKEHLASKEVEVAKLEKQLLEEKAAMTDAMVPRSSYEKLQSSLESEVSVLASKLKESVKEKEKVHSEVVQIRSEVSQVKREKENIQTLLKSKEQEVNELLQKFQQAQEELAEMKRYAESSSKLEEDKDKKINEMSKEVTKLKEALNSLSQLSYSTSSSKRQSQQLEALQQQVKQLQNQLAECKKQHQEVISVYRMHLLYAVQGQMDEDVQKVLKQILTMCKNQSQKK

SEQ ID NO: 810966 - protein, 909 aa, Homo sapiens
MITHGVDVTAQDTTGHSALHLAAKNSHHECIRKLLQSKCPAESVDSSGKTALHYAAAQGCLQAVQILCEHKSPINLKDLDGNIPLLLAVQNGHSEICHFLLDHGADVNSRNKSGRTALMLACEIGSSNAVEALIKKGADLNLVDSLGYNALHYSKLSENAGIQSLLLSKISQDADLKTPTKPKQHDQVSKISSERSGTPKKRKAPPPPISPTQLSDVSSPRSITSTPLSGKESVFFAEPPFKAEISSIRENKDRLSDSTTGADSLLDISSEADQQDLLSLLQAKVASLTLHNKELQDKLQAKSPKEAEADLSFDSYHSTQTDLGPSLGKPGETSPPDSKSSPSVLIHSLGKSTTDNDVRIQQLQEILQDLQKRLESSEAERKQLQVELQSRRAELVCLNNTEISENSSDLSQKLKETQSKYEEAMKEVLSVQKQMKLGLVSPESMDNYSHFHELRVTEEEINVLKQDLQNALEESERNKEKVRELEEKLVEREKGTVIKPPVEEYEEMKSSYCSVIENMNKEKAFLFEKYQEAQEEIMKLKDTLKSQMTQEASDEAEDMKEAMNRMIDELNKQVSELSQLYKEAQAELEDYRKRKSLEDVTAEYIHKAEHEKLMQLTNVSRAKAEDALSEMKSQYSKVLNELTQLKQLVDAQKENSVSITEHLQVITTLRTAAKEMEEKISNLKEHLASKEVEVAKLEKQLLEEKAAMTDAMVPRSSYEKLQSSLESEVSVLASKLKESVKEKEKVHSEVVQIRSEVSQVKREKENIQTLLKSKEQEVNELLQKFQQAQEELAEMKRYAESSSKLEEDKDKKINEMSKEVTKLKEALNSLSQLSYSTSSSKRQSQQLEALQQQVKQLQNQLAECKKQHQEVISVYRMHLLYAVQGQMDEDVQKVLKQILTMCKNQSQKK

SEQ ID NO: 810967 - protein, 931 aa, Homo sapiens
MKSLKAKFRKSDTNEWNKNDDRLLQAVENGDAEKVASLLGKKGASATKHDSEGKTAFHLAAAKGHVECLRVMITHGVDVTAQDTTGHSALHLAAKNSHHECIRKLLQSKCPAESVDSSGKTALHYAAAQGCLQAVQILCEHKSPINLKDLDGNIPLLLAVQNGHSEICHFLLDHGADVNSRNKSGRTALMLACEIGSSNAVEALIKKGADLNLVDSLGYNALHYSKLSENAGIQSLLLSKISQDADLKTPTKPKQHDQVSKISSERSGTPKKRKAPPPPISPTQLSDVSSPRSITSTPLSGKESVFFAEPPFKAEISSIRENKDRLSDSTTGADSLLDISSEADQQDLLSLLQAKVASLTLHNKELQDKLQVNPLLTMMSEFSNCKRFCKIYRRDSESSEAERKQLQVELQSRRAELVCLNNTEISENSSDLSQKLKETQSKYEEAMKEVLSVQKQMKLGLVSPESMDNYSHFHELRVTEEEINVLKQDLQNALEESERNKEKVRELEEKLVEREKGTVIKPPVEEYEEMKSSYCSVIENMNKEKAFLFEKYQEAQEEIMKLKDTLKSQMTQEASDEAEDMKEAMNRMIDELNKQVSELSQLYKEAQAELEDYRKRKSLEDVTAEYIHKAEHEKLMQLTNVSRAKAEDALSEMKSQYSKVLNELTQLKQLVDAQKENSVSITEHLQVITTLRTAAKEMEEKISNLKEHLASKEVEVAKLEKQLLEEKAAMTDAMVPRSSYEKLQSSLESEVSVLASKLKESVKEKEKVHSEVVQIRSEVSQVKREKENIQTLLKSKEQEVNELLQKFQQAQEELAEMKRYAESSSKLEEDKDKKINEMSKEVTKLKEALNSLSQLSYSTSSSKRQSQQLEALQQQVKQLQNQLAECKKQHQEVISVYRMHLLYAVQGQMDEDVQKVLKQILTMCKNQSQKK

SEQ ID NO: 810968 - protein, 1008 aa, Homo sapiens
RRQFQPPIKDYVIQSFHLAAAKGHVECLRVMITHGVDVTAQDTTNIITRSSDCIYQCTGVAYNNASLSDGLQFQPPIKDYVIQSFHLAAAKGHVECLRVMITHGVDVTAQDTTGHSALHLAAKNSHHECIRKLLQSKCPAESVDSSGKTALHYAAAQGCLQAVQILCEHKSPINLKDLDGNIPLLLAVQNGHSEICHFLLDHGADVNSRNKSGRTALMLACEIGSSNAVEALIKKGADLNLVDSLGYNALHYSKLSENAGIQSLLLSKISQDADLKTPTKPKQHDQVSKISSERSGTPKKRKAPPPPISPTQLSDVSSPRSITSTPLSGKESVFFAEPPFKAEISSIRENKDRLSDSTTGADSLLDISSEADQQDLLSLLQAKVASLTLHNKELQDKLQAKSPKEAEADLSFDSYHSTQTDLGPSLGKPGETSPPDSKSSPSVLIHSLGKSTTDNDVRIQQLQEILQDLQKRLESSEAERKQLQVELQSRRAELVCLNNTEISENSSDLSQKLKETQSKYEEAMKEVLSVQKQMKLGLVSPESMDNYSHFHELRVTEEEINVLKQDLQNALEESERNKEKVRELEEKLVEREKGTVIKPPVEEYEEMKSSYCSVIENMNKEKAFLFEKYQEAQEEIMKLKDTLKSQMTQEASDEAEDMKEAMNRMIDELNKQVSELSQLYKEAQAELEDYRKRKSLEDVTAEYIHKAEHEKLMQLTNVSRAKAEDALSEMKSQYSKVLNELTQLKQLVDAQKENSVSITEHLQVITTLRTAAKEMEEKISNLKEHLASKEVEVAKLEKQLLEEKAAMTDAMVPRSSYEKLQSSLESEVSVLASKLKESVKEKEKVHSEVVQIRSEVSQVKREKENIQTLLKSKEQEVNELLQKFQQAQEELAEMKRYAESSSKLEEDKDKKINEMSKEVTKLKEALNSLSQLSYSTSSSKRQSQQLEALQQQVKQLQNQLAECKKQHQEVISVYRMHLLYAVQGQMDEDVQKVLKQILTMCKNQSQKK

SEQ ID NO: 810969 - protein, 1035 aa, Homo sapiens
MDLNRIIQALKGTIDPKLRIAAENELNQSYKIINFAPSLLRIIVSDHVEFPVRQAAAIYLKNMVTQYWPDREPPPGEAIFPFNIHENDRQQIRDNIVEGIIRSPDLVRVQLTMCLRAIIKHDFPGHWPGVVDKIDYYLQSQSSASWLGSLLCLYQLVKTYEYKKAEEREPLIIAMQIFLPRIQQQIVQLLPDSSYYSVLLQKQILKIFYALVCIASSAVNNQTMTTWMEIFRTIIDRTVPPETLHIDEDDRPELVWWKCKKWALHIVARLFERYGSPGNVTKEYFEFSEFFLKTYAVGIQQVLLKILDQYRQKEYVAPRVLQQAFNYLNQGVVHSITWKQMKPHIQNISEDVIFSVMCYKDEDEELWQEDPYEYIRMKFDIFEDYASPTTAAQTLLYTAAKKRKEVLPKMMAFCYQILTDPNFDPRKKDGALHVIGSLAEILLKKSLFKDQMELFLQNHVFPLLLSNLGYLRARSCWVLHAFSSLKFHNELNLRNAVELAKKSLIEDKEMPVKVEAALALQSLISNQIQAKEYMKPHVRPIMQELLHIVRETENDDVTNVIQKMICEYSQEVASIAVDMTQHLAEIFGKVLQSDEYEEVEDKTVMAMGILHTIDTILTVVEDHKEITQQLENICLRIIDLVLQKHVIEFYEEILSLAYSLTCHSISPQMWQLLGILYEVFQQDCFEYFTDMMPLLHNYVTIDTDTLLSNAKHLEILFTMCRKVLCGDAGEDAECHAAKLLEVIILQCKGRGIDQCIPLFVQLVLERLTRGVKTSELRTMCLQVAIAALYYNPDLLLHTLERIQLPHNPGPITVQFINQWMNDTDCFLGHHDRKMCIIGLSILLELQNRPPAVDAVVGQIVPSILFLFLGLKQVCATRQLVNREDRSKAEKADMEENEEISSDEEETNVTAQAMQSNNGRGEDEEEEDDDWDEEVLEETALEGFSTPLDLDNSVDEYQFFTQALITVQSRDAAWYQLLMAPLSEDQRTALQEVYTLAEHRRTVAEAKKKIEQQGGFTFENKGVLSAFNFGTVPSNN

SEQ ID NO: 810970 - protein, 1007 aa, Homo sapiens
MDLNRIIQALKGTIDPKLRIAAENELNQSYKIINFAPSLLRIIVSDHVEFPVRQAAAIYLKNMVTQYWPDREPPPGEAIFPFNIHENDRQQIRDNIVEGIIRSPDLVRVQLTMCLRAIIKHDFPGHWPGVVDKIDYYLQSQSSASWLGSLLCLYQLVKTYEYKKAEEREPLIIAMQIFLPRIQQQIVQLLPDSSYYSVLLQKQILKIFYALVCIASSAVNNQTMTTWMEIFRTIIDRTVPPETLHIDEDDRPELVWWKCKKWALHIVARLFERYGSPGNVTKEYFEFSEFFLKTYAVGIQQVLLKILDQYRQKEYVAPRVLQQAFNYLNQGVVHSITWKQMKPHIQNISEDVIFSVMCYKDEDEELWQEDPYEYIRMKFDIFEDYASPTTAAQTLLYTAAKKRKEVLPKMMAFCYQILTDPNFDPRKKDGALHVIGSLAEILLKKSLFKDQMELFLQNHVFPLLLSNLGYLRARSCWVLHAFSSLKFHNELNLRNAVELAKKSLIEDKEMPVKVEAALALQSLISNQIQAKEYMKPHVRPIMQELLHIVRETENDDVTNVIQKMICEYSQEVASIAVDMTQHLAEIFGKVLQSDEYEEVEDKTVMAMGILHTIDTILTVVEDHKEITQQLENICLRIIDLVLQKHVIEFYEEILSLAYSLTCHSISPQMWQLLGILYEVFQQDCFEYFTDMMPLLHNYVTIDTDTLLSNAKHLEILFTMCRKVLCGDAGEDAECHAAKLLEVIILQCKGRGIDQCIPLFVQLVLERLTRGVKTSELRTMCLQVAIAALYYNPDLLLHTLERIQLPHNPGPITVQFINQWMNDTDCFLGHHDRKMCIIGLSILLELQNRPPAVDAVVGQIVPSILFLFLGLKQVCATRQLVNREDRSKAEKADMEENEEISSDEEETNVTAQAMQSNNGRGEDEEEEDDDWDEEVLEETALEGFSTPLDLDNSVDEYQFFTQALITVQSRDAAWYQLLMAPLSEDQRTALQEVYTLAEHRRTVAGQPE

SEQ ID NO: 810971 - protein, 945 aa, Homo sapiens
MVTQYWPDREPPPGEAIFPFNIHENDRQQIRDNIVEGIIRSPDLVRVQLTMCLRAIIKHDFPGHWPGVVDKIDYYLQSQSSASWLGSLLCLYQLVKTYEYKKAEEREPLIIAMQIFLPRIQQQIVQLLPDSSYYSVLLQKQILKIFYALDALPLQLVNNQTMTTWMEIFRTIIDRTVPPETLHIDEDDRPELVWWKCKKWALHIVARLFERYGSPGNVTKEYFEFSEFFLKTYAVGIQQVLLKILDQYRQKEYVAPRVLQQAFNYLNQGVVHSITWKQMKPHIQNISEDVIFSVMCYKDEDEELWQEDPYEYIRMKFDIFEDYASPTTAAQTLLYTAAKKRKEVLPKMMAFCYQILTDPNFDPRKKDGALHVIGSLAEILLKKSLFKDQMELFLQNHVFPLLLSNLGYLRARSCWVLHAFSSLKFHNELNLRNAVELAKKSLIEDKEMPVKVEAALALQSLISNQIQAKEYMKPHVRPIMQELLHIVRETENDDVTNVIQKMICEYSQEVASIAVDMTQHLAEIFGKVLQSDEYEEVEDKTVMAMGILHTIDTILTVVEDHKEITQQLENICLRIIDLVLQKHVIEFYEEILSLAYSLTCHSISPQMWQLLGILYEVFQQDCFEYFTDMMPLLHNYVTIDTDTLLSNAKHLEILFTMCRKVLCGDAGEDAECHAAKLLEVIILQCKGRGIDQCIPLFVQLVLERLTRGVKTSELRTMCLQVAIAALYYNPDLLLHTLERIQLPHNPGPITVQFINQWMNDTDCFLGHHDRKMCIIGLSILLELQNRPPAVDAVVGQIVPSILFLFLGLKQVCATRQLVNREDRSKAEKADMEENEEISSDEEETNVTAQAMQSNNGRGEDEEEEDDDWDEEVLEETALEGFSTPLDLDNSVDEYQFFTQALITVQSRDAAWYQLLMAPLSEDQRTALQEVYTLAEHRRTVAGQPE

SEQ ID NO: 810972 - protein, 953 aa, Homo sapiens
MDLNRIIQALKGTIDPKLRIAAENELNQSYKIINFAPSLLRIIVSDHVEFPVRQAAAIYLKNMVTQYWPDREPPPGEAIFPFNIHENDRQQIRDNIVEGIIRSPDLVRVQLTMCLRAIIKHDFPGHWPGVVDKIDYYLQSQSSASWLGSLLCLYQLVKTYEYKKAEEREPLIIAMQIFLPRIQQQIVQLLPDSSYYSVLLQKQILKIFYALDFLFVFSRYGSPGNVTKEYFEFSEFFLKTYAVGIQQVLLKILDQYRQKEYVAPRVLQQAFNYLNQGVVHSITWKQMKPHIQNISEDVIFSVMCYKDEDEELWQEDPYEYIRMKFDIFEDYASPTTAAQTLLYTAAKKRKEVLPKMMAFCYQILTDPNFDPRKKDGALHVIGSLAEILLKKSLFKDQMELFLQNHVFPLLLSNLGYLRARSCWVLHAFSSLKFHNELNLRNAVELAKKSLIEDKEMPVKVEAALALQSLISNQIQAKEYMKPHVRPIMQELLHIVRETENDDVTNVIQKMICEYSQEVASIAVDMTQHLAEIFGKVLQSDEYEEVEDKTVMAMGILHTIDTILTVVEDHKEITQQLENICLRIIDLVLQKHVIEFYEEILSLAYSLTCHSISPQMWQLLGILYEVFQQDCFEYFTDMMPLLHNYVTIDTDTLLSNAKHLEILFTMCRKVLCGDAGEDAECHAAKLLEVIILQCKGRGIDQCIPLFVQLVLERLTRGVKTSELRTMCLQVAIAALYYNPDLLLHTLERIQLPHNPGPITVQFINQWMNDTDCFLGHHDRKMCIIGLSILLELQNRPPAVDAVVGQIVPSILFLFLGLKQVCATRQLVNREDRSKAEKADMEENEEISSDEEETNVTAQAMQSNNGRGEDEEEEDDDWDEEVLEETALEGFSTPLDLDNSVDEYQFFTQALITVQSRDAAWYQLLMAPLSEDQRTALQEVYTLAEHRRTVAGQPE

SEQ ID NO: 810973 - protein, 990 aa, Homo sapiens
MVILLYLRHIKSYKIINFAPSLLRIIVSDHVEFPVRQAAAIYLKNMVTQYWPDREPPPGEAIFPFNIHENDRQQIRDNIVEGIIRSPDLVRVQLTMCLRAIIKHDFPGHWPGVVDKIDYYLQSQSSASWLGSLLCLYQLVKTYEYKKAEEREPLIIAMQIFLPRIQQQIVQLLPDSSYYSVLLQKQILKIFYALVCIASSAVNNQTMTTWMEIFRTIIDRTVPPETLHIDEDDRPELVWWKCKKWALHIVARLFERYGSPGNVTKEYFEFSEFFLKTYAVGIQQVLLKILDQYRQKEYVAPRVLQQAFNYLNQGVVHSITWKQMKPHIQNISEDVIFSVMCYKDEDEELWQEDPYEYIRMKFDIFEDYASPTTAAQTLLYTAAKKRKEVLPKMMAFCYQILTDPNFDPRKKDGALHVIGSLAEILLKKSLFKDQMELFLQNHVFPLLLSNLGYLRARSCWVLHAFSSLKFHNELNLRNAVELAKKSLIEDKEMPVKVEAALALQSLISNQIQAKEYMKPHVRPIMQELLHIVRETENDDVTNVIQKMICEYSQEVASIAVDMTQHLAEIFGKVLQSDEYEEVEDKTVMAMGILHTIDTILTVVEDHKEITQQLENICLRIIDLVLQKHVIEFYEEILSLAYSLTCHSISPQMWQLLGILYEVFQQDCFEYFTDMMPLLHNYVTIDTDTLLSNAKHLEILFTMCRKVLCGDAGEDAECHAAKLLEVIILQCKGRGIDQCIPLFVQLVLERLTRGVKTSELRTMCLQVAIAALYYNPDLLLHTLERIQLPHNPGPITVQFINQWMNDTDCFLGHHDRKMCIIGLSILLELQNRPPAVDAVVGQIVPSILFLFLGLKQVCATRQLVNREDRSKAEKADMEENEEISSDEEETNVTAQAMQSNNGRGEDEEEEDDDWDEEVLEETALEGFSTPLDLDNSVDEYQFFTQALITVQSRDAAWYQLLMAPLSEDQRTALQEVYTLAEHRRTVAGQPE

SEQ ID NO: 810974 - protein, 667 aa, Homo sapiens
MKPHIQNISEDVIFSVMCYKDEDEELWQEDPYEYIRMKFDIFEDYASPTTAAQTLLYTAAKKRKEVLPKMMAFCYQILTDPNFDPRKKDGALHVIGSLAEILLKKSLFKDQMELFLQNHVFPLLLSNLGYLRARSCWVLHAFSSLKFHNELNLRNAVELAKKSLIEDKEMPVKVEAALALQSLISNQIQAKEYMKPHVRPIMQELLHIVRETENDDVTNVIQKMICEYSQEVASIAVDMTQHLAEIFGKVLQSDEYEEVEDKTVMAMGILHTIDTILTVVEDHKEITQQLENICLRIIDLVLQKHVIEFYEEILSLAYSLTCHSISPQMWQLLGILYEVFQQDCFEYFTDMMPLLHNYVTIDTDTLLSNAKHLEILFTMCRKVLCGDAGEDAECHAAKLLEVIILQCKGRGIDQCIPLFVQLVLERLTRGVKTSELRTMCLQVAIAALYYNPDLLLHTLERIQLPHNPGPITVQFINQWMNDTDCFLGHHDRKMCIIGLSILLELQNRPPAVDAVVGQIVPSILFLFLGLKQVCATRQLVNREDRSKAEKADMEENEEISSDEEETNVTAQAMQSNNGRGEDEEEEDDDWDEEVLEETALEGFSTPLDLDNSVDEYQFFTQALITVQSRDAAWYQLLMAPLSEDQRTALQEVYTLAEHRRTVAGQPE

SEQ ID NO: 810975 - protein, 1007 aa, Homo sapiens; identical to SEQ ID NO: 810970

SEQ ID NO: 810976 - protein, 462 aa, Homo sapiens
MDLNRIIQALKGTIDPKLRIAAENELNQSYKIINFAPSLLRIIVSDHVEFPVRQAAAIYLKNMVTQYWPDREPPPGEAIFPFNIHENDRQQIRDNIVEGIIRSPDLVRVQLTMCLRAIIKHDFPGHWPGVVDKIDYYLQSQSSASWLGSLLCLYQLVKTYEYKKAEEREPLIIAMQIFLPRIQQQIVQLLPDSSYYSVLLQKQILKIFYALVCIASSAVNNQTMTTWMEIFRTIIDRTVPPETLHIDEDDRPELVWWKCKKWALHIVARLFERYGSPGNVTKEYFEFSEFFLKTYAVGIQQVLLKILDQYRQKEYVAPRVLQQAFNYLNQGVVHSITWKQMKPHIQNISEDVIFSVMCYKDEDEELWQEDPYEYIRMKFDIFEDYASPTTAAQTLLYTAAKKRKEVLPKMMAFCYQILTDPNFDPRKKDGALHVIGSLAEILLKKSLFKDQIGAVVTGVPNS

SEQ ID NO: 810977 - protein, 250 aa, Homo sapiens
MDLNRIIQALKGTIDPKLRIAAENELNQSYKIINFAPSLLRIIVSDHVEFPVRQAAAIYLKNMVTQYWPDREPPPGEAIFPFNIHENDRQQIRDNIVEGIIRSPDLVRVQLTMCLRAIIKHDFPGHWPGVVDKIDYYLQSQSSASWLGSLLCLYQLVKTYEYKKAEEREPLIIAMQIFLPRIQQQIVQLLPDSSYYSVLLQKQILKIFYALVQVGFYCRKQTWSPVFLPDTWKVLNKCHLLLKIILYYPI

SEQ ID NO: 810978 - protein, 245 aa, Homo sapiens
TSVSNHVSSPFELSIHKHDITLQLAEAERMADGPLKDRPETVVSRSSIIIKPSDPVERNSHAPPAETIRWKSHSAPSEVGFSDARHVTVRNAWKSRRDLKSLEDPPTRIGKNVESTNSNAYTQRSSTDFSELEQPRSCLFEQGTRRVGPSSGDAPEPSSRRTQSSLTVSEVLTRRNRVGDTITVAAWNHSASMEEEGEDCTLSVYRQLHNSLDPSELPGKQGLPESGRVRAEERLRPTRPCAEEN

SEQ ID NO: 810979 - protein, 245 aa, Homo sapiens; identical to SEQ ID NO: 810978

SEQ ID NO: 810980 - protein, 146 aa, Homo sapiens
SPRASGHCAGALCSLLPDRPCLAHSFLQAPLRVQQSWARCLPGKGNTDSRAALCSFHWKGEAAWTGGSGWGRWGHSGLRPDPQRLSPGRGHLTSTSPVAVPASRSRPSSPGKPLTRSARILTPVRDRQGPLGLGGGVWFLAQESPS

SEQ ID NO: 810981 - protein, 221 aa, Homo sapiens
MALAGTQVGPPPQERAPEPIGRAWGPPGITQPSAPGATVGRRVSVAAGPWLHGPHGSCEWVRLPGSGDRQRTDPRLGSWREGRRGAGQPGSDTVSSSGRRRPAGSTQAGRGWASLEPATALVGTWRRAHVSPHASHRGALARRPARGACAWDGSQNQRAPVRLASTVGLWESLLFIFKHLGFSHTQQNPSSALLRRAEHTGPTGHALAVSAPFLPRETAGP

SEQ ID NO: 810982 - protein, 146 aa, Homo sapiens; identical to SEQ ID NO: 810980

SEQ ID NO: 810983 - protein, 383 aa, Homo sapiens
LPHPQWGLQLGPRGHENDQLGFPGGQASLDWARCFLPAKMSNVSGILETAGVPLVSANWPQPSPPPAVPAGPQMDHMGNSSQGAPWLFLTSALARGVSGIFVWTALVLTCHQIYLHLRSYTVPQEQRYIIRLLLIVPIYAFDSWLSLLLLGDHQYYVYFDSVRDCYEAFVIYSFLSLCFQYLGGEGAIMAEIRGKPIKSSCLYGTCCLRGMTYSIGFLRFCKQATLQFCLVKPVMAVTTIILQAFGKYHDGDFNVRSGYLYVTLIYNASVSLALYALFLFYFTTRELLRPFQPVLKFLTIKAVIFLSFWQGLLLAILERCGVIPEVETSGGNKLGAGTLAAGYQNFIICVEMLFASVALRYAFPCQVYAEKKENSPAVPPALL

SEQ ID NO: 810984 - protein, 406 aa, Homo sapiens
LPHPQWGLQLGPRGHENDQLGFPGGQASLDWARCFLPAKMSNVSGILETAGVPLVSANWPQPSPPPAVPAGPQMDHMGNSSQGAPWLFLTSALARGVSGIFVWTALVLTCHQIYLHLRSYTVPQEQRYIIRLLLIVPIYAFDSWLSLLLLGDHQYYVYFDSVRDCYEAFVIYSFLSLCFQYLGGEGAIMAEIRGKPIKSSCLYGTCCLRGMTYSIGFLRFCKQATLQFCLVKPVMAVTTIILQAFGKYHDGDFNVRSGYLYVTLIYNASVSLALYALFLFYFTTRELLRPFQPVLKFLTIKAVIFLSFWQGLLLAILERCGVIPEVETSGGNKLGAGTLAAGYQNFIICVEMLFASVALRYAFPCQVYAEKKENSPAPPAPMQSISSGIRETVSPQDIVQDAIHNF

SEQ ID NO: 810985 - protein, 312 aa, Homo sapiens
QRLQRGSIRSQGAPWLFLTSALARGVSGIFVWTALVLTCHQIYLHLRSYTVPQEQRYIIRLLLIVPIYAFDSWLSLLLLGDHQYYVYFDSVRDCYEAFVIYSFLSLCFQYLGGEGAIMAEIRGKPIKSSCLYGTCCLRGMTYSIGFLRFCKQATLQFCLVKPVMAVTTIILQAFGKYHDGDFNVRSGYLYVTLIYNASVSLALYALFLFYFTTRELLRPFQPVLKFLTIKAVIFLSFWQGLLLAILERCGVIPEVETSGGNKLGAGTLAAGYQNFIICVEMLFASVALRYAFPCQVYAEKKENSPAVPPALL

SEQ ID NO: 810986 - protein, 329 aa, Homo sapiens
MALAGTQVGPPPQERAPEPIGRAWGPPGITQPSAPGATVGRRVSVAAGPWLHGPHGSCEWVRLPGSGDRQRTDPRLGSWREGRRGAGQPGSDTVSSSGRRRPAGSTQAGRGWASLEPATALVGTWRRAHVSPHASHRGALARRPARGACAWDGSQNQRAPVRLASTVGLWESLLFIFKHLGFSTGSWLLFPQGMSLRSRTRWGSQEAAAQSLHAGKGSHLSGVGSLVVQGSAGQSLGCAITATAFLLGASTSSKTGLVPAPPAASGQGHEGRALSTWAGGTLPGGTEGAPTWAPASCPSLLPPRARWGPGFEEPRTRALPAGSWRRASG

SEQ ID NO: 810987 - protein, 181 aa, Homo sapiens
GRKNSSRPGTKGASGRTHGWPRARGVTAGRPPGPGPVRGHGTALTTAPVCPSVRSGYLYVTLIYNASVSLALYALFLFYFTTRELLRPFQPVLKFLTIKAVIFLSFWQGLLLAILERCGVIPEVETSGGNKLGAGTLAAGYQNFIICVEMLFASVALRYAFPCQVYAEKKENSPAVPPALL

SEQ ID NO: 810988 - protein, 349 aa, Homo sapiens
LPHPQWGLQLGPRGHENDQLGFPGGQASLDWARCFLPAKMSNVSGILETAGVPLVSANWPQPSPPPAVPAGPQMDHMGNSSQGAPWLFLTSALARGVSGIFVWTALVLTCHQIYLHLRSYTVPQEQRYIIRLLLIVPIYALVGTWRRAHVSPHASHRGALARRPARGACAWDGSQNQRAPVRLASTVGLWESLLFIFKHLGFSTGSWLLFPQGMSLRSRTRWGSQEAAAQSLHAGKGSHLSGVGSLVVQGSAGQSLGCAITATAFLLGASTSSKTGLVPAPPAASGQGHEGRALSTWAGGTLPGGTEGAPTWAPASCPSLLPPRARWGPGFEEPRTRALPAGSWRRASG

SEQ ID NO: 810989 - protein, 271 aa, Homo sapiens
LPHPQWGLQLGPRGHENDQLGFPGGQASLDWARCFLPAKMSNVSGILETAGVPLVSANWPQPSPPPAVPAGPQMDHMGNSSQGAPWLFLTSALARGVSGIFVWTALVLTCHQIYLHLRSYTVPQEQRYIIRLLLIVPIYAFDSWLSLLLLGDHQYYVYFDSVRDCYEAFVIYSFLSLCFQYLGGEGAIMAEIRGKPIKSSCLYGTCCLRGMTYSIGFLRFCKQATLQFCLVKPVMAVTTIILQAFGKYHDGDFKTSLPSTSTVGAWTSPLP

SEQ ID NO: 810990 - protein, 168 aa, Homo sapiens
MNEVKESLRSIEQKYKLFQQQQLTFTAALEHCRENAHDKIRPISSIGQVQSYMEHYCNSSTDRRVLLMFLDICSELNKLCQHFEAVHSGTPVTNNLLEKCKTLVSQSNDLSSLRAKYPHDVVNHLSCDEARNHYGGVVSLIPLILDLMKEWIAHSEKLPRKVLQHGTT

SEQ ID NO: 810991 - protein, 222 aa, Homo sapiens
MNEVKESLRSIEQKYKLFQQQQLTFTAALEHCRENAHDKIRPISSIGQVQSYMEHYCNSSTDRRVLLMFLDICSELNKLCQHFEAVHSGTPVTNNLLEKCKTLVSQSNDLSSLRAKYPHDVVNHLSCDEARNHYGGVVSLIPLILDLMKEWIAHSEKLPRKVLQHVSEPQAHQESTRGAARPAQAIGTQPRATKHKCRQLTKASLKPRGCSKPPWRPPGGKL

SEQ ID NO: 810992 - protein, 222 aa, Homo sapiens; identical to SEQ ID NO: 810991

SEQ ID NO: 810993 - protein, 168 aa, Homo sapiens; identical to SEQ ID NO: 810990

SEQ ID NO: 810994 - protein, 378 aa, Homo sapiens
EGLGPPVAGGAAAGAGMPGGGGGPSAALREQERVYEWFGLVLGSAQRLEFMCGLLDLCNPLELRFLGSCLEDLARKDYHYLRDSEAKANGLSDPGPLADFREPAVRSRLIVYLALLGSENREAAGRLHRLLPQVDSVLKSLRAARGEGSRGGAEDERGEDGDGEQDAEKDGSGPEGGIVEPRVGGGLGSRAQEELLLLFTMASLHPAFSFHQRVTLREHLERLRAALRGGPEDAEVEVEPCKFAGPRAQVRRTEPPWTRGAIAAPAASPASLSDAPCPSPSPAQVARNPHPAAPSARGLSFVSLGRSVPLPHPTPHPGRHSHPPSQNALEVPSVPRCCHGRRGAPRPGPLSEEKCRDVFGSEHLSARCGSRGALEEPV

SEQ ID NO: 810995 - protein, 1114 aa, Homo sapiens
EGLGPPVAGGAAAGAGMPGGGGGPSAALREQERVYEWFGLVLGSAQRLEFMCGLLDLCNPLELRFLGSCLEDLARKDYHYLRDSEAKANGLSDPGPLADFREPAVRSRLIVYLALLGSENREAAGRLHRLLPQVDSVLKSLRAARGEGSRGGAEDERGEDGDGEQDAEKDGSGPEGGIVEPRVGGGLGSRAQEELLLLFTMASLHPAFSFHQRVTLREHLERLRAALRGGPEDAEVEVEPCKFAGPRAQNNSAHGDYMQNNESSLIEQAPIPQDGLTVAPHRAQREAVHIEKIMLKGVQRKRADKYWEYTFKVNWSDLSVTTVTKTHQELQEFLLKLPKELSSETFDKTILRALNQGSLKREERRHPDLEPILRQLFSSSSQAFLQSQKVHSFFQSISSDSLHSINNLQSSLKTSKILEHLKEDSSEASSQEEDVLQHAIIHKKHTGKSPIVNNIGTSCSPLDGLTMQYSEQNGIVDWRKQSCTTIQHPEHCVTSADQHSAEKRSLSSINKKKGKPQTEKEKIKKTDNRLNSRINGIRLSTPQHAHGGTVKDVNLDIGSGHDTCGETSSESYSSPSSPRHDGRESFESEEEKDRDTDSNSEDSGNPSTTRFTGYGSVNQTVTVKPPVQIASLGNENGNLLEDPLNSPKYQHISFMPTLHCVMHNGAQKSEVVVPAPKPADGKTIGMLVPSPVAISAIRESANSTPVGILGPTACTGESEKHLELLASPLPIPSTFLPHSSTPALHLTVQRLKLPPPQGSSESCTVNIPQQPPGSLSIASPNTAFIPIHNPGSFPGSPVATTDPITKSASQVVGLNQMVPQIEGNTGTVPQPTNVKVVLPAAGLSAAQPPASYPLPGSPLAAGVLPSQNSSVLSTAATSPQPASAGISQAQATVPPAVPTHTPGPAPSPSPALTHSTAQSDSTSYISAVGNTNANGTVVPPQQMGSGPCGSCGRRCSCGTNGNLQLNSYYYPNPMPGPMYRVPSFFTLPSICNGSYLNQAHQSNGNQLPFFLPQTPYANGLVHDPVMGSQANYGMQQMAGFGRFYPVYPAPNVVANTSGSGPKKNGNVSCYNCGVSGHYAQDCKQSSMEANQQGTYRLRYAPPLPPSNDTLDSAD

SEQ ID NO: 810996 - protein, 713 aa, Homo sapiens [sequence omitted]

SEQ ID NO: 810997 - protein, 799 aa, Homo sapiens
EGLGPPVAGGAAAGAGMPGGGGGPSAALREQERVYEWFGLVLGSAQRLEFMCGLLDLCNPLELRFLGSCLEDLARKDYHYLRDSEAKANGLSDPGPLADFREPAVRSRLIVYLALLGSENREAAGRLHRLLPQVDSVLKSLRAARGEGSRGGAEDERGEDGDGEQDAEKDGSGPEGGIVEPRVGGGLGSRAQEELLLLFTMASLHPAFSFHQRVTLREHLERLRAALRGGPEDAEVEVEPCKFAGPRAQNNSAHGDYMQNNESSLIEQAPIPQDGLTVAPHRAQREAVHIEKIMLKGVQRKRADKYWEYTFKVNWSDLSVTTVTKTHQELQEFLLKLPKELSSETFDKTILRALNQGSLKREERRHPDLEPILRQLFSSSSQAFLQSQKVHSFFQSISSDSLHSINNLQSSLKTSKILEHLKEDSSEASSQEEDVLQHAIIHKKHTGKSPIVNNIGTSCSPLDGLTMQYSEQNGIVDWRKQSCTTIQHPEHCVTSADQHSAEKRSLSSINKKKGKPQTEKEKIKKTDNRLNSRINGIRLSTPQHAHGGTVKDVNLDIGSGHDTCGETSSESYSSPSSPRHDGRESFESEEEKDRDTDSNSEDSGNPSTTRFTGYGSVNQTVTVKPPVQIASLGNENGNLLEDPLNSPKYQHISFMPTLHCVMHNGAQKSEVVVPAPKPADGKTIGMLVPSPVAISAIRESANSTPVGILGPTACTGESEKHLELLASPLPIPSTFLPHSSTPALHLTVQRLKLPPPQGSSESCTVNIPQQPPGSLSIASPNTAFIPIHNPDSICKWTGT

SEQ ID NO: 810998 - protein, 526 aa, Homo sapiens
EGLGPPVAGGAAAGAGMPGGGGGPSAALREQERVYEWFGLVLGSAQRLEFMCGLLDLCNPLELRFLGSCLEDLARKDYHYLRDSEAKANGLSDPGPLADFREPAVRSRLIVYLALLGSENREAAGRLHRLLPQVDSVLKSLRAARGEGSRGGAEDERGEDGDGEQDAEKDGSGPEGGIVEPRVGGGLGSRAQEELLLLFTMASLHPAFSFHQRVTLREHLERLRAALRGGPEDAEVEVEPCKFAGPRAQNNSAHGDYMQNNESSLIEQAPIPQDGLTVAPHRAQREAVHIEKIMLKGVQRKRADKYWEYTFKVNWSDLSVTTVTKTHQELQEFLLKLPKELSSETFDKTILRALNQGSLKREERRHPDLEPILRQLFSSSSQAFLQSQKVHSFFQSISSDSLHSINNLQSSLKTSKILEHLKEDSSEASSQEEDVLQHAIIHKKHTGKSPIVNNIGTSCSPLDGLTMQYSEQNGIVDWRKQSCTTIQHPEHCVTSADQHSAEKRSLSSINKKKGKPQTEKEKIKKN

SEQ ID NO: 810999 - protein, 753 aa, Homo sapiens
EGLGPPVAGGAAAGAGMPGGGGGPSAALREQERVYEWFGLVLGSAQRLEFMCGLLDLCNPLELRFLGSCLEDLARKDYHYLRDSEAKANGLSDPGPLADFREPAVRSRLIVYLALLGSENREAAGRLHRLLPQVDSVLKSLRAARGEGSRGGAEDERGEDGDGEQDAEKDGSGPEGGIVEPRVGGGLGSRAQEELLLLFTMASLHPAFSFHQRVTLREHLERLRAALRGGPEDAEVEVEPCKFAGPRAQNNSAHGDYMQNNESSLIEQAPIPQDGLTVAPHRAQREAVHIEKIMLKGVQRKRADKYWEYTFKVNWSDLSVTTVTKTHQELQEFLLKLPKELSSETFDKTILRALNQGSLKREERRHPDLEPILRQLFSSSSQAFLQSQKVHSFFQSISSDSLHSINNLQSSLKTSKILEHLKEDSSEASSQEEDVLQHAIIHKKHTGKSPIVNNIGTSCSPLDGLTMQYSEQNGIVDWRKQSCTTIQHPEHCVTSADQHSAEKRSLSSINKKKGKPQTEKEKIKKTDNRLNSRINGIRLSTPQHAHGGTVKDVNLDIGSGHDTCGETSSESYSSPSSPRHDGRESFESEEEKDRDTDSNSEDSGNPSTTRFTGYGSVNQTVTVKPPVQIASLGNENGNLLEDPLNSPKYQHISFMPTLHCVMHNGAQKSEVVVPAPKPADGKTIGMLVPSPVAISAIRESANSTPVGILGPTACTGESEKHLELLASPVSSRTTLLSDSGIMAMQSSFCLASD

SEQ ID NO: 811000 - protein, 207 aa, Homo sapiens
MAALVEPLGLERDVSRAVELLERLQRSGELPPQKLQALQRVLQSRFCSAIREVYEQLYDTLDITGSAEIRAHATAKATVAAFTASEGHAHPRVVELPKTDEGLGFNIMGGKEQNSPIYISRVIPGGVADRHGGLKRGDQLLSVNGVSVEGEQHEKAVELLKAAQGSVKLVVRYTPRVLEEMEARFEKMRSARRRQQHQSYSSLESRG

SEQ ID NO: 811001 - protein, 322 aa, Homo sapiens
PTRAAAYIPSPRSPPFPGQASAGGPADPEGVGGAGAGAGRSLVWEAPWARAGTLGARLTTRPVEGSRGRRAAGGSLSCATLDSAGCPTRLRPSSPDCALGLTPPLSLLLCVSGSLTLGVSAPRPRPADVSRAVELLERLQRSGELPPQKLQALQRVLQSRFCSAIREVYEQLYDTLDITGSAEIRAHATAKATVAAFTASEGHAHPRVVELPKTDEGLGFNIMGGKEQNSPIYISRVIPGGVADRHGGLKRGDQLLSVNGVSVEGEQHEKAVELLKAAQGSVKLVVRYTPRVLEEMEARFEKMRSARRRQQHQSYSSLESRG

SEQ ID NO: 811002 - protein, 162 aa, Homo sapiens
MPLLLTQVYEQLYDTLDITGSAEIRAHATAKATVAAFTASEGHAHPRVVELPKTDEGLGFNIMGGKEQNSPIYISRVIPGGVADRHGGLKRGDQLLSVNGVSVEGEQHEKAVELLKAAQGSVKLVVRYTPRVLEEMEARFEKMRSARRRQQHQSYSSLESRG

SEQ ID NO: 811003 - protein, 156 aa, Homo sapiens
MPLLLTQVYEQLYDTLDITGSAEIRAHATAKATVAAFTASEGHAHPRVVELPKTDEGLGFNIMGGKEQNSPIYISRVIPGGVADRHGGLKRGDQLLSVNGVSVEGEQHEKAVELLKAAQGSVKLVVRYTPRVLEEMEARFEKMRSARRRQQHQSYS

SEQ ID NO: 811004 - protein, 179 aa, Homo sapiens
IVHCAMTSVPCLGIVTQAKSLSSVHIPHPSFHAYLEGALIFSRFLFSQATVAAFTASEGHAHPRVVELPKTDEGLGFNIMGGKEQNSPIYISRVIPGGVADRHGGLKRGDQLLSVNGVSVEGEQHEKAVELLKAAQGSVKLVVRYTPRVLEEMEARFEKMRSARRRQQHQSYSSLESRG

SEQ ID NO: 811005 - protein, 131 aa, Homo sapiens
MAALVEPLGLERDVSRAVELLERLQRSGELPPQKLQALQRVLQSRFCSAIREVYEQLYDTLDITGSAEIRAHATAKSVEGEQHEKAVELLKAAQGSVKLVVRYTPRVLEEMEARFEKMRSARRRQQHQSYS

SEQ ID NO: 811006 - protein, 133 aa, Homo sapiens
MAALVEPLGLERDVSRAVELLERLQRSGELPPQKLQALQRVLQSRFCSAIREVYEQLYDTLDITGSAEIRAHATAKKYKKKKKERKSRAWWRVPVIPAGLQLRRLRQENRLNPGGRGCSEPRSCHCTPAWATE

SEQ ID NO: 811007 - protein, 121 aa, Homo sapiens
MAALVEPLGLERDVSRAVELLERLQRSGELPPQKLQALQRVLQSRFCSAIREVYEQLYDTLDITGSAEIRAHATAKVGPAPHCSWCLFNCLVELNISFMPVISVSSLMIFAKSMCHLTISK

SEQ ID NO: 811008 - protein, 136 aa, Homo sapiens
MILNWKLLGILVLCLHTRGISGSEGHPSHPPAEDREEAGSPTLPQGPPVPGDPWPGAPPLFEDPPPTRPSRPWRDLPETGVWPPEPPRTDPPQPPRPDDPWPAGPQPPENPWPPAPEVDNRPQEEPDLDPPREEYR

SEQ ID NO: 811009 - protein, 1024 aa, Homo sapiens
MERRSRRKSRRNGRSTAGKAAATQPAKSPGAQLWLFPSAAGLHRALLRRVEVTRQLCCSPGRLAVLERGGAGVQVHQLLAGSGGARTPKCIKLGKNMKIHSVDQGAEHMLILSSDGKPFEYDNYSMKHLRFESILQEKKIIQITCGDYHSLALSKGGELFAWGQNLHGQLGVGRKFPSTTTPQIVEHLAGVPLAQISAGEAHSMALSMSGNIYSWGKNECGQLGLGHTESKDDPSLIEGLDNQKVEFVACGGSHSALLTQDGLLFTFGAGKHGQLGHNSTQNELRPCLVAELVGYRVTQIACGRWHTLAYVSDLGKVFSFGSGKDGQLGNGGTRDQLMPLPVKVSSSEELKLESHTSEKELIMIAGGNQSILLWIKKENSYVNLKRTIPTLNEGTVKRWIADVETKRWQSTKREIQEIFSSPACLTGSFLRKRRTTEMMPVYLDLNKARNIFKELTQKDWITNMITTCLKDNLLKRLPFHSPPQEALEIFFLLPECPVMHISNNWESLVVPFAKVVCKMSDQSSLVLEEYWATLQESTFSKLVQMFKTAVICQLDYWDESAEENGNVQALLEMLKKLHRVNQVKCQLPESIFQVDELLHRLNFFVEVCRRYLWKMTVDASENVQCCVIFSHFPFIFNNLSKIKLLHTDTLLKIESKKHKAYLRSAAIEEERESEFALRPTFDLTVRRNHLIEDVLNQLSQFENEDLRKELWVSFSGEIGYDLGGVKKEFFYCLFAEMIQPEYGMFMYPEGASCMWFPVKPKFEKKRYFFFGVLCGLSLFNCNVANLPFPLALFKKLLDQMPSLEDLKELSPDLGKNLQTLLDDEGDNFEEVFYIHFNVHWDRNDTNLIPNGSSITVNQTNKRDYVSKYINYIFNDSVKAVYEEFRRGFYKMCDEDIIKLFHPEELKDVIVGNTDYDWKTFEKNARYEPGYNSSHPTIVMFWKAFHKLTLEEKKKFLVFLTGTDRLQMKDLNNMKITFCCPESWNERDPIRALTCFSVLFLPKYSTMETVEEALQEAINNNRGFG

SEQ ID NO: 811010 - protein, 662 aa, Homo sapiens
MIAGGNQSILLWIKKENSYVNLKRTIPTLNEGTVKRWIADVETKRWQSTKREIQEIFSSPACLTGSFLRKRRTTEMMPVYLDLNKARNIFKELTQKDWITNMITTCLKDNLLKRLPFHSPPQEALEIFFLLPECPVMHISNNWESLVVPFAKVVCKMSDQSSLVLEEYWATLQESTFSKLVQMFKTAVICQLDYWDESAEENGNVQALLEMLKKLHRVNQVKCQLPESIFQVDELLHRLNFFVEVCRRYLWKMTVDASENVQCCVIFSHFPFIFNNLSKIKLLHTDTLLKIESKKHKAYLRSAAIEEERESEFALRPTFDLTVRRNHLIEDVLNQLSQFENEDLRKELWVSFSGEIGYDLGGVKKEFFYCLFAEMIQPEYGMFMYPEGASCMWFPVKPKFEKKRYFFFGVLCGLSLFNCNVANLPFPLALFKKLLDQMPSLEDLKELSPDLGKNLQTLLDDEGDNFEEVFYIHFNVHWDRNDTNLIPNGSSITVNQTNKRDYVSKYINYIFNDSVKAVYEEFRRGFYKMCDEDIIKLFHPEELKDVIVGNTDYDWKTFEKNARYEPGYNSSHPTIVMFWKAFHKLTLEEKKKFLVFLTGTDRLQMKDLNNMKITFCCPESWNERDPIRALTCFSVLFLPKYSTMETVEEALQEAINNNRGFG

SEQ ID NO: 811011 - protein, 170 aa, Homo sapiens
SEYPPLRRDYVSKYINYIFNDSVKAVYEEFRRGFYKMCDEDIIKLFHPEELKDVIVGNTDYDWKTFEKNARYEPGYNSSHPTIVMFWKAFHKLTLEEKKKFLVFLTGTDRLQMKDLNNMKITFCCPESWNERDPIRALTCFSVLFLPKYSTMETVEEALQEAINNNRGFG

SEQ ID NO: 811012 - protein, 130 aa, Homo sapiens
MEKYERIRVVGRGAFGIVHLCLRKADQKLVIIKQIPVEQMTKEERQAAQNECQVLKLLNHPNVIEYYENFLEDKALMIAMEYAPGGPASLQWPGWRASYLWDRQTQISWLPSLEWAWQGLEFWSQLSDPG

SEQ ID NO: 811013 - protein, 490 aa, Homo sapiens
RHNGVSEGDEQVVPAPGAQGVGAHVHGIVHLCLRKADQKLVIIKQIPVEQMTKEERQAAQNECQVLKLLNHPNVIEYYENFLEDKALMIAMEYAPGGTLAEFIQKRCNSLLEEETILHFFVQILLALHHVHTHLILHRDLKTQNILLDKHRMVVKIGDFGISKILSSKSKAYTVVGTPCYISPELCEGKPYNQKSDIWALGCVLYELASLKRAFEAANLPALVLKIMSGTFAPISDRYSPELRQLVLSLLSLEPAQRPPLSHIMAQPLCIRALLNLHTDVGSVRMRRAEKSVAPSNTGSRTTSVRCRGIPRGPVRPAIPPPLSSVYAWGGGLGTPLRLPMLNTEVVQVAAGRTQKAGVTRSGASHPVRRTHPYVQDEADSLLRNMEQPKPRFNRRTREDQNGVTIKTVDSGEPQHDGPKENKHTPKTNREADKQGAKARRQPLKTRANTGDAQPRQNRYTPYKQHRRNRERNNQYDDQPDRVKRQQHTRD

SEQ ID NO: 811014 - protein, 303 aa, Homo sapiens
RHNGVSEGDEQVVPAPGAQGVGAHVHGIVHLCLRKADQKLVIIKQIPVEQMTKEERQAAQNECQVLKLLNHPNVIEYYENFLEDKALMIAMEYAPGGTLAEFIQKRCNSLLEEETILHFFVQILLALHHVHTHLILHRDLKTQNILLDKHRMVVKIGDFGISKILSSKSKAYTVPGHGRDLQGTRSLEGQDLTLPPPLPLKNPWPFGPCLGGSAGGSPLACFEKKLSPNGLMHRAPGLPSLQGCDPSSASILQDRSWDQWWVPHAISPLSCVRASPTTRRVTSGPWAVSSTSWPASRGLSRLR

SEQ ID NO: 811015 - protein, 109 aa, Homo sapiens
PKKRPGGASQGGTSEPQGLDAASWAQIHQKLRDFSRSTQAELERERAQLLVRATMAEEQLSELQEYVDQHLGRYKHEILRLRKLAGAGDPWKVGAVPPAKPQHPRTGSH

SEQ ID NO: 811016 - protein, 156 aa, Homo sapiens
AGLIVSEEATMQVLTKRYPKNCLLTVMDRYAAEVHNMEQVVMIPSLLRDVQLSGPGGQAQAEAPDLYTYFTMLKAICVDVDHGLLPREEWQAKVAGSEENGTAETEEVEDESASGELDLEAQFHLHFSSLHHILMHLTEKAQEVTRKYQEMTGQVW

SEQ ID NO: 811017 - protein, 156 aa, Homo sapiens; identical to SEQ ID NO: 811016

SEQ ID NO: 811018 - protein, 156 aa, Homo sapiens; identical to SEQ ID NO: 811016

SEQ ID NO: 811019 - protein, 156 aa, Homo sapiens; identical to SEQ ID NO: 811016

SEQ ID NO: 811020 - protein, 185 aa, Homo sapiens
FREGFSLIGSKDWLKIVRRVDCLLFGTTIKDKSRLFRVQFSGESKEQALEHCCSCVQKLAQYITVQVPDGNIQELQLIPGPPRATESQGKDSAKSVPRQPGSHQHSEQQQVCVTAGTGAPDGRTSLTQLAQTLLASEELPHVYEQSAWGAEELGPFLRLCLMDQNFPAFVEEVEKELKKLAGLRN

SEQ ID NO: 811021 - protein, 400 aa, Homo sapiens
MNFTVGFKPLLGDAHSMDNLEKQLICPICLEMFSKPVVILPCQHNLCRKCANDVFQASNPLWQSRGSTTVSSGGRFRCPSCRHEVVLDRHGVYGLQRNLLVENIIDIYKQESSRPLHSKAEQHLMCEEHEEEKINIYCLSCEVPTCSLCKVFGAHKDCEVAPLPTIYKRQKKQDLTLLPRLECSGTNTTYCSLDLPSSSDPPILASQNTKIIDSELSDGIAMLVAGNDRVQAVITQMEEVCQTIEDNSRRQKQLLNQRFESLCAVLEERKGELLQALAREQEEKLQRVRGLIRQYGDHLEASSKLVESAIQSMEEPQMALYLQQAKELINKVGAMSKVELAGRPEPGYESMEQFTVRVEHVAEMLRTIDFQPGASGEEEEVAPDGEEGSAGPEEERPDGP

SEQ ID NO: 811022 - protein, 210 aa, Homo sapiens
MNFTVGFKPLLGDAHSMDNLEKQLICPICLEMFSKPVVILPCQHNLCRKCANDVFQASNPLWQSRGSTTVSSGGRFRCPSCRHEVVLDRHGVYGLQRNLLVENIIDIYKQESSRPLHSKAEQHLMCEEHEEEKINIYCLSCEVPTCSLCKVFGAHKDCEVAPLPTIYKRQKSELSDGIAMLVAGNDRVQAVITQMEEVCQTIEVSLGWRE

SEQ ID NO: 811023 - protein, 200 aa, Homo sapiens
MSKVELAGRPEPGYESMEQFTVRVEHVAEMLRTIDFQPGEGGGRGPLRRVRTLCVGGAAGTMAVKAGTPPHQAFLGLRRFRGGRGGGPRRRGGQRGAGGRAAGWALRPAPTRPCSRARARVGEDLRRDRSITQIGAGPGRISIKNSSVPDPYLLSLPNPAAWASKATRPPSCPSQNLRPSGGRKPNEPLLGTSVMPGANW

SEQ ID NO: 811024 - protein, 179 aa, Homo sapiens
MLVAGNDRVQAVITQMEEVCQTIEDNSRRQKQLLNQRFESLCAVLEERKGELLQALAREQEEKLQRVRGLIRQYGDHLEASSKLVESAIQSMEEPQMALYLQQAKELINKVGAMSKVELAGRPEPGYESMEQFTVRVEHVAEMLRTIDFQPGASGEEEEVAPDGEEGSAGPEEERPDGP

SEQ ID NO: 811025 - protein, 358 aa, Homo sapiens
MNFTVGFKPLLGDAHSMDNLEKQLICPICLEMFSKPVVILPCQHNLCRKCANDVFQASNPLWQSRGSTTVSSGGRFRCPSCRHEVVLDRHGVYGLQRNLLVENIIDIYKQESSRPLHSKAEQHLMCEEHEEEKINIYCLSCEVPTCSLCKVFGAHKDCEVAPLPTIYKRQKSELSDGIAMLVAGNDRVQAVITQMEEVCQTIEDNSRRQKQLLNQRFESLCAVLEERKGELLQALAREQEEKLQRVRGLIRQYGDHLEASSKLVESAIQSMEEPQMALYLQQAKELINKVGAMSKVELAGRPEPGYESMEQFTVRVEHVAEMLRTIDFQPGASGEEEEVAPDGEEGSAGPEEERPDGP

SEQ ID NO: 811026 - protein, 206 aa, Homo sapiens
KDLGWVLAQPLTHSVTTDGSLSVLVLCEYPVLSQPPGLSHAFPHPCSPSFEDNSRRQKQLLNQRFESLCAVLEERKGELLQALAREQEEKLQRVRGLIRQYGDHLEASSKLVESAIQSMEEPQMALYLQQAKELINKVGAMSKVELAGRPEPGYESMEQFTVRVEHVAEMLRTIDFQPGASGEEEEVAPDGEEGSAGPEEERPDGP

SEQ ID NO: 811027 - protein, 105 aa, Homo sapiens
AARGCTQHGQPGEAAHLPHLPGDVLQTSGDPALPTQPVPQMCQRRLPGGCQGRAGPGKAMQTCGGLIRSELRPQKVMDRVLSEVGGGCCGWRAEGLGSKQIPEQA

SEQ ID NO: 811028 - protein, 140 aa, Homo sapiens
IAFFPAWGFSRFPPALGKGALSGLDGFTFVVCFLPSVPTQRCASPWLHLDFTVNVSFTAHTLPPILSSPESRRHPVFPPPYNSALHRTGPARMKLSKERDSSCCINIRNGFQACLNEFHTQCINIIVHSSFQRPLNKFPK

SEQ ID NO: 811029 - protein, 432 aa, Homo sapiens
GPARPGPPPPRALSTHAAGLALRSRGPGPAAAFSRRSYSLGICSPSGRGGNVGDAEEQSPRSASRGSGRLPSSRRKRTAQEGAGSAGRGAGPGSELGPASASASSCELPSARHPGSSGGSRTKPPRHHHPENPSPSPMAGYLPPKGYAPSPPPPYPVTPGYPEPALHPGPGQAPVPAQVPAPAPGFALFPSPGPVALGSAAPFLPLPGVPSGLEFLVQIDQILIHQKAERVETFLGWETCNRYELRSGAGQPLGQAAEESNCCARLCCGARRPLRVRLADPGDREVLRLLRPLHCGCSCCPCGLQEMEVQAPPGTTIGHVLQTWHPFLPKFSIQDADRQTVLRVVGPCWTCGCGTDTNFEVKTRDESRSVGRISKQWGGLVREALTDADDFGLQFPLDLDVRVKAVLLGATFLIDYMFFEKRGGAGPSAITS

SEQ ID NO: 811030 - protein, 208 aa, Homo sapiens
GPARPGPPPPRALSTHAAGLALRSRGPGPAAAFSRRSYSLGICSPSGRGGNVGDAEEQSPRSASRGSGRLPSSRRKRTAQEGAGSAGRGAGPGSELGPASASASSCELPSARHPGSSGGSRTKPPRHHHPENPSPSPMAGKCAQVWGSPLSPPRTWEPGLNTSSRNVLGLAGWGPSPSFRGTSTLLPCPIFLCLLPPRFPREASRPMG

SEQ ID NO: 811031 - protein, 296 aa, Homo sapiens
GPARPGPPPPRALSTHAAGLALRSRGPGPAAAFSRRSYSLGICSPSGRGGNVGDAEEQSPRSASRGSGRLPSSRRKRTAQEGAGSAGRGAGPGSELGPASASASSCELPSARHPGSSGGSRTKPPRHHHPENPSPSPMAATCPPQGYALPTATCHPGPGGLIWAGSAGRQYSRPVRLFLRPGLGLCPFCMRVLWLILCMIDGSEAGVSPGGAVRYDWLWGREPWVRRRETMCAVCVGARGVVSLADRDVRWLSPCLGERALGSRMDQSTANAVLDDLSQSSERATLDGPACVDTMG

SEQ ID NO: 811032 - protein, 295 aa, Homo sapiens
MAGYLPPKGYAPSPPPPYPVTPGYPEPALHPGPGQAPVPAQVPAPAPGFALFPSPGPVALGSAAPFLPLPGVPSGLEFLVQIDQILIHQKAERVETFLGWETCNRYELRSGAGQPLGQAAEESNCCARLCCGARRPLRVRLADPGDREVLRLLRPLHCGCSCCPCGLQEMEVQAPPGTTIGHVLQTWHPFLPKFSIQDADRQTVLRVVGPCWTCGCGTDTNFEVKTRDESRSVGRISKQWGGLVREALTDADDFGLQFPLDLDVRVKAVLLGATFLIDYMFFEKRGGAGPSAITS

SEQ ID NO: 811033 - protein, 470 aa, Homo sapiens
GPARPGPPPPRALSTHGRRPGVAFAGPGTSRRLLQALLLSGHLQSERKGREASATPREQSPRSASRGSGRLPSSRRKRTAQEGAGSAGRGAGPGSELGPASASASSCELPSARHPGSSGGSSRGAAQETLGRRRAQLPLRLCVCLCVCLAISEFASASRTKPPRHHHPENPSPSPMAGYLPPKGYAPSPPPPYPVTPGYPEPALHPGPGQAPVPAQVPAPAPGFALFPSPGPVALGSAAPFLPLPGVPSGLEFLVQIDQILIHQKAERVETFLGWETCNRYELRSGAGQPLGQAAEESNCCARLCCGARRPLRVRLADPGDREVLRLLRPLHCGCSCCPCGLQEMEVQAPPGTTIGHVLQTWHPFLPKFSIQDADRQTVLRVVGPCWTCGCGTDTNFEVKTRDESRSVGRISKQWGGLVREALTDADDFGLQFPLDLDVRVKAVLLGATFLIDYMFFEKRGGAGPSAITS

SEQ ID NO: 811034 - protein, 295 aa, Homo sapiens; identical to SEQ ID NO: 811032

SEQ ID NO: 811035 - protein, 126 aa, Homo sapiens
MEVQAPPGTTIGHVLQTWHPFLPKFSIQDADRQTVLRVVGPCWTCGCGTDTNFEVKTRDESRSVGRISKQWGGLVREALTDADDFGLQFPLDLDVRVKAVLLGATFLIDYMFFEKRGGAGPSAITS

SEQ ID NO: 811036 - protein, 446 aa, Homo sapiens
GPARPGPPPPRALSTHGRRPGVAFAGPGTSRRLLQALLLSGHLQSERKGREASATPREQSPRSASRGSGRLPSSRRKRTAQEGAGSAGRGAGPGSELGPASASASSCELPSARHPGSSGGSSRGAAQETLGRRRAQLPLRLCVCLCVCLAISEFASASRTKPPRHHHPENPSPSPMAGYLPPKGYAPSPPPPYPVTPGYPEPALHPGPGQAPVPAQVPAPAPGFALFPSPGPVALGSAAPFLPLPGVPSGLEFLVQIDQILIHQKAERVETFLGWETCNRYELRSGAGQPLGQAAEESNCCARLCCGARRPLRVRLADPGDREVLRLLRPLHCGCSCCPCGLQEFSIQDADRQTVLRVVGPCWTCGCGTDTNFEVKTRDESRSVGRISKQWGGLVREALTDADDFGLQFPLDLDVRVKAVLLGATFLIDYMFFEKRGGAGPSAITS

SEQ ID NO: 811037 - protein, 295 aa, Homo sapiens; identical to SEQ ID NO: 811032

SEQ ID NO: 811038 - protein, 374 aa, Homo sapiens
PLCQGEKGEVAPGAEGEPGASPGSMIRGAAQETLGRRRAQLPLRLCVCLCVCLAISEFASASRTKPPRHHHPENPSPSPMAGYLPPKGYAPSPPPPYPVTPGYPEPALHPGPGQAPVPAQVPAPAPGFALFPSPGPVALGSAAPFLPLPGVPSGLEFLVQIDQILIHQKAERVETFLGWETCNRYELRSGAGQPLGQAAEESNCCARLCCGARRPLRVRLADPGDREVLRLLRPLHCGCSCCPCGLQEMEVQAPPGTTIGHVLQTWHPFLPKFSIQDADRQTVLRVVGPCWTCGCGTDTNFEVKTRDESRSVGRISKQWGGLVREALTDADDFGLQFPLDLDVRVKAVLLGATFLIDYMFFEKRGGAGPSAITS

SEQ ID NO: 811039 - protein, 190 aa, Homo sapiens
MNCALGPGSPWVRRPRRATAAPVCAVAPAGRLRVRLADPGDREVLRLLRPLHCGCSCCPCGLQEMEVQAPPGTTIGHVLQTWHPFLPKFSIQDADRQTVLRVVGPCWTCGCGTDTNFEVKTRDESRSVGRISKQWGGLVREALTDADDFGLQFPLDLDVRVKAVLLGATFLIDYMFFEKRGGAGPSAITS

SEQ ID NO: 811040 - protein, 295 aa, Homo sapiens; identical to SEQ ID NO: 811032

SEQ ID NO: 811041 - protein, 190 aa, Homo sapiens; identical to SEQ ID NO: 811039

SEQ ID NO: 811042 - protein, 295 aa, Homo sapiens; identical to SEQ ID NO: 811032

SEQ ID NO: 811043 - protein, 126 aa, Homo sapiens; identical to SEQ ID NO: 811035

SEQ ID NO: 811044 - protein, 295 aa, Homo sapiens; identical to SEQ ID NO: 811032

SEQ ID NO: 811045 - protein, 358 aa, Homo sapiens
GPARPGPPPPRALSTHAAGLALRSRGPGPAAAFSRRSYSLGICSPSGRGGNVGDAEEQSPRSASRGSGRLPSSRRKRTAQEGAGSAGRGAGPGSELGPASASASSCELPSARHPGSSGGSSRGAAQETLGRRRAQLPLRLCVCLCVCLAISEFASASRTKPPRHHHPENPSPSPMAGYLPPKGYAPSPPPPYPVTPGYPLRVRLADPGDREVLRLLRPLHCGCSCCPCGLQEMEVQAPPGTTIGHVLQTWHPFLPKFSIQDADRQTVLRVVGPCWTCGCGTDTNFEVKTRDESRSVGRISKQWGGLVREALTDADDFGLQFPLDLDVRVKAVLLGATFLIDYMFFEKRGGAGPSAITS

SEQ ID NO: 811046 - protein, 295 aa, Homo sapiens; identical to SEQ ID NO: 811032

SEQ ID NO: 811047 - protein, 126 aa, Homo sapiens; identical to SEQ ID NO: 811035

SEQ ID NO: 811048 - protein, 163 aa, Homo sapiens
MEVQAPPGTTIGHVLQTWHPFLPKFSIQDADRQTVLRVVGPCWTCGCGTDTNFEVKTRDESRSVGRISKQWGGLVREALTDADDFGLQFPLDLDVRVKAVLLGATFLIVSWLPLPPPPACPLLSFEALCISWPLARGKSGIGVVGVEVLELACDSASWAGPAI

SEQ ID NO: 811049 - protein, 136 aa, Homo sapiens
MNCALGPGSPWVRRPRRATAAPVCAVAPAGRLRVRLADPGDREVLRLLRPLHCGCSCCPCGLQEMEVQAPPGTTIGHVLQTWHPFLPKFSIQDADRQTVLRVVGPCWTCGCGTDTNFEVKTRDEIPQVWARISKAV

SEQ ID NO: 811050 - protein, 140 aa, Homo sapiens
MSGRIIQVESPVLILIAIHSQPVLGSCYHQTEHRQICFPQLESQIVSWVSTQAPDMDDLGWNLSPSACWLCDSGPGRAAGEDLEIWYRQPFVCLPHRYKLAPQRPGSRRSNPSPATAGNKNQGRTEEIKQKRKNEFIEAL

SEQ ID NO: 811051 - protein, 469 aa, Homo sapiens
GVKERRGPGCVWWRRPKSLCAELRGLWMRRTRRPRFVLMNKMDDLNLHYRFLNWRRRIREIREVRAFRYQERFKHILVDGDTLSYHGNSGEVGCYVASRPLTKDSNYFEVSIVDSGVRGTIAVGLVPQYYSLDHQPGWLPDSVAYHADDGKLYNGRAKGRQFGSKCNSGDRIGCGIEPVSFDVQTAQIFFTKNGKRVGSTIMPMSPDGLFPAVGMHSLGEEVRLHLNAELGREDDSVMMVDSYEDEWGRLHDVRVCGTLLEYLGKGKSIVDVGLAQARHPLSTRSHYFEVEIVDPGEKCYIALGLARKDYPKNRHPGWSRGSVAYHADDGKIFHGSGVGDPFGPRCYKGDIMGCGIMFPRDYILDSEGDSDDSCDTVILSPTARAVRNVRNVMYLHQEGEEEEEEEEEEEDGEEIEPEHEGRKVVVFFTRNGKIIGKKDAVVPSGGFFPTIGMLSCGEKVKVDLHPLSG

SEQ ID NO: 811052 - protein, 469 aa, Homo sapiens; identical to SEQ ID NO: 811051

SEQ ID NO: 811053 - protein, 102 aa, Homo sapiens
WLLKTEARLMFLQKFSPLVGGGAAERDSSSSGGSNIDYEEWRRLPQDLQHPRGADFNFSDRIKRCQEAQNGSRAVSRQEASKPLSSLQSMQYVHYSVFCYCR

SEQ ID NO: 811054 - protein, 128 aa, Homo sapiens
WLLKTEARLMFLQKFSPLVGGGAAERDSSSSGGSNIDYEEWRRLPQDLQHPRGSRAVSRQEASKPLSSLQSMHLIKSALGDRTGLEALSFKDKIHARPSVGAGDGYDLKVKIVMEKKVVFSCTYLRNC

SEQ ID NO: 811055 - protein, 135 aa, Homo sapiens
GSRRGDRLCAGAHHFQGLGGVVSHSLCPQLTTRSAMTSKGPEEEHPSVTLFRQYLRIRTVQPKPDYGEKTVVPEPVTGPKGRGLCSKPASNPCHPAEPHSAVPNGSPTPPAIPQVNRLRQPLQVREEPFPQRLCC

SEQ ID NO: 811056 - protein, 254 aa, Homo sapiens
MTSKGPEEEHPSVTLFRQYLRIRTVQPKPDYGAAVAFFEETARQLGLGCQKVEVAPGYVVTVLTWPGTNPTLSSILLNSHTDVVPVFKEHWSHDPFEAFKDSEGYIYARGAQDMKCVSIQYLEAVRRLKVEGHRFPRTIHMTFVPDEEVGGHQGMELFVQRPEFHALRAGFALDEGIANPTDAFTVFYSERSPWWVRVTSTGRPGHASRFMEDTAAEKLHKVVNSILAFREKEWPEAAVKPPPERGVRDLREPD

SEQ ID NO: 811057 - protein, 267 aa, Homo sapiens
MTSKGPEEEHPSVTLFRQYLRIRTVQPKPDYGAAVAFFEETARQLGLGCQKVEVAPGYVVTVLTWPGTNPTLSSILLNSHTDVVPVFKEHWSHDPFEAFKDSEGYIYARGAQDMKCVSIQYLEAVRRLKVEGHRFPRTIHMTFVPDEEVGGHQGMELFVQRPEFHALRAGFALDEGIANPTDAFTVFYSERSPWWVRVTTLGGRHAHAHGGHRARSWQGCNSTGSGEEGGGNPLKRPDRNAKRGGATESARPTGAGKDRHTRAPEAP

SEQ ID NO: 811058 - protein, 267 aa, Homo sapiens; identical to SEQ ID NO: 811057

SEQ ID NO: 811059 - protein, 94 aa, Homo sapiens
FAPSILRFLPPHSSGSFSYRNLTLEPEIMPAATDNRYIRAVGVPALGFSPMNRTPVLLHDHDERLHEAVFLRGVDIYTRLLPALASVPALPSDS

SEQ ID NO: 811060 - protein, 266 aa, Homo sapiens
MTSKGPEEEHPSVTLFRQYLRIRTVQPKPDYGAAVAFFEETARQLGLGCQKVEVAPGYVVTVLTWPGTNPTLSSILLNSHTDVVPVFKEHWSHDPFEAFKDSEGYIYARGAQDMKCVSIQYLEAVRRLKVEGHRFPRTIHMTFVPDEEVGGHQGMELFVQRPEFHALRAGFALDEGIANPTDAFTVFYSERSPWWVRVTSTGRPGHASRFMEDTAAEKLHKVVNSILASRDNRMARGCSQHPDLTERDTEPREPELPQRTAGPKRD

SEQ ID NO: 811061 - protein, 97 aa, Homo sapiens
NSRGGAGRGGRCPGTGSGSNPPVISLRPEPEAGGDIRADAAAGAGTALTDGLRSPPRHPASATWWADRGGPEPATSQATSLDPKSRPQSGKGAERRA

SEQ ID NO: 811062 - protein, 254 aa, Homo sapiens; identical to SEQ ID NO: 811056

SEQ ID NO: 811063 - protein, 254 aa, Homo sapiens; identical to SEQ ID NO: 811056

SEQ ID NO: 811064 - protein, 254 aa, Homo sapiens; identical to SEQ ID NO: 811056

SEQ ID NO: 811065 - protein, 254 aa, Homo sapiens; identical to SEQ ID NO: 811056

SEQ ID NO: 811066 - protein, 254 aa, Homo sapiens; identical to SEQ ID NO: 811056

SEQ ID NO: 811067 - protein, 219 aa, Homo sapiens
MTSKGPEEEHPSVTLFRQYLRIRTVQPKPDYGTNPTLSSILLNSHTDVVPVFKEHWSHDPFEAFKDSEGYIYARGAQDMKCVSIQYLEAVRRLKVEGHRFPRTIHMTFVPDEEVGGHQGMELFVQRPEFHALRAGFALDEGIANPTDAFTVFYSERSPWWVRVTSTGRPGHASRFMEDTAAEKLHKVVNSILAFREKEWPEAAVKPPPERGVRDLREPD

SEQ ID NO: 811068 - protein, 167 aa, Homo sapiens
MEHWSHDPFEAFKDSEGYIYARGAQDMKCVSIQYLEAVRRLKVEGHRFPRTIHMTFVPDEEVGGHQGMELFVQRPEFHALRAGFALDEGIANPTDAFTVFYSERSPWWVRVTSTGRPGHASRFMEDTAAEKLHKVVNSILAFREKEWPEAAVKPPPERGVRDLREPD

SEQ ID NO: 811069 - protein, 140 aa, Homo sapiens
MSASFDFRVAPDVDFKAFEEQLQSWCQAAGEGVTLEFAQKWMHPQVTPTDDSNPWWAAFSRVCKDMNLTLEPEIMPAATDNRYIRAVGVPALGFSPMNRTPVLLHDHDERLHEAVFLRGVDIYTRLLPALASVPALPSDS

SEQ ID NO: 811070 - protein, 228 aa, Homo sapiens
MTSKGPEEEHPSVTLFRQYLRIRTVQPKPDYGAAVAFFEETARQLGLGCQKVEVAPGYVVTVLTWPGTNPTLSSILLNSHTDVVPVFKNLSRPFEASRWRLHARVPDMNSSDPYWKCELKWKARFPRTIHMTFVPDEEVGGHQGMELFVQRPEFHALRAGFALDEGIANPTDAFTVFYSERSPWWVRVTSTGRPGHACSSVGWTYIHACCLPLPVCLPCPVTAEPWNS

SEQ ID NO: 811071 - protein, 132 aa, Homo sapiens
RCYVLGTAHSMGNRARCPGPCPDPAILPVPQKWMHPQVTPTDDSNPWWAAFSRVCKDMNLTLEPEIMPAATDNRYIRAVGVPALGFSPMNRTPVLLHDHDERLHEAVFLRGVDIYTRLLPALASVPALPSDS

SEQ ID NO: 811072 - protein, 791 aa, Homo sapiens
MGEERWVSLTPEEFDQLQKYSEYSSKKIKDALTEFNEGGSLKQYDPHEPISYDVFKLFMRAYLEVDLPQPLSTHLFLAFSQKPRHETSDHPTEGASNSEANSADTNIQNADNATKADEACAPDTESNMAEKQAPAEDQVAATPLEPPVPRSSSSESPVVYLKDVVCYLSLLETGRPQDKLEFMFRLYDSDENGLLDQAEMDCIVNQMLHIAQYLEWDPTELRPILKEMLQGMDYDRDGFVSLQEWVHGGMTTIPLLVLLGMDDSGSKGDGGHAWTMKHFKKPTYCNFCHIMLMGVRKQGLCCTYCKYTVHERCVSKNIPGCVKTYSKAKRSGEVMQHAWVEGNSSVKCDRCHKSIKCYQSVTARHCVWCRMTFHRKCELSTLCDGGELRDHILLPTSICPITRDRPGEKSDGCVSAKGELVMQYKIIPTPGTHPLLVLVNPKSGGRQGERILRKFHYLLNPKQVFNLDNGGPTPGLNFFRDTPDFRVLACGGDGTVGWILDCIDKANFAKHPPVAVLPLGTGNDLARCLRWGGGYEGGSLTKILKDIEQSPLVMLDRWHLEVIPREEVENGDQVPYSIMNNYFSIGVDASIAHRFHVMREKHPEKFNSRMKNKLWYFEFGTSETFAATCKKLHDHIELECDGVGVDLSNIFLEGIAILNIPSMYGGTNLWGENKKNRAVIRESRKGVTDPKELKFCVQDLSDQLLEVVGLEGAMEMGQIYTGLKSAGRRLAQCASVTIRTNKLLPMQVDGEPWMQPCCTIKITHKNQAPMMMGPPQKSSFFSLRRKSRSKD

SEQ ID NO: 811073 - protein, 218 aa, Homo sapiens
MTTHQGSACLFHFQDASIAHRFHVMREKHPEKFNSRMKNKLWYFEFGTSETFAATCKKLHDHIELECDGVGVDLSNIFLEGIAILNIPSMYGGTNLWGENKKNRAVIRESRKGVTDPKELKFCVQDLSDQLLEVVGLEGAMEMGQIYTGLKSAGRRLAQCASVTIRTNKLLPMQVDGEPWMQPCCTIKITHKNQAPMMMGPPQKSSFFSLRRKSRSKD

SEQ ID NO: 811074 - protein, 765 aa, Homo sapiens
MGEERWVSLTPEEFDQLQKYSEYSSKKIKDALTEFNEGGSLKQYDPHEPISYDVFKLFMRAYLEVDLPQPLSTHLFLAFSQKPRHETSDHPTEGASNSEANSADTNIQNADNATKADEACAPDTESNMAEKQAPAEDQVAATPLEPPVPRSSSSESPVVYLKDVVCYLSLLETGRPQDKLEFMFRLYDSDENGLLDQAEMDCIVNQMLHIAQYLEWDPTELRPILKEMLQGMDYDRDGFVSLQEWVHGGMTTIPLLVLLGMDDSGSKGDGGHAWTMKHFKKPTYCNFCHIMLMGVRKQGLCCTYCKYTVHERCVSKNIPGCVKTYSKAKRSGEVMQHAWVEGNSSVKCDRCHKSIKCYQSVTARHCVWCRMTFHRKCELSTLCDGGELRDHILLPTSICPITRDRPGEKSDGCVSAKGELVMQYKIIPTPGTHPLLVLVNPKSGGRQGERILRKFHYLLNPKQVFNLDNGGPTPGLNFFRDTPDFRVLACGGDGTVGWILDCIDKANFAKHPPVAVLPLGTGNDLARCLRWGGGYEGGSLTKILKDIEQSPLVMLDRWHLEVIPREEVENGDQVPYSIMNNYFSIGVDASIAHRFHVMREKHPEKFNSRMKNKLWYFEFGTSETFAATCKKLHDHIELECDGVGVDLSNIFLEGIAILNIPSMYGGTNLWGENKKNRAVIRESRKGVTDPKELKFCVQDLSDQLLEVVGLEGAMEMGQIYTGLKSAGRRLAQCASVTIRTNKLLPMQVDGEPWMQPCCTVSLANL

SEQ ID NO: 811075 - protein, 791 aa, Homo sapiens; identical to SEQ ID NO: 811072

SEQ ID NO: 811076 - protein, 759 aa, Homo sapiens
MGEERWVSLTPEEFDQLQKYSEYSSKKIKDALTEFNEGGSLKQYDPHEPISYDVFKLFMRAYLEVDLPQPLSTHLFLAFSQKPRHETSDHPTEGASNSEANSADTNIQNADNATKADEACAPDTESNMAEKQAPAEDQVAATPLEPPVPRSSSSESPVVYLKDVVCYLSLLETGRPQDKLEFMFRLYDSDENGLLDQAEMDCIVNQMLHIAQYLEWDPTELRPILKEMLQGMDYDRDGFVSLQEWVHGGMTTIPLLVLLGMDDSGSKGDGGHAWTMKHFKKPTYCNFCHIMLMGVRKQGLCCTYCKYTVHERCVSKNIPGCVKTYSKAKRSGEVMQHAWVEGNSSVKCDRCHKSIKCYQSVTARHCVWCRMTFHRKCELSTLCDGGELRDHILLPTSICPITRDRPGEKSDGCVSAKGELVMQYKIIPTPGTHPLLVLVNPKSGGRQGERILRKFHYLLNPKQVFNLDNGGPTPGLNFFRDTPDFRVLACGGDGTVGWILDCIDKANFAKHPPVAVLPLGTGNDLARCLRWGGGYEGGSLTKILKDIEQSPLVMLDRWHLEVIPREEVENGDQVPYSIMNNYFSIGVDASIAHRFHVMREKHPEKFNSRMKNKLWYFEFGTSETFAATCKKLHDHIELECDGVGVDLSNIFLEGIAILNIPSMYGGTNLWGENKKNRAVIRESRKGVTDPKELKFCVQGKPGMRIIVLGQCPVVGALRWMSAGLVRPHSPARTPCSVDMLTRHPMLQSLQLNPEDKNSQ

SEQ ID NO: 811077 - protein, 862 aa, Homo sapiens
MAQPGPASQPDVSLQQRVAELEKINAEFLRAQQQLEQEFNQKRAKFKELYLAKEEDLKRQNAVLQAAQDDLGHLRTQLWEAQAEMENIKAIATVSENTKQEAIDEVKRQWREEVASLQAVMKETVRDYEHQFHLRLEQERTQWAQYRESAEREIADLRRRLSEGQEEENLENEMKKAQEDAEKLRSVVMPMEKEIAALKDKLTEAEDKIKELEASKVKELNHYLEAEKSCRTDLEMYVAVLNTQKSVLQEDAEKLRKELHEVCHLLEQERQQHNQLKHTWQKANDQFLESQRLLMRDMQRMEIVLTSEQLRQVEELKKKDQEDDEQQRLNKRKDHKKADVEEEIKIPVVCALTQEESSAQLSNEEEHLDSTRGSVHSLDAGLLLPSGDPFSKSDNDMFKDGLRRAQSTDSLGTSGSLQSKALGYNYKAKSAGNLDESDFGPLVGADSVSENFDTASLGSLQMPSGFMLTKDQERAIKAMTPEQEETASLLSSVTQGMESAYVSPSGYRLVSETEWNLLQKEVHNAGNKLGRRCDMCSNYEKQLQGIQIQEAETRDQVKKLQLMLRQANDQLEKTMKDKQELEDFIKQSSEDSSHQISALVLRAQASEILLEELQQGLSQAKRDVQEQMAVLMQSREQVSEELVRLQKDNDSLQGKHSLHVSLQQAEDFILPDTTEALRELVLKYREDIINVRTAADHVEEKLKAEILFLKEQIQAEQCLKENLEETLQLEIENCKEEIASISSLKAELERIKVEKGQLESTLREKSQQLESLQEIKISLEEQLKKETAAKATVEQLMFEEKNKAQRLQTELDVSEQVQRDFVKLSQTLQVQLERIRQADSLERIRAILNDTKLTDINQLPET

SEQ ID NO: 811078 - protein, 829 aa, Homo sapiens
MAQPGPASQPDVSLQQRVAELEKINAEFLRAQQQLEQEFNQKRAKFKELYLAKEEDLKRQNAVLQAAQDDLGHLRTQLWEAQAEMENIKAIATVSENTKQEAIDEVKRQWREEVASLQAVMKETVRDYEHQFHLRLEQERTQWAQYRESAEREIADLRRRLSEGQEEENLENEMKKAQEDAEKLRSVVMPMEKEIAALKDKLTEAEDKIKELEASKVKELNHYLEAEKSCRTDLEMYVAVLNTQKSVLQEDAEKLRKELHEVCHLLEQERQQHNQLKHTWQKANDQFLESQRLLMRDMQRMEIVLTSEQLRQVEELKKKDQEDDEQQRLNKRKDHKKADVEEEIKIPVVCALTQEESSAQLSNEEEHLDSTRGSVHSLDAGLLLPSGDPFSKSDNDMFKDGLRRAQSTDSLGTSGSLQSKALGYNYKAKSAGNLDESDFGPLVGADSVSENFDTASLGSLQMPSGFMLTKDQERAIKAMTPEQEETASLLSSVTQGMESAYVSPSGYRLVSETEWNLLQKEVHNAGNKLGRRCDMCSNYEKQLQGIQIQEAETRDQVKKLQLMLRQANDQLEKTMKDKQELEDFIKQSSEDSSHQISALVLRAQASEILLEELQQGLSQAKRDVQEQMAVLMQSREQVSEELVRLQKDNDSLQGKHSLHVSLQQAEDFILPDTTEALRELVLKYREDIINVRTAADHVEEKLKAEILFLKEQIQAEQCLKENLEETLQLEIENCKEEIASISSLKAELERIKVEKGQATVEQLMFEEKNKAQRLQTELDVSEQVQRDFVKLSQTLQVQLERIRQADSLERIRAILNDTKLTDINQLPET

SEQ ID NO: 811079 - protein, 225 aa, Homo sapiens
MAQPGPASQPDVSLQQRVAELEKINAEFLRAQQQLEQEFNQKRAKFKELYLAKEEDLKRQNAVLQAAQDDLGHLRTQLWEAQAEMENIKAIATVSENTKQEAIDEVKRQWREEVASLQAVMKETVRDYEHQFHLRLEQERTQWAQYRESAEREIADLRRRLSEGQEEENLENEMKKAQEDAEKLRSVVMPMEKEIAALKDKLTEAEDKIKELEASKVMKHCNPFA

SEQ ID NO: 811080 - protein, 625 aa, Homo sapiens
MLASLQGKHSLHVSLQQAEDFILPDTTEALRELVLKYREDIINVRTAADHVEEKLKAEILFLKEQIQAEQCLKENLEETLQLEIENCKEEIASISSLKAELERIKVEKGQLESTLREKSQQLESLQEIKISLEEQLKKETAAKATVEQLMFEEKNKAQRLQTELDVSEQVQRDFVKLSQTLQVQLEADRQVDLGEKPGNLRVANGGINRVWKRRPLGGYRRRGEFPPCSKEKFFSQIKDPQAGTGHKRRAETHGGAHNNAHARRSYVIRAIYVISLKTTDVTTLTTHTTRAEQRETEERARDRKYKRTGPSGKADERRHTAGEAGTTETAGANRMREEERPHETGNRTQTRSAETHNASRQTSTAKGRQAQNERETIERKQQEEEEKGTQERHNRAREQRGSRRRQREAKGAPRANDSRTRHENRTKQKGRRERTAEKQRKHGARREAGGRRAKRGATPAEHGTPATTTHRANKRGQPGTRTDGPGAETRTGRGTKRHEGRREGEEPHTSDARNEEQNKAHTNEERERTERQTQSSRAQPKTAGTADEERGAGESVRTRERSEQQRSSNAARDEQPHSTPTATHWSKRHNEQIRGQKAQGRLAARIPSQQRAQSASYEPETTARA

SEQ ID NO: 811081 - protein, 147 aa, Homo sapiens
MAQPGPASQPDEDLKRQNAVLQAAQDDLGHLRTQLWEAQAEMENIKAIATVSENTKQEAIDEVKRQWREEVASLQAVMKETVRDYEHQFHLRLEQERTQWAQYRESAEREIADLRRRLSEGQEEENLENEMKKDPIQDTILHLVVSP

SEQ ID NO: 811082 - protein, 802 aa, Homo sapiens
MAQPGPASQPDVSLQQRVAELEKINAEFLRAQQQLEQEFNQKRAKFKELYLAKEEDLKRQNAVLQAAQDDLGHLRTQLWEAQAEMENIKAIATVSENTKQEAIDEVKRQWREEVASLQAVMKETVRDYEHQFHLRLEQERTQWAQYRESAEREIADLRRRLSEGQEEENLENEMKKAQEDAEKLRSVVMPMEKEIAALKDKLTEAEDKIKELEASKVKELNHYLEAEKSCRTDLEMYVAVLNTQKSVYRKMLRNCGKNCMKEDDEQQRLNKRKDHKKADVEEEIKIPVVCALTQEESSAQLSNEEEHLDSTRGSVHSLDAGLLLPSGDPFSKSDNDMFKDGLRRAQSTDSLGTSGSLQSKALGYNYKAKSAGNLDESDFGPLVGADSVSENFDTASLGSLQMPSGFMLTKDQERAIKAMTPEQEETASLLSSVTQGMESAYVSPSGYRLVSETEWNLLQKEVHNAGNKLGRRCDMCSNYEKQLQGIQIQEAETRDQVKKLQLMLRQANDQLEKTMKDKQELEDFIKQSSEDSSHQISALVLRAQASEILLEELQQGLSQAKRDVQEQMAVLMQSREQVSEELVRLQKDNDSLQGKHSLHVSLQQAEDFILPDTTEALRELVLKYREDIINVRTAADHVEEKLKAEILFLKEQIQAEQCLKENLEETLQLEIENCKEEIASISSLKAELERIKVEKGQLESTLREKSQQLESLQEIKISLEEQLKKETAAKATVEQLMFEEKNKAQRLQTELDVSEQVQRDFVKLSQTLQVQLERIRQADSLERIRAILNDTKLTDINQLPET

SEQ ID NO: 811083 - protein, 575 aa, Homo sapiens
RLGGGPGFKSAEGMEIVLTSEQLRQVEELKKKDQEDDEQQRLNKRKDHKKADVEEEIKIPVVCALTQEESSAQLSNEEEHLDSTRGSVHSLDAGLLLPSGDPFSKSDNDMFKDGLRRAQSTDSLGTSGSLQSKALGYNYKAKSAGNLDESDFGPLVGADSVSENFDTASLGSLQMPSGFMLTKDQERAIKAMTPEQEETASLLSSVTQGMESAYVSPSGYRLVSETEWNLLQKEVHNAGNKLGRRCDMCSNYEKQLQGIQIQEAETRDQVKKLQLMLRQANDQLEKTMKDKQELEDFIKQSSEDSSHQISALVLRAQASEILLEELQQGLSQAKRDVQEQMAVLMQSREQVSEELVRLQKDNDSLQGKHSLHVSLQQAEDFILPDTTEALRELVLKYREDIINVRTAADHVEEKLKAEILFLKEQIQAEQCLKENLEETLQLEIENCKEEIASISSLKAELERIKVEKGQLESTLREKSQQLESLQEIKISLEEQLKKETAAKATVEQLMFEEKNKAQRLQTELDVSEQVQRDFVKLSQTLQVQLERIRQADSLERIRAILNDTKLTDINQLPET

SEQ ID NO: 811084 - protein, 593 aa, Homo sapiens
AQSPFAACLSSVNAEIPETGHWPSATYVLTGMEIVLTSEQLRQVEELKKKDQEDDEQQRLNKRKDHKKADVEEEIKIPVVCALTQEESSAQLSNEEEHLDSTRGSVHSLDAGLLLPSGDPFSKSDNDMFKDGLRRAQSTDSLGTSGSLQSKALGYNYKAKSAGNLDESDFGPLVGADSVSENFDTASLGSLQMPSGFMLTKDQERAIKAMTPEQEETASLLSSVTQGMESAYVSPSGYRLVSETEWNLLQKEVHNAGNKLGRRCDMCSNYEKQLQGIQIQEAETRDQVKKLQLMLRQANDQLEKTMKDKQELEDFIKQSSEDSSHQISALVLRAQASEILLEELQQGLSQAKRDVQEQMAVLMQSREQVSEELVRLQKDNDSLQGKHSLHVSLQQAEDFILPDTTEALRELVLKYREDIINVRTAADHVEEKLKAEILFLKEQIQAEQCLKENLEETLQLEIENCKEEIASISSLKAELERIKVEKGQLESTLREKSQQLESLQEIKISLEEQLKKETAAKATVEQLMFEEKNKAQRLQTELDVSEQVQRDFVKLSQTLQVQLERIRQADSLERIRAILNDTKLTDINQLPET

SEQ ID NO: 811085 - protein, 564 aa, Homo sapiens
RRLQRTPAYVDCRPVEELKKKDQEDDEQQRLNKRKDHKKADVEEEIKIPVVCALTQEESSAQLSNEEEHLDSTRGSVHSLDAGLLLPSGDPFSKSDNDMFKDGLRRAQSTDSLGTSGSLQSKALGYNYKAKSAGNLDESDFGPLVGADSVSENFDTASLGSLQMPSGFMLTKDQERAIKAMTPEQEETASLLSSVTQGMESAYVSPSGYRLVSETEWNLLQKEVHNAGNKLGRRCDMCSNYEKQLQGIQIQEAETRDQVKKLQLMLRQANDQLEKTMKDKQELEDFIKQSSEDSSHQISALVLRAQASEILLEELQQGLSQAKRDVQEQMAVLMQSREQVSEELVRLQKDNDSLQGKHSLHVSLQQAEDFILPDTTEALRELVLKYREDIINVRTAADHVEEKLKAEILFLKEQIQAEQCLKENLEETLQLEIENCKEEIASISSLKAELERIKVEKGQLESTLREKSQQLESLQEIKISLEEQLKKETAAKATVEQLMFEEKNKAQRLQTELDVSEQVQRDFVKLSQTLQVQLERIRQADSLERIRAILNDTKLTDINQLPET

SEQ ID NO: 811086 - protein, 315 aa, Homo sapiens
RSRPVLIGRVKKLQLMLRQANDQLEKTMKDKQELEDFIKQSSEDSSHQISALVLRAQASEILLEELQQGLSQAKRDVQEQMAVLMQSREQVSEELVRLQKDNDSLQGKHSLHVSLQQAEDFILPDTTEALRELVLKYREDIINVRTAADHVEEKLKAEILFLKEQIQAEQCLKENLEETLQLEIENCKEEIASISSLKAELERIKVEKGQLESTLREKSQQLESLQEIKISLEEQLKKETAAKATVEQLMFEEKNKAQRLQTELDVSEQVQRDFVKLSQTLQVQLERIRQADSLERIRAILNDTKLTDINQLPET

SEQ ID NO: 811087 - protein, 231 aa, Homo sapiens [sequence omitted]

SEQ ID NO: 811088 - protein, 859 aa, Homo sapiens
MAQPGPASQPDVSLQQRVAELEKINAEFLRAQQQLEQEFNQKRAKFKELYLAKEEDLKRQNAVLQAAQDDLGHLRTQLWEAQAEMENIKAIATVSENTKQEAIDEVKRQWREEVASLQAVMKETVRDYEHQFHLRLEQERTQWAQYRESAEREIADLRRRLSEGQEEENLENEMKKAQEDAEKLRSVVMPMEKEIAALKDKLTEAEDKIKELEASKVKELNHYLEAEKSCRTDLEMYVAVLNTQKSVLQEDAEKLRKELHEVCHLLEQERQQHNQLKHTWQKANDQFLESQRLLMRDMQRMEIVLTSEQLRQVEELKKKDQEDDEQQRLNKRKDHKKADVEEEIKIPVVCALTQEESSAQLSNEEEHLDSTRGSVHSLDAGLLLPSGDPFSKSDNDMFKDGLRRAQSTDSLGTSGSLQSKALGYNYKAKSAGNLDESDFGPLVGADSVSENFDTASLGSLQMPSGFMLTKDQERAIKAMTPEQEETASLLSSVTQGMESAYVSPSGYRLVSETEWNLLQKEVHNAGNKLGRRCDMCSNYEKQLQGIQIQEAETRDQVKKLQLMLRQANDQLEKTMKDKQELEDFIKQSSEDSSHQISALVLRAQASEILLEELQQGLSQAKRDVQEQMAVLMQSREQVSEELVRLQKDNDSLQGKHSLHVSLQQAEDFILPDTTEALRELVLKYREDIINVRTAADHVEEKLKAEILFLKEQIQAEQCLKENLEETLQLEIENCKEEIASISSLKAELERIKVEKGQLESTLREKSQQLESLQEIKISLEEQLKKETAAKATVEQLMFEEKNKAQRLQTELDVSEQVQRDFVKLSQTLQVRHLGNHIQSTKAVLGDRTLPIPDLTTGSS

SEQ ID NO: 811089 - protein, 1272 aa, Homo sapiens
MAQPGPASQPDVSLQQRVAELEKINAEFLRAQQQLEQEFNQKRAKFKELYLAKEEDLKRQNAVLQAAQDDLGHLRTQLWEAQAEMENIKAIATVSENTKQEAIDEVKRQWREEVASLQAVMKETVRDYEHQFHLRLEQERTQWAQYRESAEREIADLRRRLSEGQEEENLENEMKKAQEDAEKLRSVVMPMEKEIAALKDKLTEAEDKIKELEASKVKELNHYLEAEKSCRTDLEMYVAVLNTQKSVLQEDAEKLRKELHEVCHLLEQERQQHNQLKHTWQKANDQFLESQRLLMRDMQRMEIVLTSEQLRQVEELKKKDQEDDEQQRLNKRKDHKKADVEEEIKIPVVCALTQEESSAQLSNEEEHLDSTRGSVHSLDAGLLLPSGDPFSKSDNDMFKDGLRRAQSTDSLGTSGSLQSKALGYNYKAKSAGNLDESDFGPLVGADSVSENFDTASLGSLQMPSGFMLTKDQERAIKAMTPEQEETASLLSSVTQGMESAYVSPSGYRLVSETEWNLLQKEVHNAGNKLGRRCDMCSNYEKQLQGIQIQEAETRDQVKKLQLMLRQANDQLEKTMKDKQELEDFIKQSSEDSSHQISALVLRAQASEILLEELQQGLSQAKRDVQEQMAVLMQSREQVSEELVRLQKDNDSLQGKHSLHVSLQQAEDFILPDTTEALRELVLKYREDIINVRTAADHVEEKLKAEILFLKEQIQAEQCLKENLEETLQLEIENCKEEIASISSLKAELERIKVEKGQLESTLREKSQQLESLQEIKISLEEQLKKETAAKATVEQLMFEEKNKAQRLQTELDVSEQVQRDFVKLSQTLQVQLRSGSGKWILGRNLGNLRVANGGINRVWKRRPLGGYRRRGEFPPCSKEKFFSQIKDPQAGTGHKRRAETHGGAHNNAHARRSYVIRAIYVISLKTTDVTTLTTHTTRAEQRETEERARDRKYKRTGPSGKADERRHTAGEAGTTETAGANRMREEERPHETGNRTQTRSAETHNASRQTSTAKGRQAQNERETIERKQQEEGRRAHRNDTTERANSAEADSRQREAKGAPRANDSRTRHENRTKQKGRRERTAEKQRKHGARREAGGRRAKRGATPAEHGTPATTTHRANKRGQPGTRTDGPGAETRTGRGTKRHEGRREGEEPHTSDARNEEQNKAHTNEERERTERQTQSSRAQPKTAGTADEERGAGESVRTRERSEQQRSSNAARDEQPQQHADRNALEQTAQRADPRAKAQGRLAARIPSQQRAQSASYEPETTAR

SEQ ID NO: 811090 - protein, 690 aa, Homo sapiens
MAQPGPASQPDVSLQQRVAELEKINAEFLRAQQQLEQEFNQKRAKFKELYLAKEEDLKRQNAVLQAAQDDLGHLRTQLWEAQAEMENIKAIATVSENTKQEAIDEVKRQWREEVASLQAVMKETVRDYEHQFHLRLEQERTQWAQYRESAEREIADLRRRLSEGQEEENLENEMKKAQEDAEKLRSVVMPMEKEIAALKDKLTEAEDKIKELEASKVKELNHYLEAEKSCRTDLEMYVAVLNTQKSVLQEDAEKLRKELHEVCHLLEQERQQHNQLKHTWQKANDQFLESQRLLMRDMQRMEIVLTSEQLRQVEELKKKDQEDDEQQRLNKRKDHKKADVEEEIKIPVVCALTQEESSAQLSNEEEHLDSTRGSVHSLDAGLLLPSGDPFSKSDNDMFKDGLRRAQSTDSLGTSGSLQSKALGYNYKAKSAGNLDESDFGPLVGADSVSENFDTASLGSLQMPSGFMLTKDQERAIKAMTPEQEETASLLSSVTQGMESAYVSPSGYRLVSETEWNLLQKEVHNAGNKLGRRCDMCSNYEKQLQGIQIQEAETRDQVKKLQLMLRQANDQLEKTMKDKQELEDFIKQSSEDSSHQISALVLRAQASEILLEELQQGLSQAKRDVQEQMAVLMQSREQVSEELVRLQKDNDSLQGKHSLHVSLQQAEDFILPDTTEALRLVFTGRAIICAG

SEQ ID NO: 811091 - protein, 225 aa, Homo sapiens; identical to SEQ ID NO: 811079

SEQ ID NO: 811092 - protein, 225 aa, Homo sapiens; identical to SEQ ID NO: 811079

SEQ ID NO: 811093 - protein, 190 aa, Homo sapiens
MAQPGPASQPDVSLQQRVAELEKINAEFLRAQQQLEQEFNQKRAKFKELYLAKEEDLKRQNAVLQAAQDDLGHLRTQLWEAQAEMENIKAIATVSENTKQEAIDEVKRQWREEVASLQAVMKETVRDYEHQFHLRLEQERTQWAQYRESAEREIADLRRRLSEGQEEENLENEMKKDPIQDTILHLVVSP

SEQ ID NO: 811094 - protein, 195 aa, Homo sapiens
VIISKLRLSLVFILIWELNILLFLLFIAKHNVKVILWFRGVSRGPSPVSLGNQDTLPVAVALTESVNAYFKGADPTKCIVKITGDMTMSFPSGIIKVFTSNPTPAVLCFRVKNISRLEQILPNAQLVFRKGTSDLLAWDPLFGPSLDSSSSSSLTSSSSARPTTPLSVGTIVPPPRPASRPKLTSGKLSGINEGY

SEQ ID NO: 811095 - protein, 750 aa, Homo sapiens
MVAPSVLSNIQVVVPVDGGVTNMQSLPPAIWNAEQMKAFWKLSSISEKSENGGSGSLRAKFDLSEGPSKPTTLAVQFLSEGSTLSGVDFELVGTGYRLSLIKKRFATGRYLADVDGPGKVMWLQGLQTCHSALSVLSKHYFNLYDVFQTETYLRADYNTLNRTFKVSIEINSTEMILYVVNDQLQYSGSTFIQILSKNEVFVGLIFEIISSVYVEKKGYSVISGLKFQKKQAQSNLAFHTFLESEITLKFHKFDIQWIQIEHEFKVLGNVNSEHLIKLSYVPEGNQTRVQVDMQKIYNLILINILIKYEVMFYMIFKKNSQDAMCFKISLQMTAETFTSAVSYLYRSCDFFDEFNAVDLIYFYMELHNVCLLKQYTKTRDVPIQFVFINVPHFFSQSESSVQNLTVIKHFYKIFAIFVNIFGLQLGRGFRVIKPNLRILAHFFGDTLYPLEREINPMACVYRKKDYLQILDINLIKKCVNFKTNSKKTIVLNGNWYFDSQFSIFLDTLSLKIYAFIYCLCCEHEFYEYFVRDAFFKRLILETEGEALPFVFISTIGKITNLYILIIQFLLVKIGKLFEVIYLVKHFKNKLPILNSKKPNFSSKSLLIEEIKYFWIRFHNLQMGISFIIINMSVLYLPSRSDEIVLYMIIYIKPLIVPLSFTENKTSITRHLCNILLYKIQQKIYSLAIYNTVYAFLYIQCYAQVWNLHLTKAAHKIIAKMLIFTKKGAKLEFLTLICALLNANYSPLLEF

SEQ ID NO: 811096 - protein, 917 aa, Homo sapiens
MGCNWTPQCASGELPFPLEAFLVHIKVWDLEATGHHWAWKGIIVLTTDVISETRPPEKSSTWSPDRCEASHPAEPAIALSALGIWKCSASTTDLRVDYKYNPEAMVAPSVLSNIQVVVPVDGGVTNMQSLPPAIWNAEQMKAFWKLSSISEKSENGGSGSLRAKFDLSEGPSKPTTLAVQFLSEGSTLSGVDFELVGTGYRLSLIKKRFATGRYLADCDGPGKVMWLQGLQTCHSALSVLSKHYFNLYDVFQTYTYLRADYKHYNRTFKVSLEINSTEMILYVVNDQLQYSGSTFIQILSKNEVFVGLIFKLFPVSMLKKRVIVYIRPKVSEEQAQSNLAFHTFLESEITLKFHKFDIQWIQIEHEFKVLGNVNSEHLIKLSYVPEGNQTRVQVDMQKIYNLILINILIKYKMMFYMIFKKNSQVQCAFKISLQMTAETFTSAVSYLYRSCDFFDELNAVDLIYFYMELHNVLPFKTFFSQSESSVQNLTVIKHFYKIFAIFVNIFGLQLGRGFRVIKPNLRILAHFFGDTLYPLEREINPMACVYRKKDYLQILDINLIKKCVNFKTNSKKTIVLNGNWYFDSQFSIFLDTLSLKIYDLFTDCVVNMSFMVFVRDAFFKRLILETEGEALPFVFISTIGKITNLYILIIQFLLVKIGKLFEVIYLVKHFKNKLPILNSKKPNFSSKSLLIEEIKYFWIRFHNLQMGISFIIINMSVLYLPSRSDEIVLYMIIYIKPLIVPLSFTENKTSITRHLCNILLYKIQQKIYSLAIYNTVYAFLYIQCYAQVWNLHLTKAAHKIIAKMLIFTKKGAKLEFLTLILCSFKCQLQSLTGILTVICFAIKLLLGQPIFYYWNSDTVLTVFVFNQILPKNVQISEMVKLLHFLSYHSLHTKYWVQVTILKPYEFILIFFFHLKIH

SEQ ID NO: 811097 - protein, 534 aa, Homo sapiens
YIYFKGIKPRKRKTFALPGIIKKEKDAESVECPDADSLNIPDVDEEGYSIKPETNQNDTKENHFYSSSDSDSEDEEPKKYRIEIKPMHPNNSHHTMASLDELKVSIGNITLSPAISVSTVQMNRNLSNEELTKSKPSAPPNEKGTSDLLAWDPLFGPSLDSSSSSSLTSSSSARPTTPLSVGTIVPPPRPASRPKLTSGKLSGINEIPRPFSPPVTSNTSPPPAAPLARAESSSSISSSASLSAANTPTVGVSRGPSPVSLGNQDTLPVAVALTESVNAYFKGADPTKCIVKITGDMTMSFPSGIIKVFTSNPTPAVLCFRVKNISRLEQILPNAQLVFSDPSQCDSNTKDFWMNMQAVTVYLKKLSEQNPAASYYNVDVLKYQVSSNGIQSTPLNLATYWKCSASTTDLRVDYKYNPEAMVAPSVLSNIQVVVPVDGGVTNMQSLPPAIWNAEQMKAFWKLSSISEKSENGGSGSLRAKFDLSEGPSKPTTLAVQFLSEGSTLSGVDFELVGTGYRLSLIKKRFATGRYLADC

SEQ ID NO: 811098 - protein, 491 aa, Homo sapiens
MKKATVLNQKQIRMISKENHFYSSSDSDSEDEEPKKYRIEIKPMHPNNSHHTMASLDELKVSIGNITLSPAISVSTVQMNRNLSNEELTKSKPSAPPNEKGTSDLLAWDPLFGPSLDSSSSSSLTSSSSARPTTPLSVGTIVPPPRPASRPKLTSGKLSGINEIPRPFSPPVTSNTSPPPAAPLARAESSSSISSSASLSAANTPTVGVSRGPSPVSLGNQDTLPVAVALTESVNAYFKGADPTKCIVKITGDMTMSFPSGIIKVFTSNPTPAVLCFRVKNISRLEQILPNAQLVFSDPSQCDSNTKDFWMNMQAVTVYLKKLSEQNPAASYYNVDVLKYQVSSNGIQSTPLNLATYWKCSASTTDLRVDYKYNPEAMVAPSVLSNIQVVVPVDGGVTNMQSLPPAIWNAEQMKAFWKLSSISEKSENGGSGSLRAKFDLSEGPSKPTTLAVQFLSEGSTLSGVDFELVGTGYRLSLIKKRFATGRYLADC

SEQ ID NO: 811099 - protein, 512 aa, Homo sapiens
YIYFKGIKPRKRKTFALPGIIKKEKDAESVECPDADSLNIPDVDEEGYSIKPETNQNDTKENHFYSSSDSDSEDEEPKKYRIEIKPMHPNNSHHTMASLDELKVSIGNITLSPAISVSTVQMNRNLSNEELTKSKPSAPPNEKGTSDLLAWDPLFGPSLDSSSSSSLTSSSSARPTTPLSVGTIVPPPRPASRPKLTSGKLSGINEIPRPFSPPVTSNTSPPPAAPLARAESSSSISSSASLSAANTPTVGVSRGPSPVSLGNQDTLPVAVALTESVNAYFKGADPTKCIVKITGDMTMSFPSGIIKVFTSNPTPAVLCFRVKNISRLEQILPNAQLVFSDPSQCDSNTKDFWMNMQAVTVYLKKLSEQNPAASYYNVDVLKYQVSSNGIQSTPLNLATYWKCSASTTDLRVDYKYNPEAMVAPSVLSNIQVVVPVDGGVTNMQSLPPAIWNAEQMKAFWKLSSISEKSENGVQFLSEGSTLSGVDFELVGTGYRLSLIKKRFATGRYLADC

SEQ ID NO: 811100 - protein, 451 aa, Homo sapiens
YIYFKGIKPRKRKTFALPGIIKKEKDAESVECPDADSLNIPDVDEEGYSIKPETNQNDTKENHFYSSSDSDSEDEEPKKYRIEIKPMHPNNSHHTMASLDELKVSIGNITLSPAISVSTVQMNRNLSNEELTKSKPSAPPNEKGTSDLLAWDPLFGPSLDSSSSSSLTSSSSARPTTPLSVGTIVPPPRPASRPKLTSGKLSGINEIPRPFSPPVTSNTSPPPAAPLARAESSSSISSSASLSAANTPTVGVSRGPSPVSLGNQDTLPVAVALTESVNAYFKGADPTKCIVKITGDMTMSFPSGIIKVFTSNPTPAVLCFRVKNISRLEQILPNAQLVFSDPSQCDSNTKDFWMNMQAVTVYLKKLSEQNPAASYYNVDVLKYQVSSNGIQSTPLNLATYWKCSASTTDLRVDYKYNPEAMVAPSVLSNIQVVVPVDGGVTNMQSLPPAIW

SEQ ID NO: 811101 - protein, 135 aa, Homo sapiens
MKKATVLNQKQIRMISKENHFYSSSDSDSEDEEPKKYRIEIKPMHPNNSHHTMASLDELKVSIGNITLSPAISVSTVQMNRNLSNEELTKSKPSAPPNEKGTSDLLAWDPLFGPSLDSSSSSSLTSSSSGKYIYV

SEQ ID NO: 811102 - protein, 666 aa, Homo sapiens
MAAGGSTQQRRREMAAASAAAISGAGRCRLSKIGATRRPPPARVRVAVRLRPFVDGTAGASDPPCVRGMDSCSLEIANWRNHQETLKYQFDAFYGERSTQQDIYAGSVQPILRHLLEGQNASVLAYGPTGAGKTHTMLGSPEQPGVIPRALMDLLQLTREEGAEGRPWALSVTMSYLEIYQEKVLDLLDPASGDLVIREDCRGNILIPGLSQKPISSFADFERHFLPASRNRTVGATRLNQRSSRSHAVLLVKVDQRERLAPFRQREGKLYLIDLAGSEDNRRTGNKGLRLKESGAINTSLFVLGKVVDALNQGLPRVPYRDSKLTRLLQDSLGGSAHSILIANIAPERRFYLDTVSALNFAARSKEVINRPFTNESLQPHALGPVKLSQKELLGPPEAKRARGPEEEEIGSPEPMAAPASASQKLSPLQKLSSMDPAMLERLLSLDRLLASQGSQGAPLLSTPKRERMVLMKTVEEKDLEIERLKTKQKELEAKMLAQKAEEKENHCPTMLRPLSHRTVTGAKPLKKAVVMPLQLIQEQAASPNAEIHILKNKGRKRKQLESLDALEPEEKAEDCWELQISPELLAHGRQKILDLLNEGSARDLRSLQRIGPKKAQLIVGWRELHGPFSQVEDLERVEGITGKQMESFLKANILGLAAGQRCGAS

SEQ ID NO: 811103 - protein, 725 aa, Homo sapiens
GEFEWERRAQGGSGMAAGGSTQQRRREMAAASAAAISGAGRCRLSKIGATRRPPPARVRVAVRLRPFVDGTAGASDPPCVRGMDSCSLEIANWRNHQETLKYQFDAFYGERSTQQDIYAGSVQPILRHLLEGQNASVLAYGPTGAGKTHTMLGSPEQPGVIPRALMDLLQLTREEGAEGRPWALSVTMSYLEIYQEKVLDLLDPASGDLVIREDCRGNILIPGLSQKPISSFADFERHFLPASRNRTVGATRLNQRSSRSHAVLLVKVDQRERLAPFRQREGKLYLIDLAGSEDNRRTGNKGLRLKESGAINTSLFVLGKVVDALNQGLPRVPYRDSKLTRLLQVRPTCLREEGAAEGGSQACCGVGNSSVRHEEGWASDPPTAWSHPQDSLGGSAHSILIANIAPERRFYLDTVSALNFAARSKEVINRPFTNESLQPHALGPVKLSQKELLGPPEAKRARGPEEEEIGSPEPMAAPASASQKLSPLQKLSSMDPAMLERLLSLDRLLASQGSQGAPLLSTPKRERMVLMKTVEEKDLEIERLKTKQKELEAKMLAQKAEEKENHCPTMLRPLSHRTVTGAKPLKKAVVMPLQLIQEQAASPNAEIHILKNKGRKRKQLESLDALEPEEKAEDCWELQISPELLAHGRQKILDLLNEGSARDLRSLQRIGPKKAQLIVGWRELHGPFSQVEDLERVEGITGKQMESFLKANILGLAAGQRCGAS

SEQ ID NO: 811104 - protein, 666 aa, Homo sapiens; identical to SEQ ID NO: 811102

SEQ ID NO: 811105 - protein, 683 aa, Homo sapiens
MAAGGSTQQRRREMAAASAAAISGAGRCRLSKIGATRRPPPARVRVAVRLRPFVDGTAGASDPPCVRGMDSCSLEIANWRNHQETLKYQFDAFYGERSTQQDIYAGSVQPILRHLLEGQNASVLAYGPTGAGKTHTMLGSPEQPGVIPRALMDLLQLTREEGAEGRPWALSVTMSYLEIYQEKVLDLLDPASGDLVIREDCRGNILIPGLSQKPISSFADFERHFLPASRNRTVGATRLNQRSSRSHAVLLVKVDQRERLAPFRQREGKLYLIDLAGSEDNRRTGNKGLRLKESGAINTSLFVLGKVVDALNQGLPRVPYRDSKLTRLLQDSLGGSAHSILIANIAPERRFYLDTVSALNFAARSKEVINRPFTNESLQPHALGPVKLSQKELLGPPEAKRARGPEEEEIGSPEPMAAPASASQKLSPLQKLSSMDPAMLERLLSLDRLLASQGSQGAPLLSTPKRERMVLMKTVEEKDLEIEAALELGLDHISLILSNQRLKTKQKELEAKMLAQKAEEKENHCPTMLRPLSHRTVTGAKPLKKAVVMPLQLIQEQAASPNAEIHILKNKGRKRKQLESLDALEPEEKAEDCWELQISPELLAHGRQKILDLLNEGSARDLRSLQRIGPKKAQLIVGWRELHGPFSQVEDLERVEGITGKQMESFLKANILGLAAGQRCGAS

SEQ ID NO: 811106 - protein, 666 aa, Homo sapiens; identical to SEQ ID NO: 811102

SEQ ID NO: 811107 - protein, 572 aa, Homo sapiens
MAAGGSTQQRRREMAAASAAAISGAGRCRLSKIGATRRPPPARVRVAVRLRPFVDGTAGASDPPCVRGMDSCSLEIANWRNHQETLKYQFDAFYGERSTQQDIYAGSVQPILRHLLEGQNASVLAYGPTGAGKTHTMLGSPEQPGVIPRALMDLLQLTREEGAEGRPWALSVTMSYLEIYQEKVLDLLDPASGDLVIREDCRGNILIPGLSQKPISSFADFERHFLPASRNRTVGATRLNQRSSRSHAVLLVKVDQRERLAPFRQREGKLYLIDLAGSEDNRRTGNKGLRLKESGAINTSLFVLGKVVDALNQGLPRVPYRDSKLTRLLQDSLGGSAHSILIANIAPERRFYLDTVSALNFAARSKEVINRPFTNESLQPHALGPVKLSQKELLGPPEAKRARGPEEEEIGSPEPMAAPASASQKLSPLQKLSSMDPAMLERLLSLDRLLASQGSQGAPLLSTPKRERMVLMKTVEEKDLEIERLKTKQKELEAKMLAQKAEEKENHCPTMLRPLSHRTVTGAKPLKKAVVMPLQLIQEQAASPNAEIHILKNKGRKRKQLHEKGANITTGY

SEQ ID NO: 811108 - protein, 572 aa, Homo sapiens; identical to SEQ ID NO: 811107

SEQ ID NO: 811109 - protein, 666 aa, Homo sapiens; identical to SEQ ID NO: 811102

SEQ ID NO: 811110 - protein, 669 aa, Homo sapiens
MAAGGSTQQRRREMAAASAAAISGAGRCRLSKIGATRRPPPARVRVAVRLRPFVDGTAGASDPPCVRGMDSCSLEIANWRNHQETLKYQFDAFYGERSTQQDIYAGSVQPILRHLLEGQNASVLAYGPTGAGKTHTMLGSPEQPGVIPRALMDLLQLTREEGAEGRPWALSVTMSYLEIYQEKVLDLLDPASGDLVIREDCRGNILIPGLSQKPISSFADFERHFLPASRNRTVGATRLNQRSSRSHAVLLVKVDQRERLAPFRQREGKLYLIDLAGSEDNRRTGNKGLRLKESGAINTSLFVLGKVVDALNQGLPRVPYRDSKLTRLLQDSLGGSAHSILIANIAPERRFYLDTVSALNFAARSKEVINRPFTNESLQPHALGPVKLSQKELLGPPEAKRARGPEEEEIGSPEPMAAPASASQKLSPLQKLSSMDPAMLERLLSLDRLLASQGSQGAPLLSTPKRERMVLMKTVEEKDLEIERLKTKQKELEAKMLAQKAEEKENHCPTMLRPLSHRTVTGAKPLKKAVVMPLQLIQEQAASPNAEIHILKNKGRKRKQLESLDALEPEEKAEDCWELQISPELLAHGRQKILDLLNEGSARDLRSLQRIGPKKAQLIVGWRELHGPFSQVEDLERVEGITGKQMESFLKVKSRPCPSSACPAPRAPL

SEQ ID NO: 811111 - protein, 695 aa, Homo sapiens
MAAGGSTQQRRREMAAASAAAISGAGRCRLSKIGATRRPPPARVRVAVRLRPFVDGTAGASDPPCVRGMDSCSLEIANWRNHQETLKYQFDAFYGERSTQQDIYAGSVQPILRHLLEGQNASVLAYGPTGAGKTHTMLGSPEQPGVIPRALMDLLQLTREEGAEGRPWALSVTMSYLEIYQEKVLDLLDPASGDLVIREDCRGNILIPGLSQKPISSFADFERHFLPASRNRTVGATRLNQRSSRSHAVLLVKVDQRERLAPFRQREGKLYLIDLAGSEDNRRTGNKGLRLKESGAINTSLFVLGKVVDALNQGLPRVPYRDSKLTRLLQDSLGGSAHSILIANIAPERRFYLDTVSALNFAARSKEVINRPFTNESLQPHALGPVKLSQKELLGPPEAKRARGPEEEEIGSPEPMAAPASASQKLSPLQKLSSMDPAMLERLLSLDRLLASQGSQGAPLLSTPKRERMVLMKTVEEKDLEIERLKTKQKELEAKMLAQKAEEKENHCPTMLRPLSHRTVTGAKPLKKAVVMPLQLIQEQAASPNAEIHILKNKGRKRKQLESLDALEPEEKAEDCWELQISPELLAHGRQKILDLLNEGSARDLRSLQRIGPKKAQLIVGWRELHGPFSQVAAHWTGGGRGRGRPGTPETLSPIDPVPQVEDLERVEGITGKQMESFLKANILGLAAGQRCGAS

SEQ ID NO: 811112 - protein, 738 aa, Homo sapiens
MAAGGSTQQRRREMAAASAAAISGAGRCRLSKIGATRRPPPARVRVAVRLRPFVDGTAGASDPPCVRGMDSCSLEIANWRNHQETLKYQFDAFYGERSTQQDIYAGSVQPILRHLLEGQNASVLAYGPTGAGKTHTMLGSPEQPGVIPRALMDLLQLTREEGAEGRPWALSVTMSYLEIYQEKVLDLLDPASGDLVIREDCRGNILIPGLSQKPISSFADFERHFLPASRNRTVGATRLNQRSSRSHAVLLVKVDQRERLAPFRQREGKLYLIDLAGSEDNRRTGNKGLRLKESGAINTSLFVLGKVVDALNQGLPRVPYRDSKLTRLLQDSLGGSAHSILIANIAPERRFYLDTVSALNFAARSKEVINRPFTNESLQPHALGPVKLSQKELLGPPEAKRARGPEEEEIGSPEPMAAPASASQKLSPLQKLSSMDPAMLERLLSLDRLLASQGSQGAPLLSTPKRERMVLMKTVEEKDLEIERLKTKQKELEAKMLAQKAEEKENHCPTMLRPLSHRTVTGAKPLKKAVVMPLQLIQEQAASPNAEIHILKNKGRKRKQLESLDALEPEEKAEDCWELQISPELLAHGRQKILDLLNEGSARDLRSLQRIGPKKAQLIVGWRELHGPFSQVAAHWTGGGRGRGRPGTPETLSPIDPVPPGGGPGTRGGHNGETDGVLPEGEVTALPLLCLSCAPRPSLTSLSPSLLCCRQTSWVSPPASAVAPPDRRLLTPPFQIFV

SEQ ID NO: 811113 - protein, 572 aa, Homo sapiens; identical to SEQ ID NO: 811107

SEQ ID NO: 811114 - protein, 572 aa, Homo sapiens; identical to SEQ ID NO: 811107

SEQ ID NO: 811115 - protein, 576 aa, Homo sapiens
MAAGGSTQQRRREMAAASAAAISGAGRCRLSKIGATRRPPPARVRVAVRLRPFVDGTAGASDPPCVRGMDSCSLEIANWRNHQETLKYQFDAFYGERSTQQDIYAGSVQPILRHLLEGQNASVLAYGPTGAGKTHTMLGSPEQPGVIPRALMDLLQLTREEGAEGRPWALSVTMSYLEIYQEKVLDLLDPASGDLVIREDCRGNILIPGLSQKPISSFADFERHFLPASRNRTVGATRLNQRSSRSHAVLLVKVDQRERLAPFRQREGKLYLIDLAGSEDNRRTGNKGLRLKESGAINTSLFVLGKVVDALNQGLPRVPYRDSKLTRLLQDSLGGSAHSILIANIAPERRFYLDTVSALNFAARSKEVINRPFTNESLQPHALGPVKLSQKELLGPPEAKRARGPEEEEIGSPEPMAAPASASQKLSPLQKLSSMDPAMLERLLSLDRLLASQGSQGAPLLSTPKRERMVLMKTVEEKDLEIERLKTKQKELEAKMLAQKAEEKENHCPTMLRPLSHRTVTGAKPLKKAVVMPLQLIQEQAASPNAEIHILKNKGRKRKVKVAGGLGYTWSPEVRG

SEQ ID NO: 811116 - protein, 598 aa, Homo sapiens
MDSCSLEIANWRNHQETLKYQFDAFYGERSTQQDIYAGSVQPILRHLLEGQNASVLAYGPTGAGKTHTMLGSPEQPGVIPRALMDLLQLTREEGAEGRPWALSVTMSYLEIYQEKVLDLLDPASGDLVIREDCRGNILIPGLSQKPISSFADFERHFLPASRNRTVGATRLNQRSSRSHAVLLVKVDQRERLAPFRQREGKLYLIDLAGSEDNRRTGNKGLRLKESGAINTSLFVLGKVVDALNQGLPRVPYRDSKLTRLLQDSLGGSAHSILIANIAPERRFYLDTVSALNFAARSKEVINRPFTNESLQPHALGPVKLSQKELLGPPEAKRARGPEEEEIGSPEPMAAPASASQKLSPLQKLSSMDPAMLERLLSLDRLLASQGSQGAPLLSTPKRERMVLMKTVEEKDLEIERLKTKQKELEAKMLAQKAEEKENHCPTMLRPLSHRTVTGAKPLKKAVVMPLQLIQEQAASPNAEIHILKNKGRKRKQLESLDALEPEEKAEDCWELQISPELLAHGRQKILDLLNEGSARDLRSLQRIGPKKAQLIVGWRELHGPFSQVEDLERVEGITGKQMESFLKANILGLAAGQRCGAS

SEQ ID NO: 811117 - protein, 598 aa, Homo sapiens; identical to SEQ ID NO: 811116

SEQ ID NO: 811118 - protein, 666 aa, Homo sapiens
MAAGGSTQQRRREMAAASAAAISGAGRCRLSKIGATRRPPPARVRVAVRLRPFVDGTAGASDPPCVRGMDSCSLEIANWRNHQETLKYQFDAFYGERSTQQDIYAGSVQPILRHLLEGQNASVLAYGPTGAGKTHTMLGSPEQPGVIPRALMDLLQLTREEGAEGRPWALSVTMSYLEIYQEKVLDLLDPASGDLVIREDCRGNILIPGLSQKPISSFADFERHFLPASRNRTVGATRLNEGGGGGGGGGGGEVDQRERLAPFRQREGKLYLIDLAGSEDNRRTGNKGLRLKESGAINTSLFVLGKVVDALNQGLPRVPYRDSKLTRLLQDSLGGSAHSILIANIAPERRFYLDTVSALNFAARSKEVINRPFTNESLQPHALGPVKLSQKELLGPPEAKRARGPEEEEIGSPEPMAAPASASQKLSPLQKLSSMDPAMLERLLSLDRLLASQGSQGAPLLSTPKRERMVLMKTVEEKDLEIERLKTKQKELEAKMLAQKAEEKENHCPTMLRPLSHRTVTGAKPLKKAVVMPLQLIQEQAASPNAEIHILKNKGRKRKQLESLDALEPEEKAEDCWELQISPELLAHGRQKILDLLNEGSARDLRSLQRIGPKKAQLIVGWRELHGPFSQVEDLERVEGITGKQMESFLKANILGLAAGQRCGAS

SEQ ID NO: 811119 - protein, 639 aa, Homo sapiens
MAAGGSTQQRRREMAAASAAAISGAGRCRLSKIGATRRPPPARVRVAVRLRPFVDGTAGASDPPCVRGMDSCSLEIANWRNHQETLKYQFDAFYGERSTQQDIYAGSVQPILRHLLEGQNASVLAYGPTGAGKTHTMLGSPEQPGVIPRALMDLLQLTREEGAEGRPWALSVTMSYLEIYQEKSQKPISSFADFERHFLPASRNRTVGATRLNQRSSRSHAVLLVKVDQRERLAPFRQREGKLYLIDLAGSEDNRRTGNKGLRLKESGAINTSLFVLGKVVDALNQGLPRVPYRDSKLTRLLQDSLGGSAHSILIANIAPERRFYLDTVSALNFAARSKEVINRPFTNESLQPHALGPVKLSQKELLGPPEAKRARGPEEEEIGSPEPMAAPASASQKLSPLQKLSSMDPAMLERLLSLDRLLASQGSQGAPLLSTPKRERMVLMKTVEEKDLEIERLKTKQKELEAKMLAQKAEEKENHCPTMLRPLSHRTVTGAKPLKKAVVMPLQLIQEQAASPNAEIHILKNKGRKRKQLESLDALEPEEKAEDCWELQISPELLAHGRQKILDLLNEGSARDLRSLQRIGPKKAQLIVGWRELHGPFSQVEDLERVEGITGKQMESFLKANILGLAAGQRCGAS

SEQ ID NO: 811120 - protein, 430 aa, Homo sapiens
MAVSQRSSRSHAVLLVKVDQRERLAPFRQREGKLYLIDLAGSEDNRRTGNKGLRLKESGAINTSLFVLGKVVDALNQGLPRVPYRDSKLTRLLQDSLGGSAHSILIANIAPERRFYLDTVSALNFAARSKEVINRPFTNESLQPHALGPVKLSQKELLGPPEAKRARGPEEEEIGSPEPMAAPASASQKLSPLQKLSSMDPAMLERLLSLDRLLASQGSQGAPLLSTPKRERMVLMKTVEEKDLEIERLKTKQKELEAKMLAQKAEEKENHCPTMLRPLSHRTVTGAKPLKKAVVMPLQLIQEQAASPNAEIHILKNKGRKRKQLESLDALEPEEKAEDCWELQISPELLAHGRQKILDLLNEGSARDLRSLQRIGPKKAQLIVGWRELHGPFSQVEDLERVEGITGKQMESFLKANILGLAAGQRCGAS

SEQ ID NO: 811121 - protein, 435 aa, Homo sapiens
MTAGGALVEPGGSYSHAVLLVKVDQRERLAPFRQREGKLYLIDLAGSEDNRRTGNKGLRLKESGAINTSLFVLGKVVDALNQGLPRVPYRDSKLTRLLQDSLGGSAHSILIANIAPERRFYLDTVSALNFAARSKEVINRPFTNESLQPHALGPVKLSQKELLGPPEAKRARGPEEEEIGSPEPMAAPASASQKLSPLQKLSSMDPAMLERLLSLDRLLASQGSQGAPLLSTPKRERMVLMKTVEEKDLEIERLKTKQKELEAKMLAQKAEEKENHCPTMLRPLSHRTVTGAKPLKKAVVMPLQLIQEQAASPNAEIHILKNKGRKRKQLESLDALEPEEKAEDCWELQISPELLAHGRQKILDLLNEGSARDLRSLQRIGPKKAQLIVGWRELHGPFSQVEDLERVEGITGKQMESFLKANILGLAAGQRCGAS

SEQ ID NO: 811122 - protein, 251 aa, Homo sapiens
MAAPASASQKLSPLQKLSSMDPAMLERLLSLDRLLASQGSQGAPLLSTPKRERMVLMKTVEEKDLEIERLKTKQKELEAKMLAQKAEEKENHCPTMLRPLSHRTVTGAKPLKKAVVMPLQLIQEQAASPNAEIHILKNKGRKRKQLESLDALEPEEKAEDCWELQISPELLAHGRQKILDLLNEGSARDLRSLQRIGPKKAQLIVGWRELHGPFSQVEDLERVEGITGKQMESFLKANILGLAAGQRCGAS

SEQ ID NO: 811123 - protein, 249 aa, Homo sapiens
MDPAMLERLLSLDRLLASQGSQGAPLLSTPKRERMVLMKTVEEKDLEIEAALELGLDHISLILSNQRLKTKQKELEAKMLAQKAEEKENHCPTMLRPLSHRTVTGAKPLKKAVVMPLQLIQEQAASPNAEIHILKNKGRKRKQLESLDALEPEEKAEDCWELQISPELLAHGRQKILDLLNEGSARDLRSLQRIGPKKAQLIVGWRELHGPFSQVEDLERVEGITGKQMESFLKANILGLAAGQRCGAS

SEQ ID NO: 811124 - protein, 70 aa, Homo sapiens
HTMLGSPEQPGVIPRALMDLLQLTREEGAEGRPWALSVTMSYLEIYQEKEAPCWLGEEQQRVKVRPGSRT

SEQ ID NO: 811125 - protein, 166 aa, Homo sapiens
YTKNSLLHQVLHSQSRHVEVRMACIHYLRENREKFEAFIEGSFEEYLKRLENPQEWVGQVEISALSLMYRKDFIIYREPNVSPSQVTENNFPEKVLLCFSNGNHYDIVYPIKYKESSAMCQSLLYELLYEKVFKTDVSKIVMELDTLEVADEDNSEISDSEDDSCK

SEQ ID NO: 811126 - protein, 292 aa, Homo sapiens
MEAAVGVPDGGDQGGAGPREDATPMDAYLRKLGLYRKLVAKDGSCLFRAVAEQVLHSQSRHVEVRMACIHYLRENREKFEAFIEGSFEEYLKRLENPQEWVGQVEISALSLMYRKDFIIYREPNVSPSQVTENNFPEKVLLCFSNGNHYDIVYPIKYKESSAMCQSLLYELLYEKVFKTDVSKIVMELDTLEVADEDNSEISDSEDDSCKSKTAAAAADVNGFKPLSGNEQLKNNGNSTSLPLSRKVLKSLNPAVYRNVEYEIWLKSKQAQQKRDYSIAAGLQYEVGDKCQV

SEQ ID NO: 811127 - protein, 2261 aa, Homo sapiens [sequence omitted]

SEQ ID NO: 811128 - protein, 363 aa, Homo sapiens
MACWPQLRLLLWKNLTFRRRQTCQLLLEVAWPLFIFLILISVRLSYPPYEQHECHFPNKAMPSAGTLPWVQGIICNANNPCFRYPTPGEAPGVVGNFNKSIVARLFSDARRLLLYSQKDTSMKDMRKVLRTLQQIKKSSSNLKLQDFLVDNETFSGFLYHNLSLPKSTVDKMLRADVILHKVFLQGYQLHLTSLCNGSKSEEMIQLGDQEVSELCGLPREKLAAAERVLRSNMDILKPILMDVACDDIAHGQLTVPRSAAVAATGDAKPNMMGRETLLSICASVPKVEFHERHILEHFSFCVCVSVSLFPAKGIVSFSWASFRIWVLWKAVFWQHGESMAVWEGQLGLGLNIAFEYFTSIDVG

SEQ ID NO: 811129 - protein, 123 aa, Homo sapiens
MPSAGTLPWVQGIICNANNPCFRYPTPGEAPGVVGNFNKSIVARLFSDARRLLLYSQKDTSMKDMRKVLRTLQQIKKSSSNLKLQDFLVDNETFSGFLYHNLSLPKSTVDKMLRADVILHKVS

SEQ ID NO: 811130 - protein, 138 aa, Homo sapiens
CSRGNFFKKEINQSWMDVACDDIAHGQLTVPRSAAVAATGDAKPNMMGRETLLSICASVPKVEFHERHILEHFSFCVCVSVSLFPAKGIVSFSWASFRIWVLWKAVFWQHGESMAVWEGQLGLGLNIAFEYFTSIDVG

SEQ ID NO: 811131 - protein, 2261 aa, Homo sapiens [sequence omitted]

SEQ ID NO: 811132 - protein, 2261 aa, Homo sapiens [sequence omitted]

SEQ ID NO: 811133 - protein, 1987 aa, Homo sapiens
MRSWSDMRQEVMFLTNVNSSSSSTQIYQAVSRIVCGHPEGGGLKIKSLNWYEDNNYKALFGGNGTEEDAETFYDNSTTPYCNDLMKNLESSPLSRIIWKALKPLLVGKILYTPDTPATRQVMAEVNKTFQELAVFHDLEGMWEELSPKIWTFMENSQEMDLVRMLLDSRDNDHFWEQQLDGLDWTAQDIVAFLAKHPEDVQSSNGSVYTWREAFNETNQAIRTISRFMECVNLNKLEPIATEVWLINKSMELLDERKFWAGIVFTGITPGSIELPHHVKYKIRMDIDNVERTNKIKDGYWDPGPRADPFEDMRYVWGGFAYLQDVVEQAIIRVLTGTEKKTGVYMQQMPYPCYVDDIFLRVMSRSMPLFMTLAWIYSVAVIIKGIVYEKEARLKETMRIMGLDNSILWFSWFISSLIPLLVSAGLLVVILKLGNLLPYSDPSVVFVFLSVFAVVTILQCFLISTLFSRANLAAACGGIIYFTLYLPYVLCVAWQDYVGFTLKIFASLLSPVAFGFGCEYFALFEEQGIGVQWDNLFESPVEEDGFNLTTSVSMMLFDTFLYGVMTWYIEAVFPGQYGIPRPWYFPCTKSYWFGEESDEKSHPGSNQKRISEICMEEEPTHLKLGVSIQNLVKVYRDGMKVAVDGLALNFYEGQITSFLGHNGAGKTTTMSILTGLFPPTSGTAYILGKDIRSEMSTIRQNLGVCPQHNVLFDMLTVEEHIWFYARLKGLSEKHVKAEMEQMALDVGLPSSKLKSKTSQLSGGMQRKLSVALAFVGGSKVVILDEPTAGVDPYSRRGIWELLLKYRQGRTIILSTHHMDEADVLGDRIAIISHGKLCCVGSSLFLKNQLGTGYYLTLVKKDVESSLSSCRNSSSTVSYLKKEDSVSQSSSDAGLGSDHESDTLTIDVSAISNLIRKHVSEARLVEDIGHELTYVLPYEAAKEGAFVELFHEIDDRLSDLGISSYGISETTLEEIFLKVAEESGVDAETSDGTLPARRNRRAFGDKQSCLRPFTEDDAADPNDSDIDPESRETDLLSGMDGKGSYQVKGWKLTQQQFVALLWKRLLIARRSRKGFFAQIVLPAVFVCIALVFSLIVPPFGKYPSLELQPWMYNEQYTFVSNDAPEDTGTLELLNALTKDPGFGTRCMEGNPIPDTPCQAGEEEWTTAPVPQTIMDLFQNGNWTMQNPSPACQCSSDKIKKMLPVCPPGAGGLPPPQRKQNTADILQDLTGRNISDYLVKTYVQIIAKSLKNKIWVNEFRYGGFSLGVSNTQALPPSQEVNDAIKQMKKHLKLAKDSSADRFLNSLGRFMTGLDTRNNVKVWFNNKGWHAISSFLNVINNAILRANLQKGENPSHYGITAFNHPLNLTKQQLSEVALMTTSVDVLVSICVIFAMSFVPASFVVFLIQERVSKAKHLQFISGVKPVIYWLSNFVWDMCNYVVPATLVIIIFICFQQKSYVSSTNLPVLALLLLLYGWSITPLMYPASFVFKIPSTAYVVLTSVNLFIGINGSVATFVLELFTDNKLNNINDILKSVFLIFPHFCLGRGLIDMVKNQAMADALERFGENRFVSPLSWDLVGRNLFAMAVEGVVFFLITVLIQYRFFIRPRPVNAKLSPLNDEDEDVRRERQRILDGGGQNDILEIKELTKIYRRKRKPAVDRICVGIPPGECFGLLGVNGAGKSSTFKMLTGDTTVTRGDAFLNKNSILSNIHEVHQNMGYCPQFDAITELLTGREHVEFFALLRGVPEKEVGKVGEWAIRKLGLVKYGEKYAGNYSGGNKRKLSTAMALIGGPPVVFLDEPTTGMDPKARRFLWNCALSVVKEGRSVVLTSHSMEECEALCTRMAIMVNGRFRCLGSVQHLKNRFGDGYTIVVRIAGSNPDLKPVQDFFGLAFPGSVLKEKHRNMLQYQLPSSLSSLARIFSILSQSKKRLHIEDYSVSQTTLDQVFVNFAKDQSDDDHLKDLSLHKNQTVVDVAVLTSFLQDEKVKESYV

SEQ ID NO: 811134 - protein, 1202 aa, Homo sapiens
MVGKGLIAAFIGRPQFFWQLCFLTSHPQEARLFTRHTHARQGPLKPRLPVHVSQGKLFPLVLTQQSFLEALPGEGAGGSALLLSLTRSHLLLCHQEDSVSQSSSDAGLGSDHESDTLTIDVSAISNLIRKHVSEARLVEDIGHELTYVLPYEAAKEGAFVELFHEIDDRLSDLGISSYGISETTLEEIFLKVAEESGVDAETSDGTLPARRNRRAFGDKQSCLRPFTEDDAADPNDSDIDPESRETDLLSGMDGKGSYQVKGWKLTQQQFVALLWKRLLIARRSRKGFFAQIVLPAVFVCIALVFSLIVPPFGKYPSLELQPWMYNEQYTFVSNDAPEDTGTLELLNALTKDPGFGTRCMEGNPIPDTPCQAGEEEWTTAPVPQTIMDLFQNGNWTMQNPSPACQCSSDKIKKMLPVCPPGAGGLPPPQRKQNTADILQDLTGRNISDYLVKTYVQIIAKSLKNKIWVNEFRYGGFSLGVSNTQALPPSQEVNDAIKQMKKHLKLAKDSSADRFLNSLGRFMTGLDTRNNVKVWFNNKGWHAISSFLNVINNAILRANLQKGENPSHYGITAFNHPLNLTKQQLSEVALMTTSVDVLVSICVIFAMSFVPASFVVFLIQERVSKAKHLQFISGVKPVIYWLSNFVWDMCNYVVPATLVIIIFICFQQKSYVSSTNLPVLALLLLLYGWSITPLMYPASFVFKIPSTAYVVLTSVNLFIGINGSVATFVLELFTDNKLNNINDILKSVFLIFPHFCLGRGLIDMVKNQAMADALERFGENRFVSPLSWDLVGRNLFAMAVEGVVFFLITVLIQYRFFIRPRPVNAKLSPLNDEDEDVRRERQRILDGGGQNDILEIKELTKIYRRKRKPAVDRICVGIPPGECFGLLGVNGAGKSSTFKMLTGDTTVTRGDAFLNKNSILSNIHEVHQNMGYCPQFDAITELLTGREHVEFFALLRGVPEKEVGKVGEWAIRKLGLVKYGEKYAGNYSGGNKRKLSTAMALIGGPPVVFLDEPTTGMDPKARRFLWNCALSVVKEGRSVVLTSHSMEECEALCTRMAIMVNGRFRCLGSVQHLKNRFGDGYTIVVRIAGSNPDLKPVQDFFGLAFPGSVLKEKHRNMLQYQLPSSLSSLARIFSILSQSKKRLHIEDYSVSQTTLDQVFVNFAKDQSDDDHLKDLSLHKNQTVVDVAVLTSFLQDEKVKESYV

SEQ ID NO: 811135 - protein, 2248 aa, Homo sapiens
MACWPQLRLLLWKNLTFRRRQTCQLLLEVAWPLFIFLILISVRLSYPPYEQHECHFPNKAMPSAGTLPWVQGIICNANNPCFRYPTPGEAPGVVGNFNKSIVARLFSDARRLLLYSQKDTSMKDMRKVLRTLQQIKKSSSNLKLQDFLVDNETFSGFLYHNLSLPKSTVDKMLRADVILHKVFLQGYQLHLTSLCNGSKSEEMIQLGDQEVSELCGLPREKLAAAERVLRSNMDILKPILRTLNSTSPFPSKELAEATKTLLHSLGTLAQELFSMRSWSDMRQEVMFLTNVNSSSSSTQIYQAVSRIVCGHPEGGGLKIKSLNWYEDNNYKALFGGNGTEEDAETFYDNSTTPYCNDLMKNLESSPLSRIIWKALKPLLVGKILYTPDTPATRQVMAEVNKTFQELAVFHDLEGMWEELSPKIWTFMENSQEMDLVRMLLDSRDNDHFWEQQLDGLDWTAQDIVAFLAKHPEDVQSSNGSVYTWREAFNETNQAIRTISRFMECVNLNKLEPIATEVWLINKSMELLDERKFWAGIVFTGITPGSIELPHHVKYKIRMDIDNVERTNKIKDGYWDPGPRADPFEDMRYVWGGFAYLQDVVEQAIIRVLTGTEKKTGVYMQQMPYPCYVDDIFLRVMSRSMPLFMTLAWIYSVAVIIKGIVYEKEARLKETMRIMGLDNSILWFSWFISSLIPLLVSAGLLVVILKLGNLLPYSDPSVVFVFLSVFAVVTILQCFLISTLFSRANLAAACGGIIYFTLYLPYVLCVAWQDYVGFTLKIFASLLSPVAFGFGCEYFALFEEQGIGVQWDNLFESPVEEDGFNLTTSVSMMLFDTFLYGVMTWYIEAVFPGQYGIPRPWYFPCTKSYWFGEESDEKSHPGSNQKRISEICMEEEPTHLKLGVSIQNLVKVYRDGMKVAVDGLALNFYEGQITSFLGHNGAGKTTTMSILTGLFPPTSGTAYILGKDIRSEMSTIRQNLGVCPQHNVLFDMLTVEEHIWFYARLKGLSEKHVKAEMEQMALDVGLPSSKLKSKTSQLSGGMQRKLSVALAFVGGSKVVILDEPTAGVDPYSRRGIWELLLKYRQGRTIILSTHHMDEADVLGDRIAIISHGKLCCVGSSLFLKNQLGTGYYLTLVKKDVESSLSSCRNSSSTVSYLKKEDSVSQSSSDAGLGSDHESDTLTIDVSAISNLIRKHVSEARLVEDIGHELTYVLPYEAAKEGAFVELFHEIDDRLSDLGISSYGISETTLEEIFLKVAEESGVDAETSDGTLPARRNRRAFGDKQSCLRPFTEDDAADPNDSDIDPESRETDLLSGMDGKGSYQVKGWKLTQQQFVALLWKRLLIARRSRKGFFAQIVLPAVFVCIALVFSLIVPPFGKYPSLELQPWMYNEQYTFVSNDAPEDTGTLELLNALTKDPGFGTRCMEGNPIPDTPCQAGEEEWTTAPVPQTIMDLFQNGNWTMQNPSPACQCSSDKIKKMLPVCPPGAGGLPPPQRKQNTADILQDLTGRNISDYLVKTYVQIIAKSLKNKIWVNEFRYGGFSLGVSNTQALPPSQEVNDAIKQMKKHLKLAKDSSADRFLNSLGRFMTGLDTRNNVKVWFNNKGWHAISSFLNVINNAILRANLQKGENPSHYGITAFNHPLNLTKQQLSEVALMTTSVDVLVSICVIFAMSFVPASFVVFLIQERVSKAKHLQFISGVKPVIYWLSNFVWDMCNYVVPATLVIIIFICFQQKSYVSSTNLPVLALLLLLYGWSITPLMYPASFVFKIPSTAYVVLTSVNLFIGINGSVATFVLELFTDNKLNNINDILKSVFLIFPHFCLGRGLIDIGENRFVSPLSWDLVGRNLFAMAVEGVVFFLITVLIQYRFFIRPRPVNAKLSPLNDEDEDVRRERQRILDGGGQNDILEIKELTKIYRRKRKPAVDRICVGIPPGECFGLLGVNGAGKSSTFKMLTGDTTVTRGDAFLNKNSILSNIHEVHQNMGYCPQFDAITELLTGREHVEFFALLRGVPEKEVGKVGEWAIRKLGLVKYGEKYAGNYSGGNKRKLSTAMALIGGPPVVFLDEPTTGMDPKARRFLWNCALSVVKEGRSVVLTSHSMEECEALCTRMAIMVNGRFRCLGSVQHLKNRFGDGYTIVVRIAGSNPDLKPVQDFFGLAFPGSVLKEKHRNMLQYQLPSSLSSLARIFSILSQSKKRLHIEDYSVSQTTLDQVFVNFAKDQSDDDHLKDLSLHKNQTVVDVAVLTSFLQDEKVKESYV

SEQ ID NO: 811136 - protein, 600 aa, Homo sapiens
MTTSVDVLVSICVIFAMSFVPASFVVFLIQERVSKAKHLQFISGVKPVIYWLSNFVWDMCNYVVPATLVIIIFICFQQKSYVSSTNLPVLALLLLLYGWSITPLMYPASFVFKIPSTAYVVLTSVNLFIGINGSVATFVLELFTDNKLNNINDILKSVFLIFPHFCLGRGLIDMGRIALCHHYLGTWWDDNLFAMAVEGVVFFLITVLIQYRFFIRPRPVNAKLSPLNDEDEDVRRERQRILDGGGQNDILEIKELTKIYRRKRKPAVDRICVGIPPGECFGLLGVNGAGKSSTFKMLTGDTTVTRGDAFLNKNSILSNIHEVHQNMGYCPQFDAITELLTGREHVEFFALLRGVPEKEVGKVGEWAIRKLGLVKYGEKYAGNYSGGNKRKLSTAMALIGGPPVVFLDEPTTGMDPKARRFLWNCALSVVKEGRSVVLTSHSMEECEALCTRMAIMVNGRFRCLGSVQHLKNRFGDGYTIVVRIAGSNPDLKPVQDFFGLAFPGSVLKEKHRNMLQYQLPSSLSSLARIFSILSQSKKRLHIEDYSVSQTTLDQVFVNFAKDQSDDDHLKDLSLHKNQTVVDVAVLTSFLQDEKVKESYV

SEQ ID NO: 811137 - protein, 858 aa, Homo sapiens
MACWPQLRLLLWKNLTFRRRQTCQLLLEVAWPLFIFLILISVRLSYPPYEQHECHFPNKAMPSAGTLPWVQGIICNANNPCFRYPTPGEAPGVVGNFNKSIVARLFSDARRLLLYSQKDTSMKDMRKVLRTLQQIKKSSSNLKLQDFLVDNETFSGFLYHNLSLPKSTVDKMLRADVILHKVFLQGYQLHLTSLCNGSKSEEMIQLGDQEVSELCGLPREKLAAAERVLRSNMDILKPILRTLNSTSPFPSKELAEATKTLLHSLGTLAQELFSMRSWSDMRQEVMFLTNVNSSSSSTQIYQAVSRIVCGHPEGGGLKIKSLNWYEDNNYKALFGGNGTEEDAETFYDNSTTPYCNDLMKNLESSPLSRIIWKALKPLLVGKILYTPDTPATRQVMAEVNKTFQELAVFHDLEGMWEELSPKIWTFMENSQEMDLVRMLLDSRDNDHFWEQQLDGLDWTAQDIVAFLAKHPEDVQSSNGSVYTWREAFNETNQAIRTISRFMECVNLNKLEPIATEVWLINKSMELLDERKFWAGIVFTGITPGSIELPHHVKYKIRMDIDNVERTNKIKDGYWDPGPRADPFEDMRYVWGGFAYLQDVVEQAIIRVLTGTEKKTGVYMQQMPYPCYVDDIFLRVMSRSMPLFMTLAWIYSVAVIIKGIVYEKEARLKETMRIMGLDNSILWFSWFISSLIPLLVSAGLLVVILKLGNLLPYSDPSVVFVFLSVFAVVTILQCFLISTLFSRANLAAACGGIIYFTLYLPYVLCVAWQDYVGFTLKIFASLLSPVAFGFGCEYFALFEEQGIGVQWDNLFESPVEEDGFNLTTSVSMMLFDTFLYGVMTWYIEAVFPGTLLWASVWKI

SEQ ID NO: 811138 - protein, 641 aa, Homo sapiens
MACWPQLRLLLWKNLTFRRRQTCQLLLEVAWPLFIFLILISVRLSYPPYEQHECHFPNKAMPSAGTLPWVQGIICNANNPCFRYPTPGEAPGVVGNFNKSIVARLFSDARRLLLYSQKDTSMKDMRKVLRTLQQIKKSSSNLKLQDFLVDNETFSGFLYHNLSLPKSTVDKMLRADVILHKVFLQGYQLHLTSLCNGSKSEEMIQLGDQEVSELCGLPREKLAAAERVLRSNMDILKPILRTLNSTSPFPSKELAEATKTLLHSLGTLAQELFSMRSWSDMRQEVMFLTNVNSSSSSTQIYQAVSRIVCGHPEGGGLKIKSLNWYEDNNYKALFGGNGTEEDAETFYDNSTTPYCNDLMKNLESSPLSRIIWKALKPLLVGKILYTPDTPATRQVMAEVNKTFQELAVFHDLEGMWEELSPKIWTFMENSQEMDLVRMLLDSRDNDHFWEQQLDGLDWTAQDIVAFLAKHPEDVQSSNGSVYTWREAFNETNQAIRTISRFMECVNLNKLEPIATEVWLINKSMELLDERKFWAGIVFTGITPGSIELPHHVKYKIRMDIDNVERTNKIKDGYWDPGPRADPFEDMRYVWGGFAYLQDVVEQAIIRVLTGTEKKTGVYMQQMPYPCYVDDILIWGPACWSA

SEQ ID NO: 811139 - protein, 640 aa, Homo sapiens
MACWPQLRLLLWKNLTFRRRQTCQLLLEVAWPLFIFLILISVRLSYPPYEQHECHFPNKAMPSAGTLPWVQGIICNANNPCFRYPTPGEAPGVVGNFNKSIVARLFSDARRLLLYSQKDTSMKDMRKVLRTLQQIKKSSSNLKLQDFLVDNETFSGFLYHNLSLPKSTVDKMLRADVILHKVFLQGYQLHLTSLCNGSKSEEMIQLGDQEVSELCGLPREKLAAAERVLRSNMDILKPILRTLNSTSPFPSKELAEATKTLLHSLGTLAQELFSMRSWSDMRQEVMFLTNVNSSSSSTQIYQAVSRIVCGHPEGGGLKIKSLNWYEDNNYKALFGGNGTEEDAETFYDNSTTPYCNDLMKNLESSPLSRIIWKALKPLLVGKILYTPDTPATRQVMAEVNKTFQELAVFHDLEGMWEELSPKIWTFMENSQEMDLVRMLLDSRDNDHFWEQQLDGLDWTAQDIVAFLAKHPEDVQSSNGSVYTWREAFNETNQAIRTISRFMECVNLNKLEPIATEVWLINKSMELLDERKFWAGIVFTGITPGSIELPHHVKYKIRMDIDNVERTNKIKDGYWDPGPRADPFEDMRYVWGGFAYLQDVVEQAIIRVLTGTEKKTGVYMQQIAGLFKSRHSNQGPHAWCG

SEQ ID NO: 811140 - protein, 94 aa, Homo sapiens
DVSLPSQLGNLLPYSDPSVVFVFLSVFAVVTILQCFLISTLFSRANLAAACGGIIYFTLYLPYVLCVAWQDYVGFTLKIFAVSTSGLSSVAVGI

SEQ ID NO: 811141 - protein, 321 aa, Homo sapiens
LATSATSAPSPLLGPARGLSPAALGQGLTREVLPPAAATRRDLLLPGNRGFRPRGQGPLTPAQSVLGLVVSAEGGSAVAGFSSQLCPRLLAGLRGQRGATIQPLGARPKQLSRTHSACAAMASAGAERRPGVQEATVVGQGQLTEEPGSAQTSECPVAGDQFLVPAHEARGTQSEDQRPAGAASESELQEEGPKLGEERPKPHAGALEERGPRPVVSIVRPRHGPKRKPVKSLSLPGLRAHLKAEAELPPKLPLQEEEPEDSQSEPSPSAKQHKKAKKRKSLGAPVLHAVASMVSAPLETLRLEPSALPWVFAGKAQRLRP

SEQ ID NO: 811142 - protein, 212 aa, Homo sapiens
ALGGKELQPRGWGTHHSRIPKSCTPAGRILVPSHYHHSPPVPQEPPCREQQESGSFRACRGLGSLASKPLGPGVSLTRNGTGVEPWGCGQAGLFPGPGNGSQGWSLAQVSCPWLRSLSLPGLRAHLKAEAELPPKLPLQEEEPEDSQSEPSPSAKQHKKAKKRKSLGAPVLHAVASMVSAPLETLRLEREWQSLDCSFSPCLWGPTWHNLAL

SEQ ID NO: 811143 - protein, 403 aa, Homo sapiens
LATSATSAPSPLLGPARGLSPAALGQGLTREVLPPAAATRRDLLLPGNRGFRPRGQGPLTPAQSVLGLVVSAEGGSAVAGFSSQLCPRLLAGLRGQRGATIQPLGARPKQLSRTHSACAAMASAGAERRPGVQEATVVGQGQLTEEPGSAQTSEVTVRLFNLQTQGRSALRGGTERPDPLTARLGPPGGEGQQAGVLIPVSVSNVRCSVTDPYVLCPAMVTDGLCVISECPVAGDQFLVPAHEARGTQSEDQRPAGAASESELQEEGPKLGEERPKPHAGALEERGPRPVVSIVRPRHGPKRKPVKSLSLPGLRAHLKAEAELPPKLPLQEEEPEDSQSEPSPSAKQHKKAKKRKSLGAPVLHAVASMVSAPLETLRLEREWQSLDCSFSPCLWGPTWHNLAL

SEQ ID NO: 811144 - protein, 328 aa, Homo sapiens
LATSATSAPSPLLGPARGLSPAALGQGLTREVLPPAAATRRDLLLPGNRGFRPRGQGPLTPAQSVLGLVVSAEGGSAVAGFSSQLCPRLLAGLRGQRGATIQPLGARPKQLSRTHSACAAMASAGAERRPGVQEATVVGQGQLTEEPGSAQTSECPVAGDQFLVPAHEARGTQSEDQRPAGAASESELQEEGPKLGEERPKPHAGALEERGPRPVVSIVRPRHGPKRKPVKSLSLPGLRAHLKAEAELPPKLPLQEEEPEDSQSEPSPSAKQHKKAKKRKSLGAPVLHAVASMVSAPLETLRLEREWQSLDCSFSPCLWGPTWHNLAL

SEQ ID NO: 811145 - protein, 286 aa, Homo sapiens
QGQMAPPLPDSEREKQEPEQGEVGKRPGLPPEPREQRDVERAGGNQAASQLEEAGRAEMLDHAVLLQVIKEQQVQQKRLLDQQEKLLAVIEEQHKEIHQQRQEDEEDKPRQVEVHQEPGAAVPRGQEAPEGKARETVENLPPLPLDPVLRAPGGRPAPSQDLNQRSLEHSEGPVGRDPAGPPDGGPDTEPRAAQGKLRDGQKDAAPRAAGTVKELPKGPEQVPVPDPAREAGGPEERLAEEFPGQSQDVTGGSQDRKNWRGGSRARFEEARSWRPAQRGLLADADG

SEQ ID NO: 811146 - protein, 194 aa, Homo sapiens
MKPKQVSRDLGLAADLPGGAEGAAAQPQAVLRQPELRVISDGEQGGQQGHRLDHGGHLEMRKARGGDHVPVSHEQPRGGEDAAVQEPRQRPEPELGLKRAVPGGQRPDNAKPNRDLKLQAGSDLRRRRRDLGPHAEGQLAPRDGVIIGLNPLPDVQVNDLRGALDAQLRQAAGGALQVVHSRQLRQAPGPPEES

SEQ ID NO: 811147 - protein, 194 aa, Homo sapiens; identical to SEQ ID NO: 811146

SEQ ID NO: 811148 - protein, 585 aa, Homo sapiens
QGQMAPPLPDSEREKQEPEQGEVGKRPGQAQALEEAGDLPEDPQKVPEADGQPAVQPAKEDLGPGDRCLHPRPQAVLSEQQNGLAVGGGEKAKGGPPPGNAAGDTGQPAEDSDHGGKPPLPAEKPAPGPGLPPEPREQRDVERAGGNQAASQLEEAGRAEMLDHAVLLQVIKEQQVQQKRLLDQQEKLLAVIEEQHKEIHQQRQEDEEDKPRQVEVHQEPGAAVPRGQEAPEGKARETVENLPPLPLDPVLRAPGGRPAPSQDLNQRSLEHSEGPVGRDPAGPPDGGPDTEPRAAQGKLRDGQKDAAPRAAGTVKELPKGPEQVPVPDPAREAGGPEERLAEEFPGQSQDVTGGSQDRKKPGKEVAATGTSILKEANWLVAGPGAETGDPRMKPKQVSRDLGLAADLPGGAEGAAAQPQAVLRQPELRVISDGEQGGQQGHRLDHGGHLEMRKARGGDHVPVSHEQPRGGEDAAVQEPRQRPEPELGLKRAVPGGQRPDNAKPNRDLKLQAGSDLRRRRRDLGPHAEGQLAPRDGVIIGLNPLPDVQVNDLRGALDAQLRQAAGGALQVVHSRQLRQAPGPPEES

SEQ ID NO: 811149 - protein, 592 aa, Homo sapiens
QGQMAPPLPDSEREKQEPEQGEVGKRPGQAQALEEAGDLPEDPQKVPEADGQPAVQPAKEDLGPGDRCLHPRPQAVLSEQQNGLAVGGGEKAKGGPPPGNAAGDTGQPAEDSDHGGKPPLPAEKPAPGPGLPPEPREQRDVERAGGNQAASQLEAEIKKIVEAGRAEMLDHAVLLQVIKEQQVQQKRLLDQQEKLLAVIEEQHKEIHQQRQEDEEDKPRQVEVHQEPGAAVPRGQEAPEGKARETVENLPPLPLDPVLRAPGGRPAPSQDLNQRSLEHSEGPVGRDPAGPPDGGPDTEPRAAQGKLRDGQKDAAPRAAGTVKELPKGPEQVPVPDPAREAGGPEERLAEEFPGQSQDVTGGSQDRKKPGKEVAATGTSILKEANWLVAGPGAETGDPRMKPKQVSRDLGLAADLPGGAEGAAAQPQAVLRQPELRVISDGEQGGQQGHRLDHGGHLEMRKARGGDHVPVSHEQPRGGEDAAVQEPRQRPEPELGLKRAVPGGQRPDNAKPNRDLKLQAGSDLRRRRRDLGPHAEGQLAPRDGVIIGLNPLPDVQVNDLRGALDAQLRQAAGGALQVVHSRQLRQAPGPPEES

SEQ ID NO: 811150 - protein, 194 aa, Homo sapiens; identical to SEQ ID NO: 811146

SEQ ID NO: 811151 - protein, 194 aa, Homo sapiens; identical to SEQ ID NO: 811146

SEQ ID NO: 811152 - protein, 194 aa, Homo sapiens; identical to SEQ ID NO: 811146

SEQ ID NO: 811153 - protein, 189 aa, Homo sapiens
AGILGEETYILRLGAEGAAAQPQAVLRQPELRVISDGEQGGQQGHRLDHGGHLEMRKARGGDHVPVSHEQPRGGEDAAVQEPRQRPEPELGLKRAVPGGQRPDNAKPNRDLKLQAGSDLRRRRRDLGPHAEGQLAPRDGVIIGLNPLPDVQVNDLRGALDAQLRQAAGGALQVVHSRQLRQAPGPPEES

SEQ ID NO: 811154 - protein, 225 aa, Homo sapiens
MAVRSLWAGRLRVQRLLAWSAAWESKGWPLPFSTATQRTAGEDCRSEDPPDELGPPLAERALRVKAVKLEKEVQDLTVRYQRAIADCENIRRRTQRCVEDAKIFGIQSFCKDLVEVADILEKTTECISEESEPEDQKLTLEKVFRGLLLLEAKLKSVFAKHGLEKLTPIGDKYDPHEHELICHVPAGVGVQPGTVALVRQDGYKLHGRTIRLARVEVAVESQRRL

SEQ ID NO: 811155 - protein, 225 aa, Homo sapiens; identical to SEQ ID NO: 811154

SEQ ID NO: 811156 - protein, 237 aa, Homo sapiens
SVGQGTSFSASTTVHSRPHFTDGETEAISRASFLGRGRGWPLPFSTATQRTAGEDCRSEDPPDELGPPLAERALRVKAVKLEKEVQDLTVRYQRAIADCENIRRRTQRCVEDAKIFGIQSFCKDLVEVADILEKTTECISEESEPEDQKLTLEKVFRGLLLLEAKLKSVFAKHGLEKLTPIGDKYDPHEHELICHVPAGVGVQPGTVALVRQDGYKLHGRTIRLARVEVAVESQRRL

SEQ ID NO: 811157 - protein, 128 aa, Homo sapiens
KITGFSAGIQSFCKDLVEVADILEKTTECISEESEPEDQKLTLEKVFRGLLLLEAKLKSVFAKHGLEKLTPIGDKYDPHEHELICHVPAGVGVQPGTVALVRQDGYKLHGRTIRLARVEVAVESQRRL

SEQ ID NO: 811158 - protein, 225 aa, Homo sapiens; identical to SEQ ID NO: 811154

SEQ ID NO: 811159 - protein, 112 aa, Homo sapiens
MAVRSLWAGRLRVQRLLAWSAAWESKGWPLPFSTATQRTAGEDCRSEDPPDELGPPLAERALRVKAVKLEKEVQDLTVRYQRAIADCENIRRRTQRCVEDAKIFGERFIYNK

SEQ ID NO: 811160 - protein, 76 aa, Homo sapiens
ACAVSKPCQTRCGGCLKLVSRGAAHLWLGQCRAPLGRYREALVAFRLDGAGQPWFAGFWVFEQPRCRSSPPPTRSA

SEQ ID NO: 811161 - protein, 76 aa, Homo sapiens; identical to SEQ ID NO: 811160

SEQ ID NO: 811162 - protein, 76 aa, Homo sapiens; identical to SEQ ID NO: 811160

SEQ ID NO: 811163 - protein, 76 aa, Homo sapiens; identical to SEQ ID NO: 811160

SEQ ID NO: 811164 - protein, 407 aa, Homo sapiens
MDSPCQPQPLSQALPQLPGSSSEPLEPEPGRARMGVESYLPCPLLPSYHCPGVPSEASAGSGTPRATATSTTASPLRDGFGGQDGGELRPLQSEGAAALVTKGCQRLAAQGARPEAPKRKWAEDGGDAPSPSKRPWARQENQEAEREGGMSCSCSSGSGEASAGLMEEALPSAPERLALDYIVPCMRYYGICVKDSFLGAALGGRVLAEVEALKRGGRLRDGQLVSQRAIPPRSIRGDQIAWVEGHEPGCRSIGALMAHVDAVIRHCAGRLGSYVINGRTKAMVACYPGNGLGYVRHVDNPHGDGRCITCIYYLNQNWDVKVHGGLLQIFPEGRPVVANIEPLFDRLLIFWSDRRNPHEVKPAYATRYAITVWYFDAKERAAAKDKYQLASGQKGVQVPVSQPPTPT

SEQ ID NO: 811165 - protein, 407 aa, Homo sapiens; identical to SEQ ID NO: 811164

SEQ ID NO: 811166 - protein, 128 aa, Homo sapiens
MLDRERLSTNVGSKGSPEGEEWNGSGRRDVQHTRPHAATPLICTTSDSTMATCLTVQTRAHGHNMLLNNTPKASVNARSLTCCVTRELMCSLRLVLPYLIFCLYDLSSDVSRMFKSTAIIVLSQPPVG

SEQ ID NO: 811167 - protein, 407 aa, Homo sapiens; identical to SEQ ID NO: 811164

SEQ ID NO: 811168 - protein, 407 aa, Homo sapiens; identical to SEQ ID NO: 811164

SEQ ID NO: 811169 - protein, 407 aa, Homo sapiens; identical to SEQ ID NO: 811164

SEQ ID NO: 811170 - protein, 423 aa, Homo sapiens
MDSPCQPQPLSQALPQLPGSSSEPLEPEPGRARMGVESYLPCPLLPSYHCPGVPSEASAGSGTPRATATSTTASPLRDGFGGQDGGELRPLQSEGAAALVTKGCQRLAAQGARPEAPKRKWAEDGGDAPSPSKRPWARQENQEAEREGGMSCSCSSGSGEASAGLMEEALPSAPERLALDYIVPCMRYYGICVKDSFLGAALGGRVLAEVEALKRGGRLRDGQLVSQRAIPPRSIRGDQIAWVEGHEPGCRSIGALMAHVDAVIRHCAGRLGSYVINGRTKAMVACYPGNGLGYVRHVDNPHGDGRCITCIYYLNQNWDVKVGVRVRVRVALGLGLGRGWRASTPFSTLSPDSGILLFLFSTHSGQCDLPALPGKWHLLLSSGLCGGNSPLSGNGAVCPAPPGLVMNTFPLFLSLVASCPSPW

SEQ ID NO: 811171 - protein, 396 aa, Homo sapiens
MDSPCQPQPLSQALPQLPGSSSEPLEPEPGRARMGVESYLPCPLLPSYHCPGVPSEASAGSGTPRATATSTTASPLRDGFGGQDGGELRPLQSEGAAALVTKGCQRLAAQGARPEAPKRKWAEDGGDAPSPSKRPWARQENQEAEREGGMSCSCSSGSGEASAGLMEEALPSAPERLALDYIVPCMRYYGICVKDSFLGAALGGRVLAEVEALKRGGRLRDGQLVSQRAIPPRSIRGDQIAWVEGHEPGCRSIGALMAHVDAVIRHCAGRLGSYVINGRTKAMVACYPGNGLGYVRHVDNPHGDGRCITCIYYLNQNWDVKVHGGLLQIFPEGRPVVANIEPLFDRLLIFWSDRRNPHEVKPAYATSIRTERCPSTCITAAYAHLVASPRAAWQTA

SEQ ID NO: 811172 - protein, 292 aa, Homo sapiens
MDSPCQPQPLSQALPQLPGSSSEPLEPEPGRARMGVESYLPCPLLPSYHCPGVPSEASAGSGTPRATATSTTASPLRDGFGGQDGGELRPLQSEGAAALVTKGCQRLAAQGARPEAPKRKWAEDGGDAPSPSKRPWARQENQEAEREGGMSCSCSSGSGEASAGLMEEALPSAPERLALDYIVPCMRYYGICVKDSFLGAALGGRVLAEVEALKRGGRLRDGQLVSQRAIPPRSIRGDQIAWVEGHEPGCRSIGALMAHVDAVIRHCAGRLGSYVINGRTKAMGAASPVSIT

SEQ ID NO: 811173 - protein, 407 aa, Homo sapiens; identical to SEQ ID NO: 811164

SEQ ID NO: 811174 - protein, 258 aa, Homo sapiens [sequence omitted]

SEQ ID NO: 811175 - protein, 407 aa, Homo sapiens; identical to SEQ ID NO: 811164

SEQ ID NO: 811176 - protein, 114 aa, Homo sapiens
VGAGYGALCGAGRLAQTAAPGPEEKARHPEGSLPKPLGTAEDLGTSKQPPGHEKSSCCLPCLTLPHARPGGPQLHQVEAEEEAEEGGTMGPGGALHARGMKTLLPWTARASRSP

SEQ ID NO: 811177 - protein, 323 aa, Homo sapiens
MDSPCQPQPLSQALPQLPGSSSEPLEPEPGRARMGVESYLPCPLLPSYHCPGVPSEASAGSGTPRATATSTTASPLRDGFGGQDGGELRPLQSEGAAALVTKGCQRLAAQGARPEAPKRKWAEDGGDAPSPSKRPWARQENQEAEREGGMSCSCSSGSGEASAGLMEEALPSAPERLALDYIVPCMRYYGICVKDSFLGAALGGRVLAEVEALKRGGRLRDGQLVSQRAIPPRSIRGDQIAWVEGHEPGCRSIGALMAHVDAVIRHCAGRLGSYVINGRTKAMVACYPGNGLGYVRHVDNPHVPNPFGHGRHLLDWAATAWAE

SEQ ID NO: 811178 - protein, 125 aa, Homo sapiens
MVACYPGNGLGYVRHVDNPHGDGRCITCIYYLNQNWDVKVHGGLLQIFPEGRPVVANIEPLFDRLLIFWSDRRNPHEVKPAYATRYAITVWYFDAKERAAAKDKYQLASGQKGVQVPVSQPPTPT

SEQ ID NO: 811179 - protein, 151 aa, Homo sapiens
MDSPCQPQPLSQALPQLPGSSSEPLEPEPGRARMGVESYLPCPLLPSYHCPGVPSEASAGSGTPRATATSTTASPLRDGFGGQDGGELRPLQSEGAAALVTKGCQRLAAQGARPEAPKRKWAEDGGDAPSPSKRPSDFASVLPGVEGSVCC

SEQ ID NO: 811180 - protein, 134 aa, Homo sapiens
MDSPCQPQPLSQALPQLPGSSSEPLEPEPGRARMGVESYLPCPLLPSYHCPGVPSEASAGSGTPRATATSTTASPLRDGFGGQDGGELRPLQSEGAAALVTKGCQRLAAQGARPEAPKRKWAEDGAAVEATVTN

SEQ ID NO: 811181 - protein, 154 aa, Homo sapiens
MDSPCQPQPLSQALPQLPGSSSEPLEPEPGRARMGVESYLPCPLLPSYHCPGVPSEASAGSGTPRATATSTTASPLRDGFGGQDGGELRPLQSEGAAALVTKGCQRLAGSRGGHRYQLKLGAWVLPCLVMTPLGMESWEEALSLPTRMQDLGLR

SEQ ID NO: 811182 - protein, 134 aa, Homo sapiens; identical to SEQ ID NO: 811180

SEQ ID NO: 811183 - protein, 154 aa, Homo sapiens; identical to SEQ ID NO: 811181

SEQ ID NO: 811184 - protein, 142 aa, Homo sapiens [sequence omitted]

SEQ ID NO: 811185 - protein, 159 aa, Homo sapiens
YSEQTLYHEGSFEERRTPNVGRSTNTNVGSKGSPEGEEWNGSGRRDVQHTRPHAATPLICTTSDSTMATCLTVQTRAHGHNMLLNNTPKASVNATDSTEPTASCSTSTATTPNHRTGWQHTHSTRHSTRQSSGITEHNNTGQQNTQQIRSQYMPTHDTQ

SEQ ID NO: 811186 - protein, 94 aa, Homo sapiens
SGSLLIIARQRAHGHNMLLNNTPKASVNATDSTEPTASCSTSTATTPNHRTGWQHTHSTRHSTRQSSGITEHNNTGQQNTQQIRSQYMPTHDTQ

SEQ ID NO: 811187 - protein, 142 aa, Homo sapiens [sequence omitted]

SEQ ID NO: 811188 - protein, 106 aa, Homo sapiens
STCTVYSKKYGAILTFCSFFVFERRSFARFPGCRSIGALMAHVDAVIRHCAGRLGSYVINGRTKAMVACYPGNGLGYVRHVDNPHVPNPFGHGRHLLDWAATAWAE

SEQ ID NO: 811189 - protein, 158 aa, Homo sapiens
MCLPSPSKPTSLHPCQAMVACYPGNGLGYVRHVDNPHGDGRCITCIYYLNQNWDVKVGVRVRVRVALGLGLGRGWRASTPFSTLSPDSGILLFLFSTHSGQCDLPALPGKWHLLLSSGLCGGNSPLSGNGAVCPAPPGLVMNTFPLFLSLVASCPSPW

SEQ ID NO: 811190 - protein, 430 aa, Homo sapiens
VFFFYPPFLFIIFLHIDRILGNERKKKPKLTRAEDLPPLPLPSSLFSPPQEKKTPKQKKVHLGLVFFLQYFLGGQNFLGVIFFGFSSSFIFLPKLLLVGEKKMPQLNGGGGDDLGANDELISFKDEGEQEEKSSENSSAERDLADVKSSLVNESETNQNSSSDSEAERRPPPRSESFRDKSRESLEEAAKRQDGGLFKGPPYPGYPFIMIPDLTSPYLPNGSLSPTARTLHFQSGSTHYSAYKTIEHQIAVQYLQMKWPLLDVQAGSLQSRQALKDARSPSPAHIVSPLPCCTQGHDCQHFYPPSDFTVSTQVFRDMKRSHSLQKVGEPWCIESNKVPVVQHPHHVHPLTPLITYSNEHFTPGNPPPHLPADVDPKTESTARPPDIFPYYHYCWGGGKSPSVDGCPSAGTGFLRKGCKPSQLSQSSGAPM

SEQ ID NO: 811191 - protein, 698 aa, Homo sapiens
VFFFYPPFLFIIFLHIDRILGNERKKKPKLTRAEDLPPLPLPSSLFSPPQEKKTPKQKKVHLGLVFFLQYFLGGQNFLGVIFFGFSSSFIFLPKLLLVGEKKMPQLNGGGGDDLGANDELISFKDEGEQEEKSSENSSAERDLADVKSSLVNESETNQNSSSDSEAERRPPPRSESFRDKSRESLEEAAKRQDGGLFKGPPYPGYPFIMIPDLTSPYLPNGSLSPTARTYLQMKWPLLDVQAGSLQSRQALKDARSPSPAHIVSNKVPVVQHPHHVHPLTPLITYSNEHFTPGNPPPHLPADVDPKTGIPRPPHPPDISPYYPLSPGTVGQIPHPLGWLVPQQGQPVYPITTGGFRHPYPTALTVNASMSRFPPHMVPPHHTLHTTGIPHPAIVTPTVKQESSQSDVGSLHSSKHQDSKKEEEKKKPHIKKPLNAFMLYMKEMRAKVVAECTLKESAAINQILGRRWHALSREEQAKYYELARKERQLHMQLYPGWSARDNYGKKKKRKRDKQPGETNEHSECFLNPCLSLPPITDLSAPKKCRARFGLDQQNNWCGPCRRKKKCVRYIQGEGSCLSPPSSDGSLLDSPPPSPNLLGSPPRDAKSQTEQTQPLSLSLKPDPLAHLSMMPPPPALLLAEATHKASALCPNGALDLPPAALQPAAPSSSIAQPSTSSLHSHSSLAGTQPQPLSLVTKSLE

SEQ ID NO: 811192 - protein, 584 aa, Homo sapiens
VFFFYPPFLFIIFLHIDRILGNERKKKPKLTRAEDLPPLPLPSSLFSPPQEKKTPKQKKVHLGLVFFLQYFLGGQNFLGVIFFGFSSSFIFLPKLLLVGEKKMPQLNGGGGDDLGANDELISFKDEGEQEEKSSENSSAERDLADVKSSLVNESETNQNSSSDSEAERRPPPRSESFRDKSRESLEEAAKRQDGGLFKGPPYPGYPFIMIPDLTSPYLPNGSLSPTARTLHFQSGSTHYSAYKTIEHQIAVQYLQMKWPLLDVQAGSLQSRQALKDARSPSPAHIVSNKVPVVQHPHHVHPLTPLITYSNEHFTPGNPPPHLPADVDPKTGIPRPPHPPDISPYYPLSPGTVGQIPHPLGWLVPQQGQPVYPITTGGFRHPYPTALTVNASMSRFPPHMVPPHHTLHTTGIPHPAIVTPTVKQESSQSDVGSLHSSKHQDSKKEEEKKKPHIKKPLNAFMLYMKEMRAKVVAECTLKESAAINQILGRRWHALSREEQAKYYELARKERQLHMQLYPGWSARDNYGKKKKRKRDKQPGETNEHSECFLNPCLSLPPITGEKKSAFATYKVKAAASAHPLQMEAY

SEQ ID NO: 811193 - protein, 567 aa, Homo sapiens
VFFFYPPFLFIIFLHIDRILGNERKKKPKLTRAEDLPPLPLPSSLFSPPQEKKTPKQKKVHLGLVFFLQYFLGGQNFLGVIFFGFSSSFIFLPKLLLVGEKKMPQLNGGGGDDLGANDELISFKDEGEQEEKSSENSSAERDLADVKSSLVNESETNQNSSSDSEAERRPPPRSESFRDKSRESLEEAAKRQDGGLFKGPPYPGYPFIMIPDLTSPYLPNGSLSPTARTLHFQSGSTHYSAYKTIEHQIAVQYLQMKWPLLDVQAGSLQSRQALKDARSPSPAHIVSNKVPVVQHPHHVHPLTPLITYSNEHFTPGNPPPHLPADVDPKTGIPRPPHPPDISPYYPLSPGTVGQIPHPLGWLVPQQGQPVYPITTGGFRHPYPTALTVNASMSRFPPHMVPPHHTLHTTGIPHPAIVTPTVKQESSQSDVGSLHSSKHQDSKKEEEKKKPHIKKPLNAFMLYMKEMRAKVVAECTLKESAAINQILGRRWHALSREEQAKYYELARKERQLHMQLYPGWSARDNYGKKKKRKRDKQPGETNGEKKSAFATYKVKAAASAHPLQMEAY

SEQ ID NO: 811194 - protein, 698 aa, Homo sapiens; identical to SEQ ID NO: 811191

SEQ ID NO: 811195 - protein, 698 aa, Homo sapiens; identical to SEQ ID NO: 811191

SEQ ID NO: 811196 - protein, 548 aa, Homo sapiens
VFFFYPPFLFIIFLHIDRILGNERKKKPKLTRAEDLPPLPLPSSLFSPPQEKKTPKQKKVHLGLVFFLQYFLGGQNFLGVIFFGFSSSFIFLPKLLLVGEKKMPQLNGGGGDDLGANDELISFKDEGEQEEKSSENSSAERDLADVKSSLVNESETNQNSSSDSEAERRPPPRSESFRDKSRESLEEAAKRQDGGLFKGPPYPGYPFIMIPDLTSPYLPNGSLSPTARTYLQMKWPLLDVQAGSLQSRQASNKVPVVQHPHHVHPLTPLITYSNEHFTPGNPPPHLPADVDPKTGIPRPPHPPDISPYYPLSPGTVGQIPHPLGWLVPQQGQPVYPITTGGFRHPYPTALTVNASMSRFPPHMVPPHHTLHTTGIPHPAIVTPTVKQESSQSDVGSLHSSKHQDSKKEEEKKKPHIKKPLNAFMLYMKEMRAKVVAECTLKESAAINQILGRRWHALSREEQAKYYELARKERQLHMQLYPGWSARDNYGKKKKRKRDKQPGETNEHSECFLNPCLSLPPITGEKKSAFATYKVKAAASAHPLQMEAY

SEQ ID NO: 811197 - protein, 575 aa, Homo sapiens
VFFFYPPFLFIIFLHIDRILGNERKKKPKLTRAEDLPPLPLPSSLFSPPQEKKTPKQKKVHLGLVFFLQYFLGGQNFLGVIFFGFSSSFIFLPKLLLVGEKKMPQLNGGGGDDLGANDELISFKDEGEQEEKSSENSSAERDLADVKSSLVNESETNQNSSSDSEAERRPPPRSESFRDKSRESLEEAAKRQDGGLFKGPPYPGYPFIMIPDLTSPYLPNGSLSPTARTLHFQSGSTHYSAYKTIEHQIAVQYLQMKWPLLDVQAGSLQSRQALKDARSPSPAHIVSNKVPVVQHPHHVHPLTPLITYSNEHFTPGNPPPHLPADVDPKTGIPRPPHPPDISPYYPLSPGTVGQIPHPLGWLVPQQGQPVYPITTGGFRHPYPTALTVNASMSRFPPHMVPPHHTLHTTGIPHPAIVTPTVKQESSQSDVGSLHSSKHQDSKKEEEKKKPHIKKPLNAFMLYMKEMRAKVVAECTLKESAAINQILGRRWHALSREEQAKYYELARKERQLHMQLYPGWSARDNYGKKKKRKRDKQPGETNAPPHQLHSRRLLPYIPTAPWPGPSPSRCRSSPSL

SEQ ID NO: 811198 - protein, 428 aa, Homo sapiens
MKRSHSLQKVGEPWCIESNKVPVVQHPHHVHPLTPLITYSNEHFTPGNPPPHLPADVDPKTGIPRPPHPPDISPYYPLSPGTVGQIPHPLGWLVPQQGQPVYPITTGGFRHPYPTALTVNASMSRFPPHMVPPHHTLHTTGIPHPAIVTPTVKQESSQSDVGSLHSSKHQDSKKEEEKKKPHIKKPLNAFMLYMKEMRAKVVAECTLKESAAINQILGRRWHALSREEQAKYYELARKERQLHMQLYPGWSARDNYGKKKKRKRDKQPGETNEHSEMFPKSLPFTSSDYRRKKKCVRYIQGEGSCLSPPSSDGSLLDSPPPSPNLLGSPPRDAKSQTEQTQPLSLSLKPDPLAHLSMMPPPPALLLAEATHKASALCPNGALDLPPAALQPAAPSSSIAQPSTSSLHSHSSLAGTQPQPLSLVTKSLE

SEQ ID NO: 811199 - protein, 346 aa, Homo sapiens
VFFFYPPFLFIIFLHIDRILGNERKKKPKLTRAEDLPPLPLPSSLFSPPQEKKTPKQKKVHLGLVFFLQYFLGGQNFLGVIFFGFSSSFIFLPKLLLVGEKKMPQLNGGGGDDLGANDELISFKDEGEQEEKSSENSSAERDLADVKSSLVNESETNQNSSSDSEAERRPPPRSESFRDKSRESLEEAAKRQDGGLFKGPPYPGYPFIMIPDLTSPYLPNGSLSPTARTLHFQSGSTHYSAYKTIEHQIAVQYLQMKWPLLDVQAGSLQSRQALKDARSPSPAHIVSNKVPVVQHPHHVHPLTPLITYSNEHFTPGNPPPHLPGIPRPPHPPDISPYYPLSPGTIR

SEQ ID NO: 811200 - protein, 195 aa, Homo sapiens
RFSLELIQTSALLRNAERALALINRITGAALADANTPKKCRALFGLDRQTLWCKPCRRKKKCVRYIQGEGSCLSPPSSDGSLLDSPPPSPNLLGSPPRDAKSQTEQTQPLSLSLKPDPLAHLSMMPPPPALLLAEATHKASALCPNGALDLPPAALQPAAPSSSIAQPSTSSLHSHSSLAGTQPQPLSLVTKSLE

SEQ ID NO: 811201 - protein, 110 aa, Homo sapiens
ESFPSPPANPFSAPKKRVSLQLGYNARAFGLKRGWRLDKYRGFVWMEMAVWSLPPAFSFQVRPDTLLTSVSCSNSLCFISSSRERRRRGKGTSSRERPMEKKKVRSLHTR

SEQ ID NO: 811202 - protein, 497 aa, Homo sapiens
VFFFYPPFLFIIFLHIDRILGNERKKKPKLTRAEDLPPLPLPSSLFSPPQEKKTPKQKKVHLGLVFFLQYFLGGQNFLGVIFFGFSSSFIFLPKLLLVGEKKMPQLNGGGGDDLGANDELISFKDEGEQEEKSSENSSAERDLADVKSSLVNESETNQNSSSDSEAERRPPPRSESFRDKSRESLEEAAKRQDGGLFKGPPYPGYPFIMIPDLTSPYLPNGSLSPTARTLHFQSGSTHYSAYKTIEHQIAVQYLQMKWPLLDVQAGSLQSRQALKDARSPSPAHIVSNKVPVVQHPHHVHPLTPLITYSNEHFTPGNPPPHLPADVDPKTGIPRPPHPPDISPYYPLSPGTVGQIPHPLGWLVPQQGQPVYPITTGGFRHPYPTALTVNASMSRFPPHMVPPHHTLHTTGIPHPAIVTPTVKQESSQSDVGSLHSSKHQDSKKEEEKKKPHIKKPLNAFMLYMKEMRAKVVAECTLKESAAINQILGRRVACTPFSG

SEQ ID NO: 811203 - protein, 566 aa, Homo sapiens
VFFFYPPFLFIIFLHIDRILGNERKKKPKLTRAEDLPPLPLPSSLFSPPQEKKTPKQKKVHLGLVFFLQYFLGGQNFLGVIFFGFSSSFIFLPKLLLVGEKKMPQLNGGGGDDLGANDELISFKDEGEQEEKSSENSSAERDLADVKSSLVNESETNQNSSSDSEAERRPPPRSESFRDKSRESLEEAAKRQDGGLFKGPPYPGYPFIMIPDLTSPYLPNGSLSPTARTLHFQSGSTHYSAYKTIEHQIAVQYLQMKWPLLDVQAGSLQSRQALKDARSPSPAHIVSNKVPVVQHPHHVHPLTPLITYSNEHFTPGNPPPHLPADVDPKTGIPRPPHPPDISPYYPLSPGTVGQIPHPLGWLVPQQGQPVYPITTGGFRHPYPTALTVNASMSRFPPHMVPPHHTLHTTGIPHPAIVTPTVKQESSQSDVGSLHSSKHQDSKKEEEKKKPHIKKPLNAFMLYMKEMRAKVVAECTLKESAAINQILGRRWHALSREEQAKYYELARKERQLHMQLYPGWSARDNYGKKKKRKRDKQPGETNEHSECFLNPCLSLPPITGANVILSH

SEQ ID NO: 811204 - protein, 284 aa, Homo sapiens
VFFFYPPFLFIIFLHIDRILGNERKKKPKLTRAEDLPPLPLPSSLFSPPQEKKTPKQKKVHLGLVFFLQYFLGGQNFLGVIFFGFSSSFIFLPKLLLVGEKKMPQLNGGGGDDLGANDELISFKDEGEQEEKSSENSSAERDLADVKSSLVNESETNQNSSSDSEAERRPPPRSESFRDKSRESLEEAAKRQDGGLFKGPPYPGYPFIMIPDLTSPYLPNGSLSPTARTYLQMKWPLLDVQAGSLQSRQALKDARSPSPAHIVVSNLPEMMASFIEGVKKKMLF

SEQ ID NO: 811205 - protein, 119 aa, Homo sapiens
FLQYFLGGQNFLGVIFFGFSSSFIFLPKLLLVGEKKMPQLNGGGGDDLGANDELISFKDEGEQEEKSSENSSAERDLADVKSSLVNESETNQNSSSDSEVGKAPRAGGVFYLFPGLGKC

SEQ ID NO: 811206 - protein, 852 aa, Homo sapiens
MAGALAGLAAGLQVPRVAPSPDSDSDTDSEDPSLRRSAGGLLRSQVIHSGHFMVSSPHSDSLPRRRDQEGSVGPSDFGPRSIDPTLTRLFECLSLAYSGKLVSPKWKNFKGLKLLCRDKIRLNNAIWRAWYIQYVKRRKSPVCGFVTPLQGPEADAHRKPEAVVLEGNYWKRRIEVVMREYHKWRIYYKKRLRKPSREDDLLAPKQAEGRWPPPEQWCKQLFSSVVPVLLGDPEEEPGGRQLLDLNCFLSDISDTLFTMTQSGPSPLQLPPEDAYVGNADMIQPDLTPLQPSLDDFMDISDFFTNSRLPQPPMPSNFPEPPSFSPVVDSLFSSGTLGPEVPPASSAMTHLSGHSRLQARNSCPGPLDSSAFLSSDFLLPEDPKPRLPPPPVPPPLLHYPPPAKVPGLEPCPPPPFPPMAPPTALLQEEPLFSPRFPFPTVPPAPGVSPLPAPAAFPPTPQSVPSPAPTPFPIELLPLGYSEPAFGPCFSMPRGKPPAPSPRGQKASPPTLAPATASPPTTAGSNNPCLTQLLTAAKPEQALEPPLVSSTLLRSPGSPQETVPEFPCTFLPPTPAPTPPRPPPGPATLAPSRPLLVPKAERLSPPAPSGSERRLSGDLSSMPGPGTLSVRVSPPQPILSRGRPDSNKTENRRITHISAEQKRRFNIKLGFDTLHGLVSTLSAQPSLKVSKATTLQKTAEYILMLQQERAGLQEEAQQLRDEIEELNAAINLCQQQLPATGVPITHQRFDQMRDMFDDYVRTRTLHNWKFWVFSILIRPLFESFNGMVSTASVHTLRQTSLAWLDQYCSLPALRPTVLNSLRQLGTSTSILTDPGRIPEQATRAVTEGTLGKPL

SEQ ID NO: 811207 - protein, 833 aa, Homo sapiens
MAGALAGLAAGLQVPRVAPSPDSDSDTDSEDPSLRRSAGGLLRSQVIHSGHFMVSSPHSDSLPRRRDQEGSVGPSDFGPRSIDPTLTRLFECLSLAYSGKLVSPKWKNFKGLKLLCRDKIRLNNAIWRAWYIQYVKRRKSPVCGFVTPLQGPEADAHRKPEAVVLEGNYWKRRIEVVMREYHKWRIYYKKRLRKPSREDDLLAPKQAEGRWPPPEQWCKQLFSSVVPVLLGDPEEEPGGRQLLDLNCFLSDISDTLFTMTQSGPSPLQLPPEDAYVGNADMIQPDLTPLQPSLDDFMDISDFFTNSRLPQPPMPSNFPEPPSFSPVVDSLFSSGTLGPEVPPASSAMTHLSGHSRLQARNSCPGPLDSSAFLSSDFLLPEDPKPRLPPPPVPPPLLHYPPPAKVPGLEPCPPPPFPPMAPPTALLQEEPLFSPRFPFPTVPPAPGVSPLPAPAAFPPTPQSVPSPAPTPFPIELLPLGYSEPAFGPCFSMPRGKPPAPSPRGQKASPPTLAPATASPPTTAGSNNPCLTQLLTAAKPEQALEPPLVSSTLLRSPGSPQETVPEFPCTFLPPTPAPTPPRPPPGPATLAPSRPLLVPKAERLSPPAPSGSERRLSGDLSSMPGPGTLSVRVSPPQPILSRGRPDSNKTENRRITHISAEQKRRFNIKLGFDTLHGLVSTLSAQPSLKERAGLQEEAQQLRDEIEELNAAINLCQQQLPATGVPITHQRFDQMRDMFDDYVRTRTLHNWKFWVFSILIRPLFESFNGMVSTASVHTLRQTSLAWLDQYCSLPALRPTVLNSLRQLGTSTSILTDPGRIPEQATRAVTEGTLGKPL

SEQ ID NO: 811208 - protein, 575 aa, Homo sapiens
MAGALAGLAAGLQVPRVAPSPDSDSDTDSEDPSLRRSAGGLLRSQVIHSGHFMVSSPHSDSLPRRRDQEGSVGPSDFGPRSIDPTLTRLFECLSLAYSGKLVSPKWKNFKGLKLLCRDKIRLNNAIWRAWYIQYVKRRKSPVCGFVTPLQGPEADAHRKPEAVVLEGNYWKRRIEVVMREYHKWRIYYKKRLRKPSREDDLLAPKQAEGRWPPPEQWCKQLFSSVVPVLLGDPEEEPGGRQLLDLNCFLSDISDTLFTMTQSGPSPLQLPPEDAYVGNADMIQPDLTPLQPSLDDFMDISDFFTNSRLPQPPMPSNFPEPPSFSPVVDSLFSSGTLGPEVPPASSAMTHLSGHSRLQARNSCPGPLDSSAFLSSDFLLPEDPKPRLPPPPVPPPLLHYPPPAKVPGLEPCPPPPFPPMAPPTALLQEEPLFSPRFPFPTVPPAPGVSPLPAPAAFPPTPQSVPSPAPTPFPIELLPLGYSEPAFGPCFSMPRGKPPAPSPRGQKASPPTLAPATASPPTTAGSNNPCLTQLLTAAKPEQALEPPLVSSTLLRSPGSPAVNGGCQGTSAPCQALGL

SEQ ID NO: 811209 - protein, 535 aa, Homo sapiens
MIQPDLTPLQPSLDDFMDISDFFTNSRLPQPPMPSNFPEPPSFSPVVDSLFSSGTLGPEVPPASSAMTHLSGHSRLQARNSCPGPLDSSAFLSSDFLLPEDPKPRLPPPPVPPPLLHYPPPAKVPGLEPCPPPPFPPMAPPTALLQEEPLFSPRFPFPTVPPAPGVSPLPAPAAFPPTPQSVPSPAPTPFPIELLPLGYSEPAFGPCFSMPRGKPPAPSPRGQKASPPTLAPATASPPTTAGSNNPCLTQLLTAAKPEQALEPPLVSSTLLRSPGSPQETVPEFPCTFLPPTPAPTPPRPPPGPATLAPSRPLLVPKAERLSPPAPSGSERRLSGDLSSMPGPGTLSVRVSPPQPILSRGRPDSNKTENRRITHISAEQKRRFNIKLGFDTLHGLVSTLSAQPSLKVSKATTLQKTAEYILMLQQERAGLQEEAQQLRDEIEELNAAINLCQQQLPATGVPITHQRFDQMRDMFDDYVRTRTLHNWKFWVFSILIRPLFESFNGMVSTASVHTLRQTSLAWLDQYCSLPALRPST

SEQ ID NO: 811210 - protein, 233 aa, Homo sapiens [sequence omitted]

SEQ ID NO: 811211 - protein, 177 aa, Homo sapiens
LLKAGPAAQRTEPSAARAEKAPGAVRRSQASPQRPRRPPPAPGRAAPLCRSSGFQVRAWSPRVISGKLVSPKWKNFKGLKLLCRDKIRLNNAIWRAWYIQYVKRRKSPVCGFVTPLQGPEADAHRKPEAVVLEGNYWKRRIEVVMREYHKWRIYYKKRLRKPSREDDLLAPKQVGAL

SEQ ID NO: 811212 - protein, 884 aa, Homo sapiens
LLKAGPAAQRTEPSAARAEKAPGAVRRSQASPQRPRRPPPAPGRAAPLCRSSGFQVRAWSPRVISGKLVSPKWKNFKGLKLLCRDKIRLNNAIWRAWYIQYVKRRKSPVCGFVTPLQGPEADAHRKPEAVVLEGNYWKRRIEVVMREYHKWRIYYKKRVSGGGPGRPQSFPPAAAGYRPPRKIPGKGILTPELAPLGPSIQSRADSATVWPQRLLAASLPRGRLRKPSREDDLLAPKQAEGRWPPPEQWCKQLFSSVVPVLLGDPEEEPGGRQLLDLNCFLSDISDTLFTMTQSGPSPLQLPPEDAYVGNADMIQPDLTPLQPSLDDFMDISDFFTNSRLPQPPMPSNFPEPPSFSPVVDSLFSSGTLGPEVPPASSAMTHLSGHSRLQARNSCPGPLDSSAFLSSDFLLPEDPKPRLPPPPVPPPLLHYPPPAKVPGLEPCPPPPFPPMAPPTALLQEEPLFSPRFPFPTVPPAPGVSPLPAPAAFPPTPQSVPSPAPTPFPIELLPLGYSEPAFGPCFSMPRGKPPAPSPRGQKASPPTLAPATASPPTTAGSNNPCLTQLLTAAKPEQALEPPLVSSTLLRSPGSPQETVPEFPCTFLPPTPAPTPPRPPPGPATLAPSRPLLVPKAERLSPPAPSGSERRLSGDLSSMPGPGTLSVRVSPPQPILSRGRPDSNKTENRRITHISAEQKRRFNIKLGFDTLHGLVSTLSAQPSLKVSKATTLQKTAEYILMLQQERAGLQEEAQQLRDEIEELNAAINLCQQQLPATGVPITHQRFDQMRDMFDDYVRTRTLHNWKFWVFSILIRPLFESFNGMVSTASVHTLRQTSLAWLDQYCSLPALRPTVLNSLRQLGTSTSILTDPGRIPEQATRAVTEGTLGKPL

SEQ ID NO: 811213 - protein, 677 aa, Homo sapiens
GGWGKGSGVQLCVSLQLRKPSREDDLLAPKQAEGRWPPPEQWCKQLFSSVVPVLLGDPEEEPGGRQLLDLNCFLSDISDTLFTMTQSGPSPLQLPPEDAYVGNADMIQPDLTPLQPSLDDFMDISDFFTNSRLPQPPMPSNFPEPPSFSPVVDSLFSSGTLGPEVPPASSAMTHLSGHSRLQARNSCPGPLDSSAFLSSDFLLPEDPKPRLPPPPVPPPLLHYPPPAKVPGLEPCPPPPFPPMAPPTALLQEEPLFSPRFPFPTVPPAPGVSPLPAPAAFPPTPQSVPSPAPTPFPIELLPLGYSEPAFGPCFSMPRGKPPAPSPRGQKASPPTLAPATASPPTTAGSNNPCLTQLLTAAKPEQALEPPLVSSTLLRSPGSPQETVPEFPCTFLPPTPAPTPPRPPPGPATLAPSRPLLVPKAERLSPPAPSGSERRLSGDLSSMPGPGTLSVRVSPPQPILSRGRPDSNKTENRRITHISAEQKRRFNIKLGFDTLHGLVSTLSAQPSLKVSKATTLQKTAEYILMLQQERAGLQEEAQQLRDEIEELNAAINLCQQQLPATGVPITHQRFDQMRDMFDDYVRTRTLHNWKFWVFSILIRPLFESFNGMVSTASVHTLRQTSLAWLDQYCSLPALRPTVLNSLRQLGTSTSILTDPGRIPEQATRAVTEGTLGKPL

SEQ ID NO: 811214 - protein, 685 aa, Homo sapiens
MAGALAGLAAGLQVPRVAPSPDSDSDTDSEDPSLRRSAGGLLRSQVIHSGHFMVSSPHSDSLPRRRDQEGSVGPSDFGPRSIDPTLTRLFECLSLAYSGKLVSPKWKNFKGLKLLCRDKIRLNNAIWRAWYIQYFFTNSRLPQPPMPSNFPEPPSFSPVVDSLFSSGTLGPEVPPASSAMTHLSGHSRLQARNSCPGPLDSSAFLSSDFLLPEDPKPRLPPPPVPPPLLHYPPPAKVPGLEPCPPPPFPPMAPPTALLQEEPLFSPRFPFPTVPPAPGVSPLPAPAAFPPTPQSVPSPAPTPFPIELLPLGYSEPAFGPCFSMPRGKPPAPSPRGQKASPPTLAPATASPPTTAGSNNPCLTQLLTAAKPEQALEPPLVSSTLLRSPGSPQETVPEFPCTFLPPTPAPTPPRPPPGPATLAPSRPLLVPKAERLSPPAPSGSERRLSGDLSSMPGPGTLSVRVSPPQPILSRGRPDSNKTENRRITHISAEQKRRFNIKLGFDTLHGLVSTLSAQPSLKVSKATTLQKTAEYILMLQQERAGLQEEAQQLRDEIEELNAAINLCQQQLPATGVPITHQRFDQMRDMFDDYVRTRTLHNWKFWVFSILIRPLFESFNGMVSTASVHTLRQTSLAWLDQYCSLPALRPTVLNSLRQLGTSTSILTDPGRIPEQATRAVTEGTLGKPL

SEQ ID NO: 811215 - protein, 252 aa, Homo sapiens
GLSVPTTGSERRLSGDLSSMPGPGTLSVRVSPPQPILSRGRPDSNKTENRRITHISAEQKRRFNIKLGFDTLHGLVSTLSAQPSLKVSKATTLQKTAEYILMLQQERAGLQEEAQQLRDEIEELNAAINLCQQQLPATGVPITHQRFDQMRDMFDDYVRTRTLHNWKFWVFSILIRPLFESFNGMVSTASVHTLRQTSLAWLDQYCSLPALRPTVLNSLRQLGTSTSILTDPGRIPEQATRAVTEGTLGKPL

SEQ ID NO: 811216 - protein, 884 aa, Homo sapiens; identical to SEQ ID NO: 811212

SEQ ID NO: 811217 - protein, 79 aa, Homo sapiens
GALGCFLGGRVRARRRSLPGSAFLKAGLPFGEGVSVSASGACLVWRTGEKHFFSYCIPSASSLLRGPSLPPPDATQKMD

SEQ ID NO: 811218 - protein, 793 aa, Homo sapiens
MQTKVQNKKRQVAFFILLMLWGEVGSESIQYSVLEETESGTFVANLTKDLGLRVGELASRGARVVFKGNRQHLQFDPQTHDLLLNEKLDREELCGSTEPCVLPFQVLLENPLQFFQASLRVRDINDHAPEFPAREMLLKISEITMPGKIFPLKMAHDLDTGSNGLQRYTISSNPHFHVLTRNRSEGRKFPELVLDKPLDREEQPQLRLTLIALDGGSPPRSGTSEIQIQVLDINDNVPEFAQELYEAQVPENNPLGSLVITVSARDLDAGSFGKVSYALFQVDDVNQPFEINAITGEIRLRKALDFEEIQSYDVDVEATDGGGLSGKCSLVVRVLDVNDNAPELTMSFFISLIPENLPEITVAVFSVSDADSGHNQQVICSIENNLPFLLRPSVENFYTLVTEGALDRESRAEYNITITVTDLGTPRLKTQQSITVQVSDVNDNVPAFTQTSYTLFVRENNSPALHIGSVSATDRDSGINAQVTYSLLPPQDPHLPLSSLVSINADNGHLFALRSLDYEALQSFEFRVGATDRGSPALSSEALVRLLVLDANDNSPFVLYPLQNGSAPCTELVPRAAEPGYLVTKVVAVDGDSGQNAWLSYQLLKATELGLFGVWAHNGEVRTARLLSERDAAKHRLVVLVKDNGEPPRSATATLHVLLVDGFSQPYLPLPEAAPAQAQADSLTVYLVVALASVSSLFLFSVLLFVAVRLCRRSRAASVGRYSVPEGPFPGHLVDVSGTGTLSQSYQYKVCLTGGSETNEFKFLKPIMPNFPPQGTEREMEETPTSRNSFPFS

SEQ ID NO: 811219 - protein, 446 aa, Homo sapiens
RRPQSLSPVLSLSPDSMSFTTRSTFSTNYRSLGSVQAPSYGARPVSSAASVYAGAGGSGSRISVSRSTSFRGGMGSGGLATGIAGGLAGMGGIQNEKETMQSLNDRLASYLDRVRSLETENRRLESKIREHLEKKGPQVRDWSHYFKIIEDLRAQIFANTVDNARIVLQIDNARLAADDFRVKYETELAMRQSVENDIHGLRKVIDDTNITRLQLETEIEALKEELLFMKKNHEEEVKGLQAQIASSGLTVEVDAPKSQDLAKIMADIRGQYDELARKNREELDKYWSQQIEESTTVVTTQSAEVGAAETTLTELRRTVQSLEIDLDSMRNLKATLENSLREVEARYALQMEQLNGILLHLESELAQTRAEGQRQAQEYEALLNIKVKLEAEIATYRRLLEDGEDFNLGDALDSSNSMQTIQKTTTRRIVDGKVVSETNDTKVLRH

SEQ ID NO: 811220 - protein, 365 aa, Homo sapiens
MRLRSGGTEGLLAEKLEALITQTRAKQAATMSEVEWRGRTVPVKIDKVRIFLLGLADNEAAIVQAESEETKERLFESMLSECRDAIQVVREELKPDQKQRDYILEGEPGKVSNLQYLHSYLTYIKLSTAIKRNENMAKGLQRALLQQQPEDDSKRSPRPQDLIRLYDIILQNLVELLQLPGLEEDKAFQKEIGLKTLVFKAYRCFFIAQSYVLVKKWSEALVLYDRVLKYANEVNSDAGAFKNSLKDLPDVQELITQVRSEKCSLQAAAILDANDAHQTETSSSQVKDNKPLVERFETFCLDPSLVTKQANLVHFPPGFQPIPCKPLFFDLALNHVAFPPLEDKLEQKTKSGLTGYIKGIFGFRS

SEQ ID NO: 811221 - protein, 309 aa, Homo sapiens
ARSSTWRPAAARADGGGVRRYPISPARQVQLSPAQVVPPPLSRLALRRRGKMAAEKQVPGGGGGGGSGGGGGSGGGGSGGGRGAGGEENKENERPSAGSKANKEFGDSLSLEILQIIKESQQQHGLRHGDFQRYRGYCSRRQRRLRKTLNFKMGNRHKFTGKKVTEELLTDNRYLLLVLMDAERAWSYAMQLKQEANTEPRKRFHLLSRLRKAVKHAEELERLCESNRVDAKTKLEAQAYTAYLSGMLRFEHQEWKAAIEAFNKCKTIYEKLASAFTEEQAVLYNQRVEEISPNIRYCAYNIGGPVSHQ

SEQ ID NO: 811222 - protein, 208 aa, Homo sapiens
MLLLVSENPLRVLQNLVELLQLPGLEEDKAFQKEIGLKTLVFKAYRCFFIAQSYVLVKKWSEALVLYDRVLKYANEVNSDAGAFKNSLKDLPDVQELITQVRSEKCSLQAAAILDANDAHQTETSSSQVKDNKPLVERFETFCLDPSLVTKQANLVHFPPGFQPIPCKPLFFDLALNHVAFPPLEDKLEQKTKSGLTGYIKGIFGFRS

SEQ ID NO: 811223 - protein, 365 aa, Homo sapiens; identical to SEQ ID NO: 811220

SEQ ID NO: 811224 - protein, 365 aa, Homo sapiens; identical to SEQ ID NO: 811220

SEQ ID NO: 811225 - protein, 365 aa, Homo sapiens; identical to SEQ ID NO: 811220

SEQ ID NO: 811226 - protein, 365 aa, Homo sapiens; identical to SEQ ID NO: 811220

SEQ ID NO: 811227 - protein, 365 aa, Homo sapiens; identical to SEQ ID NO: 811220

SEQ ID NO: 811228 - protein, 365 aa, Homo sapiens; identical to SEQ ID NO: 811220

SEQ ID NO: 811229 - protein, 365 aa, Homo sapiens; identical to SEQ ID NO: 811220

SEQ ID NO: 811230 - protein, 307 aa, Homo sapiens
MRLRSGGTEGLLAEKLEALITQTRAKQAATMSEVEWRGRTVPVKIDKVRIFLLGLADNEAAIVQAESEETKERLFESMLSECRDAIQVVREELKPDQKQRDYILEGEPGKVSNLQYLHSYLTYIKLSTAIKRNENMAKGLQRALLQQQPEDDSKRSPRPQDLIRLYDIILQNLVELLQLPGLEEDKAFQKEIGLKTLVFKAYRCFFIAQSYVLVKKWSEALVLYDRVLKYANEVNSDAGAFKNSLKDLPDVQELITQVRSEKCSLQAAAILDANDAHQTETSSSQVKDNKPLVSNAFRSPHQAQMGP

SEQ ID NO: 811231 - protein, 309 aa, Homo sapiens; identical to SEQ ID NO: 811221

SEQ ID NO: 811232 - protein, 365 aa, Homo sapiens; identical to SEQ ID NO: 811220

SEQ ID NO: 811233 - protein, 441 aa, Homo sapiens
LTHLISFQHLIRAFNISPPFQHLIAPSNIAYLLPTSHPAFQHLMSLPTSHLSFQHLIPFLPTSHPPPNISCLLPWPLPTSHASSQHLMAEKLEALITQTRAKQAATMSEVEWRGRTVPVKIDKVRIFLLGLADNEAAIVQAESEETKERLFESMLSECRDAIQVVREELKPDQKQRDYILEGEPGKVSNLQYLHSYLTYIKLSTAIKRNENMAKGLQRALLQQQPEDDSKRSPRPQDLIRLYDIILQNLVELLQLPGLEEDKAFQKEIGLKTLVFKAYRCFFIAQSYVLVKKWSEALVLYDRVLKYANEVNSDAGAFKNSLKDLPDVQELITQVRSEKCSLQAAAILDANDAHQTETSSSQVKDNKPLVERFETFCLDPSLVTKQANLVHFPPGFQPIPCKPLFFDLALNHVAFPPLEDKLEQKTKSGLTGYIKGIFGFRS

SEQ ID NO: 811234 - protein, 208 aa, Homo sapiens; identical to SEQ ID NO: 811222

SEQ ID NO: 811235 - protein, 103 aa, Homo sapiens
LVRSEFRPQPDPGQAPRLGAVSPPRLGEALRPEGASPPVPGTRAAPASRPLPEKQVKGVQGGAVGEAWGPGGSAAAGGLWDLGDVVMDAAVGPGEMKRRGGSP

SEQ ID NO: 811236 - protein, 846 aa, Homo sapiens
VIQRFPELRRRRLGGGAGGSDVAAEGTSPNRILDRHPGLALSLPLGSERPFGLREPRRPSPAHAQPRPLGLCRRNRMAQWNQLQQLDTRYLEQLHQLYSDSFPMELRQFLAPWIESQDWAYAASKESHATLVFHNLLGEIDQQYSRFLQESNVLYQHNLRRIKQFLQSRYLEKPMEIARIVARCLWEESRLLQTAATAAQQGGQANHPTAAVVTEKQQMLEQHLQDVRKRVQDLEQKMKVVENLQDDFDFNYKTLKSQGDMQDLNGNNQSVTRQKMQQLEQMLTALDQMRRSIVSELAGLLSAMEYVQKTLTDEELADWKRRQQIACIGGPPNICLDRLENWITSLAESQLQTRQQIKKLEELQQKVSYKGDPIVQHRPMLEERIVELFRNLMKSAFVVERQPCMPMHPDRPLVIKTGVQFTTKVRLLVKFPELNYQLKIKVCIDKDSGDVAALRGSRKFNILGTNTKVMNMEESNNGSLSAEFKHLTLREQRCGNGGRANCDASLIVTEELHLITFETEVYHQGLKIDLETHSLPVVVISNICQMPNAWASILWYNMLTNNPKNVNFFTKPPIGTWDQVAEVLSWQFSSTTKRGLSIEQLTTLAEKLLGPGVNYSGCQITWAKFCKENMAGKGFSFWVWLDNIIDLVKKYILALWNEGYIMGFISKERERAILSTKPPGTFLLRFSESSKEGGVTFTWVEKDISGKTQIQSVEPYTKQQLNNMSFAEIIMGYKIMDATNILVSPLVYLYPDIPKEEAFGKYCRPESQEHPEADPGSAAPYLKTKFICVTPTTCSNTIDLPMSPRTLDSLMQFGNNGEGAEPSAGGQFESLTFDMELTSECATSPM

SEQ ID NO: 811237 - protein, 846 aa, Homo sapiens; identical to SEQ ID NO: 811236

SEQ ID NO: 811238 - protein, 770 aa, Homo sapiens
MAQWNQLQQLDTRYLEQLHQLYSDSFPMELRQFLAPWIESQDWAYAASKESHATLVFHNLLGEIDQQYSRFLQESNVLYQHNLRRIKQFLQSRYLEKPMEIARIVARCLWEESRLLQTAATAAQQGGQANHPTAAVVTEKQQMLEQHLQDVRKRVQDLEQKMKVVENLQDDFDFNYKTLKSQGDMQDLNGNNQSVTRQKMQQLEQMLTALDQMRRSIVSELAGLLSAMEYVQKTLTDEELADWKRRQQIACIGGPPNICLDRLENWITSLAESQLQTRQQIKKLEELQQKVSYKGDPIVQHRPMLEERIVELFRNLMKSAFVVERQPCMPMHPDRPLVIKTGVQFTTKVRLLVKFPELNYQLKIKVCIDKDSGDVAALRGSRKFNILGTNTKVMNMEESNNGSLSAEFKHLTLREQRCGNGGRANCDASLIVTEELHLITFETEVYHQGLKIDLETHSLPVVVISNICQMPNAWASILWYNMLTNNPKNVNFFTKPPIGTWDQVAEVLSWQFSSTTKRGLSIEQLTTLAEKLLGPGVNYSGCQITWAKFCKENMAGKGFSFWVWLDNIIDLVKKYILALWNEGYIMGFISKERERAILSTKPPGTFLLRFSESSKEGGVTFTWVEKDISGKTQIQSVEPYTKQQLNNMSFAEIIMGYKIMDATNILVSPLVYLYPDIPKEEAFGKYCRPESQEHPEADPGSAAPYLKTKFICVTPTTCSNTIDLPMSPRTLDSLMQFGNNGEGAEPSAGGQFESLTFDMELTSECATSPM

SEQ ID NO: 811239 - protein, 825 aa, Homo sapiens
NTSARYRGLGVKIGRPGLALSLPLGSERPFGLREPRRPSPAHAQPRPLGLCRRNRMAQWNQLQQLDTRYLEQLHQLYSDSFPMELRQFLAPWIESQDWAYAASKESHATLVFHNLLGEIDQQYSRFLQESNVLYQHNLRRIKQFLQSRYLEKPMEIARIVARCLWEESRLLQTAATAAQQGGQANHPTAAVVTEKQQMLEQHLQDVRKRVQDLEQKMKVVENLQDDFDFNYKTLKSQGDMQDLNGNNQSVTRQKMQQLEQMLTALDQMRRSIVSELAGLLSAMEYVQKTLTDEELADWKRRQQIACIGGPPNICLDRLENWITSLAESQLQTRQQIKKLEELQQKVSYKGDPIVQHRPMLEERIVELFRNLMKSAFVVERQPCMPMHPDRPLVIKTGVQFTTKVRLLVKFPELNYQLKIKVCIDKDSGDVAALRGSRKFNILGTNTKVMNMEESNNGSLSAEFKHLTLREQRCGNGGRANCDASLIVTEELHLITFETEVYHQGLKIDLETHSLPVVVISNICQMPNAWASILWYNMLTNNPKNVNFFTKPPIGTWDQVAEVLSWQFSSTTKRGLSIEQLTTLAEKLLGPGVNYSGCQITWAKFCKENMAGKGFSFWVWLDNIIDLVKKYILALWNEGYIMGFISKERERAILSTKPPGTFLLRFSESSKEGGVTFTWVEKDISGKTQIQSVEPYTKQQLNNMSFAEIIMGYKIMDATNILVSPLVYLYPDIPKEEAFGKYCRPESQEHPEADPGSAAPYLKTKFICVTPTTCSNTIDLPMSPRTLDSLMQFGNNGEGAEPSAGGQFESLTFDMELTSECATSPM

SEQ ID NO: 811240 - protein, 846 aa, Homo sapiens; identical to SEQ ID NO: 811236

SEQ ID NO: 811241 - protein, 699 aa, Homo sapiens
MRPAKNHMPLWCFIISWERLTSSIAASCKSRMFSISTIYEESRLLQTAATAAQQGGQANHPTAAVVTEKQQMLEQHLQDVRKRVQDLEQKMKVVENLQDDFDFNYKTLKSQGDMQDLNGNNQSVTRQKMQQLEQMLTALDQMRRSIVSELAGLLSAMEYVQKTLTDEELADWKRRQQIACIGGPPNICLDRLENWITSLAESQLQTRQQIKKLEELQQKVSYKGDPIVQHRPMLEERIVELFRNLMKSAFVVERQPCMPMHPDRPLVIKTGVQFTTKVRLLVKFPELNYQLKIKVCIDKDSGDVAALRGSRKFNILGTNTKVMNMEESNNGSLSAEFKHLTLREQRCGNGGRANCDASLIVTEELHLITFETEVYHQGLKIDLETHSLPVVVISNICQMPNAWASILWYNMLTNNPKNVNFFTKPPIGTWDQVAEVLSWQFSSTTKRGLSIEQLTTLAEKLLGPGVNYSGCQITWAKFCKENMAGKGFSFWVWLDNIIDLVKKYILALWNEGYIMGFISKERERAILSTKPPGTFLLRFSESSKEGGVTFTWVEKDISGKTQIQSVEPYTKQQLNNMSFAEIIMGYKIMDATNILVSPLVYLYPDIPKEEAFGKYCRPESQEHPEADPGSAAPYLKTKFICVTPTTCSNTIDLPMSPRTLDSLMQFGNNGEGAEPSAGGQFESLTFDMELTSECATSPM

SEQ ID NO: 811242 - protein, 945 aa, Homo sapiens
VIQRFPELRRRRLGGGAGGSDVAAEGTSPNRILDRHPGLALSLPLGSERPFGLREPRRPSPAHAQPRPLGLCRRNRMAQWNQLQQLDTRYLEQLHQLYSDSFPMELRQFLAPWIESQDWAYAASKESHATLVFHNLLGEIDQQYSRFLQESNVLYQHNLRRIKQFLQSRYLEKPMEIARIVARCLWEESRLLQTAATAAQQGGQANHPTAAVVTEKQQMLEQHLQDVRKRVQDLEQKMKVVENLQDDFDFNYKTLKSQGDMQDLNGNNQSVTRQKMQQLEQMLTALDQMRRVRARSDHFPHVSRSLAGFQRLVAELAWFLRSSCSGVDKRMWLETAEEMFSDFVLVSNQSIVSELAGLLSAMEYVQKTLTDEELADWKRRQQIACIGGPPNICLDRLENWITSLAESQLQTRQQIKKLEELQQKVSYKGDPIVQHRPMLEERIVELFRNLMKRYLASLSLSLIYKIPKDSRGRVRGGLTSGHGRAREPIFSFLSAFVVERQPCMPMHPDRPLVIKTGVQFTTKVRLLVKFPELNYQLKIKVCIDKDSGDVAALRGSRKFNILGTNTKVMNMEESNNGSLSAEFKHLTLREQRCGNGGRANCDASLIVTEELHLITFETEVYHQGLKIDLETHSLPVVVISNICQMPNAWASILWYNMLTNNPKNVNFFTKPPIGTWDQVAEVLSWQFSSTTKRGLSIEQLTTLAEKLLGPGVNYSGCQITWAKFCKENMAGKGFSFWVWLDNIIDLVKKYILALWNEGYIMGFISKERERAILSTKPPGTFLLRFSESSKEGGVTFTWVEKDISGKTQIQSVEPYTKQQLNNMSFAEIIMGYKIMDATNILVSPLVYLYPDIPKEEAFGKYCRPESQEHPEADPGSAAPYLKTKFICVTPTTCSNTIDLPMSPRTLDSLMQFGNNGEGAEPSAGGQFESLTFDMELTSECATSPM

SEQ ID NO: 811243 - protein, 828 aa, Homo sapiens
VIQRFPELRRRRLGGGAGGSDVAAEGTSPNRILDRHPGLALSLPLGSERPFGLREPRRPSPAHAQPRPLGLCRRNRMAQWNQLQQLDTRYLEQLHQLYSDSFPMELRQFLAPWIESQDWAYAASKESHATLVFHNLLGEIDQQYSRFLQESNVLYQHNLRRIKQFLQSRYLEKPMEIARIVARCLWEESRLLQTAATAAQQGGQANHPTAAVVTEKQQMLEQHLQDVRKRVQDLEQKMKVVENLQDDFDFNYKTLKSQGDMQDLNGNNQSVTRQKMQQLEQMLTALDQMRRSIVSELAGLLSAMEYVQKTLTDEELADWKRRQQIACIGGPPNICLDRLENWITSLAESQLQTRQQIKKLEELQQKVSYKGDPIVQHRPMLEERIVELFRNLMKSAFVVERQPCMPMHPDRPLVIKTGVQFTTKVRLLVKFPELNYQLKIKVCIDKDSGDVAALRGSRKFNILGTNTKVMNMEESNNGSLSAEFKHLTLREQRCGNGGRANCDASLIVTEELHLITFETEVYHQGLKIDLETHSLPVVVISNICQMPNAWASILWYNMLTNNPKNVNFFTKPPIGTWDQVAEVLSWQFSSTTKRGLSIEQLTTLAEKLLGPGVNYSGCQITWAKFCKENMAGKGFSFWVWLDNIIDLVKERERAILSTKPPGTFLLRFSESSKEGGVTFTWVEKDISGKTQIQSVEPYTKQQLNNMSFAEIIMGYKIMDATNILVSPLVYLYPDIPKEEAFGKYCRPESQEHPEADPGSAAPYLKTKFICVTPTTCSNTIDLPMSPRTLDSLMQFGNNGEGAEPSAGGQFESLTFDMELTSECATSPM

SEQ ID NO: 811244 - protein, 778 aa, Homo sapiens
VIQRFPELRRRRLGGGAGGSDVAAEGTSPNRILDRHPGLALSLPLGSERPFGLREPRRPSPAHAQPRPLGLCRRNRMAQWNQLQQLDTRYLEQLHQLYSDSFPMELRQFLAPWIESQDWAYAASKESHATLVFHNLLGEIDQQYSRFLQESNVLYQHNLRRIKQFLQSRYLEKPMEIARIVARCLWEESRLLQTAATAAQQGGQANHPTAAVVTEKQQMLEQHLQDVRKRVQDLEQKMKVVENLQDDFDFNYKTLKSQGDMQDLNGNNQSVTRQKMQQLEQMLTALDQMRRSIVSELAGLLSAMEYVQKTLTDEELADWKRRQQIACIGGPPNICLDRLENWITSLAESQLQTRQQIKKLEELQQKVSYKGDPIVQHRPMLEERIVELFRNLMKSAFVVERQPCMPMHPDRPLVIKTGVQFTTKVRLLVKFPELNYQLKIKVCIDKDSGDVAALRGSRKFNILGTNTKVMNMEESNNGSLSAEFKHLTLREQRCGNGGRANCDASLIVTEELHLITFETEVYHQGLKIDLETHSLPVVVISNICQMPNAWASILWYNMLTNNPKNVNFFTKPPIGTWDQVAEVLSWQFSSTTKRGLSIEQLTTLAEKLLGPGVNYSGCQITWAKFCKENMAGKGFSFWVWLDNIIDLVKKYILALWNEGYIMGFISKERERAILSTKPPGTFLLRFSESSKEGGVTFTWVEKDISGKTQIQSVEPYTKQQLNNMSFAEIIMGYKIMDATNILVSPLVYLYPDIPKEEAFGKYCRPESQEHPEADPGSC

SEQ ID NO: 811245 - protein, 566 aa, Homo sapiens
MFSDFVLVSNQSIVSELAGLLSAMEYVQKTLTDEELADWKRRQQIACIGGPPNICLDRLENWITSLAESQLQTRQQIKKLEELQQKVSYKGDPIVQHRPMLEERIVELFRNLMKSAFVVERQPCMPMHPDRPLVIKTGVQFTTKVRLLVKFPELNYQLKIKVCIDKDSGDVAALRGSRKFNILGTNTKVMNMEESNNGSLSAEFKHLTLREQRCGNGGRANCDASLIVTEELHLITFETEVYHQGLKIDLETHSLPVVVISNICQMPNAWASILWYNMLTNNPKNVNFFTKPPIGTWDQVAEVLSWQFSSTTKRGLSIEQLTTLAEKLLGPGVNYSGCQITWAKFCKENMAGKGFSFWVWLDNIIDLVKKYILALWNEGYIMGFISKERERAILSTKPPGTFLLRFSESSKEGGVTFTWVEKDISGKTQIQSVEPYTKQQLNNMSFAEIIMGYKIMDATNILVSPLVYLYPDIPKEEAFGKYCRPESQEHPEADPGSAAPYLKTKFICVTPTTCSNTIDLPMSPRTLDSLMQFGNNGEGAEPSAGGQFESLTFDMELTSECATSPM

SEQ ID NO: 811246 - protein, 798 aa, Homo sapiens
VIQRFPELRRRRLGGGAGGSDVAAEGTSPNRILDRHPGLALSLPLGSERPFGLREPRRPSPAHAQPRPLGLCRRNRMAQWNQLQQLDTRYLEQLHQLYSDSFPMELRQFLAPWIESQDWAYAASKESHATLVFHNLLGEIDQQYSRFLQESNVLYQHNLRRIKQFLQSRYLEKPMEIARIVARCLWEESRLLQTAATAAQQGGQANHPTAAVVTEKQQMLEQHLQDVRKRVQDLEQKMKVVENLQDDFDFNYKTLKSQGDMQDLNGNNQSVTRQKMQQLEQMLTALDQMRRSIVSELAGLLSAMEYVQKTLTDEELADWKRRQQIACIGGPPNICLDRLENWITSLAESQLQTRQQIKKLEELQQKVSYKGDPIVQHRPMLEERIVELFRNLMKSAFVVERQPCMPMHPDRPLVIKTGVQFTTKVRLLVKFPELNYQLKIKVCIDKDSGDVAALRGSRKFNILGTNTKVMNMEESNNGSLSAEFKHLTLREQRCGNGGRANCDASLIVTEELHLITFETEVYHQGLKIDLETHSLPVVVISNICQMPNAWASILWYNMLTNNPKNVNFFTKPPIGTWDQVAEVLSWQFSSTTKRGLSIEQLTTLAEKLLGPGVNYSGCQITWAKFCKENMAGKGFSFWVWLDNIIDLVKKYILALWNEGYIMGFISKERERAILSTKPPGTFLLRFSESSKEGGVTFTWVEKDISGKTQIQSVEPYTKQQLNNMSFAEIIMGYKIMDATNILVSPLVYLYPDIPKEEAFGKYCRPESQEHPEADPGSAAPYLKTKFICVTPFIDAVWK

SEQ ID NO: 811247 - protein, 778 aa, Homo sapiens; identical to SEQ ID NO: 811244

SEQ ID NO: 811248 - protein, 263 aa, Homo sapiens
PKDPRSCRYQRGLSIEQLTTLAEKLLGPGVNYSGCQITWAKFCKENMAGKGFSFWVWLDNIIDLVKKYILALWNEGYIMGFISKERERAILSTKPPGTFLLRFSESSKEGGVTFTWVEKDISGKTQIQSVEPYTKQQLNNMSFAEIIMGYKIMDATNILVSPLVYLYPDIPKEEAFGKYCRPESQEHPEADPGSAAPYLKTKFICVTPTTCSNTIDLPMSPRTLDSLMQFGNNGEGAEPSAGGQFESLTFDMELTSECATSPM

SEQ ID NO: 811249 - protein, 265 aa, Homo sapiens
NTSARYEAGCLNRPREHRAADYTGRETLGPGVNYSGCQITWAKFCKENMAGKGFSFWVWLDNIIDLVKKYILALWNEGYIMGFISKERERAILSTKPPGTFLLRFSESSKEGGVTFTWVEKDISGKTQIQSVEPYTKQQLNNMSFAEIIMGYKIMDATNILVSPLVYLYPDIPKEEAFGKYCRPESQEHPEADPGSAAPYLKTKFICVTPTTCSNTIDLPMSPRTLDSLMQFGNNGEGAEPSAGGQFESLTFDMELTSECATSPM

SEQ ID NO: 811250 - protein, 798 aa, Homo sapiens; identical to SEQ ID NO: 811246

SEQ ID NO: 811251 - protein, 66 aa, Homo sapiens
SSVPDLTTRLPTTCSNTIDLPMSPRTLDSLMQFGNNGEGAEPSAGGQFESLTFDMELTSECATSPM

SEQ ID NO: 811252 - protein, 456 aa, Homo sapiens
VIQRFPELRRRRLGGGAGGSDVAAEGTSPNRILDRHPGLALSLPLGSERPFGLREPRRPSPAHAQPRPLGLCRRNRMAQWNQLQQLDTRYLEQLHQLYSDSFPMELRQFLAPWIESQDWAYAASKESHATLVFHNLLGEIDQQYSRFLQESNVLYQHNLRRIKQFLQSRYLEKPMEIARIVARCLWEESRLLQTAATAAQQGGQANHPTAAVVTEKQQMLEQHLQDVRKRVQDLEQKMKVVENLQDDFDFNYKTLKSQGDMQDLNGNNQSVTRQKMQQLEQMLTALDQMRRSIVSELAGLLSAMEYVQKTLTDEELADWKRRQQIACIGGPPNICLDRLENWITSLAESQLQTRQQIKKLEELQQKVSYKGDPIVQHRPMLEERIVELFRNLMKSAFVVERQPCMPMHPDRPLVIKTGVQFTTKVRLLVKFPELNYQLKIKVCIDKDSGDVAALRG

SEQ ID NO: 811253 - protein, 220 aa, Homo sapiens
VIQRFPELRRRRLGGGAGGSDVAAEGTSPNRILDRHPGLALSLPLGSERPFGLREPRRPSPAHAQPRPLGLCRRNRMAQWNQLQQLDTRYLEQLHQLYSDSFPMELRQFLAPWIESQDWAYAASKESHATLVFHNLLGEIDQQYSRFLQESNVLYQHNLRRIKQFLQSRYLEKPMEIARIVARCLWEESRLLQTAATAAQVRPETKQIPGLGGMENQTTL

SEQ ID NO: 811254 - protein, 118 aa, Homo sapiens
GSPCVVQADHELLGSSDPPNSASQSAGITGVSHCTWPTGSLLLGILPAGPACIFFEVLASFEFSSETLYFLFPRKSFFTSVFLFAYFKQDLEQKMKVVENLQDDFDFNYKTLKSQGGK

SEQ ID NO: 811255 - protein, 151 aa, Homo sapiens
VTQHLGAKVSGKTQIQSVEPYTKQQLNNMSFAEIIMGYKIMDATNILVSPLVYLYPDIPKEEAFGKYCRPESQEHPEADPGSAAPYLKTKFICVTPTTCSNTIDLPMSPRTLDSLMQFGNNGEGAEPSAGGQFESLTFDMELTSECATSPM

SEQ ID NO: 811256 - protein, 541 aa, Homo sapiens
VIQRFPELRRRRLGGGAGGSDVAAEGTSPNRILDRHPGLALSLPLGSERPFGLREPRRPSPAHAQPRPLGLCRRNRMAQWNQLQQLDTRYLEQLHQLYSDSFPMELRQFLAPWIESQDWAYAASKESHATLVFHNLLGEIDQQYSRFLQESNVLYQHNLRRIKQFLQSRYLEKPMEIARIVARCLWEESRLLQTAATAAQQGGQANHPTAAVVTEKQQMLEQHLQDVRKRVQDLEQKMKVVENLQDDFDFNYKTLKSQGDMQDLNGNNQSVTRQKMQQLEQMLTALDQMRRSIVSELAGLLSAMEYVQKTLTDEELADWKRRQQIACIGGPPNICLDRLENWITSLAESQLQTRQQIKKLEELQQKVSYKGDPIVQHRPMLEERIVELFRNLMKSAFVVERQPCMPMHPDRPLVIKTGVQFTTKVRLLVKFPELNYQLKIKVCIDKDSGDVAALRGSRKFNILGTNTKVMNMEESNNGSLSAEFKHLTLREQRCGNGGRANCDASLIVTEELHLITFETEVYHQGLKIDLERFTSFNTSGD

SEQ ID NO: 811257 - protein, 168 aa, Homo sapiens
VIQRFPELRRRRLGGGAGGSDVAAEGTSPNRILDRHPGLALSLPLGSERPFGLREPRRPSPAHAQPRPLGLCRRNRMAQWNQLQQLDTRYLEQLHQLYSDSFPMELRQFLAPWIESQDWAYAASKESHATLVFHNLLGEIDQQYSRFLQESNVLYQHNLRRIKQFLQV

SEQ ID NO: 811258 - protein, 109 aa, Homo sapiens
MELDPQAKGAPLQGRSAGSRRLLDRDRGELAAAHNGHGLGGGVRTIALCLRIPVTLRGRPQAGLPQLRGLSGPGVSTLTSGPGRWGRPLVMFRSSGPLPVKGRSSRANC

SEQ ID NO: 811259 - protein, 102 aa, Homo sapiens
HREMGRSPWLGSGRACRRVYCSLSLSLSISLHLSHHTHTHSVLLRENSEKVEFSVGKGYIFPTSHVSLKMGLLLIILLASLYLGKRKRELPERSWEERTKHT

SEQ ID NO: 811260 - protein, 128 aa, Homo sapiens
PPPPRVRPLHSQSAVGARGITGVVVLYARGARRAPMELDPQAKGAPLQGRSAGSRRLLDRDRGELAAAHNGHGLGGGVRTIALCLRIPEPAGPPEVCVLPVPAARRAGLYTCAKDTNGSISKSVLSPK

SEQ ID NO: 811261 - protein, 1301 aa, Homo sapiens
PEASAALQVRATKDYCNNYDLTSLNVKAGDIITVLEQHPDGRWKGCIHDNRTGNDRVGYFPSSLGEAIVKRAGSRAGTEPSLPQGSSSSGPSAPPEEIWVLRKPFAGGDRSGSISGMAGGRGSGGHALHAGSEGVKLLATVLSQKSVSESGPGDSPAKPPEGSAGVARSQPPVAHAGQVYGEQPPKKLEPASEGKSSEAVSQWLTAFQLQLYAPNFISAGYDLPTISRMTPEDLTAIGVTKPGHRKKIAAEISGLSIPDWLPEHKPANLAVWLSMIGLAQYYKVLVDNGYENIDFITDITWEDLQEIGITKLGHQKKLMLAVRKLAELQKAEYAKYEGGPLRRKAPQSLEVMAIESPPPPEPTPADCQSPKMTTFQDSELSDELQAAMTGPAEVGPTTEKPSSHLPPTPRATTRQDSSLGGRARHMSSSQELLGDGPPGPSSPMSRSQEYLLDEGPAPGTPPREARPGRHGHSIKRASVPPVPGKPRQVLPPGTSHFTPPQTPTKTRPGSPQALGGPHGPAPATAKVKPTPQLLPPTERPMSPRSLPQSPTHRGFAYVLPQPVEGEVGPAAPGPAPPPVPTAVPTLCLPPEADAEPGRPKKRAHSLNRYAASDSEPERDELLVPAAAGPYATVQRRVGRSHSVRAPAGADKNVNRSQSFAVRPRKKGPPPPPPKRSSSALASANLADEPVPDAEPEDGLLGVRAQCRRASDLAGSVDTGSAGSVKSIAAMLELSSIGGGGRAARRPPEGHPTPRPASPEPGRVATVLASVKHKEAIGPGGEVVNRRRTLSGPVTGLLATARRGPGESADPGPFVEDGTGRQRPRGPSKGEAGVEGPPLAKVEASATLKRRIRAKQNQQENVKFILTESDTVKRRPKAKEREAGPEPPPPLSVYHNGTGTVRRRPASEQAGPPELPPPPPPAEPPPTDLAHLPPLPPPEGEARKPAKPPVSPKPVLTQPVPKLQGSPTPTSKKVPLPGPWQPRGEARPRHATARVSQAAAAAHSAQARQGGRGAAFGQRRPFTRTLARATAARRPRQAARYAALAGRQPRQAPVPRRARAARARQAPASRRRRRRRRRRAPRPARRRLVRGQRPAETGGDKRVPCRGAAGGGGEDPAGGRAGPARLGGGKEHWQHPGRHRQHVRRPGRPAGCHAGVNAAWPGPPAPPGPSPHTDLYLRMGASGRGASGRAGPCRSTTPAPGPGPGRPPGTAWPGAPRALGRPCARGSSPPAAPRAIPAGPPARAGGEGAPGPGMGQRTGPGPAQNCPSGRPASRSGAAQGTGDQGQGPPAPPHPQNISYQEY

SEQ ID NO: 811262 - protein, 1301 aa, Homo sapiens; identical to SEQ ID NO: 811261

SEQ ID NO: 811263 - protein, 1359 aa, Homo sapiens
MAEAGLRGWLLWALLLRLAQSEPYTTIHQPGYCAFYDECGKNPELSGSLMTLSNVSCLSNTPARKITGDHLILLQKICPRLYTGPNTQACCSAKQLVSLEASLSITKALLTRCPACSDNFVNLHCHNTCSPNQSLFINVTRVAQLGAGQLPAVVAYEAFYQHSFAEQSYDSCSRVRVPAAATLAVGTMCGVYGSALCNAQRWLNFQGDTGNGLAPLDITFHLLEPGQAVGSGIQPLNEGVARCNESQGDDVATCSCQDCAASCPAIARPQALDSTFYLGQMPGSLVLIIILCSVFAVVTILLVGFRVAPARDKSKMVDPKKGTSLSDKLSFSTHTLLGQFFQGWGTWVASWPLTILVLSVIPVVALAAGLVFTELTTDPVELWSAPNSQARSEKAFHDQHFGPFFRTNQVILTAPNRSSYRYDSLLLGPKNFSGILDLDLLLELLELQERLRHLQVWSPEAQRNISLQDICYAPLNPDNTSLYDCCINSLLQYFQNNRTLLLLTANQTLMGQTSQVDWKDHFLYCANAPLTFKDGTALALSCMADYGAPVFPFLAIGGYKGKDYSEAEALIMTFSLNNYPAGDPRLAQAKLWEEAFLEEMRAFQRRMAGMFQVTFMAERSLEDEINRTTAEDLPIFATSYIVIFLYISLALGSYSSWSRVMVDSKATLGLGGVAVVLGAVMAAMGFFSYLGIRSSLVILQVVPFLVLSVGADNIFIFVLEYQRLPRRPGEPREVHIGRALGRVAPSMLLCSLSEAICFFLGALTPMPAVRTFALTSGLAVILDFLLQMSAFVALLSLDSKRQEASRLDVCCCVKPQELPPPGQGEGLLLGFFQKAYAPFLLHWITRGVVLLLFLALFGVSLYSMCHISVGLDQELALPKDSYLLDYFLFLNRYFEVGAPVYFVTTLGYNFSSEAGMNAICSSAGCNNFSFTQKIQYATEFPEQSYLAIPASSWVDDFIDWLTPSSCCRLYISGPNKDKFCPSTVNSLNCLKNCMSITMGSVRPSVEQFHKYLPWFLNDRPNIKCPKGGLAAYSTSVNLTSDGQVLDTVAILSPRLEYSGTISAHCNLYLLDSASRFMAYHKPLKNSQDYTEALRAARELAANITADLRKVPGTDPAFEVFPYTITNVFYEQYLTILPEGLFMLSLCLVPTFAVSCLLLGLDLRSGLLNLLSIVMILVDTVGFMALWGISYNAVSLINLVSAVGMSVEFVSHITRSFAISTKPTWLERAKEATISMGSAVFAGVAMTNLPGILVLGLAKAQLIQIFFFRLNLLITLLGLLHGLVFLPVILSYVGPDVNPALALEQKRAEEAVAAVMVASCPNHPSRVSTADNIYVNHSFEGSIKGAGAISNFLPNNGRQF

SEQ ID NO: 811264 - protein, 724 aa, Homo sapiens
MAEAGLRGWLLWALLLRLAQSEPYTTIHQPGYCAFYDECGKNPELSGSLMTLSNVSCLSNTPARKITGDHLILLQKICPRLYTGPNTQACCSAKQLVSLEASLSITKALLTRCPACSDNFVNLHCHNTCSPNQSLFINVTRVAQLGAGQLPAVVAYEAFYQHSFAEQSYDSCSRVRVPAAATLAVGTMCGVYGSALCNAQRWLNFQGDTGNGLAPLDITFHLLEPGQAVGSGIQPLNEGVARCNESQGDDVATCSCQDCAASCPAIARPQALDSTFYLGQMPGSLVLIIILCSVFAVVTILLVGFRVAPARDKSKMVDPKKGTSLSDKLSFSTHTLLGQFFQGWGTWVASWPLTILVLSVIPVVALAAGLVFTELTTDPVELWSAPNSQARSEKAFHDQHFGPFFRTNQVILTAPNRSSYRYDSLLLGPKNFSGILDLDLLLELLELQERLRHLQVWSPEAQRNISLQDICYAPLNPDNTSLYDCCINSLLQYFQNNRTLLLLTANQTLMGQTSQVDWKDHFLYCANAPLTFKDGTALALSCMADYGAPVFPFLAIGGYKGKDYSEAEALIMTFSLNNYPAGDPRLAQAKLWEEAFLEEMRAFQRRMAGMFQVTFMAERSLEDEINRTTAEDLPIFATSYIVIFLYISLALGSYSSWSRVMVDSKATLGLGGVAVVLGAVMAAMGFFSYLGIRSSLVILQVVPFLVLSVGADNIFIFVLEYQGP

SEQ ID NO: 811265 - protein, 83 aa, Homo sapiens
ELYPGVFGPPEQPIYVLPSVEQFHKYLPWFLNDRPNIKCPKGGLAAYSTSVNLTSDGQVLGKHGLAWRGGHKSVALEGPRKPQ

SEQ ID NO: 811266 - protein, 1359 aa, Homo sapiens; identical to SEQ ID NO: 811263

SEQ ID NO: 811267 - protein, 191 aa, Homo sapiens
MDWGGPALGIPHLCRVSLLPLPTCVGSFFLGTHRAAPVLTPIECRVSREANQCSRGPGSKVPTHPPGLRFFPVAEDGVMAPRTLLLLLSGALVLTQTWAGFHSLRYFHTTMSRPGRADPRFLSVGDVDDTQCVRLDSDATSPRMEPRAPWMEQEGPEYWEEETGTAKAKAQFYRVNLRTLSGYYNQSEACE

SEQ ID NO: 811268 - protein, 106 aa, Homo sapiens
MAPRTLLLLLSGALVLTQTWAGFHSLRYFHTTMSRPGRADPRFLSVGDVDDTQCVRLDSDATSPRMEPEGPEYWEEETGTAKAKAQFYRVNLRTLSGYYNQSEACE

SEQ ID NO: 811269 - protein, 206 aa, Homo sapiens
MSWTHTETQGYGMKGKLTLWQQAPWGDFSSRRVHGDRVSLLPLPTCVGSFFLGTHRAAPVLTPIECRVSREANQCSRGPGSKVPTHPPGLRFFPVAEDGVMAPRTLLLLLSGALVLTQTWAGFHSLRYFHTTMSRPGRADPRFLSVGDVDDTQCVRLDSDATSPRMEPEGPEYWEEETGTAKAKAQFYRVNLRTLSGYYNQSEACE

SEQ ID NO: 811270 - protein, 256 aa, Homo sapiens
VPGPRGSGKGDCGELGATAGMDQSSEGCMKKISSVNLDKLINDFSQIEKKMVETNGKNNILDIQLEKSNCLLKVMQAKEVSIKEECATLHNIIKGLQQTIEYQQNLKGENEQLKISADLIKEKLKSHEQEYKNNIAKLVSEMKIKEEGYKKEISKLYQDMQRKVELNEEKHKELIEKKEMEISELNAKLRSQEKEKQNEIIKLQLEFDAKLARVQTKSKSYQDSTVLPQSIYRRKLQHFQEEKTRRLQFFVIPFAI

SEQ ID NO: 811271 - protein, 155 aa, Homo sapiens
MESLQTPQHRENQDKREKEYGVKHMPMGNNAGNLEPEKRKAVRVALSSATAAQNIPSSVHCGCSKQWRLRLPSESLQSRGQVMKRPNNILKLRNLDLLIYPWPELRRRQVASDLMSLLLLPAFSGLTWAPFLFLFTYLPPFLNLLTVGFVSYFLV

SEQ ID NO: 811272 - protein, 213 aa, Homo sapiens
MVSRGLALSGRLCSPLSSNPVSTFQCFGILALCLYSLFCICLASGTHNPSPCPSEPVAMESLQTPQHRENQDKREKEYGVKHMPMGNNAGNLEPEKRKAVRVALSSATAAQNIPSSVHCGCSKQWRLRLPSESLQSRGQVMKRPNNILKLRNLDLLIYPWPELRRRQVASDLMSLLLLPAFSGLTWAPFLFLFTYLPPFLNLLTVGFVSYFLV

SEQ ID NO: 811273 - protein, 84 aa, Homo sapiens
GFSTEVQDFSGSYRAVKSLRPLQETESFRSCTTPVCLAFPSSSLPRQHSVAVCLLARQSSAQSNDSTQLALGRSSSPELPASIV

SEQ ID NO: 811274 - protein, 1156 aa, Homo sapiens
MFPAAPSPRTPGTGSRRGPLAGLGPGSTPRTASRKGLPLGSAVSSPVLFSPVGRRSSLSSRGTPTRMFPHHSITESVNYDVKTFGSSLPVKVMEALTLAEVDDQLTINIDEGGWACLVCKEKLIIWKIALSPITKLSVCKELQLPPSDFHWSADLVALSYSSPSGEAHSTQAVAVMVATREGSIRYWPSLAGEDTYTEAFVDSGGDKTYSFLTAVQGGSFILSSSGSQLIRLIPESSGKIHQHILPQGQGMLSGIGRKVSSLFGILSPSSDLTLSSVLWDRERSSFYSLTSSNISKWELDDSSEKHAYSWDINRALKENITDAIWGSESNYEAIKEGVNIRYLDLKQNCDGLVILAAAWHSADNPCLIYYSLITIEDNGCQMSDAVTVEVTQYNPPFQSEDLILCQLTVPNFSNQTAYLYNESAVYVCSTGTGKFSLPQEKIVFNAQGDSVLGAGACGGVPIIFSRNSGLVSITSRENVSILAEDLEGSLASSVAGPNSESMIFETTTKNETIAQEDKIKLLKAAFLQYCRKDLGHAQMVVDELFSSHSDLDSDSELDRAVTQISVDLMDDYPASDPRWAESVPEEAPGFSNTSLIILHQLEDKMKAHSFLMDFIHQVGLFGRLGSFPVRGTPMATRLLLCEHAEKLSAAIVLKNHHSRLSDLVNTAILIALNKREYEIPSNLTPADVFFREVSQVDTICECLLEHEEQVLRDAPMDSIEWAEVVINVNNILKDMLQAASHYRQNRNSLYRREESLEKEPEYVPWTATSGPGGIRTVIIRQHEIVLKVAYPQADSNLRNIVTEQLVALIDCFLDGYVSQLKSVDKSSNRERYDNLEMEYLQKRSDLLSPLLSLGQYLWAASLAEKYCDFDILVQMCEQTDNQSRLQRYMTQFADQNFSDFLFRWYLEKGKRGKLLSQPISQHGQLANFLQAHEHLSWLHEINSQELEKAHATLLGLANMETRYFAKKKTLLGLSKLAALASDFSEDMLQEKIEEMAEQERFLLHQETLPEQLLAEKQLNLSAMPVLTAPQLIGLYICEENRRANEYDFKKALDLLEYIDEEEDININDLKLEILCKALQRDNWSSSDGKDDPIEVSKDSIFVKILQKLLKDGIQLSEYLPEVKDLLQADQLGSLKSNPYFEFVLKANYEYYVQGQI

SEQ ID NO: 811275 - protein, 981 aa, Homo sapiens
MVATREGSIRYWPSLAGEDTYTEAFVDSGGDKTYSFLTAVQGGSFILSSSGSQLIRLIPESSGKIHQHILPQGQGMLSGIGRKVSSLFGILSPSSDLTLSSVLWDRERSSFYSLTSSNISKWELDDSSEKHAYSWDINRALKENITDAIWGSESNYEAIKEGVNIRYLDLKQNCDGLVILAAAWHSADNPCLIYYSLITIEDNGCQMSDAVTVEVTQYNPPFQSEDLILCQLTVPNFSNQTAYLYNESAVYVCSTGTGKFSLPQEKIVFNAQGDSVLGAGACGGVPIIFSRNSGLVSITSRENVSILAEDLEGSLASSVAGPNSESMIFETTTKNETIAQEDKIKLLKAAFLQYCRKDLGHAQMVVDELFSSHSDLDSDSELDRAVTQISVDLMDDYPASDPRWAESVPEEAPGFSNTSLIILHQLEDKMKAHSFLMDFIHQVGLFGRLGSFPVRGTPMATRLLLCEHAEKLSAAIVLKNHHSRLSDLVNTAILIALNKREYEIPSNLTPADVFFREVSQVDTICECLLEHEEQVLRDAPMDSIEWAEVVINVNNILKDMLQAASHYRQNRNSLYRREESLEKEPEYVPWTATSGPGGIRTVIIRQHEIVLKVAYPQADSNLRNIVTEQLVALIDCFLDGYVSQLKSVDKSSNRERYDNLEMEYLQKRSDLLSPLLSLGQYLWAASLAEKYCDFDILVQMCEQTDNQSRLQRYMTQFADQNFSDFLFRWYLEKGKRGKLLSQPISQHGQLANFLQAHEHLSWLHEINSQELEKAHATLLGLANMETRYFAKKKTLLGLSKLAALASDFSEDMLQEKIEEMAEQERFLLHQETLPEQLLAEKQLNLSAMPVLTAPQLIGLYICEENRRANEYDFKKALDLLEYIDEEEDININDLKLEILCKALQRDNWSSSDGKDDPIEVSKDSIFVKILQKLLKDGIQLSEYLPEVKDLLQADQLGSLKSNPYFEFVLKANYEYYVQGQI

SEQ ID NO: 811276 - protein, 981 aa, Homo sapiens; identical to SEQ ID NO: 811275

SEQ ID NO: 811277 - protein, 422 aa, Homo sapiens [sequence omitted]

SEQ ID NO: 811278 - protein, 997 aa, Homo sapiens
MFPAAPSPRTPGTGSRRGPLAGLGPGSTPRTASRKGLPLGSAVSSPVLFSPVGRRSSLSSRGTPTRMFPHHSITESVNYDVKTFGSSLPVKVMEALTLAEVDDQLTINIDEGGWACLVCKEKLIIWKIALSPITKLSVCKELQLPPSDFHWSADLVALSYSSPSGEAHSTQAVAVMVATREGSIRYWPSLAGEDTYTEAFVDSGGDKTYSFLTAVQGGSFILSSSGSQLIRLIPESSGKIHQHILPQGQGMLSGIGRKVSSLFGILSPSSDLTLSSVLWDRERSSFYSLTSSNISKWELDDSSEKHAYSWDINRALKENITDAIWGSESNYEAIKEGVNIRYLDLKQNCDGLVILAAAWHSADNPCLIYYSLITIEDNGCQMSDAVTVEVTQYNPPFQSEDLILCQLTVPNFSNQTAYLYNESAVYVCSTGTGKFSLPQEKIVFNAQGDSVLGAGACGGVPIIFSRNSGLVSITSRENVSILAEDLEGSLASSVAGPNSESMIFETTTKNETIAQEDKIKLLKAAFLQYCRKDLGHAQMVVDELFSSHSDLDSDSELDRAVTQISVDLMDDYPASDPRWAESVPEEAPGFSNTSLIILHQLEDKMKAHSFLMDFIHQVGLFGRLGSFPVRGTPMATRLLLCEHAEKLSAAIVLKNHHSRLSDLVNTAILIALNKREYEIPSNLTPADVFFREVSQVDTICECLLEHEEQVLRDAPMDSIEWAEVVINVNNILKDMLQAASHYRQNRNSLYRREESLEKEPEYVPWTATSGPGGIRTVIIRQHEIVLKVAYPQADSNLRNIVTEQLVALIDCFLDGYVSQLKSVDKSSNRERYDNLEMEYLQKRSDLLSPLLSLGQYLWAASLAEKYCDFDILVQMCEQTDNQSRLQRYMTQFADQNFSDFLFRWYLEKGKRGKLLSQPISQHGQLANFLQAHEHLSWLHEINSQELEKAHATLLGLANMETRYFAKKKTLLGLSKLAALASDFSEDMLQEKIEAIYL

SEQ ID NO: 811279 - protein, 239 aa, Homo sapiens
MSQDGGREMGIQGAHEHLSWLHEINSQELEKAHATLLGLANMETRYFAKKKTLLGLSKLAALASDFSEDMLQEKIEEMAEQERFLLHQETLPEQLLAEKQLNLSAMPVLTAPQLIGLYICEENRRANEYDFKKALDLLEYIDEEEDININDLKLEILCKALQRDNWSSSDGKDDPIEVSKDSIFVKILQKLLKDGIQLSEYLPEVKDLLQADQLGSLKSNPYFEFVLKANYEYYVQGQI

SEQ ID NO: 811280 - protein, 229 aa, Homo sapiens
RKYIEHAQLNTCPGVDKNQRGAHATLLGLANMETRYFAKKKTLLGLSKLAALASDFSEDMLQEKIEEMAEQERFLLHQETLPEQLLAEKQLNLSAMPVLTAPQLIGLYICEENRRANEYDFKKALDLLEYIDEEEDININDLKLEILCKALQRDNWSSSDGKDDPIEVSKDSIFVKILQKLLKDGIQLSEYLPEVKDLLQADQLGSLKSNPYFEFVLKANYEYYVQGQI

SEQ ID NO: 811281 - protein, 1156 aa, Homo sapiens; identical to SEQ ID NO: 811274

SEQ ID NO: 811282 - protein, 1156 aa, Homo sapiens; identical to SEQ ID NO: 811274

SEQ ID NO: 811283 - protein, 1156 aa, Homo sapiens; identical to SEQ ID NO: 811274

SEQ ID NO: 811284 - protein, 1116 aa, Homo sapiens
MFPAAPSPRTPGTGSRRGPLAGLGPGSTPRTASRKGLPLGSAVSSPVLFSPVGRRSSLSSRGTPTRMFPHHSITESVNYDVKTFGSSLPVKVMEALTLAEVDDQLTINIDEGGWACLVCKEKLIIWKIALSPITKLSVCKELQLPPSDFHWSADLVALSYSSPSGEAHSTQAVAVMVATREGSIRYWPSLAGEDTYTEAFVDSGGDKTYSFLTAVQGGSFILSSSGSQLIRLIPESSGKIHQHILPQGQGMLSGIGRKVSSLFGILSPSSDLTLSSVLWDRERSSFYSLTSSNISKWELDDSSEKHAYSWDINRALKENITDAIWGSESNYEAIKEGVNIRYLDLKQNCDGLVILAAAWHSADNPCLIYYSLITIEDNGCQMSDAVTVEVTQYNPPFQSEDLILCQLTVPNFSNQTAYLYNESAVYVCSTGTGKFSLPQEKIVFNAQGDSVLGAGACGGVPIIFSRNSGLVSITSRENVSILAEDLEGSLASSVAGPNSESMIFETTTKNETIAQEDKIKLLKAAFLQYCRKDLGHAQMVVDELFSSHSDLDSDSELDRAVTQISVDLMDDYPASDPRWAESVPEEAPGFSNTSLIILHQLEDKMKAHSFLMDFIHQVGLFGRLGSFPVRGTPMATRLLLCEHAEKLSAAIVLKNHHSRLSDLVNTAILIALNKREYEIPSNLTPADVFFREVSQVDTICECLLEHEEQVLRDAPMDSIEWAEVVINVNNILKDMLQAASHYRQNRNSLYRREESLEKEPEYVPWTATSGPGGIRTVIIRQHEIVLKVAYPQADSNLRNIVTEQLVALIDCFLDGYVSQLKSVDKSSNRERYDNLEMEYLQKRSDLLSPLLSLGQYLWAASLAEKYCDFDILVQMCEQTDNQSRLQRYMTQFADQNFSDFLFRWYLEKGKRGKLLSQPISQHGQLANFLQAHEHLSWLHEINSQELEKAHATLLGLANMETRYFAKKKTLLGLSKLAALASDFSEDMLQEKIEEMAEQERFLLHQETLPEQLLAEKQLNLSAMPVLTAPQLIGLYICEENRRANEYDFKKALDLLEYIDEEEDININDLKLEILCKALQRDNWSSSDGKDDPIEVSKDSIFVKILQKLLKDGIQVQ

SEQ ID NO: 811285 - protein, 1082 aa, Homo sapiens
MFPAAPSPRTPGTGSRRGPLAGLGPGSTPRTASRKGLPLGSAVSSPVLFSPVGRRSSLSSRGTPTRMFPHHSITESVNYDVKTFGSSLPVKVMEALTLAEVDDQLTINIDEGGWACLVCKEKLIIWKIALSPITKLSVCKELQLPPSDFHWSADLVALSYSSPSGEAHSTQAVAVMVATREGSIRYWPSLAGEDTYTEAFVDSGGDKTYSFLTAVQGGSFILSSSGSQLIRLIPESSGKIHQHILPQGQGMLSGIGRKVSSLFGILSPSSDLTLSSVLWDRERSSFYSLTSSNISKWELDDSSEKHAYSWDINRALKENITDAIWGSESNYEAIKEGVNIRYLDLKQNCDGLVILAAAWHSADNPCLIYYSLITIEDNGCQMSDAVTVEVTQYNPPFQSEDLILCQLTVPNFSNQTAYLYNESAVYVCSTGTGKFSLPQEKIVFNAQGDSVLGAGACGGVPIIFSRNSGLVSITSRENVSILAEDLEGSLASSVAGPNSESMIFETTTKNETIAQEDKIKLLKAAFLQYCRKDLGHAQMVVDELFSSHSDLDSDSELDRAVTQISVDLMDDYPASDPRWAESVPEEAPGFSNTSLIILHQLEDKMKAHSFLMDFIHQVGLFGRLGSFPVRGTPMATRLLLCEHAEKLSAAIVLKNHHSRLSDLVNTAILIALNKREYEIPSNLTPADVFFREVSQVDTICECLLEHEEQVLRDAPMDSIEWAEVVINVNNILKDMLQAASHYRQNRNSLYRREESLEKEPEYVPWTATSGPGGIRTVIIRQHEIVLKVAYPQADSNLRNIVTEQLVALIDCFLDGYVSQLKSVDKSSNRERYDNLEMEYLQKRSDLLSPLLSLGQYLWAASLAEKYCDFDILVQMCEQTDNQSRLQRYMTQFADQNFSDFLFRWYLEKGKRGKLLSQPISQHGQLANFLQAHEHLSWLHEINSQELEKAHATLLGLANMETRYFAKKKTLLGLSKLAALASDFSEDMLQEKIEEMAEQERFLLHQETLPEQLLAEKQLNLSAMPVLTAPQLIGLYICEENRRANEYDFKKALDLLEYIDEEEDININDLKLEILCKALQRDK

SEQ ID NO: 811286 - protein, 871 aa, Homo sapiens
MFPAAPSPRTPGTGSRRGPLAGLGPGSTPRTASRKGLPLGSAVSSPVLFSPVGRRSSLSSRGTPTRMFPHHSITESVNYDVKTFGSSLPVKVMEALTLAEVDDQLTINIDEGGWACLVCKEKLIIWKIALSPITKLSVCKELQLPPSDFHWSADLVALSYSSPSGEAHSTQAVAVMVATREGSIRYWPSLAGEDTYTEAFVDSGGDKTYSFLTAVQGGSFILSSSGSQLIRLIPESSGKIHQHILPQGQGMLSGIGRKVSSLFGILSPSSDLTLSSVLWDRERSSFYSLTSSNISKWELDDSSEKHAYSWDINRALKENITDAIWGSESNYEAIKEGVNIRYLDLKQNCDGLVILAAAWHSADNPCLIYYSLITIEDNGCQMSDAVTVEVTQYNPPFQSEDLILCQLTVPNFSNQTAYLYNESAVYVCSTGTGKFSLPQEKIVFNAQGDSVLGAGACGGVPIIFSRNSGLVSITSRENVSILAEDLEGSLASSVAGPNSESMIFETTTKNETIAQEDKIKLLKAAFLQYCRKDLGHAQMVVDELFSSHSDLDSDSELDRAVTQISVDLMDDYPASDPRWAESVPEEAPGFSNTSLIILHQLEDKMKAHSFLMDFIHQVGLFGRLGSFPVRGTPMATRLLLCEHAEKLSAAIVLKNHHSRLSDLVNTAILIALNKREYEIPSNLTPADVFFREVSQVDTICECLLEHEEQVLRDAPMDSIEWAEVVINVNNILKDMLQAASHYRQNRNSLYRREESLEKEPEYVPWTATSGPGGIRTVIIRQHEIVLKVAYPQADSNLRNIVTEQLVALIDCFLDGYVSQLKSVDKSSNRERYDNLEMEYLQKRSDLLSPLRKFMILGKSFKFAEWMKGLNS

SEQ ID NO: 811287 - protein, 647 aa, Homo sapiens
MFPAAPSPRTPGTGSRRGPLAGLGPGSTPRTASRKGLPLGSAVSSPVLFSPVGRRSSLSSRGTPTRMFPHHSITESVNYDVKTFGSSLPVKVMEALTLAEVDDQLTINIDEGGWACLVCKEKLIIWKIALSPITKLSVCKELQLPPSDFHWSADLVALSYSSPSGEAHSTQAVAVMVATREGSIRYWPSLAGEDTYTEAFVDSGGDKTYSFLTAVQGGSFILSSSGSQLIRLIPESSGKIHQHILPQGQGMLSGIGRKVSSLFGILSPSSDLTLSSVLWDRERSSFYSLTSSNISKWELDDSSEKHAYSWDINRALKENITDAIWGSESNYEAIKEGVNIRYLDLKQNCDGLVILAAAWHSADNPCLIYYSLITIEDNGCQMSDAVTVEVTQYNPPFQSEDLILCQLTVPNFSNQTAYLYNESAVYVCSTGTGKFSLPQEKIVFNAQGDSVLGAGACGGVPIIFSRNSGLVSITSRENVSILAEDLEGSLASSVAGPNSESMIFETTTKNETIAQEDKIKLLKAAFLQYCRKDLGHAQMVVDELFSSHSDLDSDSELDRAVTQISVDLMDDYPASDPRWAESVPEEAPGFSNTSLIILHQLEDKMKAHSFLMDFIHQVGVIWDVLGRFLQVQKGTPGHSNCLLNPKL

SEQ ID NO: 811288 - protein, 611 aa, Homo sapiens
MFPAAPSPRTPGTGSRRGPLAGLGPGSTPRTASRKGLPLGSAVSSPVLFSPVGRRSSLSSRGTPTRMFPHHSITESVNYDVKTFGSSLPVKVMEALTLAEVDDQLTINIDEGGWACLVCKEKLIIWKIALSPITKLSVCKELQLPPSDFHWSADLVALSYSSPSGEAHSTQAVAVMVATREGSIRYWPSLAGEDTYTEAFVDSGGDKTYSFLTAVQGGSFILSSSGSQLIRLIPESSGKIHQHILPQGQGMLSGIGRKVSSLFGILSPSSDLTLSSVLWDRERSSFYSLTSSNISKWELDDSSEKHAYSWDINRALKENITDAIWGSESNYEAIKEGVNIRYLDLKQNCDGLVILAAAWHSADNPCLIYYSLITIEDNGCQMSDAVTVEVTQYNPPFQSEDLILCQLTVPNFSNQTAYLYNESAVYVCSTGTGKFSLPQEKIVFNAQGDSVLGAGACGGVPIIFSRNSGLVSITSRENVSILAEDLEGSLASSVAGPNSESMIFETTTKNETIAQEDKIKLLKAAFLQYCRKDLGHAQMVVDELFSSHSDLDSDSELDRAVTQISVDLMDDYPADNPCLIYYSLITIEDNGCQMSDAVTVEVTQYNPPFQR

SEQ ID NO: 811289 - protein, 524 aa, Homo sapiens
MFPAAPSPRTPGTGSRRGPLAGLGPGSTPRTASRKGLPLGSAVSSPVLFSPVGRRSSLSSRGTPTRMFPHHSITESVNYDVKTFGSSLPVKVMEALTLAEVDDQLTINIDEGGWACLVCKEKLIIWKIALSPITKLSVCKELQLPPSDFHWSADLVALSYSSPSGEAHSTQAVAVMVATREGSIRYWPSLAGEDTYTEAFVDSGGDKTYSFLTAVQGGSFILSSSGSQLIRLIPESSGKIHQHILPQGQGMLSGIGRKVSSLFGILSPSSDLTLSSVLWDRERSSFYSLTSSNISKWELDDSSEKHAYSWDINRALKENITDAIWGSESNYEAIKEGVNIRYLDLKQNCDGLVILAAAWHSADNPCLIYYSLITIEDNGCQMSDAVTVEVTQYNPPFQSEDLILCQLTVPNFSNQTAYLYNESAVYVCSTGTGKFSLPQEKIVFNAQGDSVLGAGACGGVPIIFSRNSGLVSITSRENVSILAEDLEGSLASSVAGPNSEVDRLRPGVGDQPGQHVKTPSLPKK

SEQ ID NO: 811290 - protein, 315 aa, Homo sapiens
MFPAAPSPRTPGTGSRRGPLAGLGPGSTPRTASRKGLPLGSAVSSPVLFSPVGRRSSLSSRGTPTRMFPHHSITESVNYDVKTFGSSLPVKVMEALTLAEVDDQLTINIDEGGWACLVCKEKLIIWKIALSPITKLSVCKELQLPPSDFHWSADLVALSYSSPSGEAHSTQAVAVMVATREGSIRYWPSLAGEDTYTEAFVDSGGDKTYSFLTAVQGGSFILSSSGSQLIRLIPESSGKIHQHILPQGQGMLSGIGRKLSSVLWDRERSSFYSLTSSNISKWELDDSSEKHAYSWDINRALKENITDAIWVRNNN

SEQ ID NO: 811291 - protein, 338 aa, Homo sapiens
MVGRVQPDRKQLPLVLLRLLCLLPTGLPVRSVDFNRGTDNITVRQGDTAILRCVLEDKNSKVAWLNRSGIIFAGHDKWSLDPRVELEKRHSLEYSLRIQKVDVYDEGSYTCSVQTQHEPKTSQVYLIVQVPPKISNISSDVTVNEGSNVTLVCMANGRPEPVITWRHLTPTGREFEGEEEYLEILGITREQSGKYECKAANEVSSADVKQVKVTVNYPPTITESKSNEATTGRQASLKCEASAVPAPDFEWYRDDTRINSANGLEIKSTEGQSSLTVTNVTEEHYGNYTCVAANKLGVTNASLVLFRPGSVRGINGSISLAVPLWLLAASLLCLLSKC

SEQ ID NO: 811292 - protein, 241 aa, Homo sapiens
MVGRVQPDRKQLPLVLLRLLCLLPTGLPVRSVDFNRGTDNITVRQGDTAIPGREFEGEEEYLEILGITREQSGKYECKAANEVSSADVKQVKVTVNYPPTITESKSNEATTGRQASLKCEASAVPAPDFEWYRDDTRINSANGLEIKSTEGQSSLTVTNVTEEHYGNYTCVAANKLGVTNASLVLFKRVLPTIPHPIQEIGTTVHFKQKGPGSVRGINGSISLAVPLWLLAASLLCLLSKC

SEQ ID NO: 811293 - protein, 218 aa, Homo sapiens
MVGRVQPDRKQLPLVLLRLLCLLPTGLPVRSVDFNRGTDNITVRQGDTAIPGREFEGEEEYLEILGITREQSGKYECKAANEVSSADVKQVKVTVNYPPTITESKSNEATTGRQASLKCEASAVPAPDFEWYRDDTRINSANGLEIKSTEGQSSLTVTNVTEEHYGNYTCVAANKLGVTNASLVLFRPGSVRGINGSISLAVPLWLLAASLLCLLSKC

SEQ ID NO: 811294 - protein, 342 aa, Homo sapiens
MVGRVQPDRKQLPLVLLRLLCLLPTGLPVRSVDFNRGTDNITVRQGDTAILRCVLEDKNSKVAWLNRSGIIFAGHDKWSLDPRVELEKRHSLEYSLRIQKVDVYDEGSYTCSVQTQHEPKTSQVYLIVQVPPKISNISSDVTVNEGSNVTLVCMANGRPEPVITWRHLTPTGREFEGEEEYLEILGITREQSGKYECKAANEVSSADVKQVKVTVNYPPTITESKSNEATTGRQASLKCEASAVPAPDFEWYRDDTRINSANGLEIKSTEGQSSLTVTNVTEEHYGNYTCVAANKLGVTNASLVLFRPGSVRGINGSISLAVPLWLLAASLLCLLRDRSVGD

SEQ ID NO: 811295 - protein, 350 aa, Homo sapiens
MVGRVQPDRKQLPLVLLRLLCLLPTGLPVRSVDFNRGTDNITVRQGDTAILRCVLEDKNSKVAWLNRSGIIFAGHDKWSLDPRVELEKRHSLEYSLRIQKVDVYDEGSYTCSVQTQHEPKTSQVYLIVQVPPKISNISSDVTVNEGSNVTLVCMANGRPEPVITWRHLTPTGREFEGEEEYLEILGITREQSGKYECKAANEVSSADVKQVKVTVNYPPTITESKSNEATTGRQASLKCEASAVPAPDFEWYRDDTRINSANGLEIKSTEGQSSLTVTNVTEEHYGNYTCVAANKLGVTNASLVLFKRVLPTIPHPIQGPGSVRGINGSISLAVPLWLLAASLLCLLSKC

SEQ ID NO: 811296 - protein, 320 aa, Homo sapiens
MVGRVQPDRKQLPLVLLRLLCLLPTGLPVRSVDFNRGTDNITVRQGDTAILRCVLEDKNSKVAWLNRSGIIFAGHDKWSLDPRVELEKRHSLEYSLRIQKVDVYDEGSYTCSVQTQHEPKTSQVYLIVQVPPKISNISSDVTVNEGSNVTLVCMANGRPEPVITWRHLTPTGREFEGEEEYLEILGITREQSGKYECKAANEVSSADVKQVKVTVNYPPTITESKSNEATTGRQASLKCEASAVPAPDFEWYRDDTRINSANGLEIKSTEGQSSLTVTNVTEEHYGNYTCVAANKLGVTNASLVLFSKYAKAGPNLMELN

SEQ ID NO: 811297 - protein, 338 aa, Homo sapiens
MVGRVQPDRKQLPLVLLRLLCLLPTGLPVRSVDFNRGTDNITVRQGDTAILRCVLEDKNSKVAWLNRSGIIFAGHDKWSLDPRVELEKRHSLEYSLRIQKVDVYDEGSYTCSVQTQHEPKTSQVYLIVQVPPKISNISSDVTVNEGSNVTLVCMANGRPEPVITWRHLTPTGREFEGEEEYLEILGITREQSGKYECKAANEVSSADVKQVKVTVNYPPTITESKSNEATTGRQASLKCEASAVPAPDFEWYRDDTRINSANGLEIKSTEGQSSLTVTNVTEEHYGNYTCVAANKLGVTNASLVLFKRVLPTIPHPIQEIGTTVHFKQKVLLQLNFAP

SEQ ID NO: 811298 - protein, 229 aa, Homo sapiens
PALPIMTQSLRHPTLVFTPSIHTLEQSIPTWHLRNHRDVHLHPLQLLEAKEWEQTTRWALGSTVITGLGGRMPALGEEVPFKPGMQLGQCQLLPQPPHSPPHWKLPLGLRAFLGTSLPPWDPGILLSTMSFFRHAGDLQAMISKEFHLAATQDDCRKGRTQEDILVPSSHPELFASVLPMAPEEAARLQQPQPLPPPSGIHLSASRTLAPTLLYSSPPSHSPFGLSSLI

SEQ ID NO: 811299 - protein, 229 aa, Homo sapiens; identical to SEQ ID NO: 811298

SEQ ID NO: 811300 - protein, 152 aa, Homo sapiens
MTCTDQKSHSQRALGTQTPALQGPQLLNTDPSSKETRPPHVNPDRLCHMEPANHFWHAGDLQAMISKEFHLAATQDDCRKGRTQEDILVPSSHPELFASVLPMAPEEAARLQQPQPLPPPSGIHLSASRTLAPTLLYSSPPSHSPFGLSSLI

SEQ ID NO: 811301 - protein, 505 aa, Homo sapiens [sequence omitted]

SEQ ID NO: 811302 - protein, 772 aa, Homo sapiens
MLNRVRSAVAHLVSSGGAPPPRPKSPDLPNAASAPPAAAPEAPRSPPAKAGSGSATPAKAVEARASFSRPTFLQLSPGGLRRADDHAGRAVQSPPDTGRRLPWSTGYAEWAPPGAPKPGWGSHPSPQLRIPGARTRFPTPRPGQELPFPWTFAILWSSGRTPSQPIFQWGAACVTFFTSFPLIDCPRPRRLRTLFCPRARRAESPAKDELASSPSRPGSLKAKGKGVSRRSGVLFNRGHSGWEDSLTRFPAPAPQFPVPLTEFPSPSTPRNSPRHQEAASFPRSGEGDARGRGGSHLDALQPANSCWPGKEADPLPGAAGWPPGCVYFKCICREQQSTEGDGGAQFAEEGGWWPMDPPPPPLASCVGGVYGYVAPAQSRWAFTSTLFQFLFPDLGWRASSLLRQQKLSLDGFRKGVINAGKSRHNEDQACCEVVYVEGRRSVTGVPREPSRGQGLCFYYWGLFDGHAGGGAAEMASRLLHRHIREQLKDLKEVSHESLVVGAIENAFQLMDEQMARERRGHQVEGGCCALVVIYLLGKVYVANAGDSRAIIVRNGEIIPMSREFTPETERQRLQLLGFLKPELLGSEFTHLEFPRRVLPKELGQRMLYRDQNMTGWAYKKIELEDLRFPLVCGEGKKARVMATIGVTRGLGDHSLKVCSSTLPIKPFLSCFPEVRVYDLTQYEHCPDDVLVLGTDGLWDVTTDCEVAATVDRVLSAYEPNDHSRYTALAQALVLGARGTPRDRGWRLPNNKLGSGDDISVFVIPLGGPGSYS

SEQ ID NO: 811303 - protein, 98 aa, Homo sapiens
HVGLCICLPTYMLVHECACVLLAGIQLWPKLWSWGPGVPPETVAGVSPTTSWVPGMTSLSSSSPWEGQAVTPEGLNTIPPTSLSILTPLTAQILKLSP

SEQ ID NO: 811304 - protein, 205 aa, Homo sapiens
MATIGVTRGLGDHSLKVCSSTLPIKPFLSCFPEVRVYDLTQYEHCPDDVLVLGTDGLWDVTTDCEVAATVDRVLSAYEPNDHSSPTMAAIRKKLVIVGDGACGKTCLLIVFSKDQFPEVYVPTVFENYIADIEVDGKQVELALWDTAGQEDYDRLRPLSYPDTDVILMCFSIDSPDSLENIPEKWTPEVKHFCPNVPIILVGNKK

SEQ ID NO: 811305 - protein, 505 aa, Homo sapiens [sequence omitted]

SEQ ID NO: 811306 - protein, 505 aa, Homo sapiens [sequence omitted]

SEQ ID NO: 811307 - protein, 237 aa, Homo sapiens
MPSPWGWFAVTACGAQRNNFEEPVALQEMDTSNGVLLPFYDPDSSIVYLCGKGDSSIRYFEITDEPPFVHYLNTFSSKEPQRGMGFMPKRGLDVSKCEIARFYKLHERKCEPIIMTVPRKSDLFQDDLYPDTPGPEPALEADEWLSGQDAEPVLISLRDGYVPPKHRELRVTKRNILDVRPPSGPRRSQSASDAPLSQHTLETLLEEIKALRERVQAQEQRITALENMLCELVDGTD

SEQ ID NO: 811308 - protein, 579 aa, Homo sapiens
QLGLQRRRALESRRIGQSAELDTRVPDTTDTRRGGSFALKPSSAPYALGPLPQRIRSVSAPAARSGPAMSRRVVRQSKFRHVFGQAAKADQAYEDIRVSKVTWDSSFCAVNPKFLAIIVEAGGGGAFIVLPLAKTGRVDKNYPLVTGHTAPVLDIDWCPHNDNVIASASDDTTIMVWQIPDYTPMRNITEPIITLEGHSKRVGILSWHPTARNVLLSAGGDNVIIIWNVGTGEVLLSLDDMHPDVIHSVCWNSNGSLLATTCKDKTLRIIDPRKGQVVAERFAAHEGMRPMRAVFTRQGHIFTTGFTRMSQRELGLWDPVTQLEAWVLLRRVKDPALAPPPGDAESLGVVCCDCSGAQRNNFEEPVALQEMDTSNGVLLPFYDPDSSIVYLCGKGDSSIRYFEITDEPPFVHYLNTFSSKEPQRGMGFMPKRGLDVSKCEIARFYKLHERKCEPIIMTVPRKSDLFQDDLYPDTPGPEPALEADEWLSGQDAEPVLISLRDGYVPPKHRELRVTKRNILDVRPPSGPRRSQSASDAPLSQHTLETLLEEIKALRERVQAQEQRITALENMLCELVDGTD

SEQ ID NO: 811309 - protein, 539 aa, Homo sapiens
QLGLQRRRALESRRIGQSAELDTRVPDTTDTRRGGSFALKPSSAPYALGPLPQRIRSVSAPAARSGPAMSRRVVRQSKFRHVFGQAAKADQAYEDIRVSKVTWDSSFCAVNPKFLAIIVEAGGGGAFIVLPLAKTGRVDKNYPLVTGHTAPVLDIDWCPHNDNVIASASDDTTIMVWQIPDYTPMRNITEPIITLEGHSKRVGILSWHPTARNVLLSAGGDNVIIIWNVGTGEVLLSLDDMHPDVIHSVCWNSNGSLLATTCKDKTLRIIDPRKGQVVAERFAAHEGMRPMRAVFTRQGHIFTTGFTRMSQRELGLWDPNNFEEPVALQEMDTSNGVLLPFYDPDSSIVYLCGKGDSSIRYFEITDEPPFVHYLNTFSSKEPQRGMGFMPKRGLDVSKCEIARFYKLHERKCEPIIMTVPRKSDLFQDDLYPDTPGPEPALEADEWLSGQDAEPVLISLRDGYVPPKHRELRVTKRNILDVRPPSGPRRSQSASDAPLSQHTLETLLEEIKALRERVQAQEQRITALENMLCELVDGTD

SEQ ID NO: 811310 - protein, 522 aa, Homo sapiens
QLGLQRRRALESRRIGQSAELDTRVPDTTDTRRGGSFALKPSSAPYALGPLPQRIRSVSAPAARSGPAMSRRVVRQSKFRHVFGQAAKADQAYEDIRVSKVTWDSSFCAVNPKFLAIIVEAGGGGAFIVLPLAKTGRVDKNYPLVTGHTAPVLDIDWCPHNDNVIASASDDTTIMVWQIPDYTPMRNITEPIITLEGHSKRVGILSWHPTARNVLLSAGGDNVIIIWNVGTGEVLLSLDDMHPDVIHSVCWNSNGSLLATTCKDKTLRIIDPRKGQVVAERFAAHEGMRPMRAVFTRQGHIFTTGFTRMSQRELGLWDPNNFEEPVALQEMDTSNGVLLPFYDPDSSIVYLCGKGDSSIRYFEITDEPPFVHYLNTFSSKEPRSQIDSDYAARSDYAARSDYAARSDYAARSDYAARSDYAARSDYAARSDYAARSDYAARSDYSARSDYAARSDYAARSDYALADMLAHVEELARDGEAPLDKACAEDDDEEDEEEEEEEPDPTRRWSTSEAEAYESACCL

SEQ ID NO: 811311 - protein, 330 aa, Homo sapiens
QLGLQRRRALESRRIGQSAELDTRVPDTTDTRRGGSFALKPSSAPYALGPLPQRIRSVSAPAARSGPAMSRRVVRQSKFRHVFGQAAKADQAYEDIRVSKVTWDSSFCAVNPKFLAIIVEAGGGGAFIVLPLAKTGRVDKNYPLVTGHTAPVLDIDWCPHNDNVIASASDDTTIMVWQIPDYTPMRNITEPIITLEGHSKRVGILSWHPTARNVLLSAGGDNVIIIWNVGTGEVLLSLDDMHPDVIHSVCWNSNGSLLATTCKDKTLRIIDPRKGQVVAVSALSKPPACNSLPGSCSLPSLASQKLREGLLALGLRRGEAGNSILPPEPA

SEQ ID NO: 811312 - protein, 285 aa, Homo sapiens
MCRGGGAMCAGEEERCAQGRGLQLWSLEVWGIGFGKARKRKGASGGPEVAREGGAGLVTPPVLGQNNFEEPVALQEMDTSNGVLLPFYDPDSSIVYLCGKGDSSIRYFEITDEPPFVHYLNTFSSKEPQRGMGFMPKRGLDVSKCEIARFYKLHERKCEPIIMTVPRKSDLFQDDLYPDTPGPEPALEADEWLSGQDAEPVLISLRDGYVPPKHRELRVTKRNILDVRPPSGPRRSQSASDAPLSQHTLETLLEEIKALRERVQAQEQRITALENMLCELVDGTD

SEQ ID NO: 811313 - protein, 511 aa, Homo sapiens
MSRRVVRQSKFRHVFGQAAKADQAYEDIRVSKVTWDSSFCAVNPKFLAIIVEAGGGGAFIVLPLAKTGRVDKNYPLVTGHTAPVLDIDWCPHNDNVIASASDDTTIMVWQIPDYTPMRNITEPIITLEGHSKRVGILSWHPTARNVLLSAGGDNVIIIWNVGTGEVLLSLDDMHPDVIHSVCWNSNGSLLATTCKDKTLRIIDPRKGQVVAERFAAHEGMRPMRAVFTRQGHIFTTGFTRMSQRELGLWDPVTQLEAWVLLRRVKDPALAPPPGDAESLGVVCCDCSGAQRNNFEEPVALQEMDTSNGVLLPFYDPDSSIVYLCGKGDSSIRYFEITDEPPFVHYLNTFSSKEPQRGMGFMPKRGLDVSKCEIARFYKLHERKCEPIIMTVPRKSDLFQDDLYPDTPGPEPALEADEWLSGQDAEPVLISLRDGYVPPKHRELRVTKRNILDVRPPSGPRRSQSASDAPLSQHTLETLLEEIKALRERVQAQEQRITALENMLCELVDGTD

SEQ ID NO: 811314 - protein, 237 aa, Homo sapiens; identical to SEQ ID NO: 811307

SEQ ID NO: 811315 - protein, 88 aa, Homo sapiens
GRRPPWTPATSSLGEEPQPRDEEEAELELLRQFDLAWQYGPCTGITRLQRWCRAKQMGLEPPPEVWQVLKTHPGDPRFQCSLWHLYPL

SEQ ID NO: 811316 - protein, 214 aa, Homo sapiens
VASGSLCPVQGGSLLASQGSSVLEIFMKVADCENLELGSVWIGDPAAEGDSCVGQGGMMGRPVWVTDCPPASRRVPGSSSTPRRSQGAAGSPGGLGGLAGPPPHRLVLHLGACLSAATLQILSARRWPGPVCLSQQLSFSRPLAGLSSSPQLPPSLPAWVAAMGRKRLITDSYPVVKRREGPAGHSKGELAPELGGGAPAPRRGGSGAGAAEAV

SEQ ID NO: 811317 - protein, 91 aa, Homo sapiens
KEARYEAGCELAEAVFSRPLAGLSSSPQLPPSLPAWVAAMGRKRLITDSYPVVKRREGPAGHSKGELAPELGGGAPAPRRGGSGAGAAEAV

SEQ ID NO: 811318 - protein, 89 aa, Homo sapiens
HASGPTRPELAPELGEEPQPRDEEEAELELLRQFDLAWQYGPCTGITRLQRWCRAKQMGLEPPPEVWQVLKTHPGDPRFQCSLWHLYPL

SEQ ID NO: 811319 - protein, 78 aa, Homo sapiens
RRPPLPVQSLASLSPMRQNLEVSEAQLLHLTSRLPESPEEPAQLKQSASRWRVVTGEKDLAITFQYLLPVSLTHDLAS

SEQ ID NO: 811320 - protein, 79 aa, Homo sapiens
EASSLDPGDFLSRSCLPAAGLAPSVSLSSCLSPALSSLAHHPRTSGQKREPIAPAQLSPAAEEPLAGRTWRCQRLNSSI

SEQ ID NO: 811321 - protein, 107 aa, Homo sapiens
PLRLGTEAWVWLLILSARRWPGPVCLSQQLSFSRPLAGLSSSPQLPPSLPAWVAAMGRKRLITDSYPVVKRREGPAGHSKGELAPELGGGAPAPRRGGSGAGAAEAV

SEQ ID NO: 811322 - protein, 107 aa, Homo sapiens
GGVLPGPRRLPLSILSARRWPGPVCLSQQLSFSRPLAGLSSSPQLPPSLPAWVAAMGRKRLITDSYPVVKRREGPAGHSKGELAPELGGGAPAPRRGGSGAGAAEAV

SEQ ID NO: 811323 - protein, 246 aa, Homo sapiens
VASGSLCPVQGGSLLASQGSSVLEIFMKVADCENLELGSVWIGDPAAEGDSCVGQGGMMGRPVWVTDCPPASRRVPGSSSSQGGARGLRGAQEGWEAWQGRHLTGWFSIWGPACLRRLFRSCLPAAGLAPSVSLSSCLSRAHWPVSPLPRSCLLLCLPGWPPWAGSGSSLIREEPQPRDEEEAELELLRQFDLAWQYGPCTGITRLQRWCRAKQMGLEPPPEVWQVLKTHPGDPRFQCSLWHLYPL

SEQ ID NO: 811324 - protein, 196 aa, Homo sapiens
VASGSLCPVQGGSLLASQGSSVLEIFMKVADCENLELGSVWIGDPAAEGDSCVGQGGMMGRPVWVTDCPPASRRVPGSSSTPRRSQGAAGSPGGLGGLAGPPPHRLVLHLGACLSAATLQILSARRWPGPVCLSQQLSFSRPLAGLSSSPQLPPSLPAWVAAMGRKRLITDSYPVVKRREGPAGHSKGELAPELGL

SEQ ID NO: 811325 - protein, 196 aa, Homo sapiens; identical to SEQ ID NO: 811324

SEQ ID NO: 811326 - protein, 95 aa, Homo sapiens
ASGRGAAPGRPGPSPMDLRAGEEPQPRDEEEAELELLRQFDLAWQYGPCTGITRLQRWCRAKQMGLEPPPEVWQVLKTHPGDPRFQCSLWHLYPL

SEQ ID NO: 811327 - protein, 196 aa, Homo sapiens; identical to SEQ ID NO: 811324

SEQ ID NO: 811328 - protein, 214 aa, Homo sapiens; identical to SEQ ID NO: 811316

SEQ ID NO: 811329 - protein, 108 aa, Homo sapiens
MGRKRLITDSDHTAAALVSGQADGLGASPRGVAGAEDPPRRPPLPVQSLASLSPMRHHVRPPALSSLAHHPRTSGQKREPIAPAQLSPAAEEPLAGRTWRCQRLNSSI

SEQ ID NO: 811330 - protein, 214 aa, Homo sapiens; identical to SEQ ID NO: 811316

SEQ ID NO: 811331 - protein, 89 aa, Homo sapiens
GGVLPGPRRLPLSILSARRWPGPVCLSQQLSFSRPLAGLSSSPQLPPSLPAWVAAMGRKRLITDSYPVVKRREGPAGHSKGELAPELGL

SEQ ID NO: 811332 - protein, 89 aa, Homo sapiens; identical to SEQ ID NO: 811331

SEQ ID NO: 811333 - protein, 106 aa, Homo sapiens
MVLISCPRDPTHLSLPKCWDYRREPPHPANNSYLYKLVGGKGTPRTQGTIYLELRGFPRTMGMAKNKLVKSDPGTQQLILCFSLSLSGVSLPPTPSSTVLWHLYPL

SEQ ID NO: 811334 - protein, 214 aa, Homo sapiens; identical to SEQ ID NO: 811316

SEQ ID NO: 811335 - protein, 214 aa, Homo sapiens; identical to SEQ ID NO: 811316

SEQ ID NO: 811336 - protein, 214 aa, Homo sapiens; identical to SEQ ID NO: 811316

SEQ ID NO: 811337 - protein, 214 aa, Homo sapiens; identical to SEQ ID NO: 811316

SEQ ID NO: 811338 - protein, 214 aa, Homo sapiens; identical to SEQ ID NO: 811316

SEQ ID NO: 811339 - protein, 159 aa, Homo sapiens
ELELRLHFTPAGMPGSHLSTLGFLSVSDLGFPPRQSSQPPPSFPPALISLGVSPSYVLPLLPASLSIPWGRAEGPLPSPRGVAGAEDPPRRPPLPVQSLASLSPMRHHVRPPALSSLAHHPRTSGQKREPIAPAGSTPPSNQQAPRVPGRACAAEAECF

SEQ ID NO: 811340 - protein, 214 aa, Homo sapiens; identical to SEQ ID NO: 811316

SEQ ID NO: 811341 - protein, 307 aa, Homo sapiens
SPPRPLPVPAAAAVAFGAKGTDPAEARSSRGIEEAGPRAHGRAGREPERRRSRQQRRGGLQARRSTLLKTCARARATAPGAMKMVAPWTRFYSNSCCLCCHVRTGTILLGVWYLIINAVVLLILLSALADPDQYNFSSSELGGDFEFMDDANMCIAIAISLLMILICAMATYGAYKQRAAWIIPFFCYQIFDFALNMLVAITVLIYPNSIQEYIRQLPPNFPYRDDVMSVNPTCLVLIILLFISIILTFKGYLISCVWNCYRYINGRNSSDVLVYVTSNDTTVLLPPYDDATVNGAAKEPPPPYVSA

SEQ ID NO: 811342 - protein, 307 aa, Homo sapiens; identical to SEQ ID NO: 811341

SEQ ID NO: 811343 - protein, 307 aa, Homo sapiens; identical to SEQ ID NO: 811341

SEQ ID NO: 811344 - protein, 307 aa, Homo sapiens; identical to SEQ ID NO: 811341

SEQ ID NO: 811345 - protein, 307 aa, Homo sapiens; identical to SEQ ID NO: 811341

SEQ ID NO: 811346 - protein, 128 aa, Homo sapiens
MGPVCNQAEEISDGFLNMLVAITVLIYPNSIQEYIRQLPPNFPYRDDVMSVNPTCLVLIILLFISIILTFKGYLISCVWNCYRYINGRNSSDVLVYVTSNDTTVLLPPYDDATVNGAAKEPPPPYVSA

SEQ ID NO: 811347 - protein, 307 aa, Homo sapiens; identical to SEQ ID NO: 811341

SEQ ID NO: 811348 - protein, 307 aa, Homo sapiens; identical to SEQ ID NO: 811341

SEQ ID NO: 811349 - protein, 307 aa, Homo sapiens; identical to SEQ ID NO: 811341

SEQ ID NO: 811350 - protein, 199 aa, Homo sapiens
SPPRPLPVPAAAAVAFGAKGTDPAEARSSRGIEEAGPRAHGRAGREPERRRSRQQRRGGLQARRSTLLKTCARARATAPGAMKMVAPWTRFYSNSCCLCCHVRTGTILLGVWYLIINAVVLLILLSALADPDQYNFSSSELGGDFEFMDDANMCIAIAISLLMILICAMATYGAYKQRAAWIIPFFCYQIFDFALLVHY

SEQ ID NO: 811351 - protein, 307 aa, Homo sapiens; identical to SEQ ID NO: 811341

SEQ ID NO: 811352 - protein, 315 aa, Homo sapiens
SPPRPLPVPAAAAVAFGAKGTDPAEARSSRGIEEAGPRAHGRAGREPERRRSRQQRRGGLQARRSTLLKTCARARATAPGAMKMVAPWTRFYSNSCCLCCHVRTGTILLGVWYLIINAVVLLILLSALADPDQYNFSSSELGGDFEFMDDAKILFNLSADMCIAIAISLLMILICAMATYGAYKQRAAWIIPFFCYQIFDFALNMLVAITVLIYPNSIQEYIRQLPPNFPYRDDVMSVNPTCLVLIILLFISIILTFKGYLISCVWNCYRYINGRNSSDVLVYVTSNDTTVLLPPYDDATVNGAAKEPPPPYVSA

SEQ ID NO: 811353 - protein, 155 aa, Homo sapiens [sequence omitted]

SEQ ID NO: 811354 - protein, 147 aa, Homo sapiens
ADLRGFPGKALRRRYKQRAAWIIPFFCYQIFDFALNMLVAITVLIYPNSIQEYIRQLPPNFPYRDDVMSVNPTCLVLIILLFISIILTFKGYLISCVWNCYRYINGRNSSDVLVYVTSNDTTVLLPPYDDATVNGAAKEPPPPYVSA

SEQ ID NO: 811355 - protein, 307 aa, Homo sapiens; identical to SEQ ID NO: 811341

SEQ ID NO: 811356 - protein, 79 aa, Homo sapiens
GSRLGVNRPRYLLFISIILTFKGYLISCVWNCYRYINGRNSSDVLVYVTSNDTTVLLPPYDDATVNGAAKEPPPPYVSA

SEQ ID NO: 811357 - protein, 286 aa, Homo sapiens
SPPRPLPVPAAAAVAFGAKGTDPAEARSSRGIEEAGPRAHGRAGREPERRRSRQQRRGGLQARRSTLLKTCARARATAPGAMKMVAPWTRFYSNSCCLCCHVRTGTILLGVWYLIINAVVLLILLSALADPDQYNFSSSELGGDFEFMDDANMCIAIAISLLMILICAMATYGAYKQRAAWIIPFFCYQIFDFALNMLVAITVLIYPNSIQEYIRQLPPNFPYRDDVMSVNPTCLVLIILLFISIILTFKGYLISCVWNCYRYINGRNSSDVLVYVTSNDTTGCTR

SEQ ID NO: 811358 - protein, 153 aa, Homo sapiens
NLENGFYINDQKADLLLLENKKLKEYILYLKNNIEKYREGQEALMHTSSDLSRQLIAQEAQYKDLWAEFQTTVKILVDNGEETLQDINNLTDKLRERDEKMQHVSTWLRGSLEGLRLLVEQESPMDLLKKKKHIRTRVHFPVVKCTEKNTLTK

SEQ ID NO: 811359 - protein, 454 aa, Homo sapiens
GRAHSHPLPPRPSCTLPGAALRPSPCPPPPPPPPESPCRSRAPLFSRCCCCCWRRPPRRSCPGPAARRLWPPGAQTGRAQAGLCVCASSEPVCGSDANTYANLCQLRAASRRSERLHRPPVIVLQRGACGQGQEDPNSLRHKYNFIADVVEKIAPAVVHIELFRKLPFSKREVPVASGSGFIVSEDGLIVTNAHVVTNKHRVKVELKNGATYEAKIKDVDEKADIALIKIDHQGKLPVLLLGRSSELRPGEFVVAIGSPFSLQNTVTTGIVSTTQRGGKELGLRNSDMDYIQTDAIINYGNSGGPLVNLDGEVIGINTLKVTAGISFAIPSDKIKKFLTESHDRQAKGKAITKKKYIGIRMMSLTSSKAKELKDRHRDFPDVISGAYIIEVIPDTPAEAGGLKENDVIISINGQSVVSANDVSDVIKRESTLNMVVRRGNEDIMITVIPEEIDP

SEQ ID NO: 811360 - protein, 341 aa, Homo sapiens
RPRALAPAAPEALLHSPRRRSPALALSAATAAAARVAMQIPRAALLPLLLLLLAAPASAQLSRAGRSAPLAAGCPDRCEPARCPPQPEHCEGGRARDACGCCEVCGAPEGAACGLQEGPCGEGLQCVVPFGVPASATVRRRAQAGLCVCASSEPVCGSDANTYANLCQLRAASRRSERLHRPPVIVLQRGACGQGQEDPNSLRHKYNFIADVVEKIAPAVVHIELFRKLPFSKREVPVASGSGFIVSEDGLIVTNAHVVTNKHRVKVELKNGATYEAKIKDVDEKADIALIKIDHQNDTGSCCLCCVSSGGICPSSVSQHHTVVHTRAQNGRINMIINVLS

SEQ ID NO: 811361 - protein, 297 aa, Homo sapiens [sequence omitted]

SEQ ID NO: 811362 - protein, 480 aa, Homo sapiens
MQIPRAALLPLLLLLLAAPASAQLSRAGRSAPLAAGCPDRCEPARCPPQPEHCEGGRARDACGCCEVCGAPEGAACGLQEGPCGEGLQCVVPFGVPASATVRRRAQAGLCVCASSEPVCGSDANTYANLCQLRAASRRSERLHRPPVIVLQRGACGQGQEDPNSLRHKYNFIADVVEKIAPAVVHIELFRKLPFSKREVPVASGSGFIVSEDGLIVTNAHVVTNKHRVKVELKNGATYEAKIKDVDEKADIALIKIDHQGKLPVLLLGRSSELRPGEFVVAIGSPFSLQNTVTTGIVSTTQRGGKELGLRNSDMDYIQTDAIINYGNSGGPLVNLDGEVIGINTLKVTAGISFAIPSDKIKKFLTESHDRQAKGKAITKKKYIGIRMMSLTSSKAKELKDRHRDFPDVISGAYIIEVIPDTPAEAGGLKENDVIISINGQSVVSANDVSDVIKRESTLNMVVRRGNEDIMITVIPEEIDP

SEQ ID NO: 811363 - protein, 462 aa, Homo sapiens
MQIPRAALLPLLLLLLAAPASAQLSRAGRSAPLAAGCPDRCEPARCPPQPEHCEGGRARDACGCCEVCGAPEGAACGLQEGPCGEGLQCVVPFGVPASATVRRRAQAGLCVCASSEPVCGSDANTYANLCQLRAASRRSERLHRPPVIVLQRGACGQGQEDPNSLRHKYNFIADVVEKIAPAVVHIELFRKLPFSKREVPVASGSGFIVSEDGLIVTNAHVVTNKHRVKVELKNGATYEAKIKDVDEKADIALIKIDHQGKLPVLLLGRSSELRPGEFVVAIGSPFSLQNTVTTGIVSTTQRGGKELGLRNSDMDYIQTDAIINYGNSGGPLVNLDGEVIGINTLKVTAGISFAIPSDKIKKFLTESHDRQAKGKAITKKKYIGIRMMSLTSSKAKELKDRHRDFPDVISGAYIIEVIPDTPAEAGGLKENDVIISINGQSVVSANDVSDVIITVIPEEIDP

SEQ ID NO: 811364 - protein, 480 aa, Homo sapiens; identical to SEQ ID NO: 811362

SEQ ID NO: 811365 - protein, 480 aa, Homo sapiens; identical to SEQ ID NO: 811362

SEQ ID NO: 811366 - protein, 442 aa, Homo sapiens
MQIPRAALLPLLLLLLAAPARDACGCCEVCGAPEGAACGLQEGPCGEGLQCVVPFGVPASATVRRRAQAGLCVCASSEPVCGSDANTYANLCQLRAASRRSERLHRPPVIVLQRGACGQGQEDPNSLRHKYNFIADVVEKIAPAVVHIELFRKLPFSKREVPVASGSGFIVSEDGLIVTNAHVVTNKHRVKVELKNGATYEAKIKDVDEKADIALIKIDHQGKLPVLLLGRSSELRPGEFVVAIGSPFSLQNTVTTGIVSTTQRGGKELGLRNSDMDYIQTDAIINYGNSGGPLVNLDGEVIGINTLKVTAGISFAIPSDKIKKFLTESHDRQAKGKAITKKKYIGIRMMSLTSSKAKELKDRHRDFPDVISGAYIIEVIPDTPAEAGGLKENDVIISINGQSVVSANDVSDVIKRESTLNMVVRRGNEDIMITVIPEEIDP

SEQ ID NO: 811367 - protein, 316 aa, Homo sapiens
RSLAGSPLIAVFIVIAPAVVHIDLFRTLPFSKREVPVASGSGFIVSEDGLIVTNAHVVTNKHRVKVELKNGATYEAKIKDVDEKADIALIKIDHQGKLPVLLLGRSSELRPGEFVVAIGSPFSLQNTVTTGIVSTTQRGGKELGLRNSDMDYIQTDAIINYGNSGGPLVNLDGEVIGINTLKVTAGISFAIPSDKIKKFLTESHDRQAKGKAITKKKYIGIRMMSLTSSKAKELKDRHRDFPDVISGAYIIEVIPDTPAEAGGLKENDVIISINGQSVVSANDVSDVIKRESTLNMVVRRGNEDIMITVIPEEIDP

SEQ ID NO: 811368 - protein, 226 aa, Homo sapiens
ERDFTVSLRKTLPWMTDEDSGLLERTLKTFDCHLVGSVRDSLANRILLDSLQAKQMYCCRDYIQTEAIINYGNSGGALVNLDGEVIGINTLKVTAGISFAIPSDKIKKFLTESHDRQAKGKAITKKKYIGIRMMSLTSSKAKELKDRHRDFPDVISGAYIIEVIPDTPAEAGGLKENDVIISINGQSVVSANDVSDVIKRESTLNMVVRRGNEDIMITVIPEEIDP

SEQ ID NO: 811369 - protein, 569 aa, Homo sapiens
RPRALAPAAPEALLHSPRRRSPALALSAATAAAARVAMQIPRAALLPLLLLLLAAPASAQLSRAGRSAPLAAGCPDRCEPARCPPQPEHCEGGRARDACGCCEVCGAPEGAACGLQEGPCGEGLQCVVPFGVPASATVRRRAQAGLCVCASSEPVCGSDANTYANLCQLRAASRRSERLHRPPVIVLQRGACGQGQEDPNSLRHKYNFIADVVEKIAPAVVHIELFRKLPFSKREVPVASGSGFIVSEDGLIVTNAHVVTNKHRVKVELKNGATYEAKIKDVDEKADIALIKIDHQGKLPVLLLGRSSELRPGEFVVAIGSPFSLQNTVTTGIVSTTQRGGKELGLRNSDMDYIQTDAIINYGNSGGPLVNLDGEVIGINTLKVTAGISFAIPSDKIKKFLTESHDRQAKGKAITKKKYIGIRMMSLTSRQSQELKDGTGTFQKSHQRRNYEVLRYPEKGGAQERGLTHKGTGVPNVWGLKGSPKVGRVRNNQDPKSTRGREVSHTRREEGKHKTSGGPPIEGRPFLSRYMCCVSHDRQRDENKRVDDRNTQRHDSMIERRSDTTRNNG

SEQ ID NO: 811370 - protein, 757 aa, Homo sapiens
MSLLFSRCNSIVTVKKNKRHMAEVNASPLKHFVTAKKKINGIFEQLGAYIQESATFLEDTYRNAELDPVTTEEQVLDVKGYLSKVRGISEVLARRHMKVAFFGRTSNGKSTVINAMLWDKVLPSGIGHTTNCFLRVEGTDGHEAFLLTEGSEEKRSAKTVNQLAHALHQDKQLHAGSLVSVMWPNSKCPLLKDDLVLMDSPGIDVTTELDSWIDKFCLDADVFVLVANSESTLMQTEKHFFHKVSERLSRPNIFILNNRWDASASEPEYMEEVRRQHMERCTSFLVDELGVVDRSQAGDRIFFVSAKEVLNARIQKAQGMPEGGGALAEGFQVRMFEFQNFERRFEECISQSAVKTKFEQHTVRAKQIAEAVRLIMDSLHMAAREQQVYCEEMREERQDRLKFIDKQLELLAQDYKLRIKQITEEVERQVSTAMAEEIRRLSVLVDDYQMDFHPSPVVLKVYKNELHRHIEEGLGRNMSDRCSTAITNSLQTMQQDMIDGLKPLLPVSVRSQIDMLVPRQCFSLNYDLNCDKLCADFQEDIEFHFSLGWTMLVNRFLGPKNSRRALMGYNDQVQRPIPLTPANPSMPPLPQGSLTQEEFMVSMVTGLASLTSRTSMGILVVGGVVWKAVGWRLIALSFGLYGLLYVYERLTWTTKAKERAFKRQFVEHASEKLQLVISYTGSNCSHQVQQELSGTFAHLCQQVDVTRENLEQEIAAMNKKIEVLDSLQSKAKLLRNKAGWLDSELNMFTHQYLQPSR

SEQ ID NO: 811371 - protein, 399 aa, Homo sapiens
MAFLSSWGRGALAEGFQVRMFEFQNFERRFEECISQSAVKTKFEQHTVRAKQIAEAVRLIMDSLHMAAREQQVYCEEMREERQDRLKFIDKQLELLAQDYKLRIKQITEEVERQVSTAMAEEIRRLSVLVDDYQMDFHPSPVVLKVYKNELHRHIEEGLGRNMSDRCSTAITNSLQTMQQDMIDGLKPLLPVSVRSQIDMLVPRQCFSLNYDLNCDKLCADFQEDIEFHFSLGWTMLVNRFLGPKNSRRALMGYNDQVQRPIPLTPANPSMPPLPQGSLTQEEFMVSMVTGLASLTSRTSMGILVVGGVVWKAVGWRLIALSFGLYGLLYVYERLTWTTKAKERAFKRQFVEHASEKLQLVISYTGSNCSHQVQQELSGTFAHLCQQVDVTRENGRDPF

SEQ ID NO: 811372 - protein, 289 aa, Homo sapiens
MSLLFSRCNSIVTVKKNKRHMAEVNASPLKHFVTAKKKINGIFEQLGAYIQESATFLEDTYRNAELDPVTTEEQVLDVKGYLSKVRGISEVLARRHMKVAFFGRTSNGKSTVINAMLWDKVLPSGIGHTTNCFLRVEGTDGHEAFLLTEGSEEKRSAKTVNQLAHALHQDKQLHAGSLVSVMWPNSKCPLLKDDLVLMDSPGIDVTTELDSWIDKFCLDADVFVLVANSESTLMQTEKHFFHKVSERLSRPNIFILNNRWDASASEPEYMEEGRGDMEGEHSGIKGWGC

SEQ ID NO: 811373 - protein, 757 aa, Homo sapiens; identical to SEQ ID NO: 811370

SEQ ID NO: 811374 - protein, 757 aa, Homo sapiens; identical to SEQ ID NO: 811370

SEQ ID NO: 811375 - protein, 757 aa, Homo sapiens; identical to SEQ ID NO: 811370

SEQ ID NO: 811376 - protein, 661 aa, Homo sapiens
MKVAFFGRTSNGKSTVINAMLWDKVLPSGIGHTTNCFLRVEGTDGHEAFLLTEGSEEKRSAKTVNQLAHALHQDKQLHAGSLVSVMWPNSKCPLLKDDLVLMDSPGIDVTTELDSWIDKFCLDADVFVLVANSESTLMQTEKHFFHKVSERLSRPNIFILNNRWDASASEPEYMEEVRRQHMERCTSFLVDELGVVDRSQAGDRIFFVSAKEVLNARIQKAQGMPEGGGALAEGFQVRMFEFQNFERRFEECISQSAVKTKFEQHTVRAKQIAEAVRLIMDSLHMAAREQQVYCEEMREERQDRLKFIDKQLELLAQDYKLRIKQITEEVERQVSTAMAEEIRRLSVLVDDYQMDFHPSPVVLKVYKNELHRHIEEGLGRNMSDRCSTAITNSLQTMQQDMIDGLKPLLPVSVRSQIDMLVPRQCFSLNYDLNCDKLCADFQEDIEFHFSLGWTMLVNRFLGPKNSRRALMGYNDQVQRPIPLTPANPSMPPLPQGSLTQEEFMVSMVTGLASLTSRTSMGILVVGGVVWKAVGWRLIALSFGLYGLLYVYERLTWTTKAKERAFKRQFVEHASEKLQLVISYTGSNCSHQVQQELSGTFAHLCQQVDVTRENLEQEIAAMNKKIEVLDSLQSKAKLLRNKAGWLDSELNMFTHQYLQPSR

SEQ ID NO: 811377 - protein, 605 aa, Homo sapiens
MRARPDFSPVPGFLLHDLPASQVPGLFSAGRIGLLLCLMIWFTPVTFSPGIDVTTELDSWIDKFCLDADVFVLVANSESTLMQTEKHFFHKVSERLSRPNIFILNNRWDASASEPEYMEEVRRQHMERCTSFLVDELGVVDRSQAGDRIFFVSAKEVLNARIQKAQGMPEGGGALAEGFQVRMFEFQNFERRFEECISQSAVKTKFEQHTVRAKQIAEAVRLIMDSLHMAAREQQVYCEEMREERQDRLKFIDKQLELLAQDYKLRIKQITEEVERQVSTAMAEEIRRLSVLVDDYQMDFHPSPVVLKVYKNELHRHIEEGLGRNMSDRCSTAITNSLQTMQQDMIDGLKPLLPVSVRSQIDMLVPRQCFSLNYDLNCDKLCADFQEDIEFHFSLGWTMLVNRFLGPKNSRRALMGYNDQVQRPIPLTPANPSMPPLPQGSLTQEEFMVSMVTGLASLTSRTSMGILVVGGVVWKAVGWRLIALSFGLYGLLYVYERLTWTTKAKERAFKRQFVEHASEKLQLVISYTGSNCSHQVQQELSGTFAHLCQQVDVTRENLEQEIAAMNKKIEVLDSLQSKAKLLRNKAGWLDSELNMFTHQYLQPSR

SEQ ID NO: 811378 - protein, 442 aa, Homo sapiens
MAFLSSWGRGALAEGFQVRMFEFQNFERRFEECISQSAVKTKFEQHTVRAKQIAEAVRLIMDSLHMAAREQQVYCEEMREERQDRLKFIDKQLELLAQDYKLRIKQITEEVERQVSTAMAEEIRRLSVLVDDYQMDFHPSPVVLKVYKNELHRHIEEGLGRNMSDRCSTAITNSLQTMQQDMIDGLKPLLPVSVRSQIDMLVPRQCFSLNYDLNCDKLCADFQEDIEFHFSLGWTMLVNRFLGPKNSRRALMGYNDQVQRPIPLTPANPSMPPLPQGSLTQEEFMVSMVTGLASLTSRTSMGILVVGGVVWKAVGWRLIALSFGLYGLLYVYERLTWTTKAKERAFKRQFVEHASEKLQLVISYTGSNCSHQVQQELSGTFAHLCQQVDVTRENLEQEIAAMNKKIEVLDSLQSKAKLLRNKAGWLDSELNMFTHQYLQPSR

SEQ ID NO: 811379 - protein, 445 aa, Homo sapiens
GDKLCADFQEDIEFHFSLGWTMLVNRFLGPKNSRRALMGYNDQVQRPIPLTPANPSMPPLPQGSLTLHMAAREQQVYCEEMREERQDRLKFIDKQLELLAQDYKLRIKQITEEVERQVSTAMAEEIRRLSVLVDDYQMDFHPSPVVLKVYKNELHRHIEEGLGRNMSDRCSTAITNSLQTMQQDMIDGLKPLLPVSVRSQIDMLVPRQCFSLNYDLNCDKLCADFQEDIEFHFSLGWTMLVNRFLGPKNSRRALMGYNDQVQRPIPLTPANPSMPPLPQGSLTQEEFMVSMVTGLASLTSRTSMGILVVGGVVWKAVGWRLIALSFGLYGLLYVYERLTWTTKAKERAFKRQFVEHASEKLQLVISYTGSNCSHQVQQELSGTFAHLCQQVDVTRENLEQEIAAMNKKIEVLDSLQSKAKLLRNKAGWLDSELNMFTHQYLQPSR

SEQ ID NO: 811380 - protein, 887 aa, Homo sapiens
MSLLFSRCNSIVTVKKNKRHMAEVNASPLKHFVTAKKKINGIFEQLGAYIQESATFLEDTYRNAELDPVTTEEQVLDVKGYLSKVRGISEVLARRHMKVAFFGRTSNGKSTVINAMLWDKVLPSGIGHTTNCFLRVEGTDGHEAFLLTEGSEEKRSAKTVNQLAHALHQDKQLHAGSLVSVMWPNSKCPLLKDDLVLMDSPGIDVTTELDSWIDKFCLDADVFVLVANSESTLMQTEKHFFHKVSERLSRPNIFILNNRWDASASEPEYMEEVRRQHMERCTSFLVDELGVVDRSQAGDRIFFVSAKEVLNARIQKAQGMPEGGGALAEGFQVRMFEFQNFERRFEECISQSAVKTKFEQHTVRAKQIAEAVRLIMDSLHMAAREQQVYCEEMREERQDRLKFIDKQLELLAQDYKLRIKQITEEVERQVRNEEEAFWEDLDSEESPEESRPPPLRDFSAFQKKVVALFQEYSSCRLGSIVGLCDAGHVPFPLDLHRSCGRLISQFPRPSHFRGFNSIEELRRLLFERKDVPSARISPGAAGVNFGLPGYLTVCFLLLYVSTAMAEEIRRLSVLVDDYQMDFHPSPVVLKVYKNELHRHIEEGLGRNMSDRCSTAITNSLQTMQQDMIDGLKPLLPVSVRSQIDMLVPRQCFSLNYDLNCDKLCADFQEDIEFHFSLGWTMLVNRFLGPKNSRRALMGYNDQVQRPIPLTPANPSMPPLPQGSLTQEEFMVSMVTGLASLTSRTSMGILVVGGVVWKAVGWRLIALSFGLYGLLYVYERLTWTTKAKERAFKRQFVEHASEKLQLVISYTGSNCSHQVQQELSGTFAHLCQQVDVTRENLEQEIAAMNKKIEVLDSLQSKAKLLRNKAGWLDSELNMFTHQYLQPSR

SEQ ID NO: 811381 - protein, 207 aa, Homo sapiens [sequence omitted]

SEQ ID NO: 811382 - protein, 757 aa, Homo sapiens; identical to SEQ ID NO: 811370

SEQ ID NO: 811383 - protein, 177 aa, Homo sapiens
MSLLFSRCNSIVTVKKNKRHMAEVNASPLKHFVTAKKKINGIFEQLGAYIQESATFLEDTYRNAELDPVTTEEQVLDVKGYLSKVRGISEVLARRHMKVAFFGRTSNGKSTVINAMLWDKVLPSGIGHTTNCFLRVEGTDGHEAFLLTEGSEEKRSAKTVNQLAHALHQDKQLEEWE

SEQ ID NO: 811384 - protein, 177 aa, Homo sapiens; identical to SEQ ID NO: 811383

SEQ ID NO: 811385 - protein, 757 aa, Homo sapiens; identical to SEQ ID NO: 811370

SEQ ID NO: 811386 - protein, 757 aa, Homo sapiens; identical to SEQ ID NO: 811370

SEQ ID NO: 811387 - protein, 542 aa, Homo sapiens
MSLLFSRCNSIVTVKKNKRHMAEVNASPLKHFVTAKKKINGIFEQLGAYIQESATFLEDTYRNAELDPVTTEEQVLDVKGYLSKVRGISEVLARRHMKVAFFGRTSNGKSTVINAMLWDKVLPSGIGHTTNCFLRVEGTDGHEAFLLTEGSEEKRSAKTVNQLAHALHQDKQLHAGSLVSVMWPNSKCPLLKDDLVLMDSPGIDVTTELDSWIDKFCLDADVFVLVANSESTLMQTEKHFFHKVSERLSRPNIFILNNRWDASASEPEYMEEVRRQHMERCTSFLVDELGVVDRSQAGDRIFFVSAKEVLNARIQKAQGMPEGGGALAEGFQVRMFEFQNFERRFEECISQSAVKTKFEQHTVRAKQIAEAVRLIMDSLHMAAREQQVYCEEMREERQDRLKFIDKQLELLAQDYKLRIKQITEEVERQVSTAMAEEIRRLSVLVDDYQMDFHPSPVVLKVYKNELHRHIEEGLGRNMSDRCSTAITNSLQTMQQDMIDGLKPLLPVSVRSQIDMLVPRQCFSLNYDLNCDKLCTVWWPHHR

SEQ ID NO: 811388 - protein, 757 aa, Homo sapiens; identical to SEQ ID NO: 811370

SEQ ID NO: 811389 - protein, 289 aa, Homo sapiens; identical to SEQ ID NO: 811372

SEQ ID NO: 811390 - protein, 706 aa, Homo sapiens
MSLLFSRCNSIVTVKKNKRHMAEVNASPLKHFVTAKKKINGIFEQLGAYIQESATFLEDTYRNAELDPVTTEEQVLDVKGYLSKVRGISEVLARRHMKVAFFGRTSNGKSTVINAMLWDKVLPSGIGHTTNCFLRVEGTDGHEAFLLTEGSEEKRSAKTVNQLAHALHQDKQLHAGSLVSVMWPNSKCPLLKDDLVLMDSPGIDVTTELDSWIDKFCLDADVFVLVANSESTLMQTEKHFFHKVSERLSRPNIFILNNRWDASASEPEYMEEVRRQHMERCTSFLVDELGVVDRSQAGDRIFFVSAKEVLNARIQKAQGMPEGGGALAEGFQVRMFEFQNFERRFEECISQSAVKTKFEQHTVRAKQIAEAVRLIMDSLHMAAREQQVYCEEMREERQDRLKFIDKQLELLAQDYKLRIKQITEEVERQVSTAMAEEIRRLSVLVDDYQMDFHPSPVVLKVYKNELHRHIEEGLGRNMSDRCSTAITNSLQTMQQDMIDGLKPLLPVSVRSQIDMLVPRQCFSLNYDLNCDKLCADFQEDIEFHFSLGWTMLVNRFLGPKNSRRALMGYNDQVQRPIPLTPANPSMPPLPQGSLTQEEFMVSMVTGLASLTSRTSMGILVVGGVVWKAVGWRLIALSFGLYGLLYVYERLTWTTKAKERAFKRQFVEHASEKLQLVISYTGSNCSHQVQHRGPAAQPSLIFEEMSW

SEQ ID NO: 811391 - protein, 714 aa, Homo sapiens
MSLLFSRCNSIVTVKKNKRHMAEVNASPLKHFVTAKKKINGIFEQLGAYIQESATFLEDTYRNAELDPVTTEEQVLDVKGYLSKVRGISEVLARRHMKVAFFGRTSNGKSTVINAMLWDKVLPSGIGHTTNCFLRVEGTDGHEAFLLTEGSEEKRSAKTVNQLAHALHQDKQLHAGSLVSVMWPNSKCPLLKDDLVLMDSPGIDVTTELDSWIDKFCLDADVFVLVANSESTLMQTEKHFFHKVSERLSRPNIFILNNRWDASASEPEYMEEVRRQHMERCTSFLVDELGVVDRSQAGDRIFFVSAKEVLNARIQKAQGMPEGGGALAEGFQVRMFEFQNFERRFEECISQSAVKTKFEQHTVRAKQIAEAVRLIMDSLHMAAREQQVYCEEMREERQDRLKFIDKQLELLAQDYKLRIKQITEEVERQVSTAMAEEIRRLSVLVDDYQMDFHPSPVVLKVYKNELHRHIEEGLGRNMSDRCSTAITNSLQTMQQDMIDGLKPLLPVSVRSQIDMLVPRQCFSLNYDLNCDKLCADFQEDIEFHFSLGWTMLVNRFLGPKNSRRALMGYNDQVQRPIPLTPANPSMPPLPQGSLTQEEFMVSMVTGLASLTSRTSMGILVVGGVVWKAVGWRLIALSFGLYGLLYVYERLTWTTKAKERAFKRQFVEHASEKLQLVISYTGSNCSHQVQQELSGTFAHLCQQVDVTRENGRDPF

SEQ ID NO: 811392 - protein, 200 aa, Homo sapiens [sequence omitted]

SEQ ID NO: 811393 - protein, 184 aa, Homo sapiens
MAADESSQNTLRLQFKAMQEMQHKRLQKQMEKKREKELSLKSRADDQEEPLEVSDGLSLLHAGEPNSKNSFEKRVLEDEIEHLRNELRETVDENGRLYKLLKERDFEIKHLKKKIEEDRFAFTGTAGVAGDVVATKIVELSKKNRLLMAESEGAKTRVKQLTNRIQELEREVRGLGHSPSGGDS

SEQ ID NO: 811394 - protein, 228 aa, Homo sapiens
MAADESSQNTLRLQFKAMQEMQHKRLQKQMEKKREKELSLKSRADDQEEPLEVSDGLSLLHAGEPNSKNSFEKRVLEDEIEHLRNELRETVDENGRLYKLLKERDFEIKHLKKKIEEDRFAFTGTAGVAGDVVATKIVELSKKNRLLMAESEGAKTRVKQLTNRIQELERELQTALTRLSAKGATDAGAKPPRAQMGDRALLETPEVKALQDRLVATNLKMSDLRNQI

SEQ ID NO: 811395 - protein, 976 aa, Homo sapiens
MDPEYEEKMKADRAKRFEFLLKQTELFAHFIQPSAQKSPTSPLNMKLGRPRIKKDEKQSLISAGDYRHRRTEQEEDEELLSESRKTSNVCIRFEVSPSYVKGGPLRDYQIRGLNWLISLYENGVNGILADEMGLGKTLQTIALLGYLKHYRNIPGPHMVLVPKSTLHNWMNEFKRWVPSLRVICFVGDKDARAAFIRDEMMPGEWDVCVTSYEMVIKEKSVFKKFHWRYLVIDEAHRIKNEKSKLSEIVREFKSTNRLLLTGTPLQNNLHELWALLNFLLPDVFNSADDFDSWFDTKNCLGDQKLVERLHAVLKPFLLRRIKTDVEKSLPPKKEIKIYLGLSKMQREWYTKILMKDIDVLNSSGKMDKMRLLNILMQLRKCCNHPYLFDGAEPGPPYTTDEHIVSNSGKMVVLDKLLAKLKEQGSRVLIFSQMTRLLDILEDYCMWRGYEYCRLDGQTPHEEREDKFLEVEFLGQREAIEAFNAPNSSKFIFMLSTRAGGLGINLASADVVILYDSDWNPQVDLQAMDRAHRIGQKKPVRVFRLITDNTVEERIVERAEIKLRLDSIVIQQGRLIDQQSNKLAKEEMLQMIRHGATHVFASKESELTDEDITTILERGEKKTAEMNERLQKMGESSLRNFRMDIEQSLYKFEGEDYREKQKLGMVEWIEPPKRERKANYAVDAYFREALRVSEPKIPKAPRPPKQPNVQDFQFFPPRLFELLEKEILYYRKTIGYKVPRNPDIPNPALAQREEQKKIDGAEPLTPEETEEKEKLLTQGFTNWTKRDFNQFIKANEKYGRDDIDNIAREVEGKSPEEVMEYSAVFWERCNELQDIEKIMAQIERGEARIQRRISIKKALDAKIARYKAPFHQLRIQYGTSKGKNYTEEEDRFLICMLHKMGFDRENVYEELRQCVRNAPQFRFDWFIKSRTAMEFQRRCNTLISLIEKENMEIEERERAEKKKRATKTPMVKFSAFS

SEQ ID NO: 811396 - protein, 1195 aa, Homo sapiens
KIHYDQVGFILGMYDWFHICKLISIIDHISRTKNKDHMIFSIDIEKVFDKIQYSFILKTLKNSVYMEYNNNKGHKFTANFILNGEKLKAFPLKSGKNQECSLSPFLCNIPCSIYLFPVQPLPPPRSPRPLPCPPTRSRSHGMEQDTAAVAATVAAADATATIVVIEDEQPGPSTSQEEGAAAAATEATAATEKGEKKKEKNVSSFQLKLAAKAPKSEKEMDPEYEEKMKADRAKRFEFLLKQTELFAHFIQPSAQKSPTSPLNMKLGRPRIKKDEKQSLISAGDYRHRRTEQEEDEELLSESRKTSNVCIRFEVSPSYVKGGPLRDYQIRGLNWLISLYENGVNGILADEMGLGKTLQTIALLGYLKHYRNIPGPHMVLVPKSTLHNWMNEFKRWVPSLRVICFVGDKDARAAFIRDEMMPGEWDVCVTSYEMVIKEKSVFKKFHWRYLVIDEAHRIKNEKSKLSEIVREFKSTNRLLLTGTPLQNNLHELWALLNFLLPDVFNSADDFDSWFDTKNCLGDQKLVERLHAVLKPFLLRRIKTDVEKSLPPKKEIKIYLGLSKMQREWYTKILMKDIDVLNSSGKMDKMRLLNILMQLRKCCNHPYLFDGAEPGPPYTTDEHIVSNSGKMVVLDKLLAKLKEQGSRVLIFSQMTRLLDILEDYCMWRGYEYCRLDGQTPHEEREDKFLEVEFLGQREAIEAFNAPNSSKFIFMLSTRAGGLGINLASADVVILYDSDWNPQVDLQAMDRAHRIGQKKPVRVFRLITDNTVEERIVERAEIKLRLDSIVIQQGRLIDQQSNKLAKEEMLQMIRHGATHVFASKESELTDEDITTILERGEKKTAEMNERLQKMGESSLRNFRMDIEQSLYKFEGEDYREKQKLGMVEWIEPPKRERKANYAVDAYFREALRVSEPKIPKAPRPPKQPNVQDFQFFPPRLFELLEKEILYYRKTIGYKVPRNPDIPNPALAQREEQKKIDGAEPLTPEETEEKEKLLTQGFTNWTKRDFNQFIKANEKYGRDDIDNIAREVEGKSPEEVMEYSAVFWERCNELQDIEKIMAQIERGEARIQRRISIKKALDAKIARYKAPFHQLRIQYGTSKGKNYTEEEDRFLICMLHKMGFDRENVYEELRQCVRNAPQFRFDWFIKSRTAMEFQRRCNTLISLIEKENMEIEERERAEKKKRATKTPMVKFSAFS

SEQ ID NO: 811397 - protein, 1189 aa, Homo sapiens
KIHYDQVGFILGMYDWFHICKLISIIDHISRTKNKDHMIFSIDIEKVFDKIQYSFILKTLKNSVYMEYNNNKGHKFTANFILNGEKLKAFPLKSGKNQECSLSPFLCNIPCSIYLFPVQPLPPPRSPRPLPCPPTRSRSHGMEQDTAAVAATVAAADATATIVVIEDEQPGPSTSQEEGAAAAATEATAATEKGEKKKEKNVSSFQLKLAAKAPKSEKEMDPEYEEKMKADRAKRFEFLLKQTELFAHFIQPSAQKSPTSPLNMKLGRPRIKKDEKQSLISAGDYRHRRTEQEEDEELLSESRKTSNVCIRFEVSPSYVKGGPLRDYQIRGLNWLISLYENGVNGILADEMGLGKTLQTIALLGYLKHYRNIPGPHMVLVPKSTLHNWMNEFKRWVPSLRVICFVGDKDARAAFIRDEMMPGEWDVCVTSYEMVIKEKSVFKKFHWRYLVIDEAHRIKNEKSKLSEIVREFKSTNRLLLTGTPLQNNLHELWALLNFLLPDVFNSADDFDSWFDTKNCLGDQKLVERLHAVLKPFLLRRIKTDVEKSLPPKKEIKIYLGLSKMQREWYTKILMKDIDVLNSSGKMDKMRLLNILMQLRKCCNHPYLFDGAEPGPPYTTDEHIVSNSGKMVVLDKLLAKLKEQGSRVLIFSQMTRLLDILEDYCMWRGYEYCRLDGQTPHEEREDKFLEVEFLGQREAIEAFNAPNSSKFIFMLSTRAGGLGINLASADVVILYDSDWNPQVDLQAMDRAHRIGQKKPVRVFRLITDNTVEERIVERAEIKLRLDSIVIQQGRLIDQQSNKLAKEEMLQMIRHGATHVFASKESELTDEDITTILERGEKKTAEMNERLQKMGESSLRNFRMDIEQSLYKFEGEDYREKQKLGMVEWIEPPKRERKANYAVDAYFREALRVSEPKIPKAPRPPKQPNVQDFQFFPPRLFELLEKEILYYRKTIGYKVPRNPDIPNPALAQREEQKKIDGAEPLTPEETEEKEKLLTQGFTNWTKRDFNQFIKANEKYGRDDIDNIAREVEGKSPEEVMEYSAVFWERCNELQDIEKIMAQIERGEARIQRRISIKKALDAKIARYKAPFHQLRIQYGTSKGKNYTEEEDRFLICMLHKMGFDRENVYEELRQCVRNAPQFRFDWFIKSRTAMEFQRRCNTLISLIEKENMEIEERERAEKKKRATKTPMI

SEQ ID NO: 811398 - protein, 1033 aa, Homo sapiens
MEQDTAAVAATVAAADATATIVVIEDEQPGPSTSQEEKNVSSFQLKLAAKAPKSEKEMDPEYEEKMKADRAKRFEFLLKQTELFAHFIQPSAQKSPTSPLNMKLGRPRIKKDEKQSLISAGDYRHRRTEQEEDEELLSESRKTSNVCIRFEVSPSYVKGGPLRDYQIRGLNWLISLYENGVNGILADEMGLGKTLQTIALLGYLKHYRNIPGPHMVLVPKSTLHNWMNEFKRWVPSLRVICFVGDKDARAAFIRDEMMPGEWDVCVTSYEMVIKEKSVFKKFHWRYLVIDEAHRIKNEKSKLSEIVREFKSTNRLLLTGTPLQNNLHELWALLNFLLPDVFNSADDFDSWFDTKNCLGDQKLVERLHAVLKPFLLRRIKTDVEKSLPPKKEIKIYLGLSKMQREWYTKILMKDIDVLNSSGKMDKMRLLNILMQLRKCCNHPYLFDGAEPGPPYTTDEHIVSNSGKMVVLDKLLAKLKEQGSRVLIFSQMTRLLDILEDYCMWRGYEYCRLDGQTPHEEREDKFLEVEFLGQREAIEAFNAPNSSKFIFMLSTRAGGLGINLASADVVILYDSDWNPQVDLQAMDRAHRIGQKKPVRVFRLITDNTVEERIVERAEIKLRLDSIVIQQGRLIDQQSNKLAKEEMLQMIRHGATHVFASKESELTDEDITTILERGEKKTAEMNERLQKMGESSLRNFRMDIEQSLYKFEGEDYREKQKLGMVEWIEPPKRERKANYAVDAYFREALRVSEPKIPKAPRPPKQPNVQDFQFFPPRLFELLEKEILYYRKTIGYKVPRNPDIPNPALAQREEQKKIDGAEPLTPEETEEKEKLLTQGFTNWTKRDFNQFIKANEKYGRDDIDNIAREVEGKSPEEVMEYSAVFWERCNELQDIEKIMAQIERGEARIQRRISIKKALDAKIARYKAPFHQLRIQYGTSKGKNYTEEEDRFLICMLHKMGFDRENVYEELRQCVRNAPQFRFDWFIKSRTAMEFQRRCNTLISLIEKENMEIEERERAEKKKRATKTPMVKFSAFS

SEQ ID NO: 811399 - protein, 1211 aa, Homo sapiens
KIHYDQVGFILGMYDWFHICKLISIIDHISRTKNKDHMIFSIDIEKVFDKIQYSFILKTLKNSVYMEYNNNKGHKFTANFILNGEKLKAFPLKSGKNQECSLSPFLCNIPCSIYLFPVQPLPPPRSPRPLPCPPTRSRSHGMEQDTAAVAATVAAADATATIVVIEDEQPGPSTSQEEGAAAAATEATAATEKGEKKKEKNVSSFQLKLAAKAPKSEKEMDPEYEEKMKADRAKRFEFLLKQTELFAHFIQPSAQKSPTSPLNMKLGRPRIKKDEKQSLISAGDYRHRRTEQEEDEELLSESRKTSNVCIRFEVSPSYVKGGPLRDYQIRGLNWLISLYENGVNGILADEMGLGKTLQTIALLGYLKHYRNIPGPHMVLVPKSTLHNWMNEFKRWVPSLRVICFVGDKDARAAFIRDEMMPGEWDVCVTSYEMVIKEKSVFKKFHWRYLVIDEAHRIKNEKSKLSEIVREFKSTNRLLLTGTPLQNNLHELWALLNFLLPDVFNSADDFDSWFDTKNCLGDQKLVERLHAVLKPFLLRRIKTDVEKSLPPKKEIKIYLGLSKMQREWYTKILMKDIDVLNSSGKMDKMRLLNILMQLRKCCNHPYLFDGAEPGPPYTTDEHIVSNSGKMVVLDKLLAKLKEQGSRVLIFSQMTRLLDILEDYCMWRGYEYCRLDGQTPHEEREDKFLEVEFLGQREAIEAFNAPNSSKFIFMLSTRAGGLGINLASADVVILYDSDWNPQVDLQAMDRAHRIGQKKPVRVFRLITDNTVEERIVERAEIKLRLDSIVIQQGRLIDQQSNKLAKEEMLQMIRHGATHVFASKESELTDEDITTILERGEKKTAEMNERLQKMGESSLRNFRMDIEQSLYKFEGEDYREKQKLGMVEWIEPPKRERKANYAVDAYFREALRVSEPKIPKAPRPPKQPNVQDFQFFPPRLFELLEKEILYYRKTIGYKVPRNPDIPNPALAQREEQKKIDGAEPLTPEETEEKEKLLTQGFTNWTKRDFNQFIKANEKYGRDDIDNIAREVEGKSPEEVMEYSAVFWERCNELQDIEKIMAQIERGEARIQRRISIKKALDAKIARYKAPFHQLRIQYGTSKGKNYTEEEDRFLICMLHKMGFDRENVYEELRQCVRNAPQFRFDWFIKSRTAMEFQRRCNTLISLIEKENMEIEERERAEKKKRATKTPMSQKRKAESATESSGKKDVKKVKS

SEQ ID NO: 811400 - protein, 1042 aa, Homo sapiens
MEQDTAAVAATVAAADATATIVVIEDEQPGPSTSQEEGAAAAATEATAATEKGEKKKEKNVSSFQLKLAAKAPKSEKEMDPEYEEKMKADRAKRFEFLLKQTELFAHFIQPSAQKSPTSPLNMKLGRPRIKKDEKQSLISAGDYRHRRTEQEEDEELLSESRKTSNVCIRFEVSPSYVKGGPLRDYQIRGLNWLISLYENGVNGILADEMGLGKTLQTIALLGYLKHYRNIPGPHMVLVPKSTLHNWMNEFKRWVPSLRVICFVGDKDARAAFIRDEMMPGEWDVCVTSYEMVIKEKSVFKKFHWRYLVIDEAHRIKNEKSKLSEIVREFKSTNRLLLTGTPLQNNLHELWALLNFLLPDVFNSADDFDSWFDTKNCLGDQKLVERLHAVLKPFLLRRIKTDVEKSLPPKKEIKIYLGLSKMQREWYTKILMKDIDVLNSSGKMDKMRLLNILMQLRKCCNHPYLFDGAEPGPPYTTDEHIVSNSGKMVVLDKLLAKLKEQGSRVLIFSQMTRLLDILEDYCMWRGYEYCRLDGQTPHEEREEAIEAFNAPNSSKFIFMLSTRAGGLGINLASADVVILYDSDWNPQVDLQAMDRAHRIGQKKPVRVFRLITDNTVEERIVERAEIKLRLDSIVIQQGRLIDQQSNKLAKEEMLQMIRHGATHVFASKESELTDEDITTILERGEKKTAEMNERLQKMGESSLRNFRMDIEQSLYKFEGEDYREKQKLGMVEWIEPPKRERKANYAVDAYFREALRVSEPKIPKAPRPPKQPNVQDFQFFPPRLFELLEKEILYYRKTIGYKVPRNPDIPNPALAQREEQKKIDGAEPLTPEETEEKEKLLTQGFTNWTKRDFNQFIKANEKYGRDDIDNIAREVEGKSPEEVMEYSAVFWERCNELQDIEKIMAQIERGEARIQRRISIKKALDAKIARYKAPFHQLRIQYGTSKGKNYTEEEDRFLICMLHKMGFDRENVYEELRQCVRNAPQFRFDWFIKSRTAMEFQRRCNTLISLIEKENMEIEERERAEKKKRATKTPMVKFSAFS

SEQ ID NO: 811401 - protein, 1195 aa, Homo sapiens; identical to SEQ ID NO: 811396

SEQ ID NO: 811402 - protein, 982 aa, Homo sapiens
MEQDTAAVAATVAAADATATIVVIEDEQPGPSTSQEEGAAAAATEATAATEKGEKKKEKNVSSFQLKLAAKAPKSEKEMDPEYEEKMKADRAKRFEFLLKQTELFAHFIQPSAQKSPTSPLNMKLGRPRIKKDEKQSLISAGDYRHRRTEQEEDEELLSESRKTSNVCIRFEVSPSYVKGGPLRDYQIRGLNWLISLYENGVNGILADEMAAFIRDEMMPGEWDVCVTSYEMVIKEKSVFKKFHWRYLVIDEAHRIKNEKSKLSEIVREFKSTNRLLLTGTPLQNNLHELWALLNFLLPDVFNSADDFDSWFDTKNCLGDQKLVERLHAVLKPFLLRRIKTDVEKSLPPKKEIKIYLGLSKMQREWYTKILMKDIDVLNSSGKMDKMRLLNILMQLRKCCNHPYLFDGAEPGPPYTTDEHIVSNSGKMVVLDKLLAKLKEQGSRVLIFSQMTRLLDILEDYCMWRGYEYCRLDGQTPHEEREEAIEAFNAPNSSKFIFMLSTRAGGLGINLASADVVILYDSDWNPQVDLQAMDRAHRIGQKKPVRVFRLITDNTVEERIVERAEIKLRLDSIVIQQGRLIDQQSNKLAKEEMLQMIRHGATHVFASKESELTDEDITTILERGEKKTAEMNERLQKMGESSLRNFRMDIEQSLYKFEGEDYREKQKLGMVEWIEPPKRERKANYAVDAYFREALRVSEPKIPKAPRPPKQPNVQDFQFFPPRLFELLEKEILYYRKTIGYKVPRNPDIPNPALAQREEQKKIDGAEPLTPEETEEKEKLLTQGFTNWTKRDFNQFIKANEKYGRDDIDNIAREVEGKSPEEVMEYSAVFWERCNELQDIEKIMAQIERGEARIQRRISIKKALDAKIARYKAPFHQLRIQYGTSKGKNYTEEEDRFLICMLHKMGFDRENVYEELRQCVRNAPQFRFDWFIKSRTAMEFQRRCNTLISLIEKENMEIEERERAEKKKRATKTPMVKFSAFS

SEQ ID NO: 811403 - protein, 1200 aa, Homo sapiens
KIHYDQVGFILGMYDWFHICKLISIIDHISRTKNKDHMIFSIDIEKVFDKIQYSFILKTLKNSVYMEYNNNKGHKFTANFILNGEKLKAFPLKSGKNQECSLSPFLCNIPCSIYLFPVQPLPPPRSPRPLPCPPTRSRSHGMEQDTAAVAATVAAADATATIVVIEDEQPGPSTSQEEGAAAAATEATAATEKGEKKKEKNVSSFQLKLAAKAPKSEKEMDPEYEEKMKADRAKRFEFLLKQTELFAHFIQPSAQKSPTSPLNMKLGRPRIKKDEKQSLISAGDYRHRRTEQEEDEELLSESRKTSNVCIRFEVSPSYVKGGPLRDYQIRGLNWLISLYENGVNGILADEMGLGKTLQTIALLGYLKHYRNIPGPHMVLVPKSTLHNWMNEFKRWVPSLRVICFVGDKDARAAFIRDEMMPGEWDVCVTSYEMVIKEKSVFKKFHWRYLVIDEAHRIKNEKSKLSEIVREFKSTNRLLLTGTPLQNNLHELWALLNFLLPDVFNSADDFDSWFDTKNCLGDQKLVERLHAVLKPFLLRRIKTDVEKSLPPKKEIKIYLGLSKMQREWYTKILMKDIDVLNSSGKMDKMRLLNILMQLRKCCNHPYLFDGAEPGPPYTTDEHIVSNSGKMVVLDKLLAKLKEQGSRVLIFSQMTRLLDILEDYCMWRGYEYCRLDGQTPHEEREDKFLEVEFLGQREAIEAFNAPNSSKFIFMLSTRAGGLGINLASADVVILYDSDWNPQVDLQAMDRAHRIGQKKPVRVFRLITDNTVEERIVERAEIKLRLDSIVIQQGRLIDQQSNKLAKEEMLQMIRHGATHVFASKESELTDEDITTILERGEKKTAEMNERLQKMGESSLRNFRMDIEQSLYKFEGEDYREKQKLGMVEWIEPPKRERKANYAVDAYFREALRVSEPKIPKAPRPPKQPNVQDFQFFPPRLFELLEKEILYYRKTIGYKVPRNPDIPNPALAQREEQKKIDGAEPLTPEETEEKEKLLTQGFTNWTKRDFNQFIKANEKYGRDDIDNIAREVEGKSPEEVMEYSAVFWERCNELQDIEKIMAQIERGEARIQRRISIKKALDAKIARYKAPFHQLRIQYGTSKGKNYTEEEDRFLICMLHKMGFDRENVYEELRQCVRNAPQFRFDWFIKSRTAMEFQRRCNTLISLIEKENMEIEERERAEKKKRATKTPMGGCGARCNRKFH

SEQ ID NO: 811404 - protein, 103 aa, Homo sapiens
MEQDTAAVAATVAAADATATIVVIEDEQPGPSTSQEEGAAAAATEATAATEKGEKKKEKNVSSFQLKLAAKAPKSEKEMDPEYEEKMKADRAKRFEFLLKQSS

SEQ ID NO: 811405 - protein, 701 aa, Homo sapiens
MDESPEPLQQGRGPVPVRRQRPAPRGLREMLKARLWCSCSCSVLCVRALVQDLLPATRWLRQYRPREYLAGDVMSGLVIGIILVPQAIAYSLLAGLQPIYSLYTSFFANLIYFLMGTSRHVSVGIFSLLCLMVGQVVDRELQLAGFDPSQDGLQPGANSSTLNGSAAMLDCGRDCYAIRVATALTLMTGLYQVLMGVLRLGFVSAYLSQPLLDGFAMGASVTILTSQLKHLLGVRIPRHQGPGMVVLTWLSLLRGAGQANVCDVVTSTVCLAVLLAAKELSDRYRHRLRVPLPTELLVIVVATLVSHFGQLHKRFGSSVAGDIPTGFMPPQVPEPRLMQRVALDAVALALVAAAFSISLAEMFARSHGYSVRANQELLAVGCCNVLPAFLHCFATSAALAKSLVKTATGCRTQLSSVVSATVVLLVLLALAPLFHDLQRSVLACVIVVSLRGALRKVWDLPRLWRMSPADALVWAGTAATCMLVSTEAGLLAGVILSLLSLAGRTQRPRTALLARIGDTAFYEDATEFEGLVPEPGVRVFRFGGPLYYANKDFFLQSLYSLTGLDAGCMAARRKEGGSETGVGEGGPAQGEDLGPVSTRAALVPAAAGFHTVVIDCAPLLFLDAAGVSTLQDLRRDYGALGISLLLACCSPPVRDILSRGGFLGEGPGDTAEEEQLFLSVHDAVQTARARHRELEATDAHL

SEQ ID NO: 811406 - protein, 619 aa, Homo sapiens
MDESPEPLQQGRGPVPVRRQRPAPRGLREMLKARLWCSCSCSVLCVRALVQDLLPATRWLRQYRPREYLAGDVMSGLVIGIILVPQAIAYSLLAGLQPIYSLYTSFFANLIYFLMGTSRHVSVGIFSLLCLMVGQVVDRELQLAGFDPSQDGLQPGANSSTLNGSAAMLDCGRDCYAIRVATALTLMTGLYQVLMGVLRLGFVSAYLSQPLLDGFAMGASVTILTSQLKHLLGVRIPRHQGPGMVVLTWLSLLRGAGQANVCDVVTSTVCLAVLLAAKELSDRYRHRLRVPLPTELLVIVVATLVSHFGQLHKRFGSSVAGDIPTGFMPPQVPEPRLMQRVALDAVALALVAAAFSISLAEMFARSHGYSVRANQELLAVGCCNVLPAFLHCFATSAALAKSLVKTATGCRTQLSSVVSATVVLLVLLALAPLFHDLQRSVLACVIVVSLRGALRKVWDLPRLWRMSPADALVWAGTAATCMLVSTEAGLLAGVILSLLSLAGRTQRPRTALLARIGDTAFYEDATEFEGLVPEPGVRVFRFGGPLYYANKDFFLQSKKKKKKKKKKKKKKKGGGPKKKTPGGAHILARLTPGFFVKKGGPPKRKGAIYKHNRTEGARG

SEQ ID NO: 811407 - protein, 224 aa, Homo sapiens
MDESPEPLQQGRGPVPVRRQRPAPRGLREMLKARLWCSCSCSVLCVRALVQDLLPATRWLRQYRPREYLAGDVMSGLVIGIILVPQAIAYSLLAGLQPIYSLYTSFFANLIYFLMGTSRHVSVGIFSLLCLMVGQVVDRELQLAGFDPSQDGLQPGANSSTLNGSAAMLDCGRDCYAIRVATALTLMTGLYQTSWGRNSFQQHPWQLTQRSDSQELLEEEERSC

SEQ ID NO: 811408 - protein, 258 aa, Homo sapiens
MDESPEPLQQGRGPVPVRRQRPAPRGLREMLKARLWCSCSCSVLCVRALVQDLLPATRWLRQYRPREYLAGDVMSGLVIGIILVPQAIAYSLLAGLQPIYSLYTSFFANLIYFLMGTSRHVSVGIFSLLCLMVGQVVDRELQLAGFDPSQDGLQPGANSSTLNGSAAMLDCGRDCYAIRVATALTLMTGLYQAFCPRWSGGWPPHPRRSPALACPPWPPLAPHLHGGQWAPCVGSSRKGLPSDTRGLNSEIKRAAARD

SEQ ID NO: 811409 - protein, 306 aa, Homo sapiens
MAAVDDLQFEEFGNAATSLTANPDATTVNIEDPGETPKHQPGSPRGSGREEDDELLGNDDSDKTELLAGQKKSSPFWTFEYYQTFFDVDTYQVFDRIKGSLLPIPGKNFVRLYIRSNPDLYGPFWICATLVFAIAISGNLSNFLIHLGEKTYHYVPEFRKVSIAATIIYAYAWLVPLALWGFLMWRNSKVMNIVSYSFLEIVCVYGYSLFIYIPTAILWIIPQKAVRWILVMIALGISGSLLAMTFWPAVREDNRRVALATIVTIVLLHMLLSVGCLAYFFDAPEMDHLPTTTATPNQTVAAAKSS

SEQ ID NO: 811410 - protein, 306 aa, Homo sapiens; identical to SEQ ID NO: 811409

SEQ ID NO: 811411 - protein, 306 aa, Homo sapiens; identical to SEQ ID NO: 811409

SEQ ID NO: 811412 - protein, 306 aa, Homo sapiens; identical to SEQ ID NO: 811409

SEQ ID NO: 811413 - protein, 306 aa, Homo sapiens; identical to SEQ ID NO: 811409

SEQ ID NO: 811414 - protein, 306 aa, Homo sapiens; identical to SEQ ID NO: 811409

SEQ ID NO: 811415 - protein, 338 aa, Homo sapiens
PEEAERFRPPDLRLPATGLDRNRRGATEARAFSGPGGRLTPREFGNAATSLTANPDATTVNIEDPGETPKHQPGSPRGSGREEDDELLGNDDSDKTELLAGQKKSSPFWTFEYYQTFFDVDTYQVFDRIKGSLLPIPGKNFVRLYIRSNPDLYGPFWICATLVFAIAISGNLSNFLIHLGEKTYHYVPEFRKVSIAATIIYAYAWLVPLALWGFLMWRNSKVMNIVSYSFLEIVCVYGYSLFIYIPTAILWIIPQKAVRWILVMIALGISGSLLAMTFWPAVREDNRRVALATIVTIVLLHMLLSVGCLAYFFDAPEMDHLPTTTATPNQTVAAAKSS

SEQ ID NO: 811416 - protein, 247 aa, Homo sapiens
MTCNLKLLAGQKKSSPFWTFEYYQTFFDVDTYQVFDRIKGSLLPIPGKNFVRLYIRSNPDLYGPFWICATLVFAIAISGNLSNFLIHLGEKTYHYVPEFRKVSIAATIIYAYAWLVPLALWGFLMWRNSKVMNIVSYSFLEIVCVYGYSLFIYIPTAILWIIPQKAVRWILVMIALGISGSLLAMTFWPAVREDNRRVALATIVTIVLLHMLLSVGCLAYFFDAPEMDHLPTTTATPNQTVAAAKSS

SEQ ID NO: 811417 - protein, 336 aa, Homo sapiens
MAAVDDLQFEEFGNAATSLTANPDATTVNIEDPGETPKHQPGSPRGSGREEDDELLGNDDSDKTEVTVSGNDSSEVNDTWPLPWWGKQANRPLLSLLAGQKKSSPFWTFEYYQTFFDVDTYQVFDRIKGSLLPIPGKNFVRLYIRSNPDLYGPFWICATLVFAIAISGNLSNFLIHLGEKTYHYVPEFRKVSIAATIIYAYAWLVPLALWGFLMWRNSKVMNIVSYSFLEIVCVYGYSLFIYIPTAILWIIPQKAVRWILVMIALGISGSLLAMTFWPAVREDNRRVALATIVTIVLLHMLLSVGCLAYFFDAPEMDHLPTTTATPNQTVAAAKSS

SEQ ID NO: 811418 - protein, 80 aa, Homo sapiens
PEEAERFRPPDLRLPATGLDRNRRGATEARAFSGPGGRLTPRDEETEAARSAHTAEKQQNRESNPALSDPRACAFNHWLG

SEQ ID NO: 811419 - protein, 306 aa, Homo sapiens; identical to SEQ ID NO: 811409

SEQ ID NO: 811420 - protein, 336 aa, Homo sapiens; identical to SEQ ID NO: 811417

SEQ ID NO: 811421 - protein, 247 aa, Homo sapiens; identical to SEQ ID NO: 811416

SEQ ID NO: 811422 - protein, 269 aa, Homo sapiens
MPPQLQNGLNLSAKVVQGSLDSLPQAVREFLENNAELCQPDHIHICDGSEEENGRLLGQMEEEGILRRLKKYDNCWLALTDPRDVARIESKTVIVTQEQRDTVPIPKTGLSQLGRWMSEEDFEKAFNARFPGCMKGRTMYVIPFSMGPLGSPLSKIGIELTDSPYVVASMRIMTRMGTPVLEALGDGEFVKCLHSVGCPLPLQKPLVNNWPCNPELTLIAHLPDRREIISFGSGYGGNSLLGKKCFALRMASRLAKEEGWLAEHMLIWV

SEQ ID NO: 811423 - protein, 739 aa, Homo sapiens
MPPQLQNGLNLSAKVVQGSLDSLPQAVREFLENNAELCQPDHIHICDGSEEENGRLLGQMEEEGILRRLKKYDNCWLALTDPRDVARIESKTVIVTQEQRDTVPIPKTGLSQLGRWMSEEDFEKAFNARFPGCMKGRTMYVIPFSMGPLGSPLSKIGIELTDSPYVVASMRIMTRMGTPVLEALGDGEFVKCLHSVGCPLPLQKPLVNNWPCNPELTLIAHLPDRREIISFGSGYGGNSLLGKKCFALRMASRLAKEEGWLAEHMLVSLQEALMLQMRGLGGGRNKQHYSSHPSAHLSERAGSRTDRETPPVMISLHIYIAFEGPQTPGDHRDPLDFMILGVFVCTDDLKKYILRAYIPTSGLKYQPRGEGNKDHNKESCPQQILGITNPEGEKKYLAAAFPSACGKTNLAMMNPSLPGWKVECVGDDIAWMKFDAQGHLRAINPENGFFGVAPGTSVKTNPNAIKTIQKNTIFTNVAETSDGGVYWEGIDEPLASGVTITSWKNKEWSSEDGEPCAHPNSRFCTPASQCPIIDAAWESPEGVPIEGIIFGGRRPAGVPLVYEALSWQHGVFVGAAMRSEATAAAEHKGKIIMHDPFAMRPFFGYNFGKYLAHWLSMAQHPAAKLPKIFHVNWFRKDKEGKFLWPGFGENSRVLEWMFNRIDGKASTKLTPIGYIPKEDALNLKGLGHINMMELFSISKEFWEKEVEDIEKYLEDQVNADLPCEIEREILALKQRISQM

SEQ ID NO: 811424 - protein, 484 aa, Homo sapiens
MYVIPFSMGPLGSPLSKIGIELTDSPYVVASMRIMTRMGTPVLEALGDGEFVKCLHSVGCPLPLQKPLVNNWPCNPELTLIAHLPDRREIISFGSGYGGNSLLGKKCFALRMASRLAKEEGWLAEHMLILGITNPEGEKKYLAAAFPSACGKTNLAMMNPSLPGWKVECVGDDIAWMKFDAQGHLRAINPENGFFGVAPGTSVKTNPNAIKTIQKNTIFTNVAETSDGGVYWEGIDEPLASGVTITSWKNKEWSSEDGEPCAHPNSRFCTPASQCPIIDAAWESPEGVPIEGIIFGGRRPAGVPLVYEALSWQHGVFVGAAMRSEATAAAEHKGKIIMHDPFAMRPFFGYNFGKYLAHWLSMAQHPAAKLPKIFHVNWFRKDKEGKFLWPGFGENSRVLEWMFNRIDGKASTKLTPIGYIPKEDALNLKGLGHINMMELFSISKEFWEKEVEDIEKYLEDQVNADLPCEIEREILALKQRISQM

SEQ ID NO: 811425 - protein, 665 aa, Homo sapiens
MPPQLQNGLNLSAKVVQGSLDSLPQAVREFLENNAELCQPDHIHICDGSEEENGRLLGQMEEEGILRRLKKYDNCWLALTDPRDVARIESKTVIVTQEQRDTVPIPKTGLSQLGRWMSEEDFEKAFNARFPGCMKGRTMYVIPFSMGPLGSPLSKIGIELTDSPYVVASMRIMTRMGTPVLEALGDGEFVKCLHSVGCPLPLQSKCIISESKVKIKKKAERKPQLSASGTPKQGPGALTWERSLFTEPLVNNWPCNPELTLIAHLPDRREIISFGSGYGGNSLLGKKCFALRMASRLAKEEGWLAEHMLILGITNPEGEKKYLAAAFPSACGKTNLAMMNPSLPGWKVECVGDDIAWMKFDAQGHLRAINPENGFFGVAPGTSVKTNPNAIKTIQKNTIFTNVAETSDGGVYWEGIDEPLASGVTITSWKNKEWSSEDGEPCAHPNSRFCTPASQCPIIDAAWESPEGVPIEGIIFGGRRPAGVPLVYEALSWQHGVFVGAAMRSEATAAAEHKGKIIMHDPFAMRPFFGYNFGKYLAHWLSMAQHPAAKLPKIFHVNWFRKDKEGKFLWPGFGENSRVLEWMFNRIDGKASTKLTPIGYIPKEDALNLKGLGHINMMELFSISKEFWEKEVEDIEKYLEDQVNADLPCEIEREILALKQRISQM

SEQ ID NO: 811426 - protein, 739 aa, Homo sapiens; identical to SEQ ID NO: 811423

SEQ ID NO: 811427 - protein, 103 aa, Homo sapiens
MPPQLQNGLNLSAKVVQGSLDSLPQAVREFLENNAELCQPDHIHICDGSEEENGRLLGQMEEEGILRRLKKYDNWYSSAPAACPSTLQAGLPCVSWELVEKGE

SEQ ID NO: 811428 - protein, 622 aa, Homo sapiens [sequence omitted]

SEQ ID NO: 811429 - protein, 276 aa, Homo sapiens
MPPQLQNGLNLSAKVVQGSLDSLPQAVREFLENNAELCQPDHIHICDGSEEENGRLLGQMEEEGILRRLKKYDNCWLALTDPRDVARIESKTVIVTQEQRDTVPIPKTGLSQLGRWMSEEDFEKAFNARFPGCMKGRTMYVIPFSMGPLGSPLSKIGIELTDSPYVVASMRIMTRMGTPVLEALGDGEFVKCLHSVGCPLPLQKPLVNNWPCNPELTLIAHLPDRREIISFGSGYGGNSLLGKKCFALRMASRLAKEEGWLAEHMLVSLQEALMCR

SEQ ID NO: 811430 - protein, 365 aa, Homo sapiens
MTTAGWLSLTPGMWPGSKARRLSSPKSKETQCPSPKQASASSVAGWKVECVGDDIAWMKFDAQGHLRAINPENGFFGVAPGTSVKTNPNAIKTIQKNTIFTNVAETSDGGVYWEGIDEPLASGVTITSWKNKEWSSEDGEPCAHPNSRFCTPASQCPIIDAAWESPEGVPIEGIIFGGRRPAGVPLVYEALSWQHGVFVGAAMRSEATAAAEHKGKIIMHDPFAMRPFFGYNFGKYLAHWLSMAQHPAAKLPKIFHVNWFRKDKEGKFLWPGFGENSRVLEWMFNRIDGKASTKLTPIGYIPKEDALNLKGLGHINMMELFSISKEFWEKEVEDIEKYLEDQVNADLPCEIEREILALKQRISQM

SEQ ID NO: 811431 - protein, 276 aa, Homo sapiens; identical to SEQ ID NO: 811429

SEQ ID NO: 811432 - protein, 305 aa, Homo sapiens
MAAEAADLGLGAAVPVELRRERRMVCVEYPGVVRDVAKMLPTLGGEEGVSRIYADPTKRLELYFRPKDPYCHPVCANRFSTSSLLLRIRKRTRRQKGVLGTEAHSEVTFDMEILGIISTIYKFQGMSDFQYLAVHTEAGGKHTSMYDKVLMLRPEKEAFFHQELPLYIPPPIFSRLDAPVDYFYRPETQHREGYNNPPISGENLIGLSRARRPHNAIFVNFEDEEVPKQPLEAAAQTWRRVCTNPVDRKVEEELRKLFDIRPIWSRNAVKANISVHPDKLKVLLPFIAYYMITGPWRSLWDSIWV

SEQ ID NO: 811433 - protein, 305 aa, Homo sapiens; identical to SEQ ID NO: 811432

SEQ ID NO: 811434 - protein, 305 aa, Homo sapiens; identical to SEQ ID NO: 811432

SEQ ID NO: 811435 - protein, 305 aa, Homo sapiens; identical to SEQ ID NO: 811432

SEQ ID NO: 811436 - protein, 193 aa, Homo sapiens [sequence omitted]

SEQ ID NO: 811437 - protein, 193 aa, Homo sapiens [sequence omitted]

SEQ ID NO: 811438 - protein, 305 aa, Homo sapiens; identical to SEQ ID NO: 811432

SEQ ID NO: 811439 - protein, 263 aa, Homo sapiens
MAAEAADLGLGAAVPVELRRERRMVCVEYPGVVRDVAKMLPTLGGEEGVSRIYADPTKRLELYFRPKDPYCHPVCANRFSTSSLLLRIRKRTRRQKGVLGTEAHSEVTFDMEILGIISTIYKFQGMSDFQYLAVHTEAGGKHTSMYDKVLMLRPEKEAFFHQELPLYIPPPIFSRLDAPVDYFYRPETQHREGYNNPPISGENLIGLSRARRPHNAIFVNFEDEEVPNNRPLAQPMGFDLGMTPEKTQMPRFIKSSISESVVE

SEQ ID NO: 811440 - protein, 258 aa, Homo sapiens
MTRAIYADPTKRLELYFRPKDPYCHPVCANRFSTSSLLLRIRKRTRRQKGVLGTEAHSEVTFDMEILGIISTIYKFQGMSDFQYLAVHTEAGGKHTSMYDKVLMLRPEKEAFFHQELPLYIPPPIFSRLDAPVDYFYRPETQHREGYNNPPISGENLIGLSRARRPHNAIFVNFEDEEVPKQPLEAAAQTWRRVCTNPVDRKVEEELRKLFDIRPIWSRNAVKANISVHPDKLKVLLPFIAYYMITGPWRSLWDSIWV

SEQ ID NO: 811441 - protein, 118 aa, Homo sapiens
PRMKHEPPGLSWITVRLLLREEQLPTGCLACHCFTLSPLALPQIYADPTKRLELYFRPKDPYCHPVCANRFSTSSLLLRIRKRTRRQKGVLGTEAHSEVTFDMEILGIISTIYKFQGN

SEQ ID NO: 811442 - protein, 1400 aa, Homo sapiens
ARPGWPSAHPLSPRLFPRKAEPHSFREKVFRKKPPVCAVCKVTIDGTGVSCRVCKVATHRKCEAKVTSACQALPPVELRRNTAPVRRIEHLGSTKSLNHSKQRSTLPRSFSLDPLMERRWDLDLTYVTERILAAAFPARPDEQRHRGHLRELAHVLQSKHRDKYLLFNLSEKRHDLTRLNPKVQDFGWPELHAPPLDKLCSICKAMETWLSADPQHVVVLYCKGNKGKLGVIVSAYMHYSKISAGADQALATLTMRKFCEDKVATELQPSQRRYISYFSGLLSGSIRMNSSPLFLHYVLIPMLPAFEPGTGFQPFLKIYQSMQLVYTSGVYHIAGPGPQQLCISLEPALLLKGDVMVTCYHKGGRGTDRTLVFRVQFHTCTIHGPQLTFPKDQLDEAWTDERFPFQASVEFVFSSSPEKIKGSTPRNDPSVSVDYNTTEPAVRWDSYENFNQHHEDSVDGSLTHTRGPLDGSPYAQVQRPPRQTPPAPSPEPPPPPMLSVSSDSGHSSTLTTEPAAESPGRPPPTAAERQELDRLLGGCGVASGGRGAGRETAILDDEEQPTVGGGPHLGVYPGHRPGLSRHCSCRQGYREPCGVPNGGYYRPEGTLERRRLAYGGYEGSPQGYAEASMEKRRLCRSLSEGLYPYPPEMGKPATGDFGYRAPGYREVVILEDPGLPALYPCPACEEKLALPTAALYGLRLEREAGEGWASEAGKPLLHPVRPGHPLPLLLPACGHHHAPMPDYSCLKPPKAGEEGHEGCSYTMCPEGRYGHPGYPALVTYSYGGAVPSYCPAYGRVPHSCGSPGEGRGYPSPGAHSPRAGSISPGSPPYPQSRKLSYEIPTEEGGDRYPLPGHLASAGPLASAESLEPVSWREGPSGHSTLPRSPRDAPCSASSELSGPSTPLHTSSPVQGKESTRRQDTRSPTSAPTQRLSPGEALPPVSQAGTGKAPELPSGSGPEPLAPSPVSPTFPPSSPSDWPQERSPGGHSDGASPRSPVPTTLPGLRHAPWQGPRGPPDSPDGSPLTPVPSQMPWLVASPEPPQSSPTPAFPLAASYDTNGLSQPPLPEKRHLPGPGQQPGPWGPEQASSPARGISHHVTFAPLLSDNVPQTPEPPTQESQSNVKFVQDTSKFWYKPHLSRDQAIALLKDKDPGAFLIRDSHSFQGAYGLALKVATPPPSAQPWKGDPVEQLVRHFLIETGPKGVKIKGCPSEPYFGSLSALVSQHSISPISLPCCLRIPSKDPLEETPEAPVPTNMSTAADLLRQGAACSVLYLTSVETESLTGPQAVARASSAALSCSPRPTPAVVHFKVSAQGITLTDNQRKLFFRRHYPVNSITFSSTDPQDRRWTNPDGTTSKIFGFVAKKPGSPWENVCHLFAELDPDQPAGAIVTFITKVLLGQRK

SEQ ID NO: 811443 - protein, 1396 aa, Homo sapiens
LRKESRPRRAMKPRKAEPHSFREKVFRKKPPVCAVCKVTIDGTGVSCRVCKVATHRKCEAKVTSACQALPPVELRRNTAPVRRIEHLGSTKSLNHSKQRSTLPRSFSLDPLMERRWDLDLTYVTERILAAAFPARPDEQRHRGHLRELAHVLQSKHRDKYLLFNLSEKRHDLTRLNPKVQDFGWPELHAPPLDKLCSICKAMETWLSADPQHVVVLYCKGNKGKLGVIVSAYMHYSKISAGADQALATLTMRKFCEDKVATELQPSQRRYISYFSGLLSGSIRMNSSPLFLHYVLIPMLPAFEPGTGFQPFLKIYQSMQLVYTSGVYHIAGPGPQQLCISLEPALLLKGDVMVTCYHKGGRGTDRTLVFRVQFHTCTIHGPQLTFPKDQLDEAWTDERFPFQASVEFVFSSSPEKIKGSTPRNDPSVSVDYNTTEPAVRWDSYENFNQHHEDSVDGSLTHTRGPLDGSPYAQVQRPPRQTPPAPSPEPPPPPMLSVSSDSGHSSTLTTEPAAESPGRPPPTAAERQELDRLLGGCGVASGGRGAGRETAILDDEEQPTVGGGPHLGVYPGHRPGLSRHCSCRQGYREPCGVPNGGYYRPEGTLERRRLAYGGYEGSPQGYAEASMEKRRLCRSLSEGLYPYPPEMGKPATGDFGYRAPGYREVVILEDPGLPALYPCPACEEKLALPTAALYGLRLEREAGEGWASEAGKPLLHPVRPGHPLPLLLPACGHHHAPMPDYSCLKPPKAGEEGHEGCSYTMCPEGRYGHPGYPALVTYSYGGAVPSYCPAYGRVPHSCGSPGEGRGYPSPGAHSPRAGSISPGSPPYPQSRKLSYEIPTEEGGDRYPLPGHLASAGPLASAESLEPVSWREGPSGHSTLPRSPRDAPCSASSELSGPSTPLHTSSPVQGKESTRRQDTRSPTSAPTQRLSPGEALPPVSQAGTGKAPELPSGSGPEPLAPSPVSPTFPPSSPSDWPQERSPGGHSDGASPRSPVPTTLPGLRHAPWQGPRGPPDSPDGSPLTPVPSQMPWLVASPEPPQSSPTPAFPLAASYDTNGLSQPPLPEKRHLPGPGQQPGPWGPEQASSPARGISHHVTFAPLLSDNVPQTPEPPTQESQSNVKFVQDTSKFWYKPHLSRDQAIALLKDKDPGAFLIRDSHSFQGAYGLALKVATPPPSAQPWKGDPVEQLVRHFLIETGPKGVKIKGCPSEPYFGSLSALVSQHSISPISLPCCLRIPSKDPLEETPEAPVPTNMSTAADLLRQGAACSVLYLTSVETESLTGPQAVARASSAALSCSPRPTPAVVHFKVSAQGITLTDNQRKLFFRRHYPVNSITFSSTDPQDRRWTNPDGTTSKIFGFVAKKPGSPWENVCHLFAELDPDQPAGAIVTFITKVLLGQRK

SEQ ID NO: 811444 - protein, 1416 aa, Homo sapiens
HPSQPNTMKSSGPVERLLRALGRRDSSRAASRPRKAEPHSFREKVFRKKPPVCAVCKVTIDGTGVSCRVCKVATHRKCEAKVTSACQALPPVELRRNTAPVRRIEHLGSTKSLNHSKQRSTLPRSFSLDPLMERRWDLDLTYVTERILAAAFPARPDEQRHRGHLRELAHVLQSKHRDKYLLFNLSEKRHDLTRLNPKVQDFGWPELHAPPLDKLCSICKAMETWLSADPQHVVVLYCKGNKGKLGVIVSAYMHYSKISAGADQALATLTMRKFCEDKVATELQPSQRRYISYFSGLLSGSIRMNSSPLFLHYVLIPMLPAFEPGTGFQPFLKIYQSMQLVYTSGVYHIAGPGPQQLCISLEPALLLKGDVMVTCYHKGGRGTDRTLVFRVQFHTCTIHGPQLTFPKDQLDEAWTDERFPFQASVEFVFSSSPEKIKGSTPRNDPSVSVDYNTTEPAVRWDSYENFNQHHEDSVDGSLTHTRGPLDGSPYAQVQRPPRQTPPAPSPEPPPPPMLSVSSDSGHSSTLTTEPAAESPGRPPPTAAERQELDRLLGGCGVASGGRGAGRETAILDDEEQPTVGGGPHLGVYPGHRPGLSRHCSCRQGYREPCGVPNGGYYRPEGTLERRRLAYGGYEGSPQGYAEASMEKRRLCRSLSEGLYPYPPEMGKPATGDFGYRAPGYREVVILEDPGLPALYPCPACEEKLALPTAALYGLRLEREAGEGWASEAGKPLLHPVRPGHPLPLLLPACGHHHAPMPDYSCLKPPKAGEEGHEGCSYTMCPEGRYGHPGYPALVTYSYGGAVPSYCPAYGRVPHSCGSPGEGRGYPSPGAHSPRAGSISPGSPPYPQSRKLSYEIPTEEGGDRYPLPGHLASAGPLASAESLEPVSWREGPSGHSTLPRSPRDAPCSASSELSGPSTPLHTSSPVQGKESTRRQDTRSPTSAPTQRLSPGEALPPVSQAGTGKAPELPSGSGPEPLAPSPVSPTFPPSSPSDWPQERSPGGHSDGASPRSPVPTTLPGLRHAPWQGPRGPPDSPDGSPLTPVPSQMPWLVASPEPPQSSPTPAFPLAASYDTNGLSQPPLPEKRHLPGPGQQPGPWGPEQASSPARGISHHVTFAPLLSDNVPQTPEPPTQESQSNVKFVQDTSKFWYKPHLSRDQAIALLKDKDPGAFLIRDSHSFQGAYGLALKVATPPPSAQPWKGDPVEQLVRHFLIETGPKGVKIKGCPSEPYFGSLSALVSQHSISPISLPCCLRIPSKDPLEETPEAPVPTNMSTAADLLRQGAACSVLYLTSVETESLTGPQAVARASSAALSCSPRPTPAVVHFKVSAQGITLTDNQRKLFFRRHYPVNSITFSSTDPQDRRWTNPDGTTSKIFGFVAKKPGSPWENVCHLFAELDPDQPAGAIVTFITKVLLGQRK

SEQ ID NO: 811445 - protein, 1366 aa, Homo sapiens
LRKESRPRRAMKPRKAEPHSFREKVFRKKPPVCAVCKVTIDGTGVSCRVCKVATHRKCEAKVTSACQALPPVELRRNTAPVRRIEHLGSTKSLNHSKQRSTLPRSFSLDPLMERRWDLDLTYVTERILAAAFPARPDEQRHRGHLRELAHVLQSKHRDKYLLFNLSEKRHDLTRLNPKVQDFGWPELHAPPLDKLCSICKAMETWLSADPQHVVVLYCKGNKGKLGVIVSAYMHYSKISAGADQALATLTMRKFCEDKVATELQPSQRRYISYFSGLLSGSIRMNSSPLFLHYVLIPMLPAFEPGTGFQPFLKIYQSMQLVYTSGVYHIAGPGPQQLCISLEPALLLKGDVMVTCYHKGGRGTDRTLVFRVQFHTCTIHGPQLTFPKDQLDEAWTDERFPFQASVEFVFSSSPEKIKGSTPRNDPSVSVDYNTTEPAVRWDSYENFNQHHEDSVDGSLTHTRGPLDGSPYAQVQRPPRQTPPAPSPEPPPPPMLSVSSDSGHSSTLTTEPAAESPGRPPPTAAERQELDRLLGGCGVASGGRGAGRETAILDDEEQPTVGGGPHLGVYPGHRPGLSRHCSCRQGYREPCGVPNGGYYRPEGTLERRRLAYGGYEGSPQGYAEASMEKRRLCRSLSEGLYPYPPEMGKPATGDFGYRAPGYREVVILEDPGLPALYPCPACEEKLALPTAALYGLRLEREAGEGWASEAGKPLLHPVRPGHPLPLLLPACGHHHAPMPDYSCLKPPKAGEEGHEGCSYTMCPEGRYGHPGYPALVTYSYGGAVPSYCPAYGRVPHSCGSPGEGRGYPSPGAHSPRAGSISPGSPPYPQSRKLSYEIPTEEGGDRYPLPGHLASAGPLASAESLEPVSWREGPSGHSTLPRSPRDAPCSASSELSGPSTPLHTSSPVQGKESTRRQDTRSPTSAPTQRLSPGEACPLFPSSPSDWPQERSPGGHSDGASPRSPVPTTLPGLRHAPWQGPRGPPDSPDGSPLTPVPSQMPWLVASPEPPQSSPTPAFPLAASYDTNGLSQPPLPEKRHLPGPGQQPGPWGPEQASSPARGISHHVTFAPLLSDNVPQTPEPPTQESQSNVKFVQDTSKFWYKPHLSRDQAIALLKDKDPGAFLIRDSHSFQGAYGLALKVATPPPSAQPWKGDPVEQLVRHFLIETGPKGVKIKGCPSEPYFGSLSALVSQHSISPISLPCCLRIPSKDPLEETPEAPVPTNMSTAADLLRQGAACSVLYLTSVETESLTGPQAVARASSAALSCSPRPTPAVVHFKVSAQGITLTDNQRKLFFRRHYPVNSITFSSTDPQDRRWTNPDGTTSKIFGFVAKKPGSPWENVCHLFAELDPDQPAGAIVTFITKVLLGQRK

SEQ ID NO: 811446 - protein, 1435 aa, Homo sapiens
LRKESRPRRAMKPRKAEPHSFREKVFRKKPPVCAVCKVTIDGTGVSCRVCKVATHRKCEAKVTSACQALPPVELRRNTAPVRRIEHLGSTKSLNHSKQRSTLPRSFSLDPLMERRWDLDLTYVTERILAAAFPARPDEQRHRGHLRELAHVLQSKHRDKYLLFNLSEKRHDLTRLNPKVQDFGWPELHAPPLDKLCSICKAMETWLSADPQHVVVLYCKGNKGKLGVIVSAYMHYSKISAGADQALATLTMRKFCEDKVATELQPSQRRYISYFSGLLSGSIRMNSSPLFLHYVLIPMLPAFEPGTGFQPFLKIYQSMQLVYTSGVYHIAGPGPQQLCISLEPALLLKGDVMVTCYHKGGRGTDRTLVFRVQFHTCTIHGPQLTFPKDQLDEAWTDERFPFQASVEFVFSSSPEKIKGSTPRNDPSVSVDYNTTEPAVRWDSYENFNQHHEDSVDGSLTHTRGPLDGSPYAQVQRPPRQTPPAPSPEPPPPPMLSVSSDSGHSSTLTTEPAAESPGRPPPTAAERQELDRLLGGCGVASGGRGAGRETAILDDEEQPTVGGGPHLGVYPGHRPGLSRHCSCRQGYREPCGVPNGGYYRPEGTLERRRLAYGGYEGSPQGYAEASMEKRRLCRSLSEGLYPYPPEMGKPATGDFGYRAPGYREVVILEDPGLPALYPCPACEEKLALPTAALYGLRLEREAGEGWASEAGKPLLHPVRPGHPLPLLLPACGHHHAPMPDYSCLKPPKAGEEGHEGCSYTMCPEGRYGHPGYPALVTYSYGGAVPSYCPAYGRVPHSCGSPGEGRGYPSPGAHSPRAGSISPGSPPYPQSRKLSYEIPTEEGGDRYPLPGHLASAGPLASAESLEPVSWREGPSGHSTLPRSPRDAPCSASSELSGPSTPLHTSSPVQGKESTRRQDTRSPTSAPTQRLSPGEALPPVSQAGTGKAPELPSGSGPEPLAPSPVSPTFPPSSPSDWPQERSPGGHSDGASPRSPVPTTLPGLRHAPWQGPRGPPDSPDGSPLTPVPSQMPWLVASPEPPQSSPTPAFPLAASYDTNGLSQPPLPEKRHLPGPGQQPGPWGPEQASSPARGISHHVTFAPLLSDNVPQTPGIKALEGVGATLREPFLLGCSMDGDPGTLGSEPTPSLSSEPPTQESQSNVKFVQDTSKFWYKPHLSRDQAIALLKDKDPGAFLIRDSHSFQGAYGLALKVATPPPSAQPWKGDPVEQLVRHFLIETGPKGVKIKGCPSEPYFGSLSALVSQHSISPISLPCCLRIPSKDPLEETPEAPVPTNMSTAADLLRQGAACSVLYLTSVETESLTGPQAVARASSAALSCSPRPTPAVVHFKVSAQGITLTDNQRKLFFRRHYPVNSITFSSTDPQDRRWTNPDGTTSKIFGFVAKKPGSPWENVCHLFAELDPDQPAGAIVTFITKVLLGQRK

SEQ ID NO: 811447 - protein, 1396 aa, Homo sapiens; identical to SEQ ID NO: 811443

SEQ ID NO: 811448 - protein, 267 aa, Homo sapiens
IEIGTNSAIALLKDKDPGAFLIRDSHSFQGAYGLALKVATPPPSAQPWKGDPVEQLVRHFLIETGPKGVKIKGCPSEPYFGSLSALVSQHSISPISLPCCLRIPSKDPLEETPEAPVPTNMSTAADLLRQGAACSVLYLTSVETESLTGPQAVARASSAALSCSPRPTPAVVHFKVSAQGITLTDNQRKLFFRRHYPVNSITFSSTDPQDRRWTNPDGTTSKIFGFVAKKPGSPWENVCHLFAELDPDQPAGAIVTFITKVLLGQRK

SEQ ID NO: 811449 - protein, 1396 aa, Homo sapiens; identical to SEQ ID NO: 811443

SEQ ID NO: 811450 - protein, 175 aa, Homo sapiens
DASAHASGLRIPSKDPLEETPEAPVPTNMSTAADLLRQGAACSVLYLTSVETESLTGPQAVARASSAALSCSPRPTPAVVHFKVSAQGITLTDNQRKLFFRRHYPVNSITFSSTDPQDRRWTNPDGTTSKIFGFVAKKPGSPWENVCHLFAELDPDQPAGAIVTFITKVLLGQRK

SEQ ID NO: 811451 - protein, 1396 aa, Homo sapiens; identical to SEQ ID NO: 811443

SEQ ID NO: 811452 - protein, 143 aa, Homo sapiens
EEGELLVEWCAFDARGGRARLCVDEWFGFIVCWFVVLFLFFRCVCVLFFFVFFFFFLFIVVVFFFFFYGNSIFIGCINISGLYIHFIHRRVGSEGQREAQQHNSSPAFPTALPALCKPRPTAPAASSSLEKSLLRGGGQGLKD

SEQ ID NO: 811453 - protein, 108 aa, Homo sapiens
MESAFLTSHLCDCKACDSSSWGMCKSWWGWLGDGHSLPDPLPAPVACSVLYLTSVETESLTGPQAVARASSAALSCSPRPTPAVVHFKVSAQGITLTDNQRKYVYSAL

SEQ ID NO: 811454 - protein, 1331 aa, Homo sapiens
LRKESRPRRAMKPRKAEPHSFREKVFRKKPPVCAVCKVTIDGTGVSCRVCKVATHRKCEAKVTSACQALPPVELRRNTAPVRRIEHLGSTKSLNHSKQRSTLPRSFSLDPLMERRWDLDLTYVTERILAAAFPARPDEQRHRGHLRELAHVLQSKHRDKYLLFNLSEKRHDLTRLNPKVQDFGWPELHAPPLDKLCSICKAMETWLSADPQHVVVLYCKGNKGKLGVIVSAYMHYSKISAGADQALATLTMRKFCEDKVATELQPSQRRYISYFSGLLSGSIRMNSSPLFLHYVLIPMLPAFEPGTGFQPFLKIYQSMQLVYTSGVYHIAGPGPQQLCISLEPALLLKGDVMVTCYHKGGRGTDRTLVFRVQFHTCTIHGPQLTFPKDQLDEAWTDERFPFQASVEFVFSSSPEKIKGSTPRNDPSVSVDYNTTEPAVRWDSYENFNQHHEDSVDGSLTHTRGPLDGSPYAQVQRPPRQTPPAPSPEPPPPPMLSVSSDSGHSSTLTTEPAAESPGRPPPTAAERQELDRLLGGCGVASGGRGAGRETAILDDEEQPTVGGGPHLGVYPGHRPGLSRHCSCRQGYREPCGVPNGGYYRPEGTLERRRLAYGGYEGSPQGYAEASMEKRRLCRSLSEGLYPYPPEMGKPATGDFGYRAPGYREVVILEDPGLPALYPCPACEEKLALPTAALYGLRLEREAGEGWASEAGKPLLHPVRPGHPLPLLLPACGHHHAPMPDYSCLKPPKAGEEGHEGCSYTMCPEGRKLSYEIPTEEGGDRYPLPGHLASAGPLASAESLEPVSWREGPSGHSTLPRSPRDAPCSASSELSGPSTPLHTSSPVQGKESTRRQDTRSPTSAPTQRLSPGEALPPVSQAGTGKAPELPSGSGPEPLAPSPVSPTFPPSSPSDWPQERSPGGHSDGASPRSPVPTTLPGLRHAPWQGPRGPPDSPDGSPLTPVPSQMPWLVASPEPPQSSPTPAFPLAASYDTNGLSQPPLPEKRHLPGPGQQPGPWGPEQASSPARGISHHVTFAPLLSDNVPQTPEPPTQESQSNVKFVQDTSKFWYKPHLSRDQAIALLKDKDPGAFLIRDSHSFQGAYGLALKVATPPPSAQPWKGDPVEQLVRHFLIETGPKGVKIKGCPSEPYFGSLSALVSQHSISPISLPCCLRIPSKDPLEETPEAPVPTNMSTAADLLRQGAACSVLYLTSVETESLTGPQAVARASSAALSCSPRPTPAVVHFKVSAQGITLTDNQRKLFFRRHYPVNSITFSSTDPQDRRWTNPDGTTSKIFGFVAKKPGSPWENVCHLFAELDPDQPAGAIVTFITKVLLGQRK

SEQ ID NO: 811455 - protein, 1396 aa, Homo sapiens; identical to SEQ ID NO: 811443

SEQ ID NO: 811456 - protein, 292 aa, Homo sapiens
MELGSRGGGLHGAQSTPVKTPPHCPLPLTLQPSIALLKDKDPGAFLIRDSHSFQGAYGLALKVATPPPSAQPWKGDPVEQLVRHFLIETGPKGVKIKGCPSEPYFGSLSALVSQHSISPISLPCCLRIPSKDPLEETPEAPVPTNMSTAADLLRQGAACSVLYLTSVETESLTGPQAVARASSAALSCSPRPTPAVVHFKVSAQGITLTDNQRKLFFRRHYPVNSITFSSTDPQDRRWTNPDGTTSKIFGFVAKKPGSPWENVCHLFAELDPDQPAGAIVTFITKVLLGQRK

SEQ ID NO: 811457 - protein, 226 aa, Homo sapiens
AGEPHTVGDEELGPQPRFSKSHEQDDHGVVAGRLLCLASDCRSSRVMESAFLTSHLCDCKACDSSSWGMCKSWWGWLGDGHSLPDPLPAPVACSVLYLTSVETESLTGPQAVARASSAALSCSPRPTPAVVHFKVSAQGITLTDNQRKLFFRRHYPVNSITFSSTDPQDRRWTNPDGTTSKIFGFVAKKPGSPWENVCHLFAELDPDQPAGAIVTFITKVLLGQRK

SEQ ID NO: 811458 - protein, 119 aa, Homo sapiens
GSDLGRERRKGDQTGEGLLLIHSSKPPHEFSLFLPRDQGAAVLSMLAFDLSHQGQLHSLVEGMLSPFPTLYPPRIFGFVAKKPGSPWENVCHLFAELDPDQPAGAIVTFITKVLLGQRK

SEQ ID NO: 811459 - protein, 1396 aa, Homo sapiens; identical to SEQ ID NO: 811443

SEQ ID NO: 811460 - protein, 440 aa, Homo sapiens
LRKESRPRRAMKPRKAEPHSFREKVFRKKPPVCAVCKVTIDGTGVSCRVCKVATHRKCEAKVTSACQALPPVELRRNTAPVRRIEHLGSTKSLNHSKQRSTLPRSFSLDPLMERRWDLDLTYVTERILAAAFPARPDEQRHRGHLRELAHVLQSKHRDKYLLFNLSEKRHDLTRLNPKVQDFGWPELHAPPLDKLCSICKAMETWLSADPQHVVVLYCKGNKGKLGVIVSAYMHYSKISAGADQALATLTMRKFCEDKVATELQPSQRRYISYFSGLLSGSIRMNSSPLFLHYVLIPMLPAFEPGTGFQPFLKIYQSMQLVYTSGVYHIAGPGPQQLCISLEPALLLKGDVMVTCYHKGGRGTDRTLVFRVQFHTCTIHGPQLTFPKDQLDEAWTDERFPFQASVEFVFSSSPEKIKGSTPRNDPSVSVDHVAKHRGYSR

SEQ ID NO: 811461 - protein, 34 aa, Homo sapiens
PPVCAVCKVTIDGTGVSCRGEALCPVTLRPSTQY

SEQ ID NO: 811462 - protein, 202 aa, Homo sapiens
HEAAFHPAPGSVVCMAPPWAGGERRGPGTTCLHSPWMLEAAPPWAGGEGRELGAACLHSLRMLEAGGSEAATARGRGDFGAASCSDLAFRCASSQNPRSLEPVASSPERRRRQPSRAFACTLPGCWRLEAVTQQQREATLERPHIATSPSAARPPRAQEARNLWHPSLKGEDGNPAEALLGWGLHDRAGLIKWRPTRGSNPG

SEQ ID NO: 811463 - protein, 202 aa, Homo sapiens; identical to SEQ ID NO: 811462

SEQ ID NO: 811464 - protein, 202 aa, Homo sapiens; identical to SEQ ID NO: 811462

SEQ ID NO: 811465 - protein, 202 aa, Homo sapiens; identical to SEQ ID NO: 811462

SEQ ID NO: 811466 - protein, 202 aa, Homo sapiens; identical to SEQ ID NO: 811462

SEQ ID NO: 811467 - protein, 102 aa, Homo sapiens
GWLQLRHCARSSAPEGRGQPGDRGPGAPWEAGNTCRDPRACLRLWPEVLRLPIRGSGRPVAAPSESSPDSPTSCLGHVGGTPKGMPSKCVNKLQSDCPSQRK

SEQ ID NO: 811468 - protein, 102 aa, Homo sapiens; identical to SEQ ID NO: 811467

SEQ ID NO: 811469 - protein, 133 aa, Homo sapiens [sequence omitted]

SEQ ID NO: 811470 - protein, 162 aa, Homo sapiens
KVASTSRPARGSILSVNLHHRLWRSAILVIEEMFVVCTNNDGSGERSVGAGVKSTMAVRDGHVPGLYQKWCPKQSCDFLILTQNRHFKNTEISFKLGVEFDETTADDRKVKSIVTLDGGKLVHLQKWDGQETTLVRELIDGKLILTLTHGTAVCTRTYEKEA

SEQ ID NO: 811471 - protein, 66 aa, Homo sapiens
WGVEGARDREMTGRSSIVTLDGGKLVHLQKWDGQETTLVRELIDGKLILTLTHGTAVCTRTYEKEA

SEQ ID NO: 811472 - protein, 126 aa, Homo sapiens
MVDAFLGTWKLVDSKNFDDYMKSLGVGFATRQVASMTKPTTIIEKNGDILTLKTHSTFKNTEISFKLGVEFDETTADDRKVKSIVTLDGGKLVHLQKWDGQETTLVRELIDGKLILMEKLQLRNVK

SEQ ID NO: 811473 - protein, 144 aa, Homo sapiens
MVDAFLGTWKLVDSKNFDDYMKSLAHILITFPLPSGVGFATRQVASMTKPTTIIEKNGDILTLKTHSTFKNTEISFKLGVEFDETTADDRKVKSIVTLDGGKLVHLQKWDGQETTLVRELIDGKLILTLTHGTAVCTRTYEKEA

SEQ ID NO: 811474 - protein, 155 aa, Homo sapiens
MVDAFLGTWKLVDSKNFDDYMKSLGVGFATRQVASMTKPTTIIEKNGDILTLKTHSTFKNTEISFKLGVEFDETTADDRKVKPEPGCSSDLSIYSSSSWVTLCKSIVTLDGGKLVHLQKWDGQETTLVRELIDGKLILTLTHGTAVCTRTYEKEA

SEQ ID NO: 811475 - protein, 227 aa, Homo sapiens
GRWRLAWRVWGSTAAKGLSLTLYGCAWRATESSVRKKRRGFSEIVSAMALRSQFWGLFSVCRNPGCRFAALSTSSEPAAKPEVDPVENEAVAPEFTNRNPRNLELLSVARKERGWRTVFPSREFWHRLRVIRTQHHVEALVEHQNGKVVVSASTREWAIKKHLYSTRNVVACESIGRVLAQRCLEAGINFMVYQPTPWEAASDSMKRLQSAMTEGGVVLREPQRIYE

SEQ ID NO: 811476 - protein, 170 aa, Homo sapiens
GRWRLAWRVWGSTAAKGLSLTLYGCAWRATESSVRKKRRGFSEIVSAMALRSQFWGLFSVCRNPGCRFAALSTSSEPAAKPEVDPVENEAVAPEFTNRNPRNLELLSVARKERGWRTVFPSREFWHRLRVIRTQHHVEALVEHQNGKMKRLQSAMTEGGVVLREPQRIYE

SEQ ID NO: 811477 - protein, 210 aa, Homo sapiens
MDTQGVALKQKGVRGVARTCEPGRPAFPRRARFQRRPGHHIHALPVSKPCRARRGSSSLWEKWGHSALPQRTAGGLGPAAGPRGPFCGGKGEKRGQPGSGRGGTRPSPAANPTQARPALTVLGADRFPSAAVTEHGQRPLHLDGSDTRRILLTPRATSIAAPRPTGDHSSGCDGVERTRAMSQELLGNTPPHPLPGCPGPAAGHGGKEKE

SEQ ID NO: 811478 - protein, 349 aa, Homo sapiens
MDTQGVALKQKGVRGVARTCEPGRPAFPRRARFQRRPGHHIHALPVSKPCRARRGSSSLWEKWGHSALPQRTAGGLGPAAGPRGPFCGGKGEKRGQPGSGRGGTRPSPAANPTQARPALTVLGADRFPSAAVTEHGQRPLHLDGSDTRRILLTPRATSIAAPRPTGDHSSGCDGVERTRAMSQELLGCRFAALSTSSEPAAKPEVDPVENEAVAPEFTNRNPRNLELLSVARKERGWRTVFPSREFWHRLRVIRTQHHVEALVEHQNGKVVVSASTREWAIKKHLYSTRNVVACESIGRVLAQRCLEAGINFMVYQPTPWEAASDSMKRLQSAMTEGGVVLREPQRIYE

SEQ ID NO: 811479 - protein, 209 aa, Homo sapiens
GRWRLAWRVWGSTAAKGLSLTLYGCAWRATESSVRKKRRGFSEIVSAMALRSQFWGLFSVCRNPGCRFAALSTSSEPAAKPEVDPVVLSVARKERGWRTVFPSREFWHRLRVIRTQHHVEALVEHQNGKVVVSASTREWAIKKHLYSTRNVVACESIGRVLAQRCLEAGINFMVYQPTPWEAASDSMKRLQSAMTEGGVVLREPQRIYE

SEQ ID NO: 811480 - protein, 227 aa, Homo sapiens; identical to SEQ ID NO: 811475

SEQ ID NO: 811481 - protein, 205 aa, Homo sapiens
GRWRLAWRVWGSTAAKGLSLTLYGCAWRATESSVRKKRRGFSEIVSAMALRSQFWGLFSVCRNPGCRFAALSTSSEPAAKPEVDPVENEAVAPEFTNRNPRNLELLSVARKERGWRTVFPSREFWHRLRVIRTQHHVEALVEHQNGKVVVSASTRVLAQRCLEAGINFMVYQPTPWEAASDSMKRLQSAMTEGGVVLREPQRIYE

SEQ ID NO: 811482 - protein, 127 aa, Homo sapiens
GRWRLAWRVWGSTAAKGLSLTLYGCAWRATESSVRKKRRGFSEIVSAMALRSQFWGLFSVCRNPGCRFAALSTSSEPAAKPEVDPVENEAVAPEFTNRNPRNLELLSVARKERGWRTVFPSREFWHR

SEQ ID NO: 811483 - protein, 177 aa, Homo sapiens
GRWRLAWRVWGSTAAKGLSLTLYGCAWRATESSVRKKRRGFSEIVSAMALRSQFWGLFSVCRNPGCRFAALSTSSEPAAKPEVDPVENEAVAPEFTNRNPRNLELLSVARKERGWRTVFPSREFWHRLRVIRTQHHVEALVEHQNGKVVVSASTRDETTTKCHDRRWCGSTGTSENL

SEQ ID NO: 811484 - protein, 188 aa, Homo sapiens
WEEVEPSPQNDVAQTQWAILVPSRKGCRFAALSTSSEPAAKPEVDPVENEAVAPEFTNRNPRNLELLSVARKERGWRTVFPSREFWHRLRVIRTQHHVEALVEHQNGKVVVSASTREWAIKKHLYSTRNVVACESIGRVLAQRCLEAGINFMVYQPTPWEAASDSMKRLQSAMTEGGVVLREPQRIYE

SEQ ID NO: 811485 - protein, 227 aa, Homo sapiens; identical to SEQ ID NO: 811475

SEQ ID NO: 811486 - protein, 212 aa, Homo sapiens
GRWRLAWRVWGSTAAKGLSLTLYGCAWRATESSVRKKRRGFSEIVSAMALRSQFWGLFSVCRNPGCRFAALSTSSEPAAKPEVDPVENEAVAPEFTNRNPRNLELLSVARKERGWRTVFPSREFWHRLRVIRTQHHVEALVEHQNGKVVVSASTREWAIKKHLYSTRNVVACESIGRVLAQRCLEAGINFMVYQPTPWEAASDSVFLFSCTY

SEQ ID NO: 811487 - protein, 1287 aa, Homo sapiens
TFCPPAEKDKGGRQLHRAGPRPCTQSRELLCRSQASPWVPMMREWVLLMSVLLCGLAGPTHLFQPSLVLDMAKVLLDNYCFPENLLGMQEAIQQAIKSHEILSISDPQTLASVLTAGVQSSLNDPRLVISYEPSTPEPPPQVPALTSLSEEELLAWLQRGLRHEVLEGNVGYLRVDSVPGQEVLSMMGEFLVAHVWGNLMGTSALVLDLRHCTGGQVSGIPYIISYLHPGNTILHVDTIYNRPSNTTTEIWTLPQVLGERYGADKDVVVLTSSQTRGVAEDIAHILKQMRRAIVVGERTGGGALDLRKLRIGESDFFFTVPVSRSLGPLGGGSQTWEGSGVLPCVGTPAEQALEKALAILTLRSALPGVVHCLQEVLKDYYTLVDRVPTLLQHLASMDFSTVVSEEDLVTKLNAGLQAASEDPRLLVRAIGPTETPSWPAPDAAAEDSPGVAPELPEDEAIRQALVDSVFQVSVLPGNVGYLRFDSFADASVLGVLAPYVLRQVWEPLQDTEHLIMDLRHNPGGPSSAVPLLLSYFQGPEAGPVHLFTTYDRRTNITQEHFSHMELPGPRYSTQRGVYLLTSHRTATAAEEFAFLMQSLGWATLVGEITAGNLLHTRTVPLLDTPEGSLALTVPVLTFIDNHGEAWLGGGVVPDAIVLAEEALDKAQEVLEFHQSLGALVEGTGHLLEAHYARPEVVGQTSALLRAKLAQGAYRTAVDLESLASQLTADLQEVSGDHRLLVFHSPGELVVEEAPPPPPAVPSPEELTYLIEALFKTEVLPGQLGYLRFDAMAELETVKAVGPQLVRLVWQQLVDTAALVIDLRYNPGSYSTAIPLLCSYFFEAEPRQHLYSVFDRATSKVTEVWTLPQVAGQRYGSHKDLYILMSHTSGSAAEAFAHTMQDLQRATVIGEPTAGGALSVGIYQVGSSPLYASMPTQMAMSATTGKAWDLAGVEPDITVPMSEALSIAQDIVALRAKVPTVLQTAGKLVADNYASAELGAKMATKLSGLQSRYSRVTSEVALAEILGADLQMLSGDPHLKAAHIPENAKDRIPGIVPMQIPSPEVFEELIKFSFHTNVLEDNIGYLRFDMFGDGELLTQVSRLLVEHIWKKIMHTDAMIIDMRFNIGGPTSSIPILCSYFFDEGPPVLLDKIYSRPDDSVSELWTHAQVVGERYGSKKSMVILTSSVTAGTAEEFTYIMKRLGRALVIGEVTSGGCQPPQTYHVDDTNLYLTIPTARSVGASDGSSWEGVGVTPHVVVPAEEALARAKEMLQHNQLRVKRSPGLQDHL

SEQ ID NO: 811488 - protein, 555 aa, Homo sapiens
MVAACRSVAGLLPRRRRCFPARAPLLRVALCLLCWTPAAVRAVPELGLWLETVNDKSGPLIFRKTMFNSTDIKLSVKSFHCSGPVKFTIVWHLKYHTCHNEHSNLEELFQKHKLSVDEDFCHYLKNDNCWTTKNENLDCNSDSQVFPSLNNKELINIRNVSNQERSMDVVARTQKDGFHIFIVSIKTENTDASWNLNVSLSMIGPHGYISASDWPLMIFYMVMCIVYILYGILWLTWSACYWKDILRIQFWIAAVIFLGMLEKAVFYSEYQNISNTGLSTQGLLIFAELISAIKRTLARLLVIIVSLGYGIVKPRLGTVMHRVIGLGLLYLIFAAVEGVMRVIGGSNHLAVVLDDIILAVIDSIFVWFIFISLAQTMKTLRLRKNTVKFSLYRHFKNTLIFAVLASIVFMGWTTKTFRIAKCQSDWMERWVDDAFWSFLFSLILIVIMFLWRPSANNQRYAFMPLIDDSDDEIEEFMVTSENLTEGIKLRASKSVSNGTAKPATSENFDEDLKWVEENIPSSFTDVALPVLVDSDEEIMTRSEMAEKMFSSEKIM

SEQ ID NO: 811489 - protein, 147 aa, Homo sapiens
NAYRNSYTGSSYIGNSIYEQMVEARRYTNAGRSMLSGPVIPSVRHSNTYLVQEPAVHIPGQEPLTASMLAAAPLHEQKQMIGERLYPLIHDVHTQLAGKITGMLLEIDNSELLLMLESPESLHAKIDEAVAVLQAHQAMEQPKAYMH

SEQ ID NO: 811490 - protein, 168 aa, Homo sapiens
MVRPPVVPRRPPAHISSVRQASTQVPRTVPHTQRVANIGTQTTGPSGVGCCTPGRPLLPCKCSSAAHSTYRVQEPAVHIPGQEPLTASMLAAAPLHEQKQMIGERLYPLIHDVHTQLAGKITGMLLEIDNSELLLMLESPESLHAKIDEAVAVLQAHQAMEQPKAYMH

SEQ ID NO: 811491 - protein, 168 aa, Homo sapiens; identical to SEQ ID NO: 811490

SEQ ID NO: 811492 - protein, 171 aa, Homo sapiens
MVRPPVVPRRPPAHISSVRQASTQVPRTVPHTQRVANIGTQTTGPSGVGCCTPGRPLLPCKCSSAAHSTYRVQEPAVHIPGQEPLTASMLAAAPLHEQKQMIGERLYPLIHDVHTQLAGKITGMLLEIDNSELLLMLESPESLHAKKRKSSLPWLPKGQCFWLSALRPCKL

SEQ ID NO: 811493 - protein, 559 aa, Homo sapiens
QSSALRRGARLGGPRPSYLPSAPGLCSHFPAVEGREAGAMQSESGIVPDFEVGEEFHEEPKTYYELKSQPLKSSSSAEHPGASKPPISSSSMTSRILLRQQLMREQMQEQERREQQQKLQAAQFMQQRVPVSQTPAINVSVPTTLPSATQVPMEVLKVQTHLENPTKYHIQQAQRQQVKQYLSTTLANKHANQVLSLPCPNQPGDHVMPPVPGSSAPNSPMAMLTLNSNCEKEGFYKFEEQNRAESECPGMNTHSRASCMQMDDVIDDIISLESSYNEEILGLMDPALQMANTLPVSGNLIDLYGNQGLPPPGLTISNSCPANLPNIKRELTESEARALAKERQKKDNHNLIERRRRFNINDRIKELGTLIPKSNDPDMRWNKGTILKASVDYIRKLQREQQRAKELENRQKKLEHANRHLLLRIQELEMQARAHGLSLIPSTGLCSPDLVNRIIKQEPVLENCSQDLLQHHADLTCTTTLDLTDGTITFNNNLGTGTEANQAYSVPTKMGSKLEDILMDDTLSPVGVTDPLLSSVSPGASKTSSRRSSMSMEETEHTC

SEQ ID NO: 811494 - protein, 419 aa, Homo sapiens
MLEMLEYNHYQVQTHLENPTKYHIQQAQRQQVKQYLSTTLANKHANQVLSLPCPNQPGDHVMPPVPGSSAPNSPMAMLTLNSNCEKEGFYKFEEQNRAESECPGMNTHSRASCMQMDDVIDDIISLESSYNEEILGLMDPALQMANTLPVSGNLIDLYGNQGLPPPGLTISNSCPANLPNIKRELTACIFPTESEARALAKERQKKDNHNLIERRRRFNINDRIKELGTLIPKSNDPDMRWNKGTILKASVDYIRKLQREQQRAKELENRQKKLEHANRHLLLRIQELEMQARAHGLSLIPSTGLCSPDLVNRIIKQEPVLENCSQDLLQHHADLTCTTTLDLTDGTITFNNNLGTGTEANQAYSVPTKMGSKLEDILMDDTLSPVGVTDPLLSSVSPGASKTSSRRSSMSMEETEHTC

SEQ ID NO: 811495 - protein, 541 aa, Homo sapiens
QSSALRRGARLGGPRPSYLPSAPGLCSHFPAVEGREAGAMQSESGIVPDFEVGEEFHEEPKTYYELKSQPLKSSSSAEHPGASKPPISSSSMTSRILLRQQLMREQMQEQERREQQQKLQAAQFMQQRVPVSQTPAINVSVPTTLPSATQVPMEVLKVQTHLENPTKYHIQQAQRQQVKQYLSTTLANKHANQVLSLPCPNQPGDHVMPPVPGSSAPNSPMAMLTLNSNCEKEGFYKFEEQNRAESECPGMNTHSRASCMQMDDVIDDIISLESSYNEEILGLMDPALQMANTLPVSGNLIDLYGNQGLPPPGLTISNSCPANLPNIKRELTESEARALAKERQKKDNHNLIERRRRFNINDRIKELGTLIPKSNDPDMRWNKGTILKASVDYIRKLQREQQRAKELENRQKKLEHANRHLLLRIQELEMQARAHGLSLIPSTGLCSPDLVNRIIKQEPVLENCSQDLLQHHADLTCTTTLDLTDGTITFNNNLGTGTEANQAYSVPTKMGSKLEDILMDDTLSPVGVTDPLLSSVSPGAS

SEQ ID NO: 811496 - protein, 130 aa, Homo sapiens [sequence omitted]

SEQ ID NO: 811497 - protein, 230 aa, Homo sapiens
MSSSYYVNALFSKYTAGTSLFQNAEPTSCSFAPNSQRSGYGAGAGAFASTVPGLYNVNSPLYQSPFASGYGLGADAYGNLPCASYDQNIPGLCSDLAKGACDKTDEGALHGAAEANFRIYPWMRSSGPDRKRGRQTYTRYQTLELEKEFHFNRYLTRRRRIEIAHALCLTERQIKIWFQNRRMKWKKEHKDEGPTAAAAPEGAVPSAAATAAADKADEEDDDEEEEDEEE

SEQ ID NO: 811498 - protein, 107 aa, Homo sapiens
KKTKTKTKKQPSPQPALYPPPSPTPAPNFCGLNGRRDWVALDSLCLTERQIKIWFQNRRMKWKKEHKDEGPTAAAAPEGAVPSAAATAAADKADEEDDDEEEEDEEE

SEQ ID NO: 811499 - protein, 325 aa, Homo sapiens
LLPGAVEQPQPQFISRFLEGQSGVTIKHVACGDFFTACLTDRGIIMTFGSGSNGCLGHGSLTDISQPTIVEALLGYEMVQVACGASHVLALSTERELFAWGRGDSGRLGLGTRESHSCPQQVPMPPGQEAQRVVCGIDSSMILTVPGQALACGSNRFNKLGLDHLSLGEEPVPHQQVEEALSFTLLGSAPLDQEPLLSIDLGTAHSAAVTASGDCYTFGSNQHGQLGTNTRRGSRAPCKVQGLEGIKMAMVACGDAFTVAIGAESEVYSWGKGARGRLGRRDEDAGLPRPVQLDETHPYTVTSVSCCHGNTLLAVRSVTDEPVPP

SEQ ID NO: 811500 - protein, 325 aa, Homo sapiens; identical to SEQ ID NO: 811499

SEQ ID NO: 811501 - protein, 258 aa, Homo sapiens
LLPGAVEQPQPQFISRFLEGQSGVTIKHVACGDFFTACLTDRGIIMTFGSGSNGCLGHGSLTDISQPTIVEALLGYEMVQVACGASHVLALSTERELFAWGRGDSGRLGLGTRESHSCPQQVPMPPGQEAQRVVCGIDSSMILTVPGQALACGSNRFNKLGLDHLSLGEEPVPHQQVEEALSFTLLGSAPLDQEPLLSIDLGTAHSAAVTASGDCYTFGSNQHGQLGTNTRRGSRAPCKVQGLEGIKMAMVACGDAFM

SEQ ID NO: 811502 - protein, 267 aa, Homo sapiens
MGAAAAEADRTLFVGNLETKVTEELLFELFHQAGPVIKVKIPKDKDGKPKQFAFVNFKHEVSVPYAMNLLNGIKLYGRPIKIQFRSGSSHAPQDVSLSYPQHHVGNSSPTSTSPSSRYERTMDNMTSSAQIIQRSFSSPENFQRQAVMNSALRQMSYGGKFGSSPLDQSGFSPSVQSHSHSFNQSSSSQWRQGTPSSQRKVRMNSYPYLADRHYSREQRYTDHGSDHHYRGKRDDFFYEDRNHDDWSHDYDNRRDSSRDGKWRSSRH

SEQ ID NO: 811503 - protein, 151 aa, Homo sapiens
MGAAAAEADRTLFVGNLETKVTEELLFELFHQAGPVIKVKIPKDKDGKPKQFAFVNFKHEVSVPYAMNLLNGIKLYGRPIKIQFRSGSSHAPQDVSLSYPQHHVGNSSPTSTSPSSRYERTMDNMTSSAQIIQRSFSSPENFQRQAVITLV

SEQ ID NO: 811504 - protein, 267 aa, Homo sapiens; identical to SEQ ID NO: 811502

SEQ ID NO: 811505 - protein, 267 aa, Homo sapiens; identical to SEQ ID NO: 811502

SEQ ID NO: 811506 - protein, 188 aa, Homo sapiens
PGWASNKGSSHAPQDVSLSYPQHHVGNSSPTSTSPSSRYERTMDNMTSSAQIIQRSFSSPENFQRQAVMNSALRQMSYGGKFGSSPLDQSGFSPSVQSHSHSFNQSSSSQWRQGTPSSQRKVRMNSYPYLADRHYSREQRYTDHGSDHHYRGKRDDFFYEDRNHDDWSHDYDNRRDSSRDGKWRSSRH

SEQ ID NO: 811507 - protein, 269 aa, Homo sapiens
MGAAAAEADRTLFVGNLETKVTEELLFELFHQAGPVIKVKIPKDKDGKPKQFAFVNFKHEVSVPYAMNLLNGIKLYGRPIKIQFRSGSSHAPQDVSLSYPQHHVGNSSPTSTSPSSRYERTMDNMTSSAQIIQRSFSSPENFQRQAVMNSALRQMSYGGKFGSSPLDQSGFSPSVQSHSHSFNQSSSSQWRQGTPSSQRKVRMNSYPYLADRHYSREQRYTDHGSDHHYRGKRDDFFYEDRNHDDWSHDYDNRSSTWIRMRSQRDTLIQ

SEQ ID NO: 811508 - protein, 231 aa, Homo sapiens
MDPEHAKPESSEAPSGNLKQPETAAALASSGSVVSSVPKAQRNISAKTAPRKHPAVSIRSAQSAAAARPQGSEGTAPSRKATTRPPPKPTLPPPTPSAHTESKLLNEMAIKERVEGRAKVPYKFRDSLKRFSFSPTGMLKILRLSLILGALACFIITQANESFITITSLEICIVVFFILIYVLTLHHLLTYLHWPLLDLTNSIITAVFLSVVAILAMQEKKRRHLLYVGGR

SEQ ID NO: 811509 - protein, 111 aa, Homo sapiens
MWKTLLVMERFLRGNSNLCPWKFSRREGSYQQYHYSCVPFSSCHLGHARKEKKAFTLCRGAVIVCCIDAFVVTTKMRTNLKRFLGVEVERKLSPAKDAYPETGPDAPQRPA

SEQ ID NO: 811510 - protein, 113 aa, Homo sapiens
QLTGNNSIHAHRICVGTDTRNHNIDSWWRGSYQQYHYSCVPFSSCHLGHARKEKKAFTLCRGAVIVCCIDAFVVTTKMRTNLKRFLGVEVERKLSPAKDAYPETGPDAPQRPA

SEQ ID NO: 811511 - protein, 221 aa, Homo sapiens
MDPEHAKPESSEAPSGNLKQPETAAALASSGSVVSSVPKAQRNISAKTAPRKHPAVSIRSAQSAAAARPQGSEGTAPSRKATTRPPPKPTLPPPTPSAHTESKLLNEMAIKERVEGRAKVPYKFRDSLKRFSFSPTGMLKILRLVSGELVRPSWADVAGSGLGEMPTGCQLQKPSIIHFATHLCFASPILTLNNLPLCPAPIEQGSRRGVSDAVSQSRLAF

SEQ ID NO: 811512 - protein, 221 aa, Homo sapiens
MDPEHAKPESSEAPSGNLKQPETAAALASSGSVVSSVPKAQRNISAKTAPRKHPAVSIRSAQSAAAARPQGSEGTAPSRKATTRPPPKPTLPPPTPSAHTESKLLNEMAIKERVEGRAKVPYKFRDSLKRFSFSPTGMLKILRLSLILGALACFIITQANESFITITSLEICIVVFFILIYVLTLHHLLTYLHWPLLVSVHFYNSSNPSFALSPRVRALLK

SEQ ID NO: 811513 - protein, 127 aa, Homo sapiens
RGSPWQSTHGQTIQVDHQQAEVFIVEQTVHAEEGIPMSCQYYLLSDGHLAKRIQVGSPGCCIITKMPILREEDEIEPRPVFEKKPLVWEEDMELYSKFLDRKEELRLGHASYLRQHPEAHALISDFL

SEQ ID NO: 811514 - protein, 79 aa, Homo sapiens
MLAVCRCRAGHRRGILWASVVQVGPSAELHELLSSQPCSISWFWQQEASPVHSGAVGLGHSQQEGALLRPACSLSAEGD

SEQ ID NO: 811515 - protein, 93 aa, Homo sapiens
RDPHGPDTPALRKRRTLVGATTDRRTETRGRRVLSVAPYPEQRPRPQAVMSPRPRILCASSGRAARGGAKRNPWNSLSSENWEQPQGTRCSSC

SEQ ID NO: 811516 - protein, 846 aa, Homo sapiens
METKETVTSEVVNLSNKNEKLCQELTEIDQLAQQLERHKEEVLETADKELGEAKKEIKRKLSEMQDLEETMAKLQLELNLCQKEKERLSDELLVKSDLETVVHQLEQEKQRLSKKVESFAVTERQLTLEVERMRLEHGIKRRDRSPSRLDTFLKGIEEERDYYKKELERLQHIIQRRSCSTSYSAREKSSIFRTPEKGDYNSEIHQITRERDELQRMLERFEKYMEDIQSNVKLLTAERDKLSVLYNEAQEELSALRKESTQTTAPHNIVSLMEKEKELALSDLRRIMAEKEALREKLEHIEEVSLFGKSELEKTIEHLTCVNHQLESEKYELKSKVLIMKETIESLENKLKVQAQKFSHVAGDSSHQKTEVNSLRIVNEQLQRSVDDYQHRLSIKRGELESAQAQIKILEEKIDELNLKMTSQDEEAHVMKKTIGVIDKEKDFLQETVDEKTEKIANLQENLANKEKAVAQMKIMISECESSVNQLKETLVNRDREINSLRRQLDAAHKELDEVGRSREIAFKENRRLQDDLATMARENQEISLELEAAVQEKEEMKSRVHKYITEVSRWESLMAAKEKENQDLLDRFQMLHNRAEDWEVKAHQAEGESSSVRLELLSIDTERRHLRERVELLEKEIQEHINAHHAYESQISSMAKAMSRLEEELRHQEDEKATVLNDLSSLRELCIKLDSGKDIMTQQLNSKNLEFERVVVELENVKSESDLLKKQLSNERHTVKNLESLLATNRDKEFHSHLTSHEKDTEIQLLKEKLTLSESKLTSQSRENTMLRAKVAQLQTDYDALKRQISTERYERERAIQEMRRHGLATPPLSSTLRSPSHSPEHRNV

SEQ ID NO: 811517 - protein, 249 aa, Homo sapiens
MTTAVERKYINIRKRLDQLGYRQTLTVECLPLVEKLFSDLVHTTESLRQSKLSAVKAEKESANFDFVLEPYKLENARLSRENNELYLELMKLREHSDQHVKELKTSLKKCARETADLKFLNNQYAHKLKLLEKESKAKNERIQQLQEKNLHAVVQTPGGKKRSIAFRRQRMQIDEPVPPSEVSSYPVPQPDDPYIADLLQVADNRIQELQQEVHQLQEKLAMMESGVRDYSKQVGFLFTCIVGIEIGML

SEQ ID NO: 811518 - protein, 1140 aa, Homo sapiens
MTTAVERKYINIRKRLDQLGYRQTLTVECLPLVEKLFSDLVHTTESLRQSKLSAVKAEKESANFDFVLEPYKLENARLSRENNELYLELMKLREHSDQHVKELKTSLKKCARETADLKFLNNQYAHKLKLLEKESKAKNERIQQLQEKNLHAVVQTPGGKKRSIAFRRQRMQIDEPVPPSEVSSYPVPQPDDPYIADLLQVADNRIQELQQEVHQLQEKLAMMESGVRDYSKQIELREREIERLSVALDGGRSPDVLSLESRNKTNEKLIAHLNIQVDFLQQANKDLEKRIRELMETKETVTSEVVNLSNKNEKLCQELTEIDQLAQQLERHKEEVLETADKELGEAKKEIKRKLSEMQDLEETMAKLQLELNLCQKEKERLSDELLVKSDLETVVHQLEQEKQRLSKKVESFAVTERQLTLEVERMRLEHGIKRRDRSPSRLDTFLKGIEEERDYYKKELERLQHIIQRRSCSTSYSAREKSSIFRTPEKGDYNSEIHQITRERDELQRMLERFEKYMEDIQSNVKLLTAERDKLSVLYNEAQEELSALRKESTQTTAPHNIVSLMEKEKELALSDLRRIMAEKEALREKLEHIEEVSLFGKSELEKTIEHLTCVNHQLESEKYELKSKVLIMKETIESLENKLKVQAQKFSHVAGDSSHQKTEVNSLRIVNEQLQRSVDDYQHRLSIKRGELESAQAQIKILEEKIDELNLKMTSQDEEAHVMKKTIGVIDKEKDFLQETVDEKTEKIANLQENLANKEKAVAQMKIMISECESSVNQLKETLVNRDREINSLRRQLDAAHKELDEVGRSREIAFKENRRLQDDLATMARENQEISLELEAAVQEKEEMKSRVHKYITEVSRWESLMAAKEKENQDLLDRFQMLHNRAEDWEVKAHQAEGESSSVRLELLSIDTERRHLRERVELLEKEIQEHINAHHAYESQISSMAKAMSRLEEELRHQEDEKATVLNDLSSLRELCIKLDSGKDIMTQQLNSKNLEFERVVVELENVKSESDLLKKQLSNERHTVKNLESLLATNRDKEFHSHLTSHEKDTEIQLLKEKLTLSESKLTSQSRENTMLRAKVAQLQTDYDALKRQISTERYERERAIQEMRRHGLATPPLSSTLRSPSHSPEHRNV

SEQ ID NO: 811519 - protein, 1088 aa, Homo sapiens
MTTAVERKYINIRKRLDQLGYRQTLTVECLPLVEKLFSDLVHTTESLRQSKLSAVKAEKESANFDFVLEPYKLENARLSRENNELYLELMKLREHSDQHVKELKTSLKKCARETADLKFLNNQYAHKLKLLEKESKAKNERIQQLQEKNLHAVVQTPGGKKRSIAFRRQRMQIDEPVPPSEVSSYPVPQPDDPYIADLLQVADNRIQELQQEVHQLQEKLAMMESGVRDYSKQIELREREIERLSVALDGGRSPDVLSLESRNKTNEKLIAHLNIQVDFLQQANKDLEKRIRELMETKETVTSEVVNLSNKNEKLCQELTEIDQLAQQLERHKEEVLETADKELGEAKKEIKRKLSEMQDLEETMAKLQLELNLCQKEKERLSDELLVKSDLETVVHQLEQEKQRLSKKVESFAVTERQLTLEVERMRLEHGIKRRDRSPSRLDTFLKGIEEERDYYKKELERLQHIIQRRSCSTSYSAREKSSIFRTPEKGDYNSEIHQITRERDELQRMLERFEKYMEDIQSNVKLLTAERDKLSVLYNEAQEELSALRKESTQTTAPHNIVSLMEKEKELALSDLRRIMAEKEALREKLEHIEEVSLFGKSELEKTIEHLTCVNHQLESEKYELKSKVLIMKETIESLENKLKVQAQKFSHVAGDSSHQKTEVNSLRIVNEQLQRSVDDYQHRLSIKRGELESAQAQIKILEEKIDELNLKMTSQDEEAHVMKKTIGVIDKEKDFLQETVDEKTEKIANLQENLANKEKAVAQMKIMISECESSVNQLKETLVNRDREINSLRRQLDAAHKELDEVGRSREIAFKENRRLQDDLATMARENQEISLELEAAVQEKEEMKSRVHKYITEVSRWESLMAAKEKENQDLLDRFQMLHNRAEDWEVKAHQAEGESSSVRLELLSIDTERRHLRERVELLEKEIQEHINAHHAYESQISSMAKAMSRLEEELRHQEDEKATVLNDLSSLRELCIKLDSGKDIMTQQLNSKNLEFERVVVELENVKSESDLLKKQLSNERHTVKNLESLLATNRDKEFHSHLTSHEKDTEIQLLKENCLNPGGGGCGEPRSCHCTPAWVTE

SEQ ID NO: 811520 - protein, 195 aa, Homo sapiens
MCCGHGSKASGYEGQSSSWEIPREGREPLDMWNVISVGCWWIPQVVWHGRRPEAAMDHLCLGRFLEMVGSPWARAAYVAWASSGAGGSLRMLSKVSYESWSQSLDMGVGRMLRFQDVGSRGRVFGAGQISTKFSLTQRARGFWQVCLTHMLWAGNPGFAPGVCVSIPGETPFGLHGVCHLREKDYAPRHRCDYGG

SEQ ID NO: 811521 - protein, 204 aa, Homo sapiens
CIQRRMTASNAADCIQSRMTASNAASHAILGDGRSPGTHGVWALSEAVGSLLNVVWHGRRPEAAMDHLCLGRFLEMVGSPWARAAYVAWASSGAGGSLRMLSKVSYESWSQSLDMGVGRMLRFQDVGSRGRVFGAGQISTKFSLTQRARGFWQVCLTHMLWAGNPGFAPGVCVSIPGETPFGLHGVCHLREKDYAPRHRCDYGG

SEQ ID NO: 811522 - protein, 388 aa, Homo sapiens
GRGTRRGGGTMVMAYFVENFWGEKNSGFDVLYHNMKHGQISTKELADFVRERATIEEAYSRSMTKLAKSASNYSQLGTFAPVWDVFKTSTEKLANCHLDLVRKLQELIKEVQKYGEEQVKSHKKTKEEVAGTLEAVQTIQSITQALQKSKENYNAKCVEQERLKKEGATQREIEKAAVKSKKATDTYKLYVEKYALAKADFEQKMTETAQKFQDIEETHLIHIKEIIGSLSNAIKEIHLQIGQVHEEFINNMANTTVESLIQKFAESKGTGKERPGLIEFEECDTASAVEGIKPRKRKTFALPGIIKKEKDAESVWSFTVVAQVGMQWRDLGLLHSPPPRFKRFSSYLSLPSSWNYGAHHHIWLIFCIFSRDRVSPYWPGWSRTPDLR

SEQ ID NO: 811523 - protein, 337 aa, Homo sapiens
GRGTRRGGGTMVMAYFVENFWGEKNSGFDVLYHNMKHGQISTKELADFVRERATIEEAYSRSMTKLAKSASNYSQLGTFAPVWDVFKTSTEKLANCHLDLVRKLQELIKEVQKYGEEQVKSHKKTKEEVAGTLEAVQTIQSITQALQKSKENYNAKCVEQERLKKEGATQREIEKAAVKSKKATDTYKLYVEKYALAKADFEQKMTETAQKFQDIEETHLIHIKEIIGSLSNAIKEIHLQIGQVHEEFINNMANTTVESLIQKFAESKGTGKERPGLIEFEECDTASAVEGIKPRKRKTFALPGIIKKEKDAESVECPDADSLMHFWIYIARCFPIK

SEQ ID NO: 811524 - protein, 388 aa, Homo sapiens; identical to SEQ ID NO: 811522

SEQ ID NO: 811525 - protein, 330 aa, Homo sapiens
AALESAPPPRAPSLRPAPPAPLSQRRASGVKSAPLAPQPVPTAAAQPQPSSASASLSSSSSAAGHAAAGRDRDAAGESGTRAASPSPSGSRTAGRLPSPSYSPLPAPSLFPPPPLPAPAASTMSAGGDFGNPLRKFKLVFLGEQSVGKTSLITRFMYDSFDNTYQATIGIDFLSKTMYLEDRTVRLQLWDTAGQERFRSLIPSYIRDSTVAVVVYDITNLNSFQQTSKWIDDVRTERGSDVIIMLVGNKTDLADKRQITIEEGEQRAKELSVMFIETSAKTGYNVKQLFRRVASALPGMENVQEKSKEGMIDIKLDKPQEPPASEGGCSC

SEQ ID NO: 811526 - protein, 330 aa, Homo sapiens; identical to SEQ ID NO: 811525

SEQ ID NO: 811527 - protein, 94 aa, Homo sapiens
MTHVLGTTAVAEVSGHLGKSLIKFCSGDLGPEGILPDTHLLDPLLKEASTAPLAQIPSKGMDGESRVGPLLYQLVSYPPRPRPQLPGPTPQSSG

SEQ ID NO: 811528 - protein, 348 aa, Homo sapiens
SSLCFPRMRAPGAGAASVVSLALLWLLGLPWTWSAAAALGVYVGSGGWRFLRIVCKTARRDLFGLSVLIRVRLELRRHQRAGHTIPRIFQAVVQRQPERLALVDAGTGECWTFAQLDAYSNAVANLFRQLGFAPGDVVAIFLEGRPEFVGLWLGLAKAGMEAALLNVNLRREPLAFCLGTSGAKALIFGGEMVAAVAEVSGHLGKSLIKFCSGDLGPEGILPDTHLLDPLLKEASTAPLAQIPSKGMDDRLFYIYTSGTTGLPKAAIVVHSRYYRMAAFGHHAYRMQAADVLYDCLPLYHSAGNIIGVGQCLIYGLTVVLRKKFSASRFWDDCIKYNCTLYLARPILD

SEQ ID NO: 811529 - protein, 597 aa, Homo sapiens
MRAPGAGAASVVSLALLWLLGLPWTWSAAAALGVYVGSGGWRFLRIVCKTARRDLFGLSVLIRVRLELRRHQRAGHTIPRIFQAVVQRQPERLALVDAGTGECWTFAQLDAYSNAVANLFRQLGFAPGDVVAIFLEGRPEFVGLWLGLAKAGMEAALLNVNLRREPLAFCLGTSGAKALIFGGEMVAAVAEVSGHLGKSLIKFCSGDLGPEGILPDTHLLDPLLKEASTAPLAQIPSKGMDDRLFYIYTSGTTGLPKAAIVVHSRYYRMAAFGHHAYRMQAADVLYDCLPLYHSAGNIIGVGQCLIYGLTVVLRKKFSASRFWDDCIKYNCTVVQYIGEICRYLLKQPVREAERRHRVRLAVGNGLRPAIWEEFTERFGVRQIGEFYGATECNCSIANMDGKVGSCGFNSRILPHVYPIRLVKVNEDTMELLRDAQGLCIPCQAGEPGLLVGQINQQDPLRRFDGYVSESATSKKIAHSVFSKGDSAYLSGDVLVMDELGYMYFRDRSGDTFRWRGENVSTTEVEGVLSRLLGQTDVAVYGVAVPGTFKIQKTRLQREGFDPRQTSDRLFFLDLKQGHYLPLNEAVYTRICSGAFAL

SEQ ID NO: 811530 - protein, 361 aa, Homo sapiens
STCSMLPHACTLGDLGPSLCPPGSPSPCRYYRMAAFGHHAYRMQAADVLYDCLPLYHSAGNIIGVGQCLIYGLTVVLRKKFSASRFWDDCIKYNCTVVQYIGEICRYLLKQPVREAERRHRVRLAVGNGLRPAIWEEFTERFGVRQIGEFYGATECNCSIANMDGKVGSCGFNSRILPHVYPIRLVKVNEDTMELLRDAQGLCIPCQAGEPGLLVGQINQQDPLRRFDGYVSESATSKKIAHSVFSKGDSAYLSGDVLVMDELGYMYFRDRSGDTFRWRGENVSTTEVEGVLSRLLGQTDVAVYGVAVPGTFKIQKTRLQREGFDPRQTSDRLFFLDLKQGHYLPLNEAVYTRICSGAFAL

SEQ ID NO: 811531 - protein, 418 aa, Homo sapiens
MTHVLGTTAVAEVSGHLGKSLIKFCSGDLGPEGILPDTHLLDPLLKEASTAPLAQIPSKGMDDRLFYIYTSGTTGLPKAAIVVHSRYYRMAAFGHHAYRMQAADVLYDCLPLYHSAGNIIGVGQCLIYGLTVVLRKKFSASRFWDDCIKYNCTVVQYIGEICRYLLKQPVREAERRHRVRLAVGNGLRPAIWEEFTERFGVRQIGEFYGATECNCSIANMDGKVGSCGFNSRILPHVYPIRLVKVNEDTMELLRDAQGLCIPCQAGEPGLLVGQINQQDPLRRFDGYVSESATSKKIAHSVFSKGDSAYLSGDVLVMDELGYMYFRDRSGDTFRWRGENVSTTEVEGVLSRLLGQTDVAVYGVAVPGTFKIQKTRLQREGFDPRQTSDRLFFLDLKQGHYLPLNEAVYTRICSGAFAL

SEQ ID NO: 811532 - protein, 93 aa, Homo sapiens
AAVADPHSLLDPNAIYQELQKVLAPYARPIFLRLLPQVDTTGTFKIQKTRLQREGFDPRQTSDRLFFLDLKQGHYLPLNEAVYTRICSGAFAL

SEQ ID NO: 811533 - protein, 597 aa, Homo sapiens; identical to SEQ ID NO: 811529

SEQ ID NO: 811534 - protein, 178 aa, Homo sapiens
FKDGVLLLLPRLEFNGTISALSPRFKQFSCPASCLLSWEEASWVSSSGVSTGGSHRRGSRGVRGGLLPGVGLSSLRGSSLLNIPHLVVAPPMSPLMALTPCWWRCPRQSHQDGPDIPTGFAGGSSRTSTPAFLGPATQAACPSVLPPAAPPGPWSGGAMARDTVASHVNFPGHCGFIS

SEQ ID NO: 811535 - protein, 455 aa, Homo sapiens
SSLCFPRMRAPGAGAASVVSLALLWLLGLPWTWSAAAALGVYVGSGGWRFLRIVCKTARRDLFGLSVLIRVRLELRRHQRAGHTIPRIFQAVVQRQPERLALVDAGTGECWTFAQLDAYSNAVANLFRQLGFAPGDVVAIFLEGRPEFVGLWLGLAKAGMEAALLNVNLRREPLAFCLGTSGAKALIFGGEMVAAVAEVSGHLGKSLIKFCSGDLGPEGILPDTHLLDPLLKEASTAPLAQIPSKGMDDRLFYIYTSGTTGLPKAAIVVHSRYYRMAAFGHHAYRMQAADVLYDCLPLYHSAGNIIGVGQCLIYGLTVVLRKKFSASRFWDDCIKYNCTVVQYIGEICRYLLKQPVREAERRHRVRLAVGNGLRPAIWEEFTERFGVRQIGEFYGATECNCSIANMDGKVHTGRAPGQVSEFREDHCLLFLGPLGYIKQPGLARKAPPRRTQGGV

SEQ ID NO: 811536 - protein, 97 aa, Homo sapiens
MQAGKVGGGALSWRRRLLPCFCRSAKVTELRMTLEVLGPSPRARQAKFTEKDPAYPRLLPTQFTPFQVGSCGFNSRILPHVYPIRLVKVNEDTMELL

SEQ ID NO: 811537 - protein, 150 aa, Homo sapiens
GLAPWVGRSRGLSSDPGSPPPAGPITHFLTTVPQVVQYIGEICRYLLKQPVREAERRHRVRLAVGNGLRPAIWEEFTERFGVRQIGEFYGATECNCSIANMDGKVHTGRAPGQVSEFREDHCLLFLGPLGYIKQPGLARKAPPRRTQGGV

SEQ ID NO: 811538 - protein, 128 aa, Homo sapiens
ARFEAGCGDYHDLESVVQQVEQNLELMTKRAVKAENHVVKLKQEISLLQAQVSNFQRENEALRCGQGASLTVVKQNADVALQNLRVVMNSAQASIKQLVSGAETLNLVAEILKSIDRISEVKDEEEDS

SEQ ID NO: 811539 - protein, 449 aa, Homo sapiens
VQARAFGARSGSSGERLGGAGAAERRATGAGDGGGRRGPRHGRSRGHGAAAAGLGRSCPAGPAAMSGYQRRPGATPLSRARSLAIPDDFGYGKGKCSKQSPSGAHGTHFGDDRFEDLEEANPFSFREFLKTKNLGLSKEDPASRIYAKEASRHSLGLDHNSPPSQTGGYGLEYQQPFFEDPTGAGDLLDEEEDEDTGWSGAYLPSAIEQTHPERVPAGTSPCSTYLSFFSTPSELAGPESLPSWALSDTDSRVSPASPAGSPSADFAVHGESLGDRHLRTLQISYDALKDENSKLRRKLNEVQSFSEAQTEMVRTLERKLEAKMIKEESDYHDLESVVQQVEQNLELMTKRAVKAENHVVKLKQEISLLQAQVSNFQRENEALRCGQGASLTVVKQNADVALQNLRVVMNSAQASIKQLVSGAETLNLVAEILKSIDRISEVKDEEEDS

SEQ ID NO: 811540 - protein, 499 aa, Homo sapiens
VQARAFGARSGSSGERLGGAGAAERRATGAGDGGGRRGPRHGRSRGHGAAAAGLGRSCPAGPAAMSGYQRRPGATPLSRARSLAIPDAPAFYERRSCLPQLNCERPHGRDLDSPFFGIRPAFMCYVPSPVLASVGDTDFGYGKGKCSKQSPSGAHGTHFGDDRFEDLEEANPFSFREFLKTKNLGLSKEDPASRIYAKEASRHSLGLDHNSPPSQTGGYGLEYQQPFFEDPTGAGDLLDEEEDEDTGWSGAYLPSAIEQTHPERVPAGTSPCSTYLSFFSTPSELAGPESLPSWALSDTDSRVSPASPAGSPSADFAVHGESLGDRHLRTLQISYDALKDENSKLRRKLNEVQSFSEAQTEMVRTLERKLEAKMIKEESDYHDLESVVQQVEQNLELMTKRAVKAENHVVKLKQEISLLQAQVSNFQRENEALRCGQGASLTVVKQNADVALQNLRVVMNSAQASIKQLVSGAETLNLVAEILKSIDRISEVKDEEEDS

SEQ ID NO: 811541 - protein, 476 aa, Homo sapiens
VQARAFGARSGSSGERLGGAGAAERRATGAGDGGGRRGPRHGRSRGHGAAAAGLGRSCPAGPAAMSGYQRRPGATPLSRARSLAIPDAPAFYERRSCLPQLNCERPHGRDLDSPFFGIRPAFMCYVPSPVLASVGDTDDRFEDLEEANPFSFREFLKTKNLGLSKEDPASRIYAKEASRHSLGLDHNSPPSQTGGYGLEYQQPFFEDPTGAGDLLDEEEDEDTGWSGAYLPSAIEQTHPERVPAGTSPCSTYLSFFSTPSELAGPESLPSWALSDTDSRVSPASPAGSPSADFAVHGESLGDRHLRTLQISYDALKDENSKLRRKLNEVQSFSEAQTEMVRTLERKLEAKMIKEESDYHDLESVVQQVEQNLELMTKRAVKAENHVVKLKQEISLLQAQVSNFQRENEALRCGQGASLTVVKQNADVALQNLRVVMNSAQASIKQLVSGAETLNLVAEILKSIDRISEVKDEEEDS

SEQ ID NO: 811542 - protein, 473 aa, Homo sapiens
SGTRFRCSERKQRREARRRGGGRAAGDGGGRRGRATRAARAPPRCPEPGASPFPTVSGAGAESSGPGGRRPPRHAVKSLLSLLPAPAFYERRSCLPQLNCERPHGRDLDSPFFGIRPAFMCYVPSPVLASVGDTDDRFEDLEEANPFSFREFLKTKNLGLSKEDPASRIYAKEASRHSLGLDHNSPPSQTGGYGLEYQQPFFEDPTGAGDLLDEEEDEDTGWSGAYLPSAIEQTHPERVPAGTSPCSTYLSFFSTPSELAGPESLPSWALSDTDSRVSPASPAGSPSADFAVHGESLGDRHLRTLQISYDALKDENSKLRRKLNEVQSFSEAQTEMVRTLERKLEAKMIKEESDYHDLESVVQQVEQNLELMTKRAVKAENHVVKLKQEISLLQAQVSNFQRENEALRCGQGASLTVVKQNADVALQNLRVVMNSAQASIKQLVSGAETLNLVAEILKSIDRISEVKDEEEDS

SEQ ID NO: 811543 - protein, 505 aa, Homo sapiens
VQARAFGARSGSSGERLGGAGAAERRATGAGDGGGRRGPRHGRSRGHGAAAAGLGRSCPAGPAAMSGYQRRPGATPLSRARSLAIPDGERGRAESSGPGGRRPPRHAVKSLLSLLPAPAFYERRSCLPQLNCERPHGRDLDSPFFGIRPAFMCYVPSPVLASVGDTDDRFEDLEEANPFSFREFLKTKNLGLSKEDPASRIYAKEASRHSLGLDHNSPPSQTGGYGLEYQQPFFEDPTGAGDLLDEEEDEDTGWSGAYLPSAIEQTHPERVPAGTSPCSTYLSFFSTPSELAGPESLPSWALSDTDSRVSPASPAGSPSADFAVHGESLGDRHLRTLQISYDALKDENSKLRRKLNEVQSFSEAQTEMVRTLERKLEAKMIKEESDYHDLESVVQQVEQNLELMTKRAVKAENHVVKLKQEISLLQAQVSNFQRENEALRCGQGASLTVVKQNADVALQNLRVVMNSAQASIKQLVSGAETLNLVAEILKSIDRISEVKDEEEDS

SEQ ID NO: 811544 - protein, 426 aa, Homo sapiens
VQARAFGARSGSSGERLGGAGAAERRATGAGDGGGRRGPRHGRSRGHGAAAAGLGRSCPAGPAAMSGYQRRPGATPLSRARSLAIPDDDRFEDLEEANPFSFREFLKTKNLGLSKEDPASRIYAKEASRHSLGLDHNSPPSQTGGYGLEYQQPFFEDPTGAGDLLDEEEDEDTGWSGAYLPSAIEQTHPERVPAGTSPCSTYLSFFSTPSELAGPESLPSWALSDTDSRVSPASPAGSPSADFAVHGESLGDRHLRTLQISYDALKDENSKLRRKLNEVQSFSEAQTEMVRTLERKLEAKMIKEESDYHDLESVVQQVEQNLELMTKRAVKAENHVVKLKQEISLLQAQVSNFQRENEALRCGQGASLTVVKQNADVALQNLRVVMNSAQASIKQLVSGAETLNLVAEILKSIDRISEVKDEEEDS

SEQ ID NO: 811545 - protein, 577 aa, Homo sapiens
VQARAFGARSGSSGERLGGAGAAERRATGAGDGGGRRGPRHGRSRGHGAAAAGLGRSCPAGPAAMSGYQRRPGATPLSRARSLAIPDGERGRAESSGPGGRRPPRHAVKSLLSLLPAPAFYERRSCLPQLNCERPHGRDLDSPFFGIRPAFMCYVPSPVLASVGDTGERRGRRPRGRFQFPRHVWHLRCSTSSSIDPSMCRALTACQALGIQRRSPLLGAHSLVAGRPPPRQTVPVQDDDRFEDLEEANPFSFREFLKTKNLGLSKEDPASRIYAKEASRHSLGLDHNSPPSQTGGYGLEYQQPFFEDPTGAGDLLDEEEDEDTGWSGAYLPSAIEQTHPERVPAGTSPCSTYLSFFSTPSELAGPESLPSWALSDTDSRVSPASPAGSPSADFAVHGESLGDRHLRTLQISYDALKDENSKLRRKLNEVQSFSEAQTEMVRTLERKLEAKMIKEESDYHDLESVVQQVEQNLELMTKRAVKAENHVVKLKQEISLLQAQVSNFQRENEALRCGQGASLTVVKQNADVALQNLRVVMNSAQASIKQLVSGAETLNLVAEILKSIDRISEVKDEEEDS

SEQ ID NO: 811546 - protein, 273 aa, Homo sapiens
EWPRSQRTLSIAKAQVLPGCHLRAHLVFVLLMKSRTTHCTYRTTDVLGWDWKTLIPEPLLCLKITGFYDNVFPDSRVSPASPAGSPSADFAVHGESLGDRHLRTLQISYDALKDENSKLRRKLNEVQSFSEAQTEMVRTLERKLEAKMIKEESDYHDLESVVQQVEQNLELMTKRAVKAENHVVKLKQEISLLQAQVSNFQRENEALRCGQGASLTVVKQNADVALQNLRVVMNSAQASIKQLVSGAETLNLVAEILKSIDRISEVKDEEEDS

SEQ ID NO: 811547 - protein, 355 aa, Homo sapiens
VQARAFGARSGSSGERLGGAGAAERRATGAGDGGGRRGPRHGRSRGHGAAAAGLGRSCPAGPAAMSGYQRRPGATPLSRARSLAIPDAPAFYERRSCLPQLNCERPHGRDLDSPFFGIRPAFMCYVPSPVLASVGDTDDRFEDLEEANPFSFREFLKTKNLGLSKEDPASRIYAKEASRHSLGLDHNSPPSQTGGYGLEYQQPFFEDPTGAGDLLDEEEDEDTGWSGAYLPSAIEQTHPERVPAGTSPCSTYLSFFSTPSELAGPESLPSWALSDTDSRVSPASPAGSPSADFAVHGESLGDRHLRTLQISYDAVSEPHGALWHSACPSGFSRGEPGAILPLGWPGLISRTRRFA

SEQ ID NO: 811548 - protein, 343 aa, Homo sapiens
VQARAFGARSGSSGERLGGAGAAERRATGAGDGGGRRGPRHGRSRGHGAAAAGLGRSCPAGPAAMSGYQRRPGATPLSRARSLAIPDAPAFYERRSCLPQLNCERPHGRDLDSPFFGIRPAFMCYVPSPVLASVGDTDDRFEDLEEANPFSFREFLKTKNLGLSKEDPASRIYAKEASRHSLGLDHNSPPSQTGGYGLEYQQPFFEDPTGAGDLLDEEEDEDTGWSGAYLPSAIEQTHPERVPAGTSPCSTYLSFFSTPSELAGPESLPSWALSDTDSRVSPASPAGSPSADFAVHGESLGDRHLRTLQISYDALKDENSKLRRKLNEVQSFSEAQTEMYVSF

SEQ ID NO: 811549 - protein, 476 aa, Homo sapiens; identical to SEQ ID NO: 811541

SEQ ID NO: 811550 - protein, 467 aa, Homo sapiens
VQARAFGARSGSSGERLGGAGAAERRATGAGDGGGRRGPRHGRSRGHGAAAAGLGRSCPAGPAAMSGYQRRPGATPLSRARSLAIPDAPAFYERRSCLPQLNCERPHGRDLDSPFFGIRPAFMCYVPSPVLASVGDTDDRFEDLEEANPFSFREFLKTKNLGLSKEDPASRIYAKEASRHSLGLDHNSPPSQTGGYGLEYQQPFFEDPTGAGDLLDEEEDEDTGWSGAYLPSAIEQTHPERVPAGTSPCSTYLSFFSTPSELAGPESLPSWALSDTDSRVSPASPAGSPSADFAVHGESLGDRHLRTLQISYDALKDENSKLRRKLNEVQSFSEAQTEMVRTLERKLEAKMIKEESDYHDLESVVQQKRAVKAENHVVKLKQEISLLQAQVSNFQRENEALRCGQGASLTVVKQNADVALQNLRVVMNSAQASIKQLVSGAETLNLVAEILKSIDRISEVKDEEEDS

SEQ ID NO: 811551 - protein, 444 aa, Homo sapiens
VQARAFGARSGSSGERLGGAGAAERRATGAGDGGGRRGPRHGRSRGHGAAAAGLGRSCPAGPAAMSGYQRRPGATPLSRARSLAIPDAPAFYERRSCLPQLNCERPHGRDLDSPFFGIRPAFMCYVPSPVLASVGDTDDRFEDLEEANPFSFREFLKTKNLGLSKEDPASRIYAKEASRHSLGLDHNSPPSQTGGYGLEYQQPFFEDPTGAGDLLDEEEDEDTGWSGAYLPSAIEQTHPERVPAGTSPCSTYLSFFSTPSELAGPESLPSWALSDTDSRVSPASPAGSPSADFAVHGESLGDRHLRTLQISYDALKDENSKLRRKLNEVQSFSEAQTEMVRTLERKLEAKMIKEESDYHDLESVVQQVEQNLELMTKRAVKAENHVVKLKQEISLLQAQVSNFQRENEALRCGQGASLTVVKQNADVALQNLRVVMNSAQASIK

SEQ ID NO: 811552 - protein, 138 aa, Homo sapiens
MVRTLERKLEAKMIKEESDYHDLESVVQQVEQNLELMTKRAVKAENHVVKLKQEISLLQAQVSNFQRENEALRCGQGASLTVVKQNADVALQNLRVVMNSAQASIKQLVSGAETLNLVAEILKSIDRISEVKDEEEDS

SEQ ID NO: 811553 - protein, 161 aa, Homo sapiens [sequence omitted]

SEQ ID NO: 811554 - protein, 130 aa, Homo sapiens
PPAPWVGARVRYECEDISDAFCGFSFLGEQKRAVKAENHVVKLKQEISLLQAQVSNFQRENEALRCGQGASLTVVKQNADVALQNLRVVMNSAQASIKQLVSGAETLNLVAEILKSIDRISEVKDEEEDS

SEQ ID NO: 811555 - protein, 343 aa, Homo sapiens; identical to SEQ ID NO: 811548

SEQ ID NO: 811556 - protein, 476 aa, Homo sapiens; identical to SEQ ID NO: 811541

SEQ ID NO: 811557 - protein, 476 aa, Homo sapiens; identical to SEQ ID NO: 811541

SEQ ID NO: 811558 - protein, 476 aa, Homo sapiens; identical to SEQ ID NO: 811541

SEQ ID NO: 811559 - protein, 355 aa, Homo sapiens; identical to SEQ ID NO: 811547

SEQ ID NO: 811560 - protein, 142 aa, Homo sapiens
MTRTKTVNLDNIKPQIIISKLLLTLFKSDWKTWTNQVHVLHLYVLCQYPRSSHMVDIHMEFQIQNRLPLPSCPYTSYSLFKSSICDFSFPESLKIQFENVYNTFSPVFSRLRLLLLKYTTFSLFWSRLTQYLCERELLTTLQ

SEQ ID NO: 811561 - protein, 142 aa, Homo sapiens; identical to SEQ ID NO: 811560

SEQ ID NO: 811562 - protein, 142 aa, Homo sapiens; identical to SEQ ID NO: 811560

SEQ ID NO: 811563 - protein, 81 aa, Homo sapiens
EGAEELGGEGDHVLRLAQQQEEQEVGDERVGFGVLPQIAGVAEPELLLAGDRARASAGRDPRAPGAPSRSLQGELRGAGAF

SEQ ID NO: 811564 - protein, 81 aa, Homo sapiens; identical to SEQ ID NO: 811563

SEQ ID NO: 811565 - protein, 104 aa, Homo sapiens
RQPPSPAVAGQLEGHGWVKCLAEGNSDQRAAARKQLGPHKTPEVKVRVTQRLLTIPASSSWCTSHSMPLSSGWTIVTSLRKGGKLLGLGGSTQPCYQGTCRHAM

SEQ ID NO: 811566 - protein, 76 aa, Homo sapiens
ATTAPGDLADKVASVYEAPGFFLDLEPIPGALDAVREMNDLPDTQVFICTSPLLKYHHCVGEKVWLPRPYSARGAA

SEQ ID NO: 811567 - protein, 714 aa, Homo sapiens
MNTLQGPVSFKDVAVDFTQEEWQQLDPDEKITYRDVMLENYSHLVSVGYDTTKPNVIIKLEQGEEPWIMGGEFPCQHSPEAWRVDDLIERIQENEDKHSRQAACINSKTLTEEKENTFSQIYMETSLVPSSIIAHNCVSCGKNLESISQLISSDGSYARTKPDECNECGKTYHGEKMCEFNQNGDTYSHNEENILQKISILEKPFEYNECMEALDNEAVFIAHKRAYIGEKPYEWNDSGPDFIQMSNFNAYQRSQMEMKPFECSECGKSFCKKSKFIIHQRAHTGEKPYECNVCGKSFSQKGTLTVHRRSHLEEKPYKCNECGKTFCQKLHLTQHLRTHSGEKPYECSECGKTFCQKTHLTLHQRNHSGERPYPCNECGKSFSRKSALSDHQRTHTGEKLYKCNECGKSYYRKSTLITHQRTHTGEKPYQCSECGKFFSRVSYLTIHYRSHLEEKPYECNECGKTFNLNSAFIRHRKVHTEEKSHECSECGKFSQLYLTDHHTAHLEEKPYECNECGKTFLVNSAFDGHQPLPKGEKSYECNVCGKLFNELSYYTEHYRSHSEEKPYGCSECGKTFSHNSSLFRHQRVHTGEKPYECYECGKFFSQKSYLTIHHRIHSGEKPYECSKCGKVFSRMSNLTVHYRSHSGEKPYECNECGKVFSQKSYLTVHYRTHSGEKPYECNECGKKFHHRSAFNSHQRIHRRGNMNVLDVENL

SEQ ID NO: 811568 - protein, 226 aa, Homo sapiens
SSAPSASGRARAPQTPRARSSGPAAMARSVRVLVDMDGVLADFEAGLLRGFRRRFPEEPHVPLEQRRGFLAREQYRALRPDLADKVASVYEAPGFFLDLEPIPGALDAVREMNDLPDTQVFICTSPLLKYHHCVGEKYRWVEQHLGPQFVERIILTRDKTVVLGDLLIDDKDTVRGQEETPSWEHILFTCCHNRHLVLPPTRRRLLSWSDNWREILDSKRGAAQRE

SEQ ID NO: 811569 - protein, 142 aa, Homo sapiens
SSAPSASGRARAPQTPRARSSGPAAMARSVRVLVDMDGVLADFEAGLLRGFRRRFPEEPHVPLEQRRGFLAREQYRALRPDLADKVASVYEAPGFFLDLEPIPGALDAVREMNDLPDPLLKYHHCVGEKVWLPRPYSARGAA

SEQ ID NO: 811570 - protein, 197 aa, Homo sapiens
SSAPSASGRARAPQTPRARSSGPAAMARSVRVLVDMDGVLADFEAGLLRGFRRRFPEEPHVPLEQRRGFLAREQYRALRPDLADKVASVYEAPGFFLDLEPIPGALDAVREMNDLPDTQVFICTSPLLKYHHCVGEKYRWVEQHLGPQFVERIILTRDKTVVLGDLLIDDKDTVRGQEETPSWEHILFTCCHNRHLE

SEQ ID NO: 811571 - protein, 117 aa, Homo sapiens
SSAPSASGRARAPQTPRARSSGPAAMARSVRVLVDMDGVLADFEAGLLRGFRRRFPEEPHVPLEQRRGFLAREQYRALRPDLADKVASVYEAPGFFLDLEPIPGALDAVREMNDLPE

SEQ ID NO: 811572 - protein, 106 aa, Homo sapiens
SSAPSASGRARAPQTPRARSSGPAAMARSVRVLVDMDGVLADFEAGLLRGFRRRFPEEPHVPLEQRRGFLAREQYRALRPDLAVGGAGSPPGQGPLAPFRGSPPSL

SEQ ID NO: 811573 - protein, 106 aa, Homo sapiens; identical to SEQ ID NO: 811572

SEQ ID NO: 811574 - protein, 117 aa, Homo sapiens; identical to SEQ ID NO: 811571

SEQ ID NO: 811575 - protein, 106 aa, Homo sapiens; identical to SEQ ID NO: 811572

SEQ ID NO: 811576 - protein, 234 aa, Homo sapiens
SSAPSASGRARAPQTPRARSSGPAAMARSVRVLVDMDGVLADFEAGLLRGFRRRFPEEPHVPLEQRRGFLAREQYRALRPDLAVGGAGSPPGQGPLAPFRGSPPSLWRAQSSHPGTRGQRTLGRSLWARAPDRRPLRPSELGPGAPRSLPAGPRGNGKPGPRTLVFQDKVASVYEAPGFFLDLEPIPGALDAVREMNDLPDTQVFICTSPLLKYHHCVGEKVWLPRPYSARGAA

SEQ ID NO: 811577 - protein, 177 aa, Homo sapiens
SSAPSASGRARAPQTPRARSSGPAAMARSVRVLVDMDGVLADFEAGLLRGFRRRFPEEPHVPLEQRRGFLAREQYRALRPDLADKVASVYEAPGFFLDLEPIPGALDAVREMNDLPDTQVFICTSPLLKYHHCVGEKARRRPQAGSTSCSPAATIGTWSCPRQGDGCSPGVTTGGRS

SEQ ID NO: 811578 - protein, 226 aa, Homo sapiens; identical to SEQ ID NO: 811568

SEQ ID NO: 811579 - protein, 226 aa, Homo sapiens; identical to SEQ ID NO: 811568

SEQ ID NO: 811580 - protein, 117 aa, Homo sapiens; identical to SEQ ID NO: 811571

SEQ ID NO: 811581 - protein, 234 aa, Homo sapiens; identical to SEQ ID NO: 811576

SEQ ID NO: 811582 - protein, 177 aa, Homo sapiens; identical to SEQ ID NO: 811577

SEQ ID NO: 811583 - protein, 106 aa, Homo sapiens; identical to SEQ ID NO: 811572

SEQ ID NO: 811584 - protein, 111 aa, Homo sapiens
AALPPLPAEPAPPRPRELAAPARRRWRGACACWWTWTASWPTSRPASCGASAAASLRSRTCRWSSAAASWPASSTAPCGPTWRIKWPVCTKPRAFSWTWSPSREPWTLCGR

SEQ ID NO: 811585 - protein, 106 aa, Homo sapiens; identical to SEQ ID NO: 811572

SEQ ID NO: 811586 - protein, 111 aa, Homo sapiens; identical to SEQ ID NO: 811584

SEQ ID NO: 811587 - protein, 719 aa, Homo sapiens
MAALEEEFTLSSVVLSAGPEGLLGVEQSDKTDQFLVTDSGRTVILYKVSDQKPLGSWSVKQGQIITCPAVCNFQTGEYVVVHDNKVLRIWNNEDVNLDKVFKATLSAEVYRILSVQGTEPLVLFKEGAVRGLEALLADPQQKIETVISDEEVIKWTKFFVVFRHPVLIFITEKHGNYFAYVQMFNSRILTKYTLLLGQDENSVIKSFTASVDRKFISLMSLSSDGCIYETLIPIRPADPEKNQSLVKSLLLKAVVSGNARNGVALTALDQDHVAVLGSPLAASKECLSVWNIKFQTLQTSKELPQGTSGQLWYYGEHLFMLHGKSLTVIPYKCEVSSLAGALGKLKHSQDPGTHVVSHFVNWETPQGCGLGFQNSEQSRRILRRRKIEVSLQPEVPPSKQLLSTIMKDSEKHIEVEVRKFLALKQTPDFHTVIGDTVTGLLERCKAEPSFYPRNCLMQLIQTHVLSYSLCPDLMEIALKKKDVQLLQLCLQQFPDIPESVTCACLKIFLSIGDDSLQETDVNMESVFDYSINSVHDEKMEEQTEILQNGFNPEEDKCNNCDQELNKKPQDETKESTSCPVVQKRAALLNAILHSAYSETFLLPHLKDIPAQHITLFLKYLYFLYLKCSENATMTLPGIHPPTLNQIMDWICLLLDANFTVVVMMPEAKRLLINLYKLVKSQISVYSELNKIEVSFRELQKLNQEKNNRGLYSIEVLELF

SEQ ID NO: 811588 - protein, 719 aa, Homo sapiens; identical to SEQ ID NO: 811587

SEQ ID NO: 811589 - protein, 719 aa, Homo sapiens; identical to SEQ ID NO: 811587

SEQ ID NO: 811590 - protein, 719 aa, Homo sapiens; identical to SEQ ID NO: 811587

SEQ ID NO: 811591 - protein, 592 aa, Homo sapiens
MAALEEEFTLSSVVLSAGPEGLLGVEQSDKTDQFLVTDSGRTVILYKVSDQKPLGSWSVKQGQIITCPAVCNFQTGEYVVVHDNKVLRIWNNEDVNLDKVFKATLSAEVYRILSVQGTEPLVLFKEGAVRGLEALLADPQQKIETVISDEEVIKWTKFFVVFRHPVLIFITEKHGNYFAYVQMFNSRILTKYTLLLGQDENSVIKSFTASVDRKFISLMSLSSDGCIYETLIPIRPADPEKNQSLVKSLLLKAVVSGNARNGVALTALDQDHVAVLGSPLAASKECLSVWNIKFQTLQTSKELPQGTSGQLWYYGEHLFMLHGKSLTVIPYKCEVSSLAGALGKLKHSQDPGTHVVSHFVNWETPQGCGLGFQNSEQSRRILRRRKIEVSLQPEVPPSKQLLSTIMKDSEKHIEVEVRKFLALKQTPDFHTVIGDTVTGLLERCKAEPSFYPRNCLMQLIQTHVLSYSLCPDLMEIALKKKDVQLLQLCLQQFPDIPESVTCACLKIFLSIGDDSLQETDVNMESVFDYSINSVHDEKMEEQTEILQNGFNPEEDKCNNCDQELNKKPQDETKESTSCPVVQKRAALLYPLT

SEQ ID NO: 811592 - protein, 618 aa, Homo sapiens
MPSTRKYVVDYILLQGTEPLVLFKEGAVRGLEALLADPQQKIETVISDEEVIKWTKFFVVFRHPVLIFITEKHGNYFAYVQMFNSRILTKYTLLLGQDENSVIKSFTASVDRKFISLMSLSSDGCIYETLIPIRPADPEKNQSLVKSLLLKAVVSGNARNGVALTALDQDHVAVLGSPLAASKECLSVWNIKFQTLQTSKELPQGTSGQLWYYGEHLFMLHGKSLTVIPYKCEVSSLAGALGKLKHSQDPGTHVVSHFVNWETPQGCGLGFQNSEQSRRILRRRKIEVSLQPEVPPSKQLLSTIMKDSEKHIEVEVRKFLALKQTPDFHTVIGDTVTGLLERCKAEPSFYPRNCLMQLIQTHVLSYSLCPDLMEIALKKKDVQLLQLCLQQFPDIPESVTCACLKIFLSIGDDSLQETDVNMESVFDYSINSVHDEKMEEQTEILQNGFNPEEDKCNNCDQELNKKPQDETKESTSCPVVQKRAALLNAILHSAYSETFLLPHLKDIPAQHITLFLKYLYFLYLKCSENATMTLPGIHPPTLNQIMDWICLLLDANFTVVVMMPEAKRLLINLYKLVKSQISVYSELNKIEVSFRELQKLNQEKNNRGLYSIEVLELF

SEQ ID NO: 811593 - protein, 652 aa, Homo sapiens
MAALEEEFTLSSVVLSAGPEGLLGVEQSDKTDQFLVTDSGRTVILYKVSDQKPLGSWSVKQGQIITCPAVCNFQTGEYVVVHDNKVLRIWNNEDVNLDKVFKATLSAEVYRILSVQGTEPLVLFKEGAVRGLEALLADPQQKIETVISDEEVIKWTKFFVVFRHPVLIFITEKHGNYFAYVQMFNSRILTKYTLLLGQDENSVIKSFTASVDRKFISLMSLSSDGCIYETLIPIRPADPEKNQSLVKSLLLKAVVSGNARNGVALTALDQDHVAVLGSPLAASKGTHVVSHFVNWETPQGCGLGFQNSEQSRRILRRRKIEVSLQPEVPPSKQLLSTIMKDSEKHIEVEVRKFLALKQTPDFHTVIGDTVTGLLERCKAEPSFYPRNCLMQLIQTHVLSYSLCPDLMEIALKKKDVQLLQLCLQQFPDIPESVTCACLKIFLSIGDDSLQETDVNMESVFDYSINSVHDEKMEEQTEILQNGFNPEEDKCNNCDQELNKKPQDETKESTSCPVVQKRAALLNAILHSAYSETFLLPHLKDIPAQHITLFLKYLYFLYLKCSENATMTLPGIHPPTLNQIMDWICLLLDANFTVVVMMPEAKRLLINLYKLVKSQISVYSELNKIEVSFRELQKLNQEKNNRGLYSIEVLELF

SEQ ID NO: 811594 - protein, 537 aa, Homo sapiens
MFNSRILTKYTLLLGQDENSVIKSFTASVDRKFISLMSLSSDGCIYETLIPIRPADPEKNQSLVKSLLLKAVVSGNARNGVALTALDQDHVAVLGSPLAASKECLSVWNIKFQTLQTSKELPQGTSGQLWYYGEHLFMLHGKSLTVIPYKCEVSSLAGALGKLKHSQDPGTHVVSHFVNWETPQGCGLGFQNSEQSRRILRRRKIEVSLQPEVPPSKQLLSTIMKDSEKHIEVEVRKFLALKQTPDFHTVIGDTVTGLLERCKAEPSFYPRNCLMQLIQTHVLSYSLCPDLMEIALKKKDVQLLQLCLQQFPDIPESVTCACLKIFLSIGDDSLQETDVNMESVFDYSINSVHDEKMEEQTEILQNGFNPEEDKCNNCDQELNKKPQDETKESTSCPVVQKRAALLNAILHSAYSETFLLPHLKDIPAQHITLFLKYLYFLYLKCSENATMTLPGIHPPTLNQIMDWICLLLDANFTVVVMMPEAKRLLINLYKLVKSQISVYSELNKIEVSFRELQKLNQEKNNRGLYSIEVLELF

SEQ ID NO: 811595 - protein, 537 aa, Homo sapiens; identical to SEQ ID NO: 811594

SEQ ID NO: 811596 - protein, 719 aa, Homo sapiens; identical to SEQ ID NO: 811587

SEQ ID NO: 811597 - protein, 719 aa, Homo sapiens; identical to SEQ ID NO: 811587

SEQ ID NO: 811598 - protein, 719 aa, Homo sapiens; identical to SEQ ID NO: 811587

SEQ ID NO: 811599 - protein, 711 aa, Homo sapiens
MAALEEEFTLSSVVLSAGPEGLLGVEQSDKTDQFLVTDSGRTVILYKVSDQKPLGSWSVKQGQIITCPAVCNFQTGEYVVVHDNKVLRIWNNEDVNLDKVFKATLSAEVYRILSVQGTEPLVLFKEGAVRGLEALLADPQQKIETVISDEEVIKWTKFFVVFRHPVLIFITEKHGNYFAYVQMFNSRILTKYTLLLGQDENSVIKSFTASVDRKFISLMSLSSDGCIYETLIPIRPADPEKNQSLVKSLLLKAVVSGNARNGVALTALDQDHVAVLGSPLAASKECLSVWNIKFQTLQTSKELPQGTSGQLWYYGEHLFMLHGKSLTVIPYKCEVSSLAGALGKLKHSQDPGTHVVSHFVNWETPQGCGLGFQNSEQSRRILRRRKIEVSLQPEVPPSKQLLSTIMKDSEKHIEVEVRKFLALKQTPDFHTVIGDTVTGLLERCKAEPSFYPRNCLMQLIQTHVLSYSLCPDLMEIALKKKDVQLLQLCLQQFPDIPESVTCACLKIFLSIGDDSLQETDVNMESVFDYSINSVHDEKMEEQTEILQNGFNPEEDKCNNCDQELNKKPQDETKESTSCPVVQKRAALLNAILHSAYSETFLLPHLKDIPAQHITLFLKYLYFLYLKCSENATMTLPGIHPPTLNQIMDWICLLLDANFTVVVMMPEAKRLLINLYKLVKSQARTVFCLRPSQCQEKRVSEYLDHHLTDAPG

SEQ ID NO: 811600 - protein, 672 aa, Homo sapiens
MAALEEEFTLSSVVLSAGPEGLLGVEQSDKTDQFLVTDSGRTVILYKVSDQKPLGSWSVKQGQIITCPAVCNFQTGEYVVVHDNKVLRIWNNEDVNLDKVFKATLSAEVYRILSVQGTEPLVLFKEGAVRGLEALLADPQQKIETVISDEEVIKWTKFFVVFRHPVLIFITEKHGNYFAYVQMFNSRILTKYTLLLGQDENSVIKSFTASVDRKFISLMSLSSDGCIYETLIPIRPADPEKNQSLVKSLLLKAVVSGNARNGVALTALDQDHVAVLGSPLAASKECLSVWNIKFQTLQTSKELPQGTSGQLWYYGEHLFMLHGKSLTVIPYKCEVSSLAGALGKLKHSQDPGTHVVSHFVNWETPQGCGLGFQNSEQSRRILRRRKIEVSLQPEVPPSKQLLSTIMKDSEKHIEVEVRKFLALKQTPDFHTVIGDTVTGLLERCKAEPSFYPRNCLMQLIQTHVLSYSLCPDLMEIALKKKDVQLLQLCLQQFPDIPESVTCACLKIFLSIGDDSLQETDVNMESVFDYSINSVHDEKMEEQTEILQNGFNPEEDKCNNCDQELNKKPQDETKESTSCPVVQKRAALLNAILHSAYSETFLLPHLKDIPAQHITLFLKYLYFLYLKSSLILLLAPISNPLANLVDPTFTIYLKLTTSFLTSTINGLFQGTII

SEQ ID NO: 811601 - protein, 119 aa, Homo sapiens
MEIALKKKDVQLLQLCLQQFPDIPESVTCACLKIFLSIGDDSLQETDVNMESVFDYSINSVHDEKMEEQTEILQNGFNPEEDKCNNCDQELNKKPQDETKESTSCPVVQKRAALLYPLT

SEQ ID NO: 811602 - protein, 197 aa, Homo sapiens
MESVFDYSINSVHDEKMEEQTEILQNGFNPEEDKCNNCDQELNKKPQDETKESTSCPVVQKRAALLNAILHSAYSETFLLPHLKDIPAQHITLFLKYLYFLYLKCSENATMTLPGIHPPTLNQIMDWICLLLDANFTVVVMMPEAKRLLINLYKLVKSQISVYSELNKIEVSFRELQKLNQEKNNRGLYSIEVLELF

SEQ ID NO: 811603 - protein, 200 aa, Homo sapiens
MAALEEEFTLSSVVLSAGPEGLLGVEQSDKTDQFLVTDSGRTVILYKVSDQKPLGSWSVKQGQIITCPAVCNFQTGEYVVVHDNKVLRIWNNEDVNLDKVFKATLSAEVYRILSVQGTEPLVLFKEGAVRGLEALLADPQQKIETVISDEEVIKWTKFFVVFRHPVLIFITEKHGNYFAYVQMFNSRILTKYTLLLVIKS

SEQ ID NO: 811604 - protein, 286 aa, Homo sapiens
MAALEEEFTLSSVVLSAGPEGLLGVEQSDKTDQFLVTDSGRTVILYKVSDQKPLGSWSVKQGQIITCPAVCNFQTGEYVVVHDNKVLRIWNNEDVNLDKVFKATLSAEVYRILSVQGTEPLVLFKEGAVRGLEALLADPQQKIETVISDEEVIKWTKFFVVFRHPVLIFITEKHGNYFAYVQMFNSRILTKYTLLLGQDENSVIKSFTASVDRKFISLMSLSSDGCIYETLIPIRPADPEKNQSLVKSLLLKAVVSGNARNGVALTALDQDHVAVLGSPLAASKGN

SEQ ID NO: 811605 - protein, 267 aa, Homo sapiens
MVSNSAGSNSRQLPLPLSADAPPASSSHWSWQPSRHTNQPIDRAILRSRPCCRLSRTCHWSLQPPHPPRRASGWAASLGRAAVPARARLASLVRAGSAGRARLRGAALEETEAAGGPEAQEEDEDEEEALPHSEAMDVFQEGLAMVVQDPLLCDLPIQVTLEEVNSQIALEYGQAMTVRVCKMDGEVMPVVVVQSATVLDLKKAIQRYVQLKQEREGGIQHISWSYVWRTYHLTSAGEKLTEDRKKLRDYGIRNRDEVSFIKKLRQK

SEQ ID NO: 811606 - protein, 207 aa, Homo sapiens
MVSNSAGSNSRQLPLPLSADAPPASSSHWSWQPSRHTNQPIDRAILRSRPCCRLSRTCHWSLQPPHPPRRASGWAASLGRAAVPARARLASLVRAGSAGRARLRGAALEETEAAGGPEAQEEDEDEEEALPHSEAMDVFQEGLAMVVQDPLLCDLPIQVTLEEVNSQIALEYGQAMTVRVCKMDGEVMPTWEAEVGVSFTPGRLRLQ

SEQ ID NO: 811607 - protein, 267 aa, Homo sapiens; identical to SEQ ID NO: 811605

SEQ ID NO: 811608 - protein, 267 aa, Homo sapiens; identical to SEQ ID NO: 811605

SEQ ID NO: 811609 - protein, 224 aa, Homo sapiens
MVSNSAGSNSRQLPLPLSADAPPASSSHWSWQPSRHTNQPIDRAILRSRPCCRLSRTCHWSLQPPHPPRRASGWAASLGRAAVPARARLASLVRAGSAGRARLRGAALEETEAAGGPEAQEEDEDEEEALPHSEAMDVFQEGLAMVVQDPLLCDLPIQVTLEEVNSQIALEYGQAMTVRVCKMDGEVMPVVVVQSATVLDLKKAIQRYVQLKQEREGGIQHISW

SEQ ID NO: 811610 - protein, 625 aa, Homo sapiens
RVSVSVAEMESRDPAQPMSPGEATQSGARPADRYGLLKHSREFLDFFWDIAKPEQETRLAATEKLLEYLRGRPKGSEMKYALKRLITGLGVGRETARPCYSLALAQLLQSFEDLPLCSILQQIQEKYDLHQVKKAMLRPALFANLFGVLALFQSGRLVKDQEALMKSVKLLQALAQYQNHLQEQPRKALVDILSEVSKATLQEILPEVLKADLNIILSSPEQLELFLLAQQKVPSKLKKLVGSVNLFSDENVPRLVNVLKMAASSVKKDRKLPAIALDLLRLALKEDKFPRFWKEVVEQGLLKMQFWPASYLCFHLLGAALPLLTKEQLHLVMQGDVIRHYGEHVCTAKLPKQFKFAPEMDDYVGTFLEGCQDDPERQLAVLVAFSSVTNQGLPVTPTFWRVVRFLSPPALQGYVAWLRAMFLQPDLDSLVDFSTNNQKKAQDSSLHMPERAVFRLRKWIIFRLVSIVDSLHLEMEEALTEQVARFCLFHSFFVTKKPTSQIPETKHPFSFPLENQAREAVSSAFFSLLQTLSTQFKQAPGQTQGGQPWTYHLVQFADLLLNHSHNVTTVTPFTAQQRQAWDRMLQTLKELEAHSAEARAAAFQHLLLLVGIHLLKVLGPGREGL

SEQ ID NO: 811611 - protein, 1336 aa, Homo sapiens
RVSVSVAEMESRDPAQPMSPGEATQSGARPADRYGLLKHSREFLDFFWDIAKPEQETRLAATEKLLEYLRGRPKGSEMKYALKRLITGLGVGRETARPCYSLALAQLLQSFEDLPLCSILQQIQEKYDLHQVKKAMLRPALFANLFGVLALFQSGRLVKDQEALMKSVKLLQALAQYQNHLQEQPRKALVDILSEVSKATLQEILPEVLKADLNIILSSPEQLELFLLAQQKVPSKLKKLVGSVNLFSDENVPRLVNVLKMAASSVKKDRKLPAIALDLLRLALKEDKFPRFWKEVVEQGLLKMQFWPASYLCFHLLGAALPLLTKEQLHLVMQGDVIRHYGEHVCTAKLPKQFKFAPEMDDYVGTFLEGCQDDPERQLAVLVAFSSVTNQGLPVTPTFWRVVRFLSPPALQGYVAWLRAMFLQPDLDSLVDFSTNNQKKAQDSSLHMPERAVFRLRKWIIFRLVSIVDSLHLEMEEALTEQVARFCLFHSFFVTKKPTSQIPETKHPFSFPLENQAREAVSSAFFSLLQTLSTQFKQAPGQTQGGQPWTYHLVQFADLLLNHSHNVTTVTPFTAQQRQAWDRMLQTLKELEAHSAEARAAAFQHLLLLVGIHLLKSPAESCDLLGDIQTCIRKSLGEKPRRSRTKTIDPQEPPWVEVLVEILLALLAQPSHLMRQVARSVFGHICSHLTPRALQLILDVLNPETSEDENDRVVVTDDSDERRLKGAEDKSEEGEDNRSSESEEESEGEESEEEERDGDVDQGFREQLMTVLQAGKALGGEDSENEEELGDEAMMALDQSLASLFAEQKLRIQARRDEKNKLQKEKALRRDFQIRVLDLVEVLVTKQPENALVLELLEPLLSIIRRSLRSSSSKQEQDLLHKTARIFTHHLCRARRYCHDLGERAGALHAQVERLVQQAGRQPDSPTALYHFNASLYLLRVLKGNTAEGCVHETQEKQKAGTDPSHMPTGPQAASCLDLNLVTRVYSTALSSFLTKRNSPLTVPMFLSLFSRHPVLCQSLLPILVQHITGPVRPRHQACLLLQKTLSMREVRSCFEDPEWKQLMGQVLAKVTENLRVLGEAQTKAQHQQALSSLELLNVLFRTCKHEKLTLDLTVLLGVLQGQQQSLQQGAHSTGSSRLHDLYWQAMKTLGVQRPKLEKKDAKEIPSATQSPISKKRKKKGFLPETKKRKKRKSEDGTPAEDGTPAATGGSQPPSMGRKKRNRTKAKVPAQANGTPTTKSPAPGAPTRSPSTPAKSPKLQKKNQKPSQVNGAPGSPTEPAGQKQHQKALPKKGVLGKSPLSALARKKARLSLVIRSPSLLQSGAKKKAQVRKAGKP

SEQ ID NO: 811612 - protein, 1336 aa, Homo sapiens; identical to SEQ ID NO: 811611

SEQ ID NO: 811613 - protein, 1340 aa, Homo sapiens
RVSVSVAEMESRDPAQPMSPGEATQSGARPADRYGLLKHSREFLDFFWDIAKPEQETRLAATEKLLEYLRGRPKGSEMKYALKRLITGLGVGRETARPCYSLALAQLLQSFEDLPLCSILQQIQEKYDLHQVKKAMLRPALFANLFGVLALFQSGRLVKDQEALMKSVKLLQALAQYQNHLQEQPRKALVDILSEVSKATLQEILPEVLKADLNIILSSPEQLELFLLAQQKVPSKLKKLVGSVNLFSDENVPRLVNVLKMAASSVKKDRKLPAIALDLLRLALKEDKFPRFWKEVVEQGLLKMQFWPASYLCFHLLGAALPLLTKEQLHLVMQGDVIRHYGEHVCTAKLPKQFKFAPEMDDYVGTFLEGCQDDPERQLAVLVAFSSVTNQGLPVTPTFWRVVRFLSPPALQGYVAWLRAMFLQPDLDSLVDFSTNNQKKAQDSSLHMPERAVFRLRKWIIFRLVSIVDSLHLEMEEALTEQVARFCLFHSFFVTKKPTSQIPETKHPFSFPLENQAREAVSSAFFSLLQTLSTQFKQAPGQTQGGQPWTYHLVQFADLLLNHSHNVTTVTPFTAQQRQAWDRMLQTLKELEAHSAEARAAAFQHLLLLVGIHLLKSPAESCDLLGDIQTCIRKSLGEKPRRSRTKTIDPQEPPWVEVLVEILLALLAQPSHLMRQVARSVFGHICSHLTPRALQLILDVLNPETSEDENDRVVVTDDSDERRLKGAEDKSEEGEDNRSSESEEESEGEESEEEERDGDVDQGFREQLMTVLQAGKALGGEDSENEEELGDEAMMALDQSLASLFAEQKLRIQARRDEKNKLQKEKALRRDFQIRVLDLVEVLVTKQPENALVLELLEPLLSIIRRSLRSSSSKQEQDLLHKTARIFTHHLCRARRYCHDLGERAGALHAQVERLVQQAGRQPDSPTALYHFNASLYLLRVLKGNTAEGCVHETQEKQKAGTDPSHMPTGPQAASCLDLNLVTRVYSTALSSFLTKRNSPLTVPMFLSLFSRHPVLCQSLLPILVQHITGPVRPRHQACLLLQKTLSMREVRSCFEDPEWKQLMGQVLAKVTENLRVLGEAQTKAQHQQALSSLELLNVLFRTCKHEKLTLDLTVLLGVLQGQQQSLQQGAHSTGSSRLHDLYWQAMKTLGVQRPKLEKKDAKEIPSATQSPISKKRKKKGFLPETKKRKKRKSEDGTPAEDGTPAATGGSQPPSMGRKKRNRTKAKVPAQANGTPTTKSPAPGAPTRSPSTPAKSPKLQKKNQKPSQVNGAPGSPTEPAGQKQHQKALPKKGVLGKSPLSALARKKARLSLVIRSPSLLQSGAKKKAQTLRFTISSSKK

SEQ ID NO: 811614 - protein, 1242 aa, Homo sapiens
RVSVSVAEMESRDPAQPMSPGEATQSGARPADRYGLLKHSREFLDFFWDIAKPEQETRLAATEKLLEYLRGRPKGSEMKYALKRLITGLGVGRETARPCYSLALAQLLQSFEDLPLCSILQQIQEKYDLHQVKKAMLRPALFANLFGVLALFQSGRLVKDQEALMKSVKLLQALAQYQNHLQEQPRKALVDILSEVSKATLQEILPEVLKADLNIILSSPEQLELFLLAQQKVPSKLKKLVGSVNLFSDENVPRLVNVLKMAASSVKKDRKLPAIALDLLRLALKEDKFPRFWKEVVEQGLLKMQFWPASYLCFHLLGAALPLLTKEQLHLVMQGDVIRHYGEHVCTAKLPKQFKFAPEMDDYVGTFLEGCQDDPERQLAVLVAFSSVTNQGLPVTPTFWRVVRFLSPPALQGYVAWLRAMFLQPDLDSLVDFSTNNQKKAQDSSLHMPERAVFRLRKWIIFRLVSIVDSLHLEMEEALTEQVARFCLFHSFFVTKKPTSQIPETKHPFSFPLENQAREAVSSAFFSLLQTLSTQFKQAPGQTQGGQPWTYHLVQFADLLLNHSHNVTTVTPFTAQQRQAWDRMLQTLKELEAHSAEARAAAFQHLLLLVGIHLLKSPAESCDLLGDIQTCIRKSLGEKPRRSRTKTIDPQEPPWVEVLVEILLALLAQPSHLMRQVARSVFGHICSHLTPRALQLILDVLNPETSEDENDRVVVTDDSDERRLKGAEDKSEEGEDNRSSESEEESEGEESEEEERDGDVDQGFREQLMTVLQAGKALGGEDSENEEELGDEAMMALDQSLASLFAEQKLRIQARRDEKNKLQKEKALRRDFQIRVLDLVEVLVTKQPENALVLELLEPLLSIIRRSLRSSSSKQEQDLLHKTARIFTHHLCRARRYCHDLGERAGALHAQVERLVQQAGRQPDSPTALYHFNASLYLLRVLKGNTAEGCVHETQEKQKAGTDPSHMPTGPQAASCLDLNLVTRVYSTALSSFLTKRNSPLTVPMFLSLFSRHPVLCQSLLPILVQHITGPVRPRHQACLLLQKTLSMREVRSCFEDPEWKQLMGQVLAKVTENLRVLGEAQTKAQHQQALSSLELLNVLFRTCKHEKLTLDLTVLLGVLQGQQQSLQQGAHSTGSSRLHDLYWQAMKTLGVQRPKLEKKDAKEIPSATQSPISKKRKKKGFLPETKKRKKRKSEDGTPAEDGTPAATGGSQPPSMGRKKRNRTKAKVPAQANGTPTTKSPR

SEQ ID NO: 811615 - protein, 1319 aa, Homo sapiens
RVSVSVAEMESRDPAQPMSPGEATQSGARPADRYGLLKHSREFLDFFWDIAKPEQETRLAATEKLLEYLRGRPKGSEMKYALKRLITGLGVGRETARPCYSLALAQLLQSFEDLPLCSILQQIQEKYDLHQVKKAMLRPALFANLFGVLALFQSGRLVKDQEALMKSVKLLQALAQYQNHLQEQPRKALVDILSEVSKATLQEILPEVLKADLNIILSSPEQLELFLLAQQKVPSKLKKLVGSVNLFSDENVPRLVNVLKMAASSVKKDRKLPAIALDLLRLALKEDKFPRFWKEVVEQGLLKMQFWPASYLCFHLLGAALPLLTKEQLHLVMQGDVIRHYGEHVCTAKLPKQFKFAPEMDDYVGTFLEGCQDDPERQLAVLVAFSSVTNQGLPVTPTFWRVVRFLSPPALQGYVAWLRAMFLQPDLDSLVDFSTNNQKKAQDSSLHMPERAVFRLRKWIIFRLVSIVDSLHLEMEEALTEQVARFCLFHSFFVTKKPTSQIPETKHPFSFPLENQAREAVSSAFFSLLQTLSTQFKQAPGQTQGGQPWTYHLVQFADLLLNHSHNVTTVTPFTAQQRQAWDRMLQTLKELEAHSAEARAAAFQHLLLLVGIHLLKSPAESCDLLGDIQTCIRKSLGEKPRRSRTKTIDPQEPPWVEVLVEILLALLAQPSHLMRQVARSVFGHICSHLTPRALQLILDVLNPETSEDENDRVVVTDDSDERRLKGAEDKSEEGEDNRSSESEEESEGEESEEEERDGDVDQGFREQLMTVLQAGKALGGEDSENEEELGDEAMMALDQSLASLFAEQKLRIQARRDEKNKLQKEKALRRDFQIRVLDLVEVLVTKQPENALVLELLEPLLSIIRRSLRSSSSKQEQDLLHKTARIFTHHLCRARRYCHDLGERAGALHAQVERLVQQAGRQPDSPTALYHFNASLYLLRVLKGNTAEGCVHETQEKQKAGTDPSHMPTGPQAASCLDLNLVTRVYSTALSSFLTKRNSPLTVPMFLSLFSRHPVLCQSLLPILVQHITGPVRPRHQACLLLQKTLSMREVRSCFEDPEWKQLMGQVLAKVTENLRVLGEAQTKAQHQQALSSLELLNVLFRTCKHEKLTLDLTVLLGVLQGQQQSLQQGAHSTGSSRLHDLYWQAMKTLGVQRPKLEKKDAKEIPSATQSPISKKRKKKGFLPETKKRKKRKSEDGTPAEDGTPAATGGSQPPSMGRKKRNRTKAKVPAQANGTPTTKSPAPGAPTRSPSTPAKSPKLQKKNQKPSGLGPWLQGHVQGSGVCLGWCRLMCWLQAGVTISRACHLFAPRLFCCEGATRG

SEQ ID NO: 811616 - protein, 185 aa, Homo sapiens
MARPRPVLQALLLPLQHTQSPISKKRKKKGFLPETKKRKKRKSEDGTPAEDGTPAATGGSQPPSMGRKKRNRTKAKVPAQANGTPTTKSPAPGAPTRSPSTPAKSPKLQKKNQKPSQVNGAPGSPTEPAGQKQHQKALPKKGVLGKSPLSALARKKARLSLVIRSPSLLQSGAKKKAQVRKAGKP

SEQ ID NO: 811617 - protein, 106 aa, Homo sapiens
MPAASVWVGAASPGASASALGQEALWIAASSSSRSPGYCPMDSGNGLLGPAPGKGSAQPRGRSGVLAWGVVAGREALQSWAGVHLPETLSLGAQVVYSCSQGLHPW

SEQ ID NO: 811618 - protein, 154 aa, Homo sapiens
SGTWVGSAWRSRVDRECSDQLIVLTTHRHHLCRARRYCHDLGERAGALHAQVERLVQQAGRQPDSPTALYHFNASLYLLRVLKGNTAEGCVHETQEKQKAGTDPSHMPTGPQVSRAWPRSSPRHFTAREWRPGLPQGPTLSLLMKVGQALLPSQ

SEQ ID NO: 811619 - protein, 112 aa, Homo sapiens
TWRMGDMCWVCGAVARWPGEFFSSTFSRASSLEMTCCSSCTTLRRLWFSTFRLVIRTTSSLWSPLGPLEAPGPEFPARDFWMFSLALAMSRRITLASFSWREAPATGPFICS

SEQ ID NO: 811620 - protein, 112 aa, Homo sapiens; identical to SEQ ID NO: 811619

SEQ ID NO: 811621 - protein, 351 aa, Homo sapiens [sequence omitted]

SEQ ID NO: 811622 - protein, 1528 aa, Homo sapiens
MSVAIRKRSWEEHVTHWMGQPFNSDDRNTACHHGLVADSLQASMEKDATLNVDRKEKCVSLPDCCHGSELRDFPGRPMGHLSKDVDENDSHEGEDQFLSLEASTETLVHVSDEDNNADLCLTDDKQVLNTQGQKTSGQHMIQGAGSLEKALPIIQSNQVSSNSWGIAGETELALVKESGERKVTDSISKSLELCNEISLSEIKDAPKVNAVDTLNVKDIAPEKQLLNSAVIAQQRRKPDPPKDENERSTCNVVHDEFLDIPCTNRGLPLLKTDFGSCLLQPPSCPNGMSAENGLEKSGFSQHQNKSPPKVKAEDGMQCLQLKETLATQEPTDNQVRLRKRKEIREDRDRARLDSMVLLIMKLDQLDQDIENALSTSSSPSGTPTNLRRHVPDLESGSESGADTISVNQTRVNLSSDTESTDLPSSTPVANSGTKPKTTAIQGISEKEKAEIEAKEACDWLRATGFPQYAQLYEDFLFPIDISLVKREHDFLDRDAIEALCRRLNTLNKCAVMKLEISPHRKRSDDSDEDEPCAISGKWTFQRDSKRWSRLEEFDVFSPKQDLVPGSPDDSHPKDGPSPGGTLMDLSERQEVSSVRSLSSTGSLPSHAPPSEDAATPRTNSVISVCSSSNLAGNDDSFGSLPSPKELSSFSFSMKGHEKTAKSKTRSLLKRMESLKLKSSHHSKHKAPSKLGLIISGPILQEGMDEEKLKQLNCVEISALNGNRINVPMVRKRSVSNSTQTSSSSSQSETSSAVSTPSPVTRTRSLSACNKRVGMYLEGFDPFNQSTFNNVVEQNFKNRESYPEDTVFYIPEDHKPGTFPKALTNGSFSPSGNNGSVNWRTGSFHGPGHISLRRENSSDSPKELKRRNSSSSMSSRLSIYDNVPGSILYSSSGDLADLENEDIFPELDDILYHVKGMQRIVNQWSEKFSDEGDSDSALDSVSPCPSSPKQIHLDVDNDRTTPSDLDSTGNSLNEPEEPSEIPERRDSGVGASLTRSNRHRLRWHSFQSSHRPSLNSVSLQINCQSVAQMNLLQKYSLLKLTALLEKYTPSNKHGFSWAVPKFMKRIKVPDYKDRSVFGVPLTVNVQRTGQPLPQSIQQAMRYLRNHCLDQVGLFRKSGVKSRIQALRQMNEGAIDCVNYEGQSAYDVADMLKQYFRDLPEPLMTNKLSETFLQIYQYVPKDQRLQAIKAAIMLLPDENREVLQTLLYFLSDVTAAVKENQMTPTNLAVCLAPSLFHLNTLKRENSSPRVMQRKQSLGKPDQKDLNENLAATQGLAHMIAECKKLFQVPEEMSRCRNSYTEQELKPLTLEALGHLGNDDSADYQHFLQDCVDGLFKEVKEKFKGWVSYSTSEQAELSYKKVSEGPPLRLWRSVIEVPAVPEEILKRLLKEQHLWDVDLLDSKVIEILDSQTEIYQYVQNSMAPHPARDYVVLRTWRTNLPKGACALLLTSVDHDRAPVVGVRVNVLLSRYLIEPCGPGKSKLTYMCRVDLRGHMPEWYTKSFGHLCAAEVVKIRDSFSNQNTETKDTKSR

SEQ ID NO: 811623 - protein, 499 aa, Homo sapiens
MSVAIRKRSWEEHVTHWMGQPFNSDDRNTACHHGLVADSLQASMEKDATLNVDRKEKCVSLPDCCHGSELRDFPGRPMGHLSKDVDENDSHEGEDQFLSLEASTETLVHVSDEDNNADLCLTDDKQVLNTQGQKTSGQHMIQGAGSLEKALPIIQSNQVSSNSWGIAGETELALVKESGERKVTDSISKSLELCNEISLSEIKDAPKVNAVDTLNVKDIAPEKQLLNSAVIAQQRRKPDPPKDENERSTCNVVHDEFLDIPCTNRGLPLLKTDFGSCLLQPPSCPNGMSAENGLEKSGFSQHQNKSPPKVKAEDGMQCLQLKETLATQEPTDNQVRLRKRKEIREDRDRARLDSMVLLIMKLDQLDQDIENALSTSSSPSGTPTNLRRHVPDLESGSESGADTISVNQTRVNLSSDTESTDLPSSTPVANSGTKPKTTAIQGISEKEKAAAVKSVKLEVDEDKSTKGSNFSNSEVAIGLSPYTFPQKRLFHVAGEENIT

SEQ ID NO: 811624 - protein, 1083 aa, Homo sapiens [sequence omitted]

SEQ ID NO: 811625 - protein, 1083 aa, Homo sapiens [sequence omitted]

SEQ ID NO: 811626 - protein, 1125 aa, Homo sapiens
MGDPKAHVMARPLRAPLRRSFSDHIRDSTARALDVIWKNTRDRRLAEIEAKEACDWLRATGFPQYAQLYEDFLFPIDISLVKREHDFLDRDAIEALCRRLNTLNKCAVMKLEISPHRKRSDDSDEDEPCAISGKWTFQRDSKRWSRLEEFDVFSPKQDLVPGSPDDSHPKDGPSPGGTLMDLSERQEVSSVRSLSSTGSLPSHAPPSEDAATPRTNSVISVCSSSNLAGNDDSFGSLPSPKELSSFSFSMKGHEKTAKSKTRSLLKRMESLKLKSSHHSKHKAPSKLGLIISGPILQEGMDEEKLKQLNCVEISALNGNRINVPMVRKRSVSNSTQTSSSSSQSETSSAVSTPSPVTRTRSLSACNKRVGMYLEGFDPFNQSTFNNVVEQNFKNRESYPEDTVFYIPEDHKPGTFPKALTNGSFSPSGNNGSVNWRTGSFHGPGHISLRRENSSDSPKELKRRNSSSSMSSRLSIYDNVPGSILYSSSGDLADLENEDIFPELDDILYHVKGMQRIVNQWSEKFSDEGDSDSALDSVSPCPSSPKQIHLDVDNDRTTPSDLDSTGNSLNEPEEPSEIPERRDSGVGASLTRSNRHRLRWHSFQSSHRPSLNSVSLQINCQSVAQMNLLQKYSLLKLTALLEKYTPSNKHGFSWAVPKFMKRIKVPDYKDRSVFGVPLTVNVQRTGQPLPQSIQQAMRYLRNHCLDQVGLFRKSGVKSRIQALRQMNEGAIDCVNYEGQSAYDVADMLKQYFRDLPEPLMTNKLSETFLQIYQYVPKDQRLQAIKAAIMLLPDENREVLQTLLYFLSDVTAAVKENQMTPTNLAVCLAPSLFHLNTLKRENSSPRVMQRKQSLGKPDQKDLNENLAATQGLAHMIAECKKLFQVPEEMSRCRNSYTEQELKPLTLEALGHLGNDDSADYQHFLQDCVDGLFKEVKEKFKGWVSYSTSEQAELSYKKVSEGPPLRLWRSVIEVPAVPEEILKRLLKEQHLWDVDLLDSKVIEILDSQTEIYQYVQNSMAPHPARDYVVLRTWRTNLPKGACALLLTSVDHDRAPVVGVRVNVLLSRYLIEPCGPGKSKLTYMCRVDLRGHMPEWYTKSFGHLCAAEVVKIRDSFSNQNTETKDTKSR

SEQ ID NO: 811627 - protein, 1083 aa, Homo sapiens [sequence omitted]

SEQ ID NO: 811628 - protein, 1083 aa, Homo sapiens [sequence omitted]

SEQ ID NO: 811629 - protein, 551 aa, Homo sapiens
MFSGSSAADFILTSGHSLLSSGVGSHCVRLSLLFSHHVLSAPFDPKCFRSHQELRSDSYPFFKTKGTLFFTLYQMHLIRAVPKFMKRIKVPDYKDRSVFGVPLTVNVQRTGQPLPQSIQQAMRYLRNHCLDQVGLFRKSGVKSRIQALRQMNEGAIDCVNYEGQSAYDVADMLKQYFRDLPEPLMTNKLSETFLQIYQYVPKDQRLQAIKAAIMLLPDENREVLQTLLYFLSDVTAAVKENQMTPTNLAVCLAPSLFHLNTLKRENSSPRVMQRKQSLGKPDQKDLNENLAATQGLAHMIAECKKLFQVPEEMSRCRNSYTEQELKPLTLEALGHLGNDDSADYQHFLQDCVDGLFKEVKEKFKGWVSYSTSEQAELSYKKVSEGPPLRLWRSVIEVPAVPEEILKRLLKEQHLWDVDLLDSKVIEILDSQTEIYQYVQNSMAPHPARDYVVLRTWRTNLPKGACALLLTSVDHDRAPVVGVRVNVLLSRYLIEPCGPGKSKLTYMCRVDLRGHMPEWYTKSFGHLCAAEVVKIRDSFSNQNTETKDTKSR

SEQ ID NO: 811630 - protein, 1174 aa, Homo sapiens
MVLLIMKLDQLDQDIENALSTSSSPSGTPTNLRRHVPDLESGSESGADTISVNQTRVNLSSDTESTDLPSSTPVANSGTKPKTTAIQGISEKEKAEIEAKEACDWLRATGFPQYAQLYEDFLFPIDISLVKREHDFLDRDAIEALCRRLNTLNKCAVMKLEISPHRKRSDDSDEDEPCAISGKWTFQRDSKRWSRLEEFDVFSPKQDLVPGSPDDSHPKDGPSPGGTLMDLSERQEVSSVRSLSSTGSLPSHAPPSEDAATPRTNSVISVCSSSNLAGNDDSFGSLPSPKELSSFSFSMKGHEKTAKSKTRSLLKRMESLKLKSSHHSKHKAPSKLGLIISGPILQEGMDEEKLKQLNCVEISALNGNRINVPMVRKRSVSNSTQTSSSSSQSETSSAVSTPSPVTRTRSLSACNKRVGMYLEGFDPFNQSTFNNVVEQNFKNRESYPEDTVFYIPEDHKPGTFPKALTNGSFSPSGNNGSVNWRTGSFHGPGHISLRRENSSDSPKELKRRNSSSSMSSRLSIYDNVPGSILYSSSGDLADLENEDIFPELDDILYHVKGMQRIVNQWSEKFSDEGDSDSALDSVSPCPSSPKQIHLDVDNDRTTPSDLDSTGNSLNEPEEPSEIPERRDSGVGASLTRSNRHRLRWHSFQSSHRPSLNSVSLQINCQSVAQMNLLQKYSLLKLTALLEKYTPSNKHGFSWAVPKFMKRIKVPDYKDRSVFGVPLTVNVQRTGQPLPQSIQQAMRYLRNHCLDQVGLFRKSGVKSRIQALRQMNEGAIDCVNYEGQSAYDVADMLKQYFRDLPEPLMTNKLSETFLQIYQYVPKDQRLQAIKAAIMLLPDENREVLQTLLYFLSDVTAAVKENQMTPTNLAVCLAPSLFHLNTLKRENSSPRVMQRKQSLGKPDQKDLNENLAATQGLAHMIAECKKLFQVPEEMSRCRNSYTEQELKPLTLEALGHLGNDDSADYQHFLQDCVDGLFKEVKEKFKGWVSYSTSEQAELSYKKVSEGPPLRLWRSVIEVPAVPEEILKRLLKEQHLWDVDLLDSKVIEILDSQTEIYQYVQNSMAPHPARDYVVLRTWRTNLPKGACALLLTSVDHDRAPVVGVRVNVLLSRYLIEPCGPGKSKLTYMCRVDLRGHMPEWYTKSFGHLCAAEVVKIRDSFSNQNTETKDTKSR

SEQ ID NO: 811631 - protein, 1083 aa, Homo sapiens [sequence omitted]

SEQ ID NO: 811632 - protein, 182 aa, Homo sapiens
IALALKNTSSFQVSEGPPLRLWRSVIEVPAVPEEILKRLLKEQHLWDVDLLDSKVIEILDSQTEIYQYVQNSMAPHPARDYVVLRTWRTNLPKGACALLLTSVDHDRAPVVGVRVNVLLSRYLIEPCGPGKSKLTYMCRVDLRGHMPEWYTKSFGHLCAAEVVKIRDSFSNQNTETKDTKSR

SEQ ID NO: 811633 - protein, 369 aa, Homo sapiens
YNRVARARASLPAQSPARSMAATSLMSALAARLLQPAHSCSLRLRPFHLAAVRNEAVVISGRKLAQQIKQEVRQEVEEWVASGNKRPHLSVILVGENPASHSYVLNKTRAAAVVGINSETIMKPASISEEELLNLINKLNNDDNVDGLLVQLPLPEHIDERRICNAVSPDKDVDGFHVINVGRMCLDQYSMLPATPWGVWEIIKRTGIPTLGKNVVVAGRSKNVGMPIAMLLHTDGAHERPGGDATVTISHRYTPKEQLKKHTILADIVISAAGIPNLITADMIKEGAAVIDVGINRVHDPVTAKPKLVGDVDFEGVRQKAGYITPVPGGVGPMTVAMLMKNTIIAAKKVLRLEEREVLKSKELGVATN

SEQ ID NO: 811634 - protein, 248 aa, Homo sapiens
MKPASISEEELLNLINKLNNDDNVDGLLVQLPLPEHIDERRICNAVSPDKDVDGFHVINVGRMCLDQYSMLPATPWGVWEIIKRTGIPTLGKNVVVAGRSKNVGMPIAMLLHTDGAHERPGGDATVTISHRYTPKEQLKKHTILADIVISAAGIPNLITADMIKEGAAVIDVGINRVHDPVTAKPKLVGDVDFEGVRQKAGYITPVPGGVGPMTVAMLMKNTIIAAKKVLRLEEREVLKSKELGVATN

SEQ ID NO: 811635 - protein, 228 aa, Homo sapiens
YNRVARARASLPAQSPARSMAATSLMSALAARLLQPAHSCSLRLRPFHLAAVRNEAVVISGRKLAQQIKQEVRQEVEEWVASGNKRPHLSVILVGENPASHSYVLNKTRAAAVVGINSETIMKPASISEEELLNLINKLNNDDNVDGLLVQLPLPEHIDERRICNAVSPDKDVDGFHVINVGRMCLDQYSMLPATPWGVWEIIKRTASRLAFQPKEWGLGWVTVGCPC

SEQ ID NO: 811636 - protein, 361 aa, Homo sapiens
MVIGRGSPARSMAATSLMSALAARLLQPAHSCSLRLRPFHLAAVRNEAVVISGRKLAQQIKQEVRQEVEEWVASGNKRPHLSVILVGENPASHSYVLNKTRAAAVVGINSETIMKPASISEEELLNLINKLNNDDNVDGLLVQLPLPEHIDERRICNAVSPDKDVDGFHVINVGRMCLDQYSMLPATPWGVWEIIKRTGIPTLGKNVVVAGRSKNVGMPIAMLLHTDGAHERPGGDATVTISHRYTPKEQLKKHTILADIVISAAGIPNLITADMIKEGAAVIDVGINRVHDPVTAKPKLVGDVDFEGVRQKAGYITPVPGGVGPMTVAMLMKNTIIAAKKVLRLEEREVLKSKELGVATN

SEQ ID NO: 811637 - protein, 369 aa, Homo sapiens; identical to SEQ ID NO: 811633

SEQ ID NO: 811638 - protein, 369 aa, Homo sapiens; identical to SEQ ID NO: 811633

SEQ ID NO: 811639 - protein, 369 aa, Homo sapiens; identical to SEQ ID NO: 811633

SEQ ID NO: 811640 - protein, 248 aa, Homo sapiens; identical to SEQ ID NO: 811634

SEQ ID NO: 811641 - protein, 248 aa, Homo sapiens; identical to SEQ ID NO: 811634

SEQ ID NO: 811642 - protein, 239 aa, Homo sapiens
YNRVARARASLPAQSPARSMAATSLMSALAARLLQPAHSCSLRLRPFHLAAVRNEAVVISGRKLAQQIKQEVRQEVEEWVASGNKRPHLSVILVGENPASHSYVLNKTRAAAVVGINSETIMKPASISEEELLNLINKLNNDDNVDGLLVQLPLPEHIDERRICNAVSPDKDVDGFHVINVGRMCLDQYSMLPATPWGVWEIIKRTGIPTLGKNVVVAGRSKNVMPLLQYLIDILPKSS

SEQ ID NO: 811643 - protein, 197 aa, Homo sapiens
MRGSTHASVGRMCLDQYSMLPATPWGVWEIIKRTGIPTLGKNVVVAGRSKNVGMPIAMLLHTDGAHERPGGDATVTISHRYTPKEQLKKHTILADIVISAAGIPNLITADMIKEGAAVIDVGINRVHDPVTAKPKLVGDVDFEGVRQKAGYITPVPGGVGPMTVAMLMKNTIIAAKKVLRLEEREVLKSKELGVATN

SEQ ID NO: 811644 - protein, 140 aa, Homo sapiens [sequence omitted]

SEQ ID NO: 811645 - protein, 109 aa, Homo sapiens
EGAAVIDVGISAAGIPNLITADMIKEGAAVIDVGINRVHDPVTAKPKLVGDVDFEGVRQKAGYITPVPGGVGPMTVAMLMKNTIIAAKKVLRLEEREVLKSKELGVATN

SEQ ID NO: 811646 - protein, 400 aa, Homo sapiens
YNRVARARASLPAQSPARSMAATSLMSALAARLLQPAHSCSLRLRPFHLAAVRNEAVVISGRKLAQQIKQEVRQEVEEWVASGNKRPHLSVILVGENPASHSYVLNKTRAAAVVGINSETIMKPASISEEELLNLINKLNNDDNVDGLLVQLPLPEHIDERRICNAVSPDKDVDGFHVINVGRMCLDQYSMLPATPWGVWEIIKRTGIPTLGKNVVVAGRSKNVGMPIAMLLHTDGAHERPGGDATVTISHRYTPKEQLKKHTILADIVISAAGIPNLITADMIKEGAAVIDVGINRVHDPVTAKPKLVGDVDFEGVRQKAGYITPVPGGVGPMTVAMLMKNTIIAAARAQLLPSPSPFPPRGSSNEAVVISGRKLAQQIKQEVRQEVEEWVPQATNGHT

SEQ ID NO: 811647 - protein, 361 aa, Homo sapiens
YNRVARARASLPAQSPARSMAATSLMSALAARLLQPAHSCSLRLRPFHLAAVRNEAVVISGRKLAQQIKQEVRQEVEEWVASGNKRPHLSVILVGENPASHSYVLNKTRAAAVVGINSETIMKPASISEEELLNLINKLNNDDNVDGLLVQLPLPEHIDERRICNAVSPDKDVDGFHVINVGRMCLDQYSMLPATPWGVWEIIKRTGIPTLGKNVVVAGRSKNVGMPIAMLLHTDGAHERPGGDATVTISHRYTPKEQLKKHTILADIVISAAGIPNLITADMIKEGAAVIDVGINRVHDPVTAKPKLVGDVDFEDGSLTLLPRLECSGAISAHCNLCLLGSSYSSASASRVAGTPKVLGL

SEQ ID NO: 811648 - protein, 218 aa, Homo sapiens
YNRVARARASLPAQSPARSMAATSLMSALAARLLQPAHSCSLRLRPFHLAAVRNEAVVISGRKLAQQIKQEVRQEVEEWVASGNKRPHLSVILVGENPASHSYVLNKTRAAAVVGINSETIMKPASISEEELLNLINKLNNDDNVDGLLVQLPLPEHIDERRICNAVSPDKDVDGFHVINVGRMCLDQYSMLPATPWGVWEIIKRTDSTLGRVSVVYR

SEQ ID NO: 811649 - protein, 121 aa, Homo sapiens
YNRVARARASLPAQSPARSMAATSLMSALAARLLQPAHSCSLRLRPFHLAAVRNEAVVISGRKLAQQIKQEVRQEVEEWVASGNKRPHLSVILVGENPASHSYVLNKTRAAAVVGNPSRGG

SEQ ID NO: 811650 - protein, 166 aa, Homo sapiens
PSQEKLKDFPVCVSTKPEPEDDAEEGLGGLPSNISSVSSLLLFNTTENLYKKYVFLDPLAGAVTKTHVMLGAETEEKLFDAPLSISKREQLEQQVPENYFYVPDLGQVPEIDVPSYLPDLPGIANDLMYIADLGPGIAPSAPGTIPELPTFHTEVAEPLKTYKMGY

SEQ ID NO: 811651 - protein, 128 aa, Homo sapiens
PPQVSPRKQYAMFKIELGTVGDTDGTKTHVMLGAETEEKLFDAPLSISKREQLEQQVPENYFYVPDLGQVPEIDVPSYLPDLPGIANDLMYIADLGPGIAPSAPGTIPELPTFHTEVAEPLKTYKMGY

SEQ ID NO: 811652 - protein, 166 aa, Homo sapiens; identical to SEQ ID NO: 811650

SEQ ID NO: 811653 - protein, 187 aa, Homo sapiens
PSQEKLKDFPVCVSTKPEPEDDAEEGLGGLPSNISSVSSLLLFNTTENLYKKYVFLDPLAGAVTKTHVMLGAETEEKLFDAPLSISKREQLEQQVPENYFYVPDLGQVPEIDVPSYLPDLPGIANDLMYIADLGPGIAPSAPGTIPELPTFHTEVAEPLKTPHTLCFRPTRWGTNTTPTAPTTTPSS

SEQ ID NO: 811654 - protein, 121 aa, Homo sapiens
ALPGEAEGLSCVREHQAGARGRCRRGTWGSSQQHQLCQLLAALQHHREPVPENYFYVPDLGQVPEIDVPSYLPDLPGIANDLMYIADLGPGIAPSAPGTIPELPTFHTEVAEPLKTYKMGY

SEQ ID NO: 811655 - protein, 110 aa, Homo sapiens
MSSSFLCCYSTHGRCTQGLVGCPCRSLSPLTCPCLILQVPENYFYVPDLGQVPEIDVPSYLPDLPGIANDLMYIADLGPGIAPSAPGTIPELPTFHTEVAEPLKTYKMGY

SEQ ID NO: 811656 - protein, 166 aa, Homo sapiens; identical to SEQ ID NO: 811650

SEQ ID NO: 811657 - protein, 166 aa, Homo sapiens; identical to SEQ ID NO: 811650

SEQ ID NO: 811658 - protein, 166 aa, Homo sapiens; identical to SEQ ID NO: 811650

SEQ ID NO: 811659 - protein, 166 aa, Homo sapiens; identical to SEQ ID NO: 811650

SEQ ID NO: 811660 - protein, 166 aa, Homo sapiens; identical to SEQ ID NO: 811650

SEQ ID NO: 811661 - protein, 166 aa, Homo sapiens; identical to SEQ ID NO: 811650

SEQ ID NO: 811662 - protein, 166 aa, Homo sapiens; identical to SEQ ID NO: 811650

SEQ ID NO: 811663 - protein, 161 aa, Homo sapiens
PSQEKLKDFPVCVSTKPEPEDDAEEGLGGLPSNISSVSSLLLFNTTENLYKKYVFLDPLAGAVTKTHVMLGAETEEKLFDAPLSISKREQLEQQVPENYFYVPDLGQVPEIDVPSYLPDLPGIANDLMYIADLGPGIAPSAPGTIPELPTFHTEVAEPLKT

SEQ ID NO: 811664 - protein, 110 aa, Homo sapiens
AATGRGGRGRLGIVGGSMTPSPPDPDLGHCSDMDTARTSCSDLLPWVGVTEPALCGDQLQGAEGWPEATQLGRGLLSACAPWGDGSTQPAPLCSSLKRLPEKMAHQSIKN

SEQ ID NO: 811665 - protein, 477 aa, Homo sapiens
SPTHPGPGMASPRELTQNPLKKIWMPYSNGRPALHACQRGVCMTNCPTLIVMVGLPARGKTYISKKLTRYLNWIGVPTREFNVGQYRRDVVKTYKSFEFFLPDNEEGLKIRKQCALAALRDVRRFLSEEGGHVAVFDATNTTRERRATIFNFGEQNGYKTFFVESICVDPEVIAANIVQVKLGSPDYVNRDSDEATEDFMRRIECYENSYESLDEDLDRDLSYIKIMDVGQSYVVNRVADHIQSRIVYYLMNIHVTPRSIYLCRHGESELNLKGRIGGDPGLSPRGREFAKSLAQFISDQNIKDLKVWTSQMKRTIQTAEALGVPYEQWKVLNEIDAGVCEEMTYEEIQDNYPLEFALRDQDKYRYRYPKGESYEDLVQRLEPVIMELERQENVLVICHQAVMRCLLAYFLDKAAEQLPYLKCPLHTVLKLTPVAYGCKVESIFLNVAAVNTHRDRPQNVDISRPPEEALVTVPAHQ

SEQ ID NO: 811666 - protein, 477 aa, Homo sapiens; identical to SEQ ID NO: 811665

SEQ ID NO: 811667 - protein, 458 aa, Homo sapiens
MDRGSLGGSSLTDLGPGSSRRVCMTNCPTLIVMVGLPARGKTYISKKLTRYLNWIGVPTREFNVGQYRRDVVKTYKSFEFFLPDNEEGLKIRKQCALAALRDVRRFLSEEGGHVAVFDATNTTRERRATIFNFGEQNGYKTFFVESICVDPEVIAANIVQVKLGSPDYVNRDSDEATEDFMRRIECYENSYESLDEDLDRDLSYIKIMDVGQSYVVNRVADHIQSRIVYYLMNIHVTPRSIYLCRHGESELNLKGRIGGDPGLSPRGREFAKSLAQFISDQNIKDLKVWTSQMKRTIQTAEALGVPYEQWKVLNEIDAGVCEEMTYEEIQDNYPLEFALRDQDKYRYRYPKGESYEDLVQRLEPVIMELERQENVLVICHQAVMRCLLAYFLDKAAEQLPYLKCPLHTVLKLTPVAYGCKVESIFLNVAAVNTHRDRPQNVDISRPPEEALVTVPAHQ

SEQ ID NO: 811668 - protein, 472 aa, Homo sapiens
MRARDSTGHPLMLREQTLGQHLHGEDTGEWEHTCEVCMTNCPTLIVMVGLPARGKTYISKKLTRYLNWIGVPTREFNVGQYRRDVVKTYKSFEFFLPDNEEGLKIRKQCALAALRDVRRFLSEEGGHVAVFDATNTTRERRATIFNFGEQNGYKTFFVESICVDPEVIAANIVQVKLGSPDYVNRDSDEATEDFMRRIECYENSYESLDEDLDRDLSYIKIMDVGQSYVVNRVADHIQSRIVYYLMNIHVTPRSIYLCRHGESELNLKGRIGGDPGLSPRGREFAKSLAQFISDQNIKDLKVWTSQMKRTIQTAEALGVPYEQWKVLNEIDAGVCEEMTYEEIQDNYPLEFALRDQDKYRYRYPKGESYEDLVQRLEPVIMELERQENVLVICHQAVMRCLLAYFLDKAAEQLPYLKCPLHTVLKLTPVAYGCKVESIFLNVAAVNTHRDRPQNVDISRPPEEALVTVPAHQ

SEQ ID NO: 811669 - protein, 121 aa, Homo sapiens
MYEPVESDEAVRYLKESYEDLVQRLEPVIMELERQENVLVICHQAVMRCLLAYFLDKAAEQLPYLKCPLHTVLKLTPVAYGCKVESIFLNVAAVNTHRDRPQNVDISRPPEEALVTVPAHQ

SEQ ID NO: 811670 - protein, 93 aa, Homo sapiens
MDRGSLGGSSLTDLGPGSSRRVCMTNCPTLIVMVGLPARGKTYISKKLTRYLNWIGVPTREFNVGQYRRDVVKTYKSFEFFLPDNEEGLKIRK

SEQ ID NO: 811671 - protein, 387 aa, Homo sapiens
RVYPLNAGTLQPGPMGRAGLEAPPPPCGVTGTPGARGLQGRVGPRPQSLAFRGCPPRASSLPGSPRCRRRCHTMAFVTRQFMRSVSSSSTASASAKKIIVKHVTVIGGGLMGAGIAQVAAATGHTVVLVDQTEDILAKSKKGIEESLRKVAKKKFAENPKAGDEFVEKTLSTIATSTDAASVVHSTDLVVEAIVENLKVKNELFKRLDKFAAEHTIFASNTSSLQITSIANATTRQDRFAGLHFFNPVPVMKLVEVIKTPMTSQKTFESLVDFSKALGKHPVSCKDTPGFIVNRLLVPYLMEAIRLYERGDASKEDIDTAMKLGAGYPMGPFELLDYVGLDTTKFIVDGWHEMDAENPLHQPSPSLNKLVAENKFGKKTGEGFYKYK

SEQ ID NO: 811672 - protein, 387 aa, Homo sapiens; identical to SEQ ID NO: 811671

SEQ ID NO: 811673 - protein, 387 aa, Homo sapiens; identical to SEQ ID NO: 811671

SEQ ID NO: 811674 - protein, 387 aa, Homo sapiens; identical to SEQ ID NO: 811671

SEQ ID NO: 811675 - protein, 404 aa, Homo sapiens
RVYPLNAGTLQPGPMGRAGLEAPPPPCGVTGTPGARGLQGRVGPRPQSLAFRGCPPRASSLPGSPRCRRRCHTMAFVTRQFMRSVSSSSTASASAKKIIVKHVTVIGGGLMGAGIAQVAAATGHTVVLVDQTEDILAKSKKGIEESLRKVAKKKFAENPKAGDEFVEKTLSTIATSTDAASVVHSTDLVVEAIVENLKVKNELFKRLDKFAAEHTIFASNTSSLQITSIANATTRQDRFAGLHFFNPVPVMKLVEVIKTPMTSQKTFESLVDFSKALGKHPVSCKDTPGFIVNRLLVPYLMEAIRLYERDFQTCGDSNSGLGFSLKGDASKEDIDTAMKLGAGYPMGPFELLDYVGLDTTKFIVDGWHEMDAENPLHQPSPSLNKLVAENKFGKKTGEGFYKYK

SEQ ID NO: 811676 - protein, 472 aa, Homo sapiens
RVYPLNAGTLQPGPMGRAGLEAPPPPCGVTGTPGARGLQGRVGPRPQSLAFRGCPPRASSLPGSPRCRRRCHTMAFVTRQFMRSVSSSSTASASAKKIIVKHVTVIGGGLMGAGIAQERGVASAAMRDNSFKKGMKREVRWKRDFEGQKKQLKNMCRTALGVTTLQDLGVCWRKEHDPAEMLRVGRAELGGWKPSWEAIVKEVAAATGHTVVLVDQTEDILAKSKKGIEESLRKVAKKKFAENPKAGDEFVEKTLSTIATSTDAASVVHSTDLVVEAIVENLKVKNELFKRLDKFAAEHTIFASNTSSLQITSIANATTRQDRFAGLHFFNPVPVMKLVEVIKTPMTSQKTFESLVDFSKALGKHPVSCKDTPGFIVNRLLVPYLMEAIRLYERGDASKEDIDTAMKLGAGYPMGPFELLDYVGLDTTKFIVDGWHEMDAENPLHQPSPSLNKLVAENKFGKKTGEGFYKYK

SEQ ID NO: 811677 - protein, 387 aa, Homo sapiens; identical to SEQ ID NO: 811671

SEQ ID NO: 811678 - protein, 256 aa, Homo sapiens
RVYPLNAGTLQPGPMGRAGLEAPPPPCGVTGTPGARGLQGRVGPRPQSLAFRGCPPRASSLPGSPRCRRRCHTMAFVTRQFMRSVSSSSTASASAKKIIVKHVTVIGGGLMGAGIAQVAAATGHTVVLVDQTEDILAKSKKGIEESLRKVAKKKFAENPKAGDEFVEKTLSTIATSTDAASVVHSTDLVVEAIVENLKVKNELFKRLDKFAAEHTIFASNTSSLQITSIANATTRQDRFAGLHFFNPVPVMKLVEP

SEQ ID NO: 811679 - protein, 352 aa, Homo sapiens
RVYPLNAGTLQPGPMGRAGLEAPPPPCGVTGTPGARGLQGRVGPRPQSLAFRGCPPRASSLPGSPRCRRRCHTMAFVTRQFMRSVSSSSTASASAKKIIVKHVTVIGGGLMGAGIAQVAAATGHTVVLVDQTEDILAKSKKGIEESLRKVAKKKFAENPKAGDEFVEKTLSTIATSTDAASVVHSTDLVVEAIVENLKVKNELFKRLDKFAAEHTIFASNTSSLQITSIANATTRQDRFAGLHFFNPVPVMKLVEVIKTPMTSQKTFESLVDFSKALGKHPVSCKDTPGFIVNRLLVPYLMEAIRLYERGILLTQARSSRPQLLAPLSGILSVSRRGRAVHNGGSSVCFLAL

SEQ ID NO: 811680 - protein, 382 aa, Homo sapiens
RVYPLNAGTLQPGPMGRAGLEAPPPPCGVTGTPGARGLQGRVGPRPQSLAFRGCPPRASSLPGSPRCRRRCHTMAFVTRQFMRSVSSSSTASASAKKIIVKHVTVIGGGLMGAGIAQVAAATGHTVVLVDQTEDILAKSKKGIEESLRKVAKKKFAENPKAGDEFVEKTLSTIATSTDAASVVHSTDLVVEAIVENLKVKNELFKRLDKFAAEHTIFASNTSSLQITSIANATTRQDRFAGLHFFNPVPVMKLVEVIKTPMTSQKTFESLVDFSKALGKHPVSCKDTPGFIVNRLLVPYLMEAIRLYERGLQEEIVLFELEPVPQGPIEVLNILAGNHTHSGGEKEWNHICRPYNVGKWDRRVNNGFGEKGQHAGASPIEKD

SEQ ID NO: 811681 - protein, 404 aa, Homo sapiens; identical to SEQ ID NO: 811675

SEQ ID NO: 811682 - protein, 152 aa, Homo sapiens
RLCRAPARPPRRRRLLFPAGARGALKQGPRQPAPERVLRSKDGWGFLCVFSGRGWDGVVAAPRGNRGGLREDGTSALELSSPDLLFRSTLAEEVGTDMVFVGQRCEQWSHQKGLLPASSPTTDIPGPTRPPGQVLSPASQIWGPFTCLYYCK

SEQ ID NO: 811683 - protein, 152 aa, Homo sapiens; identical to SEQ ID NO: 811682

SEQ ID NO: 811684 - protein, 124 aa, Homo sapiens
RLCRAPARPPRRRRLLFPAGARGALKQGPRQPAPERVLRSKDGWGFLCVFSGRGWDGVVAAPREEVGTDMVFVGQRCEQWSHQKGLLPASSPTTDIPGPTRPPGQVLSPASQIWGPFTCLYYCK

SEQ ID NO: 811685 - protein, 147 aa, Homo sapiens
RLCRAPARPPRRRRLLFPAGARGALKQGPRQPAPERVLRSKDGWGFLCVFSGRGWDGVVAAPRGNRGGLREDGTSALELSSPDLLFRSTLAEEVGTDMVFVGQRCEQWSHQKGLLPASSPTTDIPGPTRPPGQVLSPASQFLKEGPK

SEQ ID NO: 811686 - protein, 1321 aa, Homo sapiens [sequence omitted]

SEQ ID NO: 811687 - protein, 1156 aa, Homo sapiens
MVLTLGESWPVLVGRRFLSLSAADGSDGSHDSWDVERVAEWPWLSGTIRAVSHTDVTKKDLKVCVEFDGESWRKRRWIEVYSLLRRAFLVEHNLVLAERKSPEISERIVQWPAITYKPLLDKAGLGSITSVRFLGDQQRVFLSKDLLKPIQDVNSLRLSLTDNQIVSKEFQALIVKHLDESHLLKGDKNLVGSEVKIYSLDPSTQWFSATVVNGNPASKTLQVNCEEIPALKIVDPSLIHVEVVHDNLVTCGNSARIGAVKRKSSENNGTLVSKQAKSCSEASPSMCPVQSVPTTVFKEILLGCTAATPPSKDPRQQSTPQAANSPPNLGAKIPQGCHKQSLPEEISSCLNTKSEALRTKPDVCKAGLLSKSSQIGTGDLKILTEPKGSCTQPKTNTDQENRLESVPQALTGLPKECLPTKASSKAELEIANPPELQKHLEHAPSPSDVSNAPEVKAGVNSDSPNNCSGKKVEPSALACRSQNLKESSVKVDNESCCSRSNNKIQNAPSRKSVLTDPAKLKKLQQSGEAFVQDDSCVNIVAQLPKCRECRLDSLRKDKEQQKDSPVFCRFFHFRRLQFNKHGVLRVEGFLTPNKYDNEAIGLWLPLTKNVVGIDLDTAKYILANIGDHFCQMVISEKEAMSTIEPHRQVAWKRAVKGVREMCDVCDTTIFNLHWVCPRCGFGVCVDCYRMKRKNCQQGAAYKTFSWLKCVKSQIHEPENLMPTQIIPGKALYDVGDIVHSVRAKWGIKANCPCSNRQFKLFSKPASKEDLKQTSLAGEKPTLGAVLQQNPSVLEPAAVGGEAASKPAGSMKPACPASTSPLNWLADLTSGNVNKENKEKQPTMPILKNEIKCLPPLPPLSKSSTVLHTFNSTILTPVSNNNSGFLRNLLNSSTGKTENGLKNTPKILDDIFASLVQNKTTSDLSKRPQGLTIKPSILGFDTPHYWLCDNRLLCLQDPNNKSNWNVFRECWKQGQPVMVSGVHHKLNSELWKPESFRKEFGEQEVDLVNCRTNEIITGATVGDFWDGFEDVPNRLKNEKEPMVLKLKDWPPGEDFRDMMPSRFDDLMANIPLPEYTRRDGKLNLASRLPNYFVRPDLGPKMYNAYGLITPEDRKYGTTNLHLDVSDAANVMVYVGIPKGQCEQEEGRVLSIKGGLTL

SEQ ID NO: 811688 - protein, 643 aa, Homo sapiens
MCDVCDTTIFNLHWVCPRCGFGVCVDCYRMKRKNCQQGAAYKTFSWLKCVKSQIHEPENLMPTQIIPGKALYDVGDIVHSVRAKWGIKANCPCSNRQFKLFSKPASKEDLKQTSLAGEKPTLGAVLQQNPSVLEPAAVGGEAASKPAGSMKPACPASTSPLNWLADLTSGNVNKENKLPPLSKSSTVLHTFNSTILTPVSNNNSGFLRNLLNSSTGKTENGLKNTPKILDDIFASLVQNKTTSDLSKRPQGLTIKPSILGFDTPHYWLCDNRLLCLQDPNNKSNWNVFRECWKQGQPVMVSGVHHKLNSELWKPESFRKEFGEQEVDLVNCRTNEIITGATVGDFWDGFEDVPNRLKNEKEPMVLKLKDWPPGEDFRDMMPSRFDDLMANIPLPEYTRRDGKLNLASRLPNYFVRPDLGPKMYNAYGLITPEDRKYGTTNLHLDVSDAANVMVYVGIPKGQCEQEEEVLKTIQDGDSDELTIKRFIEGKEKPGALWHIYAAKDTEKIREFLKKVSEEQGQENPADHDPIHDQSWYLDRSLRKRLHQEYGVQGWAIVQFLGDVVFIPAGAPHQVHNLYSCIKVAEDFVSPEHVKHCFWLTQEFRYLSQTHTNHEDKLQVKNVIYHAVKDAVAMLKASESSFGKP

SEQ ID NO: 811689 - protein, 302 aa, Homo sapiens
GDLYFAAPCCLLDRLKNEKEPMVLKLKDWPPGEDFRDMMPSRFDDLMANIPLPEYTRRDGKLNLASRLPNYFVRPDLGPKMYNAYGLITPEDRKYGTTNLHLDVSDAANVMVYVGIPKGQCEQEEEVLKTIQDGDSDELTIKRFIEGKEKPGALWHIYAAKDTEKIREFLKKVSEEQGQENPADHDPIHDQSWYLDRSLRKRLHQEYGVQGWAIVQFLGDVVFIPAGAPHQVHNLYSCIKVAEDFVSPEHVKHCFWLTQEFRYLSQTHTNHEDKLQVKNVIYHAVKDAVAMLKASESSFGKP

SEQ ID NO: 811690 - protein, 1198 aa, Homo sapiens [sequence omitted]

SEQ ID NO: 811691 - protein, 1069 aa, Homo sapiens
MVLTLGESWPVLVGRRFLSLSAADGSDGSHDSWDVERVAEWPWLSGTIRAVSHTDVTKKDLKVCVEFDGESWRKRRWIEVYSLLRRAFLVEHNLVLAERKSPEISERIVQWPAITYKPLLDKAGLGSITSVRFLGDQQRVFLSKDLLKPIQDVNSLRLSLTDNQIVSKEFQALIVKHLDESHLLKGDKNLVGSEVKIYSLDPSTQWFSATVVNGNPASKTLQVNCEEIPALKIVDPSLIHVEVVHDNLVTCGNSARIGAVKRKSSENNGTLVSKQAKSCSEASPSMCPVQSVPTTVFKEILLGCTAATPPSKDPRQQSTPQAANSPPNLGAKIPQGCHKQSLPEEISSCLNTKSEALRTKPDVCKAGLLSKSSQIGTGDLKILTEPKGSCTQPKTNTDQENRLESVPQALTGLPKECLPTKASSKAELEIANPPELQKHLEHAPSPSDVSNAPEVKAGVNSDSPNNCSGKKVEPSALACRSQNLKESSVKVDNESCCSRSNNKIQNAPSRKSVLTDPAKLKKLQQSGEAFVQDDSCVNIVAQLPKCRECRLDSLRKDKEQQKDSPVFCRFFHFRRLQFNKHGVLRVEGFLTPNKYDNEAIGLWLPLTKNVVGIDLDTAKYILANIGDHFCQMVISEKEAMSTIEPHRQVAWKRAVKGVREMCDVCDTTIFNLHWVCPRCGFGVCVDCYRMKRKNCQQGAAYKTFSWLKCVKSQIHEPENLMPTQIIPGKALYDVGDIVHSVRAKWGIKANCPCSNRQFKLFSKPASKEDLKQTSLAGEKPTLGAVLQQNPSVLEPAAVGGEAASKPAGSMKPACPASTSPLNWLADLTSGNVNKENKEKQPTMPILKNEIKCLPPLPPLSKSSTVLHTFNSTILTPVSNNNSGFLRNLLNSSTGKTENGLKNTPKILDDIFASLVQNKTTSDLSKRPQGLTIKPSILGFDTPHYWLCDNRLLCLQDPNNKSNWNVFRECWKQGQPVMVSGVHHKLNSELWKPESFRKEFGEQEVDLVNCRTNEIITGATVGDFWDGFEDVPNRLKNEKEPMVLKLKDWPPGEDFRDMMPSRYDYEGGER

SEQ ID NO: 811692 - protein, 262 aa, Homo sapiens
MVLTLGESWPVLVGRRFLSLSAADGSDGSHDSWDVERVAEWPWLSGTIRAVSHTDVTKKDLKVCVEFDGESWRKRRWIEVYSLLRRAFLVEHNLVLAERKSPEISERIVQWPAITYKPLLDKAGLGSITSVRFLGDQQRVFLSKDLLKPIQDVNSLRLSLTDNQIVSKEFQALIVKHLDESHLLKGDKNLVGSEVKIYSLDPSTQWFSATVVNGNPASKTLQVNCEEVKTTITLCKITRQSMITIQSIYDFLGTKYLYYFIG

SEQ ID NO: 811693 - protein, 122 aa, Homo sapiens
AAPRGAGPGGCACLVRALEPSQRWSRLGGWKRRLPPVTQGGGRRGRSSSCRRGNHGAHARRKLAGIGGEEVSQSVRSRRQRWQPRQLGRGARRRVALALRDHSSCFPHRRYQEGSEDLFKDR

SEQ ID NO: 811694 - protein, 1321 aa, Homo sapiens [sequence omitted]

SEQ ID NO: 811695 - protein, 512 aa, Homo sapiens
MKPACPASTSPLNWLADLTSGNVNKENKEKQPTMPILKNEIKCLPPLPPLSKSSTVLHTFNSTILTPVSNNNSGFLRNLLNSSTGKTENGLKNTPKILDDIFASLVQNKTTSDLSKRPQGLTIKPSILGFDTPHYWLCDNRLLCLQDPNNKSNWNVFRECWKQGQPVMVSGVHHKLNSELWKPESFRKEFGEQEVDLVNCRTNEIITGATVGDFWDGFEDVPNRLKNEKEPMVLKLKDWPPGEDFRDMMPSRFDDLMANIPLPEYTRRDGKLNLASRLPNYFVRPDLGPKMYNAYGLITPEDRKYGTTNLHLDVSDAANVMVYVGIPKGQCEQEEEVLKTIQDGDSDELTIKRFIEGKEKPGALWHIYAAKDTEKIREFLKKVSEEQGQENPADHDPIHDQSWYLDRSLRKRLHQEYGVQGWAIVQFLGDVVFIPAGAPHQVHNLYSCIKVAEDFVSPEHVKHCFWLTQEFRYLSQTHTNHEDKLQVKNVIYHAVKDAVAMLKASESSFGKP

SEQ ID NO: 811696 - protein, 192 aa, Homo sapiens [sequence omitted]

SEQ ID NO: 811697 - protein, 613 aa, Homo sapiens
MVLTLGESWPVLVGRRFLSLSAADGSDGSHDSWDVERVAEWPWLSGTIRAVSHTDVTKKDLKVCVEFDGESWRKRRWIEVYSLLRRAFLVEHNLVLAERKSPEISERIVQWPAITYKPLLDKAGLGSITSVRFLGDQQRVFLSKDLLKPIQDVNSLRLSLTDNQIVSKEFQALIVKHLDESHLLKGDKNLVGSEVKIYSLDPSTQWFSATVVNGNPASKTLQVNCEEIPALKIVDPSLIHVEVVHDNLVTCGNSARIGAVKRKSSENNGTLVSKQAKSCSEASPSMCPVQSVPTTVFKEILLGCTAATPPSKDPRQQSTPQAANSPPNLGAKIPQGCHKQSLPEEISSCLNTKSEALRTKPDVCKAGLLSKSSQIGTGDLKILTEPKGSCTQPKTNTDQENRLESVPQALTGLPKECLPTKASSKAELEIANPPELQKHLEHAPSPSDVSNAPEVKAGVNSDSPNNCSGKKVEPSALACRSQNLKESSVKVDNESCCSRSNNKIQNAPSRKSVLTDPAKLKKLQQSGEAFVQDDSCVNIVAQLPKCRECRLDSLRKDKEQQKDSPVFCRFFHFRRLQFNKHGVLRVEGFLTPNKYDNEDGGVLNKSGGCLASK

SEQ ID NO: 811698 - protein, 108 aa, Homo sapiens
MVLTLGESWPVLVGRRFLSLSAADGSDGSHDSWDVERVAEWPWLSGTIRAVSHTDVTKKDLKVRRLRASATGRFAVTVVTRPSVPSFRFLKTETRKLAYDLKVQEARS

SEQ ID NO: 811699 - protein, 79 aa, Homo sapiens
FDDLMANIPLPEYTRRDGKLNLASRLPNYFVRPDLGPKMYNAYGKEEMANFKMEIKQFKMFGKLILWEGEVENTHNPNA

SEQ ID NO: 811700 - protein, 1259 aa, Homo sapiens
GVSRAGYLSSRAYGAACPTAAGAAAVMGFLKLIEIENFKSYKGRQIIGPFQRFTAIIGPNGSGKSNLMDAISFVLGEKTSNLRVKTLRDLIHGAPVGKPAANRAFVSMVYSEEGAEDRTFARVIVGGSSEYKINNKVVQLHEYSEELEKLGILIKARNFLVFQGAVESIAMKNPKERTALFEEISRSGELAQEYDKRKKEMVKAEEDTQFNYHRKKNIAAERKEAKQEKEEADRYQRLKDEVVRAQVQLQLFKLYHNEVEIEKLNKELASKNKEIEKDKKRMDKVEDELKEKKKELGKMMREQQQIEKEIKEKDSELNQKRPQYIKAKENTSHKIKKLEAAKKSLQNAQKHYKKRKGDMDELEKEMLSVEKARQEFEERMEEESQSQGRDLTLEENQVKKYHRLKEEASKRAATLAQELEKFNRDQKADQDRLDLEERKKVETEAKIKQKLREIEENQKRIEKLEEYITTSKQSLEEQKKLEGELTEEVEMAKRRIDEINKELNQVMEQLGDARIDRQESSRQQRKAEIMESIKRLYPGSVYGRLIDLCQPTQKKYQIAVTKVLGKNMDAIIVDSEKTGRDCIQYIKEQRGEPETFLPLDYLEVKPTDEKLRELKGAKLVIDVIRYEPPHIKKALQYACGNALVCDNVEDARRIAFGGHQRHKTVALDGTLFQKSGVISGGASDLKAKARRWDEKAVDKLKEKKERLTEELKEQMKAKRKEAELRQVQSQAHGLQMRLKYSQSDLEQTKTRHLALNLQEKSKLESELANFGPRINDIKRIIQSREREMKDLKEKMNQVEDEVFEEFCREIGVRNIREFEEEKVKRQNEIAKKRLEFENQKTRLGIQLDFEKNQLKEDQDKVHMWEQTVKKDENEIEKLKKEEQRHMKIIDETMAQLQDLKNQHLAKKSEVNDKNHEMEEIRKKLGGANKEMTHLQKEVTAIETKLEQKRSDRHNLLQACKMQDIKLPLSKGTMDDISQEEGSSQGEDSVSGSQRISSIYAREALIEIDYGDLCEDLKDAQAEEEIKQEMNTLQQKLNEQQSVLQRIAAPNMKAMEKLESVRDKFQETSDEFEAARKRAKKAKQAFEQIKKERFDRFNACFESVATNIDEIYKALSRNSSAQAFLGPENPEEPYLDGINYNCVAPGKRFRPMDNLSGGEKTVAALALLFAIHSYKPAPFFVLDEIDAALDNTNIGKVANYIKEQSTCNFQAIVISLKEEFYTKAESLIGVYPEQGDCVISKVLTFDLTKYPDANPNPNEQ

SEQ ID NO: 811701 - protein, 1259 aa, Homo sapiens; identical to SEQ ID NO: 811700

SEQ ID NO: 811702 - protein, 1259 aa, Homo sapiens; identical to SEQ ID NO: 811700

SEQ ID NO: 811703 - protein, 1099 aa, Homo sapiens [sequence omitted]

SEQ ID NO: 811704 - protein, 843 aa, Homo sapiens
TWHFSEEENQVKKQQKSIETGRKKVETEAKIKQKLREIEENQKRIEKLEEYITTSKQSLEEQKKLEGELTEEVEMAKRRIDEINKELNQVMEQLGDARIDRQESSRQQRKAEIMESIKRLYPGSVYGRLIDLCQPTQKKYQIAVTKVLGKNMDAIIVDSEKTGRDCIQYIKEQRGEPETFLPLDYLEVKPTDEKLRELKGAKLVIDVIRYEPPHIKKALQYACGNALVCDNVEDARRIAFGGHQRHKTVALDGTLFQKSGVISGGASDLKAKARRWDEKAVDKLKEKKERLTEELKEQMKAKRKEAELRQVQSQAHGLQMRLKYSQSDLEQTKTRHLALNLQEKSKLESELANFGPRINDIKRIIQSREREMKDLKEKMNQVEDEVFEEFCREIGVRNIREFEEEKVKRQNEIAKKRLEFENQKTRLGIQLDFEKNQLKEDQDKVHMWEQTVKKDENEIEKLKKEEQRHMKIIDETMAQLQDLKNQHLAKKSEVNDKNHEMEEIRKKLGGANKEMTHLQKEVTAIETKLEQKRSDRHNLLQACKMQDIKLPLSKGTMDDISQEEGSSQGEDSVSGSQRISSIYAREALIEIDYGDLCEDLKDAQAEEEIKQEMNTLQQKLNEQQSVLQRIAAPNMKAMEKLESVRDKFQETSDEFEAARKRAKKAKQAFEQIKKERFDRFNACFESVATNIDEIYKALSRNSSAQAFLGPENPEEPYLDGINYNCVAPGKRFRPMDNLSGGEKTVAALALLFAIHSYKPAPFFVLDEIDAALDNTNIGKVANYIKEQSTCNFQAIVISLKEEFYTKAESLIGVYPEQGDCVISKVLTFDLTKYPDANPNPNEQ

SEQ ID NO: 811705 - protein, 629 aa, Homo sapiens
WIPLPRLELDRLSTGDSFVQLLPLFSLPPAVCETVALDGTLFQKSGVISGGASDLKAKARRWDEKAVDKLKEKKERLTEELKEQMKAKRKEAELRQVQSQAHGLQMRLKYSQSDLEQTKTRHLALNLQEKSKLESELANFGPRINDIKRIIQSREREMKDLKEKMNQVEDEVFEEFCREIGVRNIREFEEEKVKRQNEIAKKRLEFENQKTRLGIQLDFEKNQLKEDQDKVHMWEQTVKKDENEIEKLKKEEQRHMKIIDETMAQLQDLKNQHLAKKSEVNDKNHEMEEIRKKLGGANKEMTHLQKEVTAIETKLEQKRSDRHNLLQACKMQDIKLPLSKGTMDDISQEEGSSQGEDSVSGSQRISSIYAREALIEIDYGDLCEDLKDAQAEEEIKQEMNTLQQKLNEQQSVLQRIAAPNMKAMEKLESVRDKFQETSDEFEAARKRAKKAKQAFEQIKKERFDRFNACFESVATNIDEIYKALSRNSSAQAFLGPENPEEPYLDGINYNCVAPGKRFRPMDNLSGGEKTVAALALLFAIHSYKPAPFFVLDEIDAALDNTNIGKVANYIKEQSTCNFQAIVISLKEEFYTKAESLIGVYPEQGDCVISKVLTFDLTKYPDANPNPNEQ

SEQ ID NO: 811706 - protein, 473 aa, Homo sapiens
RTKTEISEMNRVEDEVFEEFCREIGVRNIREFEEEKVKRQNEIAKKRLEFENQKTRLGIQLDFEKNQLKEDQDKVHMWEQTVKKDENEIEKLKKEEQRHMKIIDETMAQLQDLKNQHLAKKSEVNDKNHEMEEIRKKLGGANKEMTHLQKEVTAIETKLEQKRSDRHNLLQACKMQDIKLPLSKGTMDDISQEEGSSQGEDSVSGSQRISSIYAREALIEIDYGDLCEDLKDAQAEEEIKQEMNTLQQKLNEQQSVLQRIAAPNMKAMEKLESVRDKFQETSDEFEAARKRAKKAKQAFEQIKKERFDRFNACFESVATNIDEIYKALSRNSSAQAFLGPENPEEPYLDGINYNCVAPGKRFRPMDNLSGGEKTVAALALLFAIHSYKPAPFFVLDEIDAALDNTNIGKVANYIKEQSTCNFQAIVISLKEEFYTKAESLIGVYPEQGDCVISKVLTFDLTKYPDANPNPNEQ

SEQ ID NO: 811707 - protein, 472 aa, Homo sapiens [sequence omitted]

SEQ ID NO: 811708 - protein, 1259 aa, Homo sapiens; identical to SEQ ID NO: 811700

SEQ ID NO: 811709 - protein, 961 aa, Homo sapiens
GVSRAGYLSSRAYGAACPTAAGAAAVMGFLKLIEIENFKSYKGRQIIGPFQRFTAIIGPNGSGKSNLMDAISFVLGEKTSNLRVKTLRDLIHGAPVGKPAANRAFVSMVYSEEGAEDRTFARVIVGGSSEYKINNKVVQLHEYSEELEKLGILIKARNFLVFQGAVESIAMKNPKERTALFEEISRSGELAQEYDKRKKEMVKAEEDTQFNYHRKKNIAAERKEAKQEKEEADRYQRLKDEVVRAQVQLQLFKLYHNEVEIEKLNKELASKNKEIEKDKKRMDKVEDELKEKKKELGKMMREQQQIEKEIKEKDSELNQKRPQYIKAKENTSHKIKKLEAAKKSLQNAQKHYKKRKGDMDELEKEMLSVEKARQEFEERMEEESQSQGRDLTLEENQVKKYHRLKEEASKRAATLAQELEKFNRDQKADQDRLDLEERKKVETEAKIKQKLREIEENQKRIEKLEEYITTSKQSLEEQKKLEGELTEEVEMAKRRIDEINKELNQVMEQLGDARIDRQESSRQQRKAEIMESIKRLYPGSVYGRLIDLCQPTQKKYQIAVTKVLGKNMDAIIVDSEKTGRDCIQYIKEQRGEPETFLPLDYLEVKPTDEKLRELKGAKLVIDVIRYEPPHIKKALQYACGNALVCDNVEDARRIAFGGHQRHKTVALDGTLFQKSGVISGGASDLKAKARRWDEKAVDKLKEKKERLTEELKEQMKAKRKEAELRQVQSQAHGLQMRLKYSQSDLEQTKTRHLALNLQEKSKLESELANFGPRINDIKRIIQSREREMKDLKEKMNQVEDEVFEEFCREIGVRNIREFEEEKVKRQNEIAKKRLEFENQKTRLGIQLDFEKNQLKEDQDKVHMWEQTVKKDENEIEKLKKELASKNKEIEKDKKRMDKVEDELNEKKKELGKMMREQQQIDKEIHGEGLSIEPEAGFVSMVYSEEGAEAVPWPLSGYQLES

SEQ ID NO: 811710 - protein, 610 aa, Homo sapiens
GVSRAGYLSSRAYGAACPTAAGAAAVMGFLKLIEIENFKSYKGRQIIGPFQRFTAIIGPNGSGKSNLMDAISFVLGEKTSNLRVKTLRDLIHGAPVGKPAANRAFVSMVYSEEGAEDRTFARVIVGGSSEYKINNKVVQLHEYSEELEKLGILIKARNFLVFQGAVESIAMKNPKERTALFEEISRSGELAQEYDKRKKEMVKAEEDTQFNYHRKKNIAAERKEAKQEKEEADRYQRLKDEVVRAQVQLQLFKLYHNEVEIEKLNKELASKNKEIEKDKKRMDKVEDELKEKKKELGKMMREQQQIEKEIKEKDSELNQKRPQYIKAKENTSHKIKKLEAAKKSLQNAQKHYKKRKGDMDELEKEMLSVEKARQEFEERMEEESQSQGRDLTLEENQVKKYHRLKEEASKRAATLAQELEKFNRDQKADQDRLDLEERKKVETEAKIKQKLREIEENQKRIEKLEEYITTSKQSLEEQKKLEGELTEEVEMAKRRIDEINKELNQVMEQLGDARIDRQESSRQQRKAEIMESIKRLYPGSVYGRLIDLCQPTQKKYQIAVTKVLGKNMDAIIVDSEKTGRDCIQYIKEQRGEPETFLPLDYLEMPFRATR

SEQ ID NO: 811711 - protein, 538 aa, Homo sapiens
GVSRAGYLSSRAYGAACPTAAGAAAVMGFLKLIEIENFKSYKGRQIIGPFQRFTAIIGPNGSGKSNLMDAISFVLGEKTSNLRVKTLRDLIHGAPVGKPAANRAFVSMVYSEEGAEDRTFARVIVGGSSEYKINNKVVQLHEYSEELEKLGILIKARNFLVFQGAVESIAMKNPKERTALFEEISRSGELAQEYDKRKKEMVKAEEDTQFNYHRKKNIAAERKEAKQEKEEADRYQRLKDEVVRAQVQLQLFKLYHNEVEIEKLNKELASKNKEIEKDKKRMDKVEDELKEKKKELGKMMREQQQIEKEIKEKDSELNQKRPQYIKAKENTSHKIKKLEAAKKSLQNAQKHYKKRKGDMDELEKEMLSVEKARQEFEERMEEESQSQGRDLTLEENQVKKYHRLKEEASKRAATLAQELEKFNRDQKADQDRLDLEERKKVETEAKIKQKLREIEENQKRIEKLEEYITTSKQSLEEQKKLEGELTEEVEMAKRRIDEINKELNQGHTWTFWGQGLYAFVYCCILGSKLALNKYWLNK

SEQ ID NO: 811712 - protein, 479 aa, Homo sapiens
GVSRAGYLSSRAYGAACPTAAGAAAVMGFLKLIEIENFKSYKGRQIIGPFQRFTAIIGPNGSGKSNLMDAISFVLGEKTSNLRVKTLRDLIHGAPVGKPAANRAFVSMVYSEEGAEDRTFARVIVGGSSEYKINNKVVQLHEYSEELEKLGILIKARNFLVFQGAVESIAMKNPKERTALFEEISRSGELAQEYDKRKKEMVKAEEDTQFNYHRKKNIAAERKEAKQEKEEADRYQRLKDEVVRAQVQLQLFKLYHNEVEIEKLNKELASKNKEIEKDKKRMDKVEDELKEKKKELGKMMREQQQIEKEIKEKDSELNQKRPQYIKAKENTSHKIKKLEAAKKSLQNAQKHYKKRKGDMDELEKEMLSVEKARQEFEERMEEESQSQGRDLTLEENQNEKKKELGKMMREQQQIDKEIHGEGLSIEPEAAQYIKAKEDTSHNIKKLEAAKKSLQNAQELYTKRKGDMDEPGEGDALSEK

SEQ ID NO: 811713 - protein, 347 aa, Homo sapiens
GVSRAGYLSSRAYGAACPTAAGAAAVMGFLKLIEIENFKSYKGRQIIGPFQRFTAIIGPNGSGKSNLMDAISFVLGEKTSNLRVKTLRDLIHGAPVGKPAANRAFVSMVYSEEGAEDRTFARVIVGGSSEYKINNKVVQLHEYSEELEKLGILIKARNFLVFQGAVESIAMKNPKERTALFEEISRSGELAQEYDKRKKEMVKAEEDTQFNYHRKKNIAAERKEAKQEKEEADRYQRLKDEVVRAQVQLQLFKLYHNEVEIEKLNKELASKNKEIEKDKKRMDKVEDELKEKKKELGKMMREQQQIEKEIKEKDSALNQNRAFVSMVYSEEGAEAVPWPLSGYQLES

SEQ ID NO: 811714 - protein, 316 aa, Homo sapiens
GVSRAGYLSSRAYGAACPTAAGAAAVMGFLKLIEIENFKSYKGRQIIGPFQRFTAIIGPNGSGKSNLMDAISFVLGEKTSNLRVKTLRDLIHGAPVGKPAANRAFVSMVYSEEGAEDRTFARVIVGGSSEYKINNKVVQLHEYSEELEKLGILIKARNFLVFQGAVESIAMKNPKERTALFEEISRSGELAQEYDKRKKEMVKAEEDTQFNYHRKKNIAAERKEAKQEKEEADRYQRLKDEVVRAQVQLQLFKLYHNEVEIEKLNKELASKNKEIEKDKKRMDKVEDSSFEEISRSGELAQEYDKRKKEMVNAGIL

SEQ ID NO: 811715 - protein, 164 aa, Homo sapiens
MPEPAKFAPAPKKGSKKAVTKAQKKDGKKRKRSRKESYSIYVYKVLKRVHPDTGIWCKAMGIMNSFLNDIFERIAGEASRLAHYNKRSTITSRRSRRPCACCCPASWPSTPCPRAPRRSPSTPAPSESLPGPGARSLPPSLPPRVAGCFVSKGSFQGHLTPLVK

SEQ ID NO: 811716 - protein, 164 aa, Homo sapiens
QRALPAPSQAGMLRLRSGLRHLRATPNTRGSARLLRAEMPKKAGATTKGKSQSKEPERPLPPLGPVAVDPKGCVTIAIHAKPGSKQNAVTDLTAEAVNVAIAAPPSEGEANAELCRYLSKVLELRKSDVVLDKKLRDLLKIVPCKLATRTQILGLLVECSFSRL

SEQ ID NO: 811717 - protein, 178 aa, Homo sapiens
QRALPAPSQAGMLRLRSGLRHLRATPNTRGSARLLRAEMPKKAGATTKGKSQSKEPERPLPPLGPVAVDPKGCVTIAIHAKPGSKQNAVTDLTAEAVNVAIAAPPSEGEANAELCRYLSKVLELRKSDVVLDKVGLALFFFFLRQNLALSPKLECSGVVLAHCNLHLLGSSYSPASAS

SEQ ID NO: 811718 - protein, 164 aa, Homo sapiens
QRALPAPSQAGMLRLRSGLRHLRATPNTRGSARLLRAEMPKKAGATTKGKSQSKEPERPLPPLGPVAVDPKGCVTIAIHAKPGSKQNAVTDLTAEAVNVAIAAPPSEGEANAELCRYLSKVLELRKSDVVLDKGGKSREKVVKLLASTTPEEILEKLKKEAKKT

SEQ ID NO: 811719 - protein, 79 aa, Homo sapiens
QRALPAPSQAGMLRLRSGLRHLRATPNTRGSARLLRAEMPKKAGATTKGGKSREKVVKLLASTTPEEILEKLKKEAKKT

SEQ ID NO: 811720 - protein, 418 aa, Homo sapiens
MRTKAAGCAERRPLQPRTEAAAAPAGRAMPSEYTYVKLRSDCSRPSLQWYTRAQSKMRRPSLLLKDILKCTLLVFGVWILYILKLNYTTEECDMKKMHYVDPDHVKRAQKYAQQVLQKECRPKFAKTSMALLFEHRYSVDLLPFVQKAPKDSEAESKYDPPFGFRKFSSKVQTLLELLPEHDLPEHLKAKTCRRCVVIGSGGILHGLELGHTLNQFDVVIRLNSAPVEGYSEHVGNKTTIRMTYPEGAPLSDLEYYSNDLFVAVLFKSVDFNWLQAMVKKETLPFWVRLFFWKQVAEKIPLQPKHFRILNPVIIKETAFDILQYSEPQSRFWGRDKNVPTIGVIAVVLATHLCDEVSLAGFGYDLNQPRTPLHYFDSQCMAAMNFQTMHNVTTETKFLLKLVKEGVVKDLSGGIDREF

SEQ ID NO: 811721 - protein, 390 aa, Homo sapiens
MPSEYTYVKLRSDCSRPSLQWYTRAQSKMRRPSLLLKDILKCTLLVFGVWILYILKLNYTTEECDMKKMHYVDPDHVKRAQKYAQQVLQKECRPKFAKTSMALLFEHRYSVDLLPFVQKAPKDSEAESKYDPPFGFRKFSSKVQTLLELLPEHDLPEHLKAKTCRRCVVIGSGGILHGLELGHTLNQFDVVIRLNSAPVEGYSEHVGNKTTIRMTYPEGAPLSDLEYYSNDLFVAVLFKSVDFNWLQAMVKKETLPFWVRLFFWKQVAEKIPLQPKHFRILNPVIIKETAFDILQYSEPQSRFWGRDKNVPTIGVIAVVLATHLCDEVSLAGFGYDLNQPRTPLHYFDSQCMAAMNFQTMHNVTTETKFLLKLVKEGVVKDLSGGIDREF

SEQ ID NO: 811722 - protein, 114 aa, Homo sapiens
MRTKAAGCAERRPLQPRTEAAAAPAGRAMPSEYTYVKLRSDCSRPSLQWYTRAQSKMRRPSLLLKDILKCTLLVFGVWILYILKLNYTTEECDMKKMHYVDPDHVKVRYPIGVV

SEQ ID NO: 811723 - protein, 390 aa, Homo sapiens; identical to SEQ ID NO: 811721

SEQ ID NO: 811724 - protein, 404 aa, Homo sapiens
LSCLAATQDMASVPMPSEYTYVKLRSDCSRPSLQWYTRAQSKMRRPSLLLKDILKCTLLVFGVWILYILKLNYTTEECDMKKMHYVDPDHVKRAQKYAQQVLQKECRPKFAKTSMALLFEHRYSVDLLPFVQKAPKDSEAESKYDPPFGFRKFSSKVQTLLELLPEHDLPEHLKAKTCRRCVVIGSGGILHGLELGHTLNQFDVVIRLNSAPVEGYSEHVGNKTTIRMTYPEGAPLSDLEYYSNDLFVAVLFKSVDFNWLQAMVKKETLPFWVRLFFWKQVAEKIPLQPKHFRILNPVIIKETAFDILQYSEPQSRFWGRDKNVPTIGVIAVVLATHLCDEVSLAGFGYDLNQPRTPLHYFDSQCMAAMNFQTMHNVTTETKFLLKLVKEGVVKDLSGGIDREF

SEQ ID NO: 811725 - protein, 290 aa, Homo sapiens
MALLFEHRYSVDLLPFVQKAPKDSEAESKYDPPFGFRKFSSKVQTLLELLPEHDLPEHLKAKTCRRCVVIGSGGILHGLELGHTLNQFDVVIRLNSAPVEGYSEHVGNKTTIRMTYPEGAPLSDLEYYSNDLFVAVLFKSVDFNWLQAMVKKETLPFWVRLFFWKQVAEKIPLQPKHFRILNPVIIKETAFDILQYSEPQSRFWGRDKNVPTIGVIAVVLATHLCDEVSLAGFGYDLNQPRTPLHYFDSQCMAAMNFQTMHNVTTETKFLLKLVKEGVVKDLSGGIDREF

SEQ ID NO: 811726 - protein, 290 aa, Homo sapiens; identical to SEQ ID NO: 811725

SEQ ID NO: 811727 - protein, 290 aa, Homo sapiens; identical to SEQ ID NO: 811725

SEQ ID NO: 811728 - protein, 350 aa, Homo sapiens
MPSEYTYVKLRSDCSRPSLQWYTRAQSKMRRPSLLLKDILKCTLLVFGVWILYILKLNYTTEECDMKKMHYVDPDHVKKAPKDSEAESKYDPPFGFRKFSSKVQTLLELLPEHDLPEHLKAKTCRRCVVIGSGGILHGLELGHTLNQFDVVIRLNSAPVEGYSEHVGNKTTIRMTYPEGAPLSDLEYYSNDLFVAVLFKSVDFNWLQAMVKKETLPFWVRLFFWKQVAEKIPLQPKHFRILNPVIIKETAFDILQYSEPQSRFWGRDKNVPTIGVIAVVLATHLCDEVSLAGFGYDLNQPRTPLHYFDSQCMAAMNFQTMHNVTTETKFLLKLVKEGVVKDLSGGIDREF

SEQ ID NO: 811729 - protein, 319 aa, Homo sapiens
KPEINLLRAQKYAQQVLQKECRPKFAKTSMALLFEHRYSVDLLPFVQKAPKDSEAESKYDPPFGFRKFSSKVQTLLELLPEHDLPEHLKAKTCRRCVVIGSGGILHGLELGHTLNQFDVVIRLNSAPVEGYSEHVGNKTTIRMTYPEGAPLSDLEYYSNDLFVAVLFKSVDFNWLQAMVKKETLPFWVRLFFWKQVAEKIPLQPKHFRILNPVIIKETAFDILQYSEPQSRFWGRDKNVPTIGVIAVVLATHLCDEVSLAGFGYDLNQPRTPLHYFDSQCMAAMNFQTMHNVTTETKFLLKLVKEGVVKDLSGGIDREF

SEQ ID NO: 811730 - protein, 237 aa, Homo sapiens
MALLFEHRYSVDLLPFVQKAPKDSEAESKYDPPFGFRKFSSKVQTLLELLPEHDLPEHLKAKTCRRCVVIGSGGILHGLELGHTLNQFDVVIRLNSAPVEGYSEHVGNKTTIRMTYPEGAPLSDLEYYSNDLFVAVLFKSVDFNWLQAMVKKETLNVPTIGVIAVVLATHLCDEVSLAGFGYDLNQPRTPLHYFDSQCMAAMNFQTMHNVTTETKFLLKLVKEGVVKDLSGGIDREF

SEQ ID NO: 811731 - protein, 231 aa, Homo sapiens
MRTKAAGCAERRPLQPRTEAAAAPAGRAMPSEYTYVKLRSDCSRPSLQWYTRAQSKMRRPSLLLKDILKCTLLVFGVWILYILKLNYTTEECDMKKMHYVDPDHVKRAQKYAQQVLQKECRPKFAKTSMALLFEHRYSVDLLPFVQKAPKDSEAESKYDPPFGFRKFSSKVQTLLELLPEHDLPEHLKAKTCRRCVVIGSGGILHGLELGHTLNQFDVVIRVLISTGFKQW

SEQ ID NO: 811732 - protein, 177 aa, Homo sapiens
MTYPEGAPLSDLEYYSNDLFVAVLFKSVDFNWLQAMVKKETLPFWVRLFFWKQVAEKIPLQPKHFRILNPVIIKETAFDILQYSEPQSRFWGRDKNVPTIGVIAVVLATHLCDEVSLAGFGYDLNQPRTPLHYFDSQCMAAMNFQTMHNVTTETKFLLKLVKEGVVKDLSGGIDREF

SEQ ID NO: 811733 - protein, 292 aa, Homo sapiens
MRTKAAGCAERRPLQPRTEAAAAPAGRAMPSEYTYVKLRSDCSRPSLQWYTRAQSKMRRPSLLLKDILKCTLLVFGVWILYILKLNYTTEECDMKKMHYVDPDHVKRAQKYAQQVLQKECRPKFAKTSMALLFEHRYSVDLLPFVQKAPKDSEAESKYDPPFGFRKFSSKVQTLLELLPEHDLPEHLKAKTCRRCVVIGSGGILHGLELGHTLNQFDVVIRLNSAPVEGYSEHVGNKTTIRMTYPEGAPLSDLEYYSNDLFVAVLFKSVDFNWLQAMVKKETLPFWVRRRWC

SEQ ID NO: 811734 - protein, 110 aa, Homo sapiens
MPSEYTYVKLRSDCSRPSLQWYTRAQSKMRRPSLLLKDILKCTLLVFGVWILYILKLNYTTEECDMKKMHYVDPDHVKTYTVPLKEAGPSLLKHSVSPGTSIFKPSLFSP

SEQ ID NO: 811735 - protein, 191 aa, Homo sapiens
MASCDFSIRTYTYADTPDDFQLHNFSLPEEDTKLKIPLIHRALQLAQRPVSLLASPWTSPTWLKTNGAVNGKGSLKGQPGDIYHQTWARYFVKFLDAYAEHKLQFWAVTAENEPSAGLLSGYPFQCLGFTPEHQRDFIARDLGPTLANSTHHNVRLLMLDDQRLLLPHWAKVVLTDPEAAKTPKGDPLDHQ

SEQ ID NO: 811736 - protein, 160 aa, Homo sapiens
MASCDFSIRTYTYADTPDDFQLHNFSLPEEDTKLKIPLIHRALQLAQRPVSLLASPWTSPTWLKTNGAVNGKGSLKGQPGDIYHQTWARYFVKKGISKDVGSGLASHLAMLICVPTLNLVPLPDLPVLSSPFYLLGLSALGLSILPTPSGFLFSRSGPLS

SEQ ID NO: 811737 - protein, 536 aa, Homo sapiens
MEFSSPSREECPKPLSRVSIMAGSLTGLLLLQAVSWASGARPCIPKSFGYSSVVCVCNATYCDSFDPPTFPALGTFSRYESTRSGRRMELSMGPIQANHTGTGLLLTLQPEQKFQKVKGFGGAMTDAAALNILALSPPAQNLLLKSYFSEEGIGYNIIRVPMASCDFSIRTYTYADTPDDFQLHNFSLPEEDTKLKIPLIHRALQLAQRPVSLLASPWTSPTWLKTNGAVNGKGSLKGQPGDIYHQTWARYFVKFLDAYAEHKLQFWAVTAENEPSAGLLSGYPFQCLGFTPEHQRDFIARDLGPTLANSTHHNVRLLMLDDQRLLLPHWAKVVLTDPEAAKYVHGIAVHWYLDFLAPAKATLGETHRLFPNTMLFASEACVGSKFWEQSVRLGSWDRGMQYSHSIITNLLYHVVGWTDWNLALNPEGGPNWVRNFVDSPIIVDITKDTFYKQPMFYHLGHFSKFIPEGSQRVGLVASQKNDLDAVALMHPDGSAVVVVLNRSSKDVPLTIKDPAVGFLETISPGYSIHTYLWRRQ

SEQ ID NO: 811738 - protein, 536 aa, Homo sapiens; identical to SEQ ID NO: 811737

SEQ ID NO: 811739 - protein, 536 aa, Homo sapiens; identical to SEQ ID NO: 811737

SEQ ID NO: 811740 - protein, 606 aa, Homo sapiens
AVIGRAASCLQSLTARGPSLQSRPGAFAGCGGISFCLRLGLLFLFADVDPLSFRDSGTPVVFSSSNDPEGMEFSSPSREECPKPLSRVSIMAGSLTGLLLLQAVSWASGARPCIPKSFGYSSVVCVCNATYCDSFDPPTFPALGTFSRYESTRSGRRMELSMGPIQANHTGTGLLLTLQPEQKFQKVKGFGGAMTDAAALNILALSPPAQNLLLKSYFSEEGIGYNIIRVPMASCDFSIRTYTYADTPDDFQLHNFSLPEEDTKLKIPLIHRALQLAQRPVSLLASPWTSPTWLKTNGAVNGKGSLKGQPGDIYHQTWARYFVKFLDAYAEHKLQFWAVTAENEPSAGLLSGYPFQCLGFTPEHQRDFIARDLGPTLANSTHHNVRLLMLDDQRLLLPHWAKVVLTDPEAAKYVHGIAVHWYLDFLAPAKATLGETHRLFPNTMLFASEACVGSKFWEQSVRLGSWDRGMQYSHSIITNLLYHVVGWTDWNLALNPEGGPNWVRNFVDSPIIVDITKDTFYKQPMFYHLGHFSKFIPEGSQRVGLVASQKNDLDAVALMHPDGSAVVVVLNRSSKDVPLTIKDPAVGFLETISPGYSIHTYLWRRQ

SEQ ID NO: 811741 - protein, 536 aa, Homo sapiens; identical to SEQ ID NO: 811737

SEQ ID NO: 811742 - protein, 536 aa, Homo sapiens; identical to SEQ ID NO: 811737

SEQ ID NO: 811743 - protein, 218 aa, Homo sapiens
MEFSSPSREECPKPLSRVSIMAGSLTGLLLLQAVSWASGARPCIPKSFGYSSVVCVCNATYCDSFDPPTFPALGTFSRYESTRSGRRMELSMGPIQANHTGTGLLLTLQPEQKFQKVKGFGGAMTDAAALNILALSPPAQNLLLKSYFSEEGIGYNIIRVPMASCDFSIRTYTYADTPDDFQLHNFSLPEEDTKLKIPLIHRALQLAQRPVSTSLPVT

SEQ ID NO: 811744 - protein, 375 aa, Homo sapiens [sequence omitted]

SEQ ID NO: 811745 - protein, 430 aa, Homo sapiens
MEFSSPSRENVPSLRVGCLQPLQEQKQWALDGAEYRTIQANCTGTGIGYNIIRVPMASCDFSIRTYTYADTPDDFQLHNFSLPEEDTKLKIPLIHRALQLAQRPVSLLASPWTSPTWLKTNGAVNGKGSLKGQPGDIYHQTWARYFVKFLDAYAEHKLQFWAVTAENEPSAGLLSGYPFQCLGFTPEHQRDFIARDLGPTLANSTHHNVRLLMLDDQRLLLPHWAKVVLTDPEAAKYVHGIAVHWYLDFLAPAKATLGETHRLFPNTMLFASEACVGSKFWEQSVRLGSWDRGMQYSHSIITNLLYHVVGWTDWNLALNPEGGPNWVRNFVDSPIIVDITKDTFYKQPMFYHLGHFSKFIPEGSQRVGLVASQKNDLDAVALMHPDGSAVVVVLNRSSKDVPLTIKDPAVGFLETISPGYSIHTYLWRRQ

SEQ ID NO: 811746 - protein, 356 aa, Homo sapiens
ISRYEEYTAEEDTKLKIPLIHRALQLAQRPVSLLASPWTSPTWLKTNGAVNGKGSLKGQPGDIYHQTWARYFVKFLDAYAEHKLQFWAVTAENEPSAGLLSGYPFQCLGFTPEHQRDFIARDLGPTLANSTHHNVRLLMLDDQRLLLPHWAKVVLTDPEAAKYVHGIAVHWYLDFLAPAKATLGETHRLFPNTMLFASEACVGSKFWEQSVRLGSWDRGMQYSHSIITNLLYHVVGWTDWNLALNPEGGPNWVRNFVDSPIIVDITKDTFYKQPMFYHLGHFSKFIPEGSQRVGLVASQKNDLDAVALMHPDGSAVVVVLNRSSKDVPLTIKDPAVGFLETISPGYSIHTYLWRRQ

SEQ ID NO: 811747 - protein, 218 aa, Homo sapiens [sequence omitted]

SEQ ID NO: 811748 - protein, 163 aa, Homo sapiens [sequence omitted]

SEQ ID NO: 811749 - protein, 463 aa, Homo sapiens
MEFSSPSREECPKPLSRVSIMAGSLTGLLLLQAVSWASGARPCIPKSFGYSSVVCVCNATYCDSFDPPTFPALGTFSRYESTRSGRRMELSMGPIQANHTGTGLLLTLQPEQKFQKVKGFGGAMTDAAALNILALSPPAQNLLLKSYFSEEGIGYNIIRVPMASCDFSIRTYTYADTPDDFQLHNFSLPEEDTKLKIPLIHRALQLAQRPVSLLASPWTSPTWLKTNGAVNGKGSLKGQPGDIYHQTWARYFVKFLDAYAEHKLQFWAVTAENEPSAGLLSGYPFQCLGFTPEHQRDFIARDLGPTLANSTHHNVRLLMLDDQRLLLPHWAKVVLTDPEAAKYVHGIAVHWYLDFLAPAKATLGETHRLFPNTMLFASEACVGSKFWEQSVRLGSWDRGMQYSHSIITNLLYHVVGWTDWNLALNPEGGPNWVRNFVDSPIIVDITKDTFYKQPMFYHLGHFR

SEQ ID NO: 811750 - protein, 165 aa, Homo sapiens
SRGSRLRLDTRSRVAGEQSVRLGSWDRGMQYSHSIITNLLYHVVGWTDWNLALNPEGGPNWVRNFVDSPIIVDITKDTFYKQPMFYHLGHFSKFIPEGSQRVGLVASQKNDLDAVALMHPDGSAVVVVLNRSSKDVPLTIKDPAVGFLETISPGYSIHTYLWRRQ

SEQ ID NO: 811751 - protein, 140 aa, Homo sapiens
TWTLSADNSIITNLLYHVVGWTDWNLALNPEGGPNWVRNFVDSPIIVDITKDTFYKQPMFYHLGHFSKFIPEGSQRVGLVASQKNDLDAVALMHPDGSAVVVVLNRSSKDVPLTIKDPAVGFLETISPGYSIHTYLWRRQ

SEQ ID NO: 811752 - protein, 352 aa, Homo sapiens
MEFSSPSREECPKPLSRVSIMAGSLTGLLLLQAVSWASGARPCIPKSFGYSSVVCVCNATYCDSFDPPTFPALGTFSRYESTRSGRRMELSMGPIQANHTGTGLLLTLQPEQKFQKVKGFGGAMTDAAALNILALSPPAQNLLLKSYFSEEGIGYNIIRVPMASCDFSIRTYTYADTPDDFQLHNFSLPEEDTKLKIPLIHRALQLAQRPVSLLASPWTSPTWLKTNGAVNGKGSLKGQPGDIYHQTWARYFVKFLDAYAEHKLQFWAVTAENEPSAGLLSGYPFQCLGFTPEHQRDFIARDLGPTLANSTHHNVRLLMLDDQRLLLPHWAKVVLTDPEAAKTPKGDPLDHQ

SEQ ID NO: 811753 - protein, 160 aa, Homo sapiens
MEFSSPSREECPKPLSRVSIMAGSLTGLLLLQAVSWASGARPCIPKSFGYSSVVCVCNATYCDSFDPPTFPALGTFSRYESTRSGRRMELSMGPIQANHTGTGLLLTLQPEQKFQKVKGFGGAMTDAAALNILALSPPAQNLLLKSYFSEEGEEEGDKMT

SEQ ID NO: 811754 - protein, 56 aa, Homo sapiens
QTAHVLPPWPLQVSGGRAPPFHTRPIISYIGWLTSLYTTREQEGVQGGTSEEAHPS

SEQ ID NO: 811755 - protein, 1091 aa, Homo sapiens
MAAGCLLALTLTLFQSLLIGPSSEEPFPSAVTIKSWVDKMQEDLVTLAKTASGVNQLVDIYEKYQDLYTVEPNNARQLVEIAARDIEKLLSNRSKALVSLALEAEKVQAAHQWREDFASNEVVYYNAKDDLDPEKNDSEPGSQRIKPVFIEDANFGRQISYQHAAVHIPTDIYEGSTIVLNELNWTSALDEVFKKNREEDPSLLWQVFGSATGLARYYPASPWVDNSRTPNKIDLYDVRRRPWYIQGAASPKDMLILVDVSGSVSGLTLKLIRTSVSEMLETLSDDDFVNVASFNSNAQDVSCFQHLVQANVRNKKVLKDAVNNITAKGITDYKKGFSFAFEQLLNYNVSRANCNKIIMLFTDGGEERAQEIFNKYNKDKKVRVFRFSVGQHNYERGPIQWMACENKGYYYEIPSIGAIRINTQEYLDVLGRPMVLAGDKAKQVQWTNVYLDALELGLVITGTLPVFNITGQFENKTNLKNQLILGVMGVDVSLEDIKRLTPRFTLCPNGYYFAIDPNGYVLLHPNLQPKNPKSQEPVTLDFLDAELENDIKVEIRNKMIDGESGEKTFRTLVKSQDERYIDKGNRTYTWTPVNGTDYSLALVLPTYSFYYIKAKLEETITQARSKKGKMKDSETLKPDNFEESGYTFIAPRDYCNDLKISDNNTEFLLNFNEFIDRKTPNNPSCNADLINRVLLDAGFTNELVQNYWSKQKNIKGVKARFVVTDGGITRVYPKEAGENWQENPETYEDSFYKRSLDNDNYVFTAPYFNKSGPGAYESGIMVSKAVEIYIQGKLLKPAVVGIKIDVNSWIENFTKTSIRDPCAGPVCDCKRNSDVMDCVILDDGGFLLMANHDDYTNQIGRFFGEIDPSLMRHLVNISVYAFNKSYDYQSVCEPGAAPKQGAGHRSAYVPSVADILQIGWWATAAAWSILQQFLLSLTFPRLLEAVEMEDDDFTASLSKQSCITEQTQYFFDNDSKSFSGVLDCGNCSRIFHGEKLMNTNLIFIMVESKGTCPCDTRLLIQAEQTSDGPNPCDMVKQPRYRKGPDVCFDNNVLEDYTDCGGVSGLNPSLWYIIGIQFLLLWLVSGSTHRLL

SEQ ID NO: 811756 - protein, 377 aa, Homo sapiens
FSISYIAERLEHKTPFRPSWDHSIKSWVDKMQEDLVTLAKTASGVNQLVDIYEKYQDLYTVEPNNARQLVEIAARDIEKLLSNRSKALVRLALEAEKVQAAHQWREDFASNEVVYYNAKDDLDPEKNDSEPGSQRIKPVFIEDANFGRQISYQHAAVHIPTDIYEGSTIVLNELNWTSALDEVFKKNREEDPSLLWQVFGSATGLARYYPASPWVDNSRTPNKIDLYDVRRRPWYIQGAASPKDMLILVDVSGSVSGLTLKLIRTSVSEMLETLSDDDFVNVASFNSNAQDVSCFQHLVQANVRNKKVLKDAVNNITAKGITDYKKGFSFAFEQLLNYNVSRANCNKIIMLFTDGGEERAQEIFNKYNKDKKVSVIL

SEQ ID NO: 811757 - protein, 448 aa, Homo sapiens
FSISYIAERLEHKTPFRPSWDHSIKSWVDKMQEDLVTLAKTASGVNQLVDIYEKYQDLYTVEPNNARQLVEIAARDIEKLLSNRSKALVRLALEAEKVQAAHQWREDFASNEVVYYNAKDDLDPEKNDSEPGSQRIKPVFIEDANFGRQISYQHAAVHIPTDIYEGSTIVLNELNWTSALDEVFKKNREEDPSLLWQVFGSATGLARYYPASPWVDNSRTPNKIDLYDVRRRPWYIQGAASPKDMLILVDVSGSVSGLTLKLIRTSVSEMLETLSDDDFVNVASFNSNAQDVSCFQHLVQANVRNKKVLKDAVNNITAKGITDYKKGFSFAFEQLLNYNVSRANCNKIIMLFTDGGEERAQEIFNKYNKDKKVRVFTFSVGQHNYDRGPIQWMACENKGYYYEIPSIGAIRINTQEYLDVLGRPMVLAGDKAKQVQWTNVYLDALVRG

SEQ ID NO: 811758 - protein, 281 aa, Homo sapiens
TTKVTTFPVKEDLETRSCFAQSKGYLDPEKNDSEPGSQRIKPVFIEDANFGRQISYQHAAVHIPTDIYEGSTIVLNELNWTSALDEVFKKNREEDPSLLWQVFGSATGLARYYPASPWVDNSRTPNKIDLYDVRRRPWYIQGAASPKDMLILVDVSGSVSGLTLKLIRTSVSEMLETLSDDDFVNVASFNSNAQDVSCFQHLVQANVRNKKVLKDAVNNITAKGITDYKKGFSFAFEQLLNYNVSRANCNKIIMLFTDGGEERAQEIFNKYNKDKKVSVIL

SEQ ID NO: 811759 - protein, 1075 aa, Homo sapiens
FSISYIAERLEHKTPFRPSWDHSIKSWVDKMQEDLVTLAKTASGVNQLVDIYEKYQDLYTVEPNNARQLVEIAARDIEKLLSNRSKALVSLALEAEKVQAAHQWREDFASNEVVYYNAKDDLDPEKNDSEPGSQRIKPVFIEDANFGRQISYQHAAVHIPTDIYEGSTIVLNELNWTSALDEVFKKNREEDPSLLWQVFGSATGLARYYPASPWVDNSRTPNKIDLYDVRRRPWYIQGAASPKDMLILVDVSGSVSGLTLKLIRTSVSEMLETLSDDDFVNVASFNSNAQDVSCFQHLVQANVRNKKVLKDAVNNITAKGITDYKKGFSFAFEQLLNYNVSRANCNKIIMLFTDGGEERAQEIFNKYNKDKKVRVFRFSVGQHNYERGPIQWMACENKGYYYEIPSIGAIRINTQEYLDVLGRPMVLAGDKAKQVQWTNVYLDALELGLVITGTLPVFNITGQFENKTNLKNQLILGVMGVDVSLEDIKRLTPRFTLCPNGYYFAIDPNGYVLLHPNLQPKNPKSQEPVTLDFLDAELENDIKVEIRNKMIDGESGEKTFRTLVKSQDERYIDKGNRTYTWTPVNGTDYSLALVLPTYSFYYIKAKLEETITQARYSETLKPDNFEESGYTFIAPRDYCNDLKISDNNTEFLLNFNEFIDRKTPNNPSCNADLINRVLLDAGFTNELVQNYWSKQKNIKGVKARFVVTDGGITRVYPKEAGENWQENPETYEDSFYKRSLDNDNYVFTAPYFNKSGPGAYESGIMVSKAVEIYIQGKLLKPAVVGIKIDVNSWIENFTKTSIRDPCAGPVCDCKRNSDVMDCVILDDGGFLLMANHDDYTNQIGRFFGEIDPSLMRHLVNISVYAFNKSYDYQSVCEPGAAPKQGAGHRSAYVPSVADILQIGWWATAAAWSILQQFLLSLTFPRLLEAVEMEDDDFTASLSKQSCITEQTQYFFDNDSKSFSGVLDCGNCSRIFHGEKLMNTNLIFIMVESKGTCPCDTRLLIQAEQTSDGPNPCDMVKQPRYRKGPDVCFDNNVLEDYTDCGGVSGLNPSLWYIIGIQFLLLWLVSGSTHRLL

SEQ ID NO: 811760 - protein, 104 aa, Homo sapiens [sequence omitted]

SEQ ID NO: 811761 - protein, 104 aa, Homo sapiens [sequence omitted]

SEQ ID NO: 811762 - protein, 246 aa, Homo sapiens
PTWGDFRGATFAKCSELIAPPPSTRSRRPLAWKDTAVPPEDLRDRVGGGSSASTGGRKRRGWLVTRGWGGPRALGGCGEGESRQRAAGSSMEPAAGSSMEPSADWLATAAARGRVEEVRALLEAGALPNAPNSYGRRPIQVMMMGSARVAELLLLHGAEPNCADPATLTRPVHDAAREGFLDTLVVLHRAGARLDVRDAWGRLPVDLAEELGHRDVARYLRAAAGGTRGSNHARIDAAEGPSDIPD

SEQ ID NO: 811763 - protein, 104 aa, Homo sapiens [sequence omitted]

SEQ ID NO: 811764 - protein, 156 aa, Homo sapiens
MEPAAGSSMEPSADWLATAAARGRVEEVRALLEAGALPNAPNSYGRRPIQVMMMGSARVAELLLLHGAEPNCADPATLTRPVHDAAREGFLDTLVVLHRAGARLDVRDAWGRLPVDLAEELGHRDVARYLRAAAGGTRGSNHARIDAAEGPSDIPD

SEQ ID NO: 811765 - protein, 337 aa, Homo sapiens
PTWGDFRGATFAKCSELIAPPPSTRSRRPLAWKDTAVPPEDLRDRVGGGSSASTGGRKRRGWLVTRGWGGPRALGGCGEGESRQRAAGSSMEPAAGSSMEPSADWLATAAARGRVEEVRALLEAGALPNAPNSYGRRPIQVGRGSAAGAGDGGRLWRTKFAGELESGSASILRKKGRLPGEFSEGVCNHRPPPGDALGAWEAKEEECGATRVQISRMLRRSEGGNIFVLMEVMMMGSARVAELLLLHGAEPNCADPATLTRPVHDAAREGFLDTLVVLHRAGARLDVRDAWGRLPVDLAEELGHRDVARYLRAAAGGTRGSNHARIDAAEGPSDIPD

SEQ ID NO: 811766 - protein, 105 aa, Homo sapiens
MMMGSARVAELLLLHGAEPNCADPATLTRPVHDAAREGFLDTLVVLHRAGARLDVRDAWGRLPVDLAEELGHRDVARYLRAAAGGTRGSNHARIDAAEGPSDIPD

SEQ ID NO: 811767 - protein, 104 aa, Homo sapiens [sequence omitted]

SEQ ID NO: 811768 - protein, 228 aa, Homo sapiens
PTWGDFRGATFAKCSELIAPPPSTRSRRPLAWKDTAVPPEDLRDRVGGGSSASTGGRKRRGWLVTRGWGGPRALGGCGEGESRQRAAGSSMEPAAGSSMEPSADWLATAAARGRVEEVRALLEAGALPNAPNSYGRRPIQVMMMGSARVAELLLLHGAEPNCADPATLTRPVHDAAREGFLDTLVVLHRAGARLDVRDAWGRLPVDLAEELGHRDVARHPRLKEPERL

SEQ ID NO: 811769 - protein, 120 aa, Homo sapiens
MMGSARVAELLLLHGAEPNCADPATLTRPVHDAAREGFLDTLVVLHRAGARLDVRDAWGRLPVDLAEELGHRDVARYLRAAAGGTRGSNHARIDAAEGPSVTASIQVPGGEEGDFGSSYS

SEQ ID NO: 811770 - protein, 854 aa, Homo sapiens
MDFSMVAGAAAYNEKSGRITSLSLLFQKVFAQIFPQWRKGNTEECLPYKCSETGALGENYSWQIPINHNDFKILKNNERQLCEVLQNKFGCISTLVSPVQEGNSKSLQVFRKMLTPRIELSVWKDDLTTHAVDAVVNAANEDLLHGGGLALALVKAGGFEIQEESKQFVARYGKVSAGEIAVTGAGRLPCKQIIHAVGPRWMEWDKQGCTGKLQRAIVSILNYVIYKNTHIKTVAIPALSSGIFQFPLNLCTKTIVETIRVSLQGKPMMSNLKEIHLVSNEDPTVAAFKAASEFILGKSELGQETTPSFNAMVVNNLTLQIVQGHIEWQTADVIVNSVNPHDITVGPVAKSILQQAGVEMKSEFLATKAKQFQRSQLVLVTKGFNLFCKYIYHVLWHSEFPKPQILKHAMKECLEKCIEQNITSISFPALGTGNMEIKKETAAEILFDEVLTFAKDHVKHQLTVKFVIFPTDLEIYKAFSSEMAKRSKMLSLNNYSVPQSTREEKRENGLEARSPAINLMGFNVEEMCEAHAWIQRILSLQNHHIIENNHILYLGRKEHDILSQLQKTSSVSITEIISPGRTELEIEGARADLIEVVMNIEDMLCKVQEEMARKKERGLWRSLGQWTIQQQKTQDEMKENIIFLKCPVPPTQELLDQKKQFEKCGLQVLKVEKIDNEVLMAAFQRKKKMMEEKLHRQPVSHRLFQQVPYQFCNVVCRVGFQRMYSTPCDPKYGAGIYFTKNLKNLAEKAKKISAADKLIYVFEAEVLTGFFCQGHPLNIVPPPLSPGAIDGHDSVVDNVSSPETFVIFSGMQAIPQYLWTCTQEYVQSQDYSSGPMRPFAQHPWRGFASGSPVD

SEQ ID NO: 811771 - protein, 819 aa, Homo sapiens [sequence omitted]

SEQ ID NO: 811772 - protein, 854 aa, Homo sapiens; identical to SEQ ID NO: 811770

SEQ ID NO: 811773 - protein, 819 aa, Homo sapiens [sequence omitted]

SEQ ID NO: 811774 - protein, 819 aa, Homo sapiens [sequence omitted]

SEQ ID NO: 811775 - protein, 166 aa, Homo sapiens
MMEEKLHRQPVSHRLFQQVPYQFCNVVCRVGFQRMYSTPCDPKYGAGIYFTKNLKNLAEKAKKISAADKLIYVFEAEVLTGFFCQGHPLNIVPPPLSPGAIDGHDSVVDNVSSPETFVIFSGMQAIPQYLWTCTQEYVQSQDYSSGPMRPFAQHPWRGFASGSPVD

SEQ ID NO: 811776 - protein, 854 aa, Homo sapiens; identical to SEQ ID NO: 811770

SEQ ID NO: 811777 - protein, 815 aa, Homo sapiens
MDFSMVAGAAAYNEKSGRITSLSLLFQKVFAQIFPQWRKGNTEECLPYKCSETGALGENYSWQIPINHNDFKILKNNERQLCEVLQNKFGCISTLVSPVQEGNSKSLQVFRKMLTPRIELSVWKDDLTTHAVDAVVNAANEDLLHGGGLALALVKAGGFEIQEESKQFVARYGKVSAGEIAVTGAGRLPCKQIIHAVGPRWMEWDKQGCTGKLQRAIVSILNYVIYKNTHIKTVAIPALSSGIFQFPLNLCTKTIVETIRVSLQGKPMMSNLKEIHLVSNEDPTVAAFKAASEFILGKSELGQETTPSFNAMVVNNLTLQIVQGHIEWQTADVIVNSVNPHDITVGPVAKSILQQAGVEMKSEFLATKAKQFQRSQLVLVTKGFNLFCKYIYHVLWHSEFPKPQILKHAMKECLEKCIEQNITSISFPALGTGNMEIKKETAAEILFDEVLTFAKDHVKHQLTVKFVIFPTDLEIYKAFSSEMAKRSKMLSLNNYSVPQSTREEKRENGLEARSPAINLMGFNVEEMCEAHAWIQRILSLQNHHIIENNHILYLGRKEHDILSQLQKTSSVSITEIISPGRTELEIEGARADLIEVVMNIEDMLCKVQEEMARKKERGLWRSLGQWTIQQQKTQDEMKENIIFLKCPVPPTQELLDQKKQFEKCGLQVLKVEKIDNEVLMAAFQRKKKMMEEKLHRQPVSHRLFQQVPYQFCNVVCRVGFQRMYSTPCDPKYGAGIYFTKNLKNLAEKAKKISAADKLIYVFEAEVLTGFFCQGHPLNIVPPPLSPGAIDGHDSVVDNVSSPETFVIFSGMQAIP

SEQ ID NO: 811778 - protein, 786 aa, Homo sapiens
MDFSMVAGAAAYNEKSGRITSLSLLFQKVFAQIFPQWRKGNTEECLPYKCSETGALGENYSWQIPINHNDFKILKNNERQLCEVLQNKFGCISTLVSPVQEGNSKSLQVFRKMLTPRIELSVWKDDLTTHAVDAVVNAANEDLLHGGGLALALVKAGGFEIQEESKQFVARYGKVSAGEIAVTGAGRLPCKQIIHAVGPRWMEWDKQGCTGKLQRAIVSILNYVIYKNTHIKTVAIPALSSGIFQFPLNLCTKTIVETIRVSLQGKPMMSNLKEIHLVSNEDPTVAAFKAASEFILGKSELGQETTPSFNAMVVNNLTLQIVQGHIEWQTADVIVNSVNPHDITVGPVAKSILQQAGVEMKSEFLATKAKQFQRSQLVLVTKGFNLFCKYIYHVLWHSEFPKPQILKHAMKECLEKCIEQNITSISFPALGTGNMEIKKETAAEILFDEVLTFAKDHVKHQLTVKFVIFPTDLEIYKAFSSEMAKRSKMLSLNNYSVPQSTREEKRENGLEARSPAINLMGFNVEEMCEAHAWIQRILSLQNHHIIENNHILYLGRKEHDILSQLQKTSSVSITEIISPGRTELEIEGARADLIEVVMNIEDMLCKVQEEMARKKERGLWRSLGQWTIQQQKTQDEMKENIIFLKCPVPPTQELLDQKKQFEKCGLQVLKVEKIDNEVLMAAFQRKKKMMEEKLHRQPVSHRLFQQVPYQFCNVVCRVGFQRMYSTPCETRFHHVGQADLQLLVIRPPQPPKVLGLQIQNTELAYTSPRTSKTWQRRPRKSLLQIS

SEQ ID NO: 811779 - protein, 738 aa, Homo sapiens
MDFSMVAGAAAYNEKSGRITSLSLLFQKVFAQIFPQWRKGNTEECLPYKCSETGALGENYSWQIPINHNDFKILKNNERQLCEVLQNKFGCISTLVSPVQEGNSKSLQVFRKMLTPRIELSVWKDDLTTHAVDAVVNAANEDLLHGGGLALALVKAGGFEIQEESKQFVARYGKVSAGEIAVTGAGRLPCKQIIHAVGPRWMEWDKQGCTGKLQRAIVSILNYVIYKNTHIKTVAIPALSSGIFQFPLNLCTKTIVETIRVSLQGKPMMSNLKEIHLVSNEDPTVAAFKAASEFILGKSELGQETTPSFNAMVVNNLTLQIVQGHIEWQTADVIVNSVNPHDITVGPVAKSILQQAGVEMKSEFLATKAKQFQRSQLVLVTKGFNLFCKYIYHVLWHSEFPKPQILKHAMKECLEKCIEQNITSISFPALGTGNMEIKKETAAEILFDEVLTFAKDHVKHQLTVKFVIFPTDLEIYKAFSSEMAKRSKMLSLNNYSVPQSTREEKRENGLEARSPAINLMGFNVEEMCEAHAWIQRILSLQNHHIIENNHILYLGRKEHDILSQLQKTSSVSITEIISPGRTELEIEGARADLIEVVMNIEDMLCKVQEEMARKKERGLWRSLGQWTIQQQKTQDEMKENIIFLKCPVPPTQELLDQKKQFEKCGLQVLKVEKIDNEVLMAAFQRKKKMMEEKLHRQPVSHRLFQQVPYQFCNVVCRVGFQRMYSTPCEIGSHCVAPG

SEQ ID NO: 811780 - protein, 745 aa, Homo sapiens
MDFSMVAGAAAYNEKSGRITSLSLLFQKVFAQIFPQWRKGNTEECLPYKCSETGALGENYSWQIPINHNDFKILKNNERQLCEVLQNKFGCISTLVSPVQEGNSKSLQVFRKMLTPRIELSVWKDDLTTHAVDAVVNAANEDLLHGGGLALALVKAGGFEIQEESKQFVARYGKVSAGEIAVTGAGRLPCKQIIHAVGPRWMEWDKQGCTGKLQRAIVSILNYVIYKNTHIKTVAIPALSSGIFQFPLNLCTKTIVETIRVSLQGKPMMSNLKEIHLVSNEDPTVAAFKAASEFILGKSELGQETTPSFNAMVVNNLTLQIVQGHIEWQTADVIVNSVNPHDITVGPVAKSILQQAGVEMKSEFLATKAKQFQRSQLVLVTKGFNLFCKYIYHVLWHSEFPKPQILKHAMKECLEKCIEQNITSISFPALGTGNMEIKKETAAEILFDEVLTFAKDHVKHQLTVKFVIFPTDLEIYKAFSSEMAKRSKMLSLNNYSVPQSTREEKRENGLEARSPAINLMGFNVEEMCEAHAWIQRILSLQNHHIIENNHILYLGRKEHDILSQLQKTSSVSITEIISPGRTELEIEGARADLIEVVMNIEDMLCKVQEEMARKKERGLWRSLGQWTIQQQKTQDEMKENIIFLKCPVPPTQELLDQKKQFEKCGLQVLKVEKIDNEVLMAAFQRKKKMMEEKLHRQPVSHRLFQQVPYQFCNVVCRVGFQRMYSTPCGRCQCLIIGATLWNLVS

SEQ ID NO: 811781 - protein, 219 aa, Homo sapiens
MDFSMVAGAAAYNEKSETGALGENYSWQIPINHNDFKILKNNERQLCEVLQNKFGCISTLVSPVQEGNSKSLQVFRKMLTPRIELSVWKDDLTTHAVDAVVNAANEDLLHGGGLALALVKAGGFEIQEESKQFVARYGKVSAGEIAVTGAGRLPCKQIIHAVGPRWMEWDKQGCTGKLQRAIVSILNYVIYKNTHIKTVVELPLIWFSSVSPPKSHVKL

SEQ ID NO: 811782 - protein, 97 aa, Homo sapiens
PEEERSRELRRWWLGHQREAGVAQAAGAGTDLERRKRGRKVVLSGWGLPGIRRPAVEPQGSTGQICLPGCLSYAESLAQGGGFSYWPRYLNGMEDRS

SEQ ID NO: 811783 - protein, 97 aa, Homo sapiens; identical to SEQ ID NO: 811782

SEQ ID NO: 811784 - protein, 587 aa, Homo sapiens
MATAAYEQLKLHITPEKFYVEACDDGADDVLTIDRVSTEVTLAVKKDVPPSAVTRPIFGILGTIHLVAGNYLIVITKKIKVGEFFSHVVWKATDFDVLSYKKTMLHLTDIQLQDNKTFLAMLNHVLNVDGFYFSTTYDLTHTLQRLSNTSPEFQEMSLLERADQRFVWNGHLLRELSAQPEVHRFALPVLHGFITMHSCSINGKYFDWILISRRSCFRAGVRYYVRGIDSEGHAANFVETEQIVHYNGSKASFVQTRGSIPVFWSQRPNLKYKPLPQISKVANHMDGFQRHFDSQVIIYGKQVIINLINQKGSEKPLEQTFATMVSSLGSGMMRYIAFDFHKECKNMRWDRLSILLDQVAEMQDELSYFLVDSAGQVVANQEGVFRSNCMDCLDRTNVIQSLLARRSLQAQLQRLGVLHVGQKLEEQDEFEKIYKNAWADNANACAKQYAGTGALKTDFTRTGKRTHLGLIMDGWNSMIRYYKNNFSDGFRQDSIDLFLGNYSVDELESHSPLSVPRDWKFLALPIIMVVAFSMCIICLLMAGDTWTETLAYVLFWGVASIGTFFIILYNGKDFVDAPRLVQKEKID

SEQ ID NO: 811785 - protein, 90 aa, Homo sapiens
VKFAVLPGFLLKDLPPPRLKVPKNQKPPTLEKDFEFALMDLKEVADHGNADTIHHSRDCRYAARGPGAGELTDINDGVAVTKGMTVSQRK

SEQ ID NO: 811786 - protein, 587 aa, Homo sapiens; identical to SEQ ID NO: 811784

SEQ ID NO: 811787 - protein, 264 aa, Homo sapiens
MVSSLGSGMMRYIAFDFHKECKNMRWDRLSILLDQVAEMQDELSYFLVDSAGQVVANQEGVFRSNCMDCLDRTNVIQSLLARRSLQAQLQRLGVLHVGQKLEEQDEFEKIYKNAWADNANACAKQYAGTGALKTDFTRTGKRTHLGLIMDGWNSMIRYYKNNFSDGFRQDSIDLFLGNYSVDELESHSPLSVPRDWKFLALPIIMVVAFSMCIICLLMAGDTWTETLAYVLFWGVASIGTFFIILYNGKDFVDAPRLVQKEKID

SEQ ID NO: 811788 - protein, 587 aa, Homo sapiens; identical to SEQ ID NO: 811784

SEQ ID NO: 811789 - protein, 215 aa, Homo sapiens
MATAAYEQLKLHITPEKFYVEACDDGADDVLTIDRVSTEVTLAVKKDVPPSAVTRPIFGILGTIHLVAGNYLIVITKKIKVGEFFSHVVWKATDFDVLSYKKTMLHLTDIQLQDNKTFLAMLNHVLNVDGFYFSTTYDLTHTLQRLSNTSPEFQEMSLLERADQRFVWNGHLLRELSAQPEVQSVCAFPGLTWLYYHAFMFYLRENTLTGFSSKE

SEQ ID NO: 811790 - protein, 186 aa, Homo sapiens
MATAAYEQLKLHITPEKFYVEACDDGADDVLTIDRVSTEVTLAVKKDVPPSAVTRPIFGILGTIHLVAGNYLIVITKKIKVGEFFSHVVWKATDFDVLSYKKTMLHLTDIQLQDNKTFLAMLNHVLNVDGFYFSTTYDLTHTLQRLSNTSPEFQEMSLLERADQRFVWNGHLLRELSAQPEVMYTK

SEQ ID NO: 811791 - protein, 111 aa, Homo sapiens
MATAAYEQLKLHITPEKFYVEACDDGADDVLTIDRVSTEVTLAVKKDVPPSAVTRPIFGILGTIHLVAGNYLIVITKKIKVGEFFSHVVWKATDFDVLSYKKTMLHLTDIQ

SEQ ID NO: 811792 - protein, 194 aa, Homo sapiens
MATAAYEQLKLHITPEKFYVEACDDGADDVLTIDRVSTEVTLAVKKDVPPSAVTRPIFGILGTIHLVAGNYLIVITKKIKVGEFFSHVVWKATDFDVLSYKKTMLHLTDIQFSTTYDLTHTLQRLSNTSPEFQEMSLLERADQRFVWNGHLLRELSAQPEVQSVCAFPGLTWLYYHAFMFYLRENTLTGFSSKE

SEQ ID NO: 811793 - protein, 98 aa, Homo sapiens
IRCKGRRLHCIFTVPVVLQFTLLPGVSMASVGIAIYTSMMTSDNYYYTHSIWHILLAGSAALLLPPPDQPAEPWACSQKFPCHYQICKNDREELYAVT

SEQ ID NO: 811794 - protein, 771 aa, Homo sapiens [sequence omitted]

SEQ ID NO: 811795 - protein, 771 aa, Homo sapiens [sequence omitted]

SEQ ID NO: 811796 - protein, 771 aa, Homo sapiens [sequence omitted]

SEQ ID NO: 811797 - protein, 771 aa, Homo sapiens [sequence omitted]

SEQ ID NO: 811798 - protein, 693 aa, Homo sapiens
RLGSEAWVVCASTLLHRRWRYRHFRSGAPPVINPLGTSFPDDTAVQPSFQVGVPLSTAPRSNASVNVSHPAPGDWFVAAHLPPSSQKIELKGLAPTCAYVFQPELLVTRVVEISIMEPDVPLPQTLLSHPSYLKVFVPDYTRELLLELRDCVSNGSLGCPVRLTVGPVTLPSNFQKVLTCTGAPWPCRLLLPSPPWDRWLQVTAESLVGPLGTVAFSAVAALTACRPRSVTVQPLLQSSQNQSFNASSGLLSPSPDHQDLGRSGRVDRSPFCLTNYPVTREDMDVVSVHFQPLDRVSVRVCSDTPSVMRLRLNTGMDSGGSLTISLRANKTEMRNETVVVACVNAASPFLGFNTSLNCTTAFFQGYPLSLSAWSRRANLIIPYPETDNWYLSLQLMCPENAEDCEQAVVHVETTLYLVPCLNDCGPYGQCLLLRRHSYLYASCSCKAGWRGWSCTDNSTAQTVAQQRAATLLLTLSNLMFLAPIAVSVRRFFLVEASVYAYTMFFSTFYHACDQPGEAVLCILSYDTLQYCDFLGSGAAIWVTILCMARLKTVLKYVLFLLGTLVIAMSLQLDRRGMWNMLGPCLFAFVIMASMWAYRCGHRRQCYPTSWQRWAFYLLPGVSMASVGIAIYTSMMTSDNYYYTHSIWHILLAGSAALLLPPPDQPAEPWACSQKFPCHYQICKNDREELYAVT

SEQ ID NO: 811799 - protein, 795 aa, Homo sapiens
MGRAGTGTGGEAVAAVVAGPLLLLLLARPPPASAGYSGKSEVGLVSEHFSQAPQRLSFYSWYGSARLFRFRVPPDAVLLRWLLQVSRESGAACTDAEITVHFRSGAPPVINPLGTSFPDDTAVQPSFQVGVPLSTAPRSNASVNVSHPAPGDWFVAAHLPPSSQKIELKGLAPTCAYVFQPELLVTRVVEISIMEPDVPLPQTLLSHPSYLKVFVPDYTRELLLELRDCVSNGSLGCPVRLTVGPVTLPSNFQKVLTCTGAPWPCRLLLPSPPWDRWLQVTAESLVGPLGTVAFSAVAALTACRPRSVTVQPLLQSSQNQSFNASSGLLSPSPDHQDLGRSGRVDRSPFCLTNYPVTREDMDVVSVHFQPLDRVSVRVCSDTPSVMRLRLNTGMDSGGSLTISLRANKTEMRNETVVVACVNAASPFLGFNTSLNCTTAFFQGYPLSLSAWSRRANLIIPYPETDNWYLSLQLMCPENADLLGALVAAGLQITAPAFLWPLPQRDCEQAVVHVETTLYLVPCLNDCGPYGQCLLLRRHSYLYASCSCKAGWRGWSCTDNSTAQTVAQQRAATLLLTLSNLMFLAPIAVSVRRFFLVEASVYAYTMFFSTFYHACDQPGEAVLCILSYDTLQYCDFLGSGAAIWVTILCMARLKTVLKYVLFLLGTLVIAMSLQLDRRGMWNMLGPCLFAFVIMASMWAYRCGHRRQCYPTSWQRWAFYLLPGVSMASVGIAIYTSMMTSDNYYYTHSIWHILLAGSAALLLPPPDQPAEPWACSQKFPCHYQICKNDREELYAVT

SEQ ID NO: 811800 - protein, 732 aa, Homo sapiens [sequence omitted]

SEQ ID NO: 811801 - protein, 695 aa, Homo sapiens
MGRAGTGTGGEAVAAVVAGPLLLLLLARPPPASAGYSGKSEVGLVSEHFSQAPQRLSFYSWYGSARLFRFRVPPDAVLLRWLLQVSRESGAACTDAEITVHFRSGAPPVINPLGTSFPDDTAVQPSFQVGVPLSTAPRSNASVNVSHPAPGDWFVAAHLPPSSQKIELKGLAPTCAYVFQPELLVTRVVEISIMEPDVPLPQTLLSHPSYLKVFVPDYTRELLLELRDCVSNGSLGCPVRLTVGPVTLPSNFQKVLTCTGAPWPCRLLLPSPPWDRWLQVTAESLVGPLGTVAFSAVAALTACRPRSVTVQPLLQSSQNQSFNASSGLLSPSPDHQDLGRSGRVDRSPFCLTNYPVTREDMDVVSVHFQPLDRVSVRVCSDTPSVMRLRLNTGMDSGGSLTISLRANKTEMRNETVVVACVNAASPFLGFNTSLNCTTAFFQGYPLSLSAWSRRANLIIPYPETDNWYLSLQLMCPENAEDCEQAVVHVETTLYLVPCLNDCGPYGQCLLLRRHSYLYASCSCKAGWRGWSCTDNSTAQTVAQQRAATLLLTLSNLMFLAPIAVSVRRFFLVEASVYAYTMFFSTFYHACDQPGEAVLCILSYDTLQYCDFLGSGAAIWVTILCMARLKTVLKYVLFLLGTLVIAMSLQLDRRGMWNMLGPCLFAFVIMASMWVRSRAGWHCCPGARRREPGPLL

SEQ ID NO: 811802 - protein, 311 aa, Homo sapiens
MAALGVLESDLPSAVTLLKNLQEQVMAVTAQVKSLTQKVQAGAYPTEKGLSFLEVKDQLLLMYLMDLTHLILDKASGGSLQGHDAVLRLVEIRTVLEKLRPLDQKLKYQIDKLIKTAVTGSLSENDPLRFKPHPSNMMSKLSSEDEEEDEAEDDQSEASGKKSVKGVSKKYVPPRLVPVHYDETEAEREKKRLERAKRRALSSSVIRELKEQYSDAPEEIRDARHPHVTRQSQEDQHRINYEESMMVRLSVSKREKGRRKRANVMSSQLHSLTHFSDISALTGGTVHLDEDQNPIKKRKKIPQKGRKKKGQ

SEQ ID NO: 811803 - protein, 155 aa, Homo sapiens
PQHELFLFSLFLDNPAYFHHVDETEAEREKKRLERAKRRALSSSVIRELKEQYSDAPEEIRDARHPHVTRQSQEDQHRINYEESMMVRLSVSKREKGRRKRANVMSSQLHSLTHFSDISALTGGTVHLDEDQNPIKKRKKIPQKGRKKKGFRRRR

SEQ ID NO: 811804 - protein, 315 aa, Homo sapiens
MAALGVLESDLPSAVTLLKNLQEQVMAVTAQVKSLTQKVQAGAYPTEKGLSFLEVKDQLLLMYLMDLTHLILDKASGGSLQGHDAVLRLVEIRTVLEKLRPLDQKLKYQIDKLIKTAVTGSLSENDPLRFKPHPSNMMSKLSSEDEEEDEAEDDQSEASGKKSVKGVSKKYVPPRLVPVHYDETEAEREKKRLERAKRRALSSSVIRELKEQYSDAPEEIRDARHPHVTRQSQEDQHRINYEESMMVRLSVSKREKGRRKRANVMSSQLHSLTHFSDISALTGGTVHLDEDQNPIKKRKKIPQKGRKKKGFRRRR

SEQ ID NO: 811805 - protein, 315 aa, Homo sapiens; identical to SEQ ID NO: 811804

SEQ ID NO: 811806 - protein, 311 aa, Homo sapiens; identical to SEQ ID NO: 811802

SEQ ID NO: 811807 - protein, 300 aa, Homo sapiens
MAALGVLESDLPSAVTLLKNLQEQVMAVTAQVKSLTQKVQAGAYPTEKGLSFLEVKDQLLLMYLMDLTHLILDKASGGSLQGHDAVLRLVEIRTVLEKLRPLDQKLKYQIDKLIKTAVTGSLSENDPLRFKPHPSNMMSKLSSEDEEEDEAEDDQSEASGKKSVKGVSKKYVPPRLVPVHYDETEAEREKKRLERAKRRALSSSVIRELKEQYSDAPEEIRDARHPHVTRQSQEDQHRINYEESMMVRLSVSKREKGRRKRANVMSSQLHSLTHFSDISALTGGTVHLDEVRLRYGCSRM

SEQ ID NO: 811808 - protein, 326 aa, Homo sapiens
MAALGVLESDLPSAVTLLKNLQEQVMAVTAQVKSLTQKVQAGAYPTEKGLSFLEVKDQLLLMYLMDLTHLILDKASGGSLQGHDAVLRLVEIRTVLEKLRPLDQKLKYQIDKLIKTAVTGSLSENDPLRFKPHPSNMMSKLSSEDEEEDEAEDDQSEASGKKSVKGVSKKYVPPRLVPVHYDETEAEREKKRLERAKRRALSSSVIRELKEQYSDAPEEIRDARHPHVTRQSQEDQHRINYEESMMVRLSVSKREKGRRKRANVMSSQLHSLTHFSDISALTGGTVHLDEDQNPIKKRKKIPQKGRKKKGFRGGGDYGCTSAATTL

SEQ ID NO: 811809 - protein, 300 aa, Homo sapiens; identical to SEQ ID NO: 811807

SEQ ID NO: 811810 - protein, 315 aa, Homo sapiens; identical to SEQ ID NO: 811804

SEQ ID NO: 811811 - protein, 290 aa, Homo sapiens
MAVTAQVKSLTQKVQAGAYPTEKGLSFLEVKDQLLLMYLMDLTHLILDKASGGSLQGHDAVLRLVEIRTVLEKLRPLDQKLKYQIDKLIKTAVTGSLSENDPLRFKPHPSNMMSKLSSEDEEEDEAEDDQSEASGKKSVKGVSKKYVPPRLVPVHYDETEAEREKKRLERAKRRALSSSVIRELKEQYSDAPEEIRDARHPHVTRQSQEDQHRINYEESMMVRLSVSKREKGRRKRANVMSSQLHSLTHFSDISALTGGTVHLDEDQNPIKKRKKIPQKGRKKKGFRRRR

SEQ ID NO: 811812 - protein, 274 aa, Homo sapiens
FLFCSTQGLSFLEVKDQLLLMYLMDLTHLILDKASGGSLQGHDAVLRLVEIRTVLEKLRPLDQKLKYQIDKLIKTAVTGSLSENDPLRFKPHPSNMMSKLSSEDEEEDEAEDDQSEASGKKSVKGVSKKYVPPRLVPVHYDETEAEREKKRLERAKRRALSSSVIRELKEQYSDAPEEIRDARHPHVTRQSQEDQHRINYEESMMVRLSVSKREKGRRKRANVMSSQLHSLTHFSDISALTGGTVHLDEDQNPIKKRKKIPQKGRKKKGFRRRR

SEQ ID NO: 811813 - protein, 278 aa, Homo sapiens
AHVPYGFEQQLVFHFQEAEDQLLLMYLMDLTHLILDKASGGSLQGHDAVLRLVEIRTVLEKLRPLDQKLKYQIDKLIKTAVTGSLSENDPLRFKPHPSNMMSKLSSEDEEEDEAEDDQSEASGKKSVKGVSKKYVPPRLVPVHYDETEAEREKKRLERAKRRALSSSVIRELKEQYSDAPEEIRDARHPHVTRQSQEDQHRINYEESMMVRLSVSKREKGRRKRANVMSSQLHSLTHFSDISALTGGTVHLDEDQNPIKKRKKIPQKGRKKKGFRRRR

SEQ ID NO: 811814 - protein, 273 aa, Homo sapiens
MKRSTSLYYAQARKDQLLLMYLMDLTHLILDKASGGSLQGHDAVLRLVEIRTVLEKLRPLDQKLKYQIDKLIKTAVTGSLSENDPLRFKPHPSNMMSKLSSEDEEEDEAEDDQSEASGKKSVKGVSKKYVPPRLVPVHYDETEAEREKKRLERAKRRALSSSVIRELKEQYSDAPEEIRDARHPHVTRQSQEDQHRINYEESMMVRLSVSKREKGRRKRANVMSSQLHSLTHFSDISALTGGTVHLDEDQNPIKKRKKIPQKGRKKKGFRRRR

SEQ ID NO: 811815 - protein, 179 aa, Homo sapiens
MMSKLSSEDEEEDEAEDDQSEASGKKSVKGVSKKYVPPRLVPVHYDETEAEREKKRLERAKRRALSSSVIRELKEQYSDAPEEIRDARHPHVTRQSQEDQHRINYEESMMVRLSVSKREKGRRKRANVMSSQLHSLTHFSDISALTGGTVHLDEDQNPIKKRKKIPQKGRKKKGFRRRR

SEQ ID NO: 811816 - protein, 151 aa, Homo sapiens
MAALGVLESDLPSAVTLLKNLQEQVMAVTAQVKSLTQKVQAGAYPTEKGLSFLEVKDQLLLMYLMDLTHLILDKASGGSLQGHDAVLRLVEIRTVLEKLRPLDQKLKYQIDKLIKTAVTGSLSENDPLRFKPHPSNMMSKVRGCSILLIFF

SEQ ID NO: 811817 - protein, 179 aa, Homo sapiens; identical to SEQ ID NO: 811815

SEQ ID NO: 811818 - protein, 770 aa, Homo sapiens
SLGFELTSVEKSLREWSRLSREVIAWLCPSSPNFILNFPPPPSASSVSMVQLFSSPFGYQSPSGHSEEEREGNMKSAKPQVNHSQHGESQRALSPLQSTLSSAASPSQAYETYIENGLICLKHKIRNIEKKKLKLEDYKDRLKSGEHLNPDQLEAVEKYEEVLHNLEFAKELQKTFSGLSLDLLKAQKKAQRREHMLKLEAEKKKLRTILQVQYVLQNLTQEHVQKDFKGGLNGAVYLPSKELDYLIKFSKLTCPERNESLNKHLKDLLSKLLNSGYFESIPVPKNAKEKEVPLEEEMLIQSEKKTQLSKTESVKESESLMEFAQPEIQPQEFLNRRYMTEVDYSNKQGEEQPWEADYARKPNLPKRWDMLTEPDGQEKKQESFKSWEASGKHQEVSKPAVSLEQRKQDTSKLRSTLPEEQKKQEISKSKPSPSQWKQDTPKSKAGYVQEEQKKQETPKLWPVQLQKEQDPKKQTPKSWTPSMQSEQNTTKSWTTPMCEEQDSKQPETPKSWENNVESQKHSLTSQSQISPKSWGVATASLIPNDQLLPRKLNTEPKDVPKPVHQPVGSSSTLPKDPVLRKEKLQDLMTQIQGTCNFMQESVLDFDKPSSAIPTSQPPSATPGSPVASKEQNLSSQSDFLQEPLQATSSPVTCSSNACLVTTDQASSGSETEFMTSETPEAAIPPGKQPSSLASPNPPMAKGSEQGFQSPPASSSSVTINTAPFQAMQTVFNVNAPLPPRKRNKEIKESPYSPGYNQSFTTASTQTPPQC

SEQ ID NO: 811819 - protein, 727 aa, Homo sapiens
PGAGRGSRGPRSVRFPQSPSGHSEEEREGNMKSAKPQVNHSQHGESQRALSPLQSTLSSAASPSQAYETYIENGLICLKHKIRNIEKKKLKLEDYKDRLKSGEHLNPDQLEAVEKYEEVLHNLEFAKELQKTFSGLSLDLLKAQKKAQRREHMLKLEAEKKKLRTILQVQYVLQNLTQEHVQKDFKGGLNGAVYLPSKELDYLIKFSKLTCPERNESLNKHLKDLLSKLLNSGYFESIPVPKNAKEKEVPLEEEMLIQSEKKTQLSKTESVKESESLMEFAQPEIQPQEFLNRRYMTEVDYSNKQGEEQPWEADYARKPNLPKRWDMLTEPDGQEKKQESFKSWEASGKHQEVSKPAVSLEQRKQDTSKLRSTLPEEQKKQEISKSKPSPSQWKQDTPKSKAGYVQEEQKKQETPKLWPVQLQKEQDPKKQTPKSWTPSMQSEQNTTKSWTTPMCEEQDSKQPETPKSWENNVESQKHSLTSQSQISPKSWGVATASLIPNDQLLPRKLNTEPKDVPKPVHQPVGSSSTLPKDPVLRKEKLQDLMTQIQGTCNFMQESVLDFDKPSSAIPTSQPPSATPGSPVASKEQNLSSQSDFLQEPLQATSSPVTCSSNACLVTTDQASSGSETEFMTSETPEAAIPPGKQPSSLASPNPPMAKGSEQGFQSPPASSSSVTINTAPFQAMQTVFNVNAPLPPRKRNKEIKESPYSPGYNQSFTTASTQTPPQC

SEQ ID NO: 811820 - protein, 773 aa, Homo sapiens
GGVGWVSGAAEAAGEDREGRGRRQEEETRVRGGAGPPPQRSCLPQALEGGPGLRQRRPRLPGESPSGHSEEEREGNMKSAKPQVNHSQHGESQRALSPLQSTLSSAASPSQAYETYIENGLICLKHKIRNIEKKKLKLEDYKDRLKSGEHLNPDQLEAVEKYEEVLHNLEFAKELQKTFSGLSLDLLKAQKKAQRREHMLKLEAEKKKLRTILQVQYVLQNLTQEHVQKDFKGGLNGAVYLPSKELDYLIKFSKLTCPERNESLNKHLKDLLSKLLNSGYFESIPVPKNAKEKEVPLEEEMLIQSEKKTQLSKTESVKESESLMEFAQPEIQPQEFLNRRYMTEVDYSNKQGEEQPWEADYARKPNLPKRWDMLTEPDGQEKKQESFKSWEASGKHQEVSKPAVSLEQRKQDTSKLRSTLPEEQKKQEISKSKPSPSQWKQDTPKSKAGYVQEEQKKQETPKLWPVQLQKEQDPKKQTPKSWTPSMQSEQNTTKSWTTPMCEEQDSKQPETPKSWENNVESQKHSLTSQSQISPKSWGVATASLIPNDQLLPRKLNTEPKDVPKPVHQPVGSSSTLPKDPVLRKEKLQDLMTQIQGTCNFMQESVLDFDKPSSAIPTSQPPSATPGSPVASKEQNLSSQSDFLQEPLQATSSPVTCSSNACLVTTDQASSGSETEFMTSETPEAAIPPGKQPSSLASPNPPMAKGSEQGFQSPPASSSSVTINTAPFQAMQTVFNVNAPLPPRKRNKEIKESPYSPGYNQSFTTASTQTPPQC

SEQ ID NO: 811821 - protein, 560 aa, Homo sapiens
SLGFELTSVEKSLREWSRLSREVIAWLCPSSPNFILNFPPPPSASSVSMVQLFSSPFGYQSPSGHSEEEREGNMKSAKPQVNHSQHGESQRALSPLQSTLSSAASPSQAYETYIENGLICLKHKIRNIEKKKLKLEDYKDRLKSGEHLNPDQLEAVEKYEEVLHNLEFAKELQKTFSGLSLDLLKAQKKAQRREHMLKLEAEKKKLRTILQVQYVLQNLTQEHVQKDFKGGLNGAVYLPSKELDYLIKFSKLTCPERNESLNKHLKDLLSKLLNSGYFESIPVPKNAKEKEVPLEEEMLIQSEKKTQLSKTESVKESESLMEFAQPEIQPQEFLNRRYMTEVDYSNKQGEEQPWEADYARKPNLPKRWDMLTEPDGQEKKQESFKSWEASGKHQEVSKPAVSLEQRKQDTSKLRSTLPEEQKKQEISKSKPSPSQWKQDTPKSKAGYVQEEQKKQETPKLWPVQLQKEQDPKKQTPKSWTPSMQSEQNTTKSWTTPMCEEQDSKQPETPKSWENNVESQKHSLTSQSQISPKSWGVATASLIPNDQLLPRKLNTEPKDVS

SEQ ID NO: 811822 - protein, 588 aa, Homo sapiens
SLGFELTSVEKSLREWSRLSREVIAWLCPSSPNFILNFPPPPSASSVSMVQLFSSPFGYQSPSGHSEEEREGNMKSAKPQVNHSQHGESQRALSPLQSTLSSAASPSQAYETYIENGLICLKHKIRNIEKKKLKLEDYKDRLKSGEHLNPDQLEAVEKYEEVLHNLEFAKELQKTFSGLSLDLLKAQKKAQRREHMLKLEAEKKKLRTILQVQYVLQNLTQEHVQKDFKGGLNGAVYLPSKELDYLIKFSKLTCPERNESLSVEDQMEQSSLYFWDLLEGSEKAVVGTTYKHLKDLLSKLLNSGYFESIPVPKNAKEKEVPLEEEMLIQSEKKTQLSKTESVKESESLMEFAQPEIQPQEFLNRRYMTEVDYSNKQGEEQPWEADYARKPNLPKRWDMLTEPDGQEKKQESFKSWEASGKHQEVSKPAVSLEQRKQDTSKLRSTLPEEQKKQEISKSKPSPSQWKQDTPKSKAGYVQEEQKKQETPKLWPVQLQKEQDPKKQTPKSWTPSMQSEQNTTKSWTTPMCEEQDSKQPETPKSWENNVESQKHSLTSQSQISPKSWGVATASLIPNDQLLPRKLNTEPKDVS

SEQ ID NO: 811823 - protein, 686 aa, Homo sapiens
SLGFELTSVEKSLREWSRLSREVIAWLCPSSPNFILNFPPPPSASSVSMVQLFSSPFGYQSPSGHSEEEREGNMKSAKPQVNHSQHGESQRALSPLQSTLSSAASPSQAYETYIENGLICLKHKIRNIEKKKLKLEDYKDRLKSGEHLNPDQLEAVEKYEEVLHNLEFAKELQKTFSGLSLDLLKAQKKAQRREHMLKLEAEKKKLRTILQVQYVLQNLTQEHVQKDFKGGLNGAVYLPSKELDYLIKFSKLTCPERNESLNKHLKDLLSKLLNSGYFESIPVPKNAKEKEVPLEEEMLIQSEKKTQLSKTESVKESESLMEFAQPEIQPQEFLNRRYMTEVDYSNKQGEEQPWEADYARKPNLPKRWDMLTEPDGQEKKQESFKSWEASGKHQEVSKPAVSLEQRKQDTSKLRSTLPEEQKKQEISKSKPSPSQWKQDTPKSKAGYVQEEQKKQETPKLWPVQLQKEQDPKKQTPKSWTPSMQSEQNTTKSWTTPMCEEQDSKQPETPKSWENNVESQKHSLTSQSQISPKSWGVATASLIPNDQLLPRKLNTEPKDVPKPVHQPVGSSSTLPKDPVLRKEKLQDLMTQIQGTCNFMQESVLDFDKPSSAIPTSQPPSATPGSPVASKEQNLSSQSDFLQEPLQVFNVNAPLPPRKRNKEIKESPYSPGYNQSFTTASTQTPPQC

SEQ ID NO: 811824 - protein, 630 aa, Homo sapiens
SLGFELTSVEKSLREWSRLSREVIAWLCPSSPNFILNFPPPPSASSVSMVQLFSSPFGYQSPSGHSEEEREGNMKSAKPQVNHSQHGESQRALSPLQSTLSSAASPSQAYETYIENGLICLKHKIRNIEKKKLKLEDYKDRLKSGEHLNPDQLEAVEKYEEVLHNLEFAKELQKTFSGLSLDLLKAQKKAQRREHMLKLEAEKKKLRTILQVQYVLQNLTQEHVQKDFKGGLNGAVYLPSKELDYLIKFSKLTCPERNESLRVSNGIVPSQRYNHKSFLTDSYMTEVDYSNKQGEEQPWEADYARKPNLPKRWDMLTEPDGQEKKQESFKSWEASGKHQEVSKPAVSLEQRKQDTSKLRSTLPEEQKKQEISKSKPSPSQWKQDTPKSKAGYVQEEQKKQETPKLWPVQLQKEQDPKKQTPKSWTPSMQSEQNTTKSWTTPMCEEQDSKQPETPKSWENNVESQKHSLTSQSQISPKSWGVATASLIPNDQLLPRKLNTEPKDVPKPVHQPVGSSSTLPKDPVLRKEKLQDLMTQIQGTCNFMQESVLDFDKPSSAIPTSQPPSATPGSPVASKEQNLSSQSDFLQEPLQVFNVNAPLPPRKRNKEIKESPYSPGYNQSFTTASTQTPPQ

SEQ ID NO: 811825 - protein, 424 aa, Homo sapiens
MATLSFVFLLLGAVSWPPASASGQEFWPGQSAADILSGAASRRRYLLYDVNPPEGFNLRRDVYIRIASLLKTLLKTEEWVLVLPPWGRLYHWQSPDIHQVRIPWSEFFDLPSLNKNIPVIEYEQFIAESGGPFIDQVYVLQSYAEGWKEGTWEEKVDERPCIDQLLYSQDKHEYYRGWFWGYEETRGLNVSCLSVQGSASIVAPLLLRNTSARSVMLDRAENLLHDHYGGKEYWDTRRSMVFARHLREVGDEFRSRHLNSTDDADRIPFQEDWMKMKVKLGSALGGPYLGVHLRRKDFIWGHRQDVPSLEGAVRKIRSLMKTHRLDKVFVATDAVRKEYEELKKLLPEMVRFEPTWEELELYKDGGVAIIDQWICAHARCLPTSLSAESGSGGFQRFFCPKYSVSEQMVACVHSGHFHTVCLLV

SEQ ID NO: 811826 - protein, 380 aa, Homo sapiens
MATLSFVFLLLGAVSWPPASASGQEFWPGQSAADILSGAASRRRYLLYDVNPPEGFNLRRDVYIRIASLLKTLLKTEEWVLVLPPWGRLYHWQSPDIHQVRIPWSEFFDLPSLNKNIPVIEYEQFIAESGGPFIDQVYVLQSYAEGWKEGTWEEKVDERPCIDQLLYSQDKHEYYRGWFWGYEETRGLNVSCLSVQGSASIVAPLLLRNTSARSVMLDRAENLLHDHYGGKEYWDTRRSMVFARHLREVGDEFRSRHLNSTDDADRIPFQEDWMKMKVKLGSALGGPYLGVHLRRKDFIWGHRQDVPSLEGAVRKIRSLMKTHRLDKVFVATDAVRKEYEELKKLLPEMVRFEPTWEELELYKDGGVAIIDQWICAHASS

SEQ ID NO: 811827 - protein, 113 aa, Homo sapiens
MASLPRNRCSSGFELESVNLFPGSLCEPLLFVKENLPPPSPPQARLQLAIAVGGSWIPSLLPTVKYTPQIRRYFSLMSFCSLTVGIKALSEPWCGGQTAACLCLSHNHPTRPG

SEQ ID NO: 811828 - protein, 438 aa, Homo sapiens
AGSAWPPGAMATLSFVFLLLGAVSWPPASASGQEFWPGQSAADILSGAASRRRYLLYDVNPPEGFNLRRDVYIRIASLLKTLLKTEEWVLVLPPWGRLYHWQSPDIHQVRIPWSEFFDLPSLNKNIPVIEYEQFIAESGGPFIDQVYVLQSYAEGWKEGTWEEKVDERPCIDQLLYSQDKHEYYRGWFWGYEETRGLNVSCLSVQGSASIVAPLLLRNTSARSVMLDRAENLLHDHYGGKEYWDTRRSMVFARHLREVGDEFRSRHLNSTDDADRIPFQEDWMKMKVKLGSALGGPYLGVHLRRKDFIWGHRQDVPSLEGAVRKIRSLMKTHRLDKVFVATDAVRKEYEELKKLLPEMVRFEPTWEELELYKDGGVAIIDQWICAHARFFIGTSVSTFSFRIHEEREILGLDPKTTYNRFCGDQEKACEQPTHWKITY

SEQ ID NO: 811829 - protein, 424 aa, Homo sapiens; identical to SEQ ID NO: 811825

SEQ ID NO: 811830 - protein, 214 aa, Homo sapiens
MLDRAENLLHDHYGGKEYWDTRRSMVFARHLREVGDEFRSRHLNSTDDADRIPFQEDWMKMKVKLGSALGGPYLGVHLRRKDFIWGHRQDVPSLEGAVRKIRSLMKTHRLDKVFVATDAVRKEYEELKKLLPEMVRFEPTWEELELYKDGGVAIIDQWICAHARFFIGTSVSTFSFRIHEEREILGLDPKTTYNRFCGDQEKACEQPTHWKITY

SEQ ID NO: 811831 - protein, 424 aa, Homo sapiens; identical to SEQ ID NO: 811825

SEQ ID NO: 811832 - protein, 185 aa, Homo sapiens [sequence omitted]

SEQ ID NO: 811833 - protein, 209 aa, Homo sapiens [sequence omitted]

SEQ ID NO: 811834 - protein, 424 aa, Homo sapiens; identical to SEQ ID NO: 811825

SEQ ID NO: 811835 - protein, 353 aa, Homo sapiens
MATLSFVFLLLGAVSWPPASASGQEFWPGQSAADILSGAASRRRYLLYDVNPPEGFNLRRDVYIRIASLLKTLLKTEEWVLVLPPWGRLYHWQSPDIHQVRIPWSEFFDLPSLNKNIPVIEYEQFIAESGGPFIDQVYVLQSYAEGWKEGTWEEKVDERPCIDQLLYSQDKHEYYRGWFWGYEETRGLNVSCLSVQGSASIVAPLLLRNTSARSVMLDRAENLLHDHYGGKEYWDTRRSMVFARHLREVGDEFRSRHLNSTDDADRIPFQEDWMKMKVKLGSALGGPYLGVHLRRKDFIWGHRQDVPSLEGAVRKIRSLMKTHRLDKVFVATDAVRKETVPFSSVAFSRLRAV

SEQ ID NO: 811836 - protein, 178 aa, Homo sapiens
MATLSFVFLLLGAVSWPPASASGQEFWPGQSAADILSGAASRRRYLLYDVNPPEGFNLRRDVYIRIASLLKTLLKTEEWVLVLPPWGRLYHWQSPDIHQVRIPWSEFFDLPSLNKNIPVIEYEQFIAESGGPFIDQVYVLQSYAEGWKEGTWEEKVDERPCIDQLLYSQDKHEYYSPH

SEQ ID NO: 811837 - protein, 255 aa, Homo sapiens
MATLSFVFLLLGAVSWPPASASGQEFWPGQSAADILSGAASRRRYLLYDVNPPEGFNLRRDVYIRIASLLKTLLKTEEWVLVLPPWGRLYHWQSPDIHQVRIPWSEFFDLPSLNKNIPVIEYEQFIAESGGPFIDQVYVLQSYAEGWKEGTWEEKVDERPCIDQLLYSQDKHEYYRGWFWGYEETRGLNVSCLSVQGSASIVAPLLLRNTSARSVMLDRAENLLHDHYGGKEYWDVSVSSGAFFSVSVCCPLFSF

SEQ ID NO: 811838 - protein, 485 aa, Homo sapiens [sequence omitted]

SEQ ID NO: 811839 - protein, 485 aa, Homo sapiens [sequence omitted]

SEQ ID NO: 811840 - protein, 112 aa, Homo sapiens
CCFRVHGMRPLGREAPVVSDTEATILCLLAWAGLAAGDRVYIHPFHLVIHNESTCEQLAKANAGKPKDPTFIPAPIQAKTSPVDEKALQDLFFVFWWRRLTPNTGLGGGPGQ

SEQ ID NO: 811841 - protein, 467 aa, Homo sapiens
MRKRAPQSEMAPAGVSLRATILCLLAWAGLAAGDRVYIHPFHLVIHNESTCEQLAKANAGKPKDPTFIPAPIQAKTSPVDEKALQDQLVLVAAKLDTEDKLRAAMVGMLANFLGFRIYGMHSELWGVVHGATVLSPTAVFGTLASLYLGALDHTADRLQAILGVPWKDKNCTSRLDAHKVLSALQAVQGLLVAQGRADSQAQLLLSTVVGVFTAPGLHLKQPFVQGLALYTPVVLPRSLDFTELDVAAEKIDRFMQAVTGWKTGCSLTGASVDSTLAFNTYVHFQGKMKGFSLLAEPQEFWVDNSTSVSVPMLSGMGTFQHWSDIQDNFSVTQVPFTESACLLLIQPHYASDLDKVEGLTFQQNSLNWMKKLSPRTIHLTMPQLVLQGSYDLQDLLAQAELPAILHTELNLHELEADEREPTESTQQLNKPEVLEVTLNRPFLFAVYDQSATALHFLGRVANPLSTA

SEQ ID NO: 811842 - protein, 485 aa, Homo sapiens [sequence omitted]

SEQ ID NO: 811843 - protein, 485 aa, Homo sapiens [sequence omitted]

SEQ ID NO: 811844 - protein, 485 aa, Homo sapiens [sequence omitted]

SEQ ID NO: 811845 - protein, 485 aa, Homo sapiens [sequence omitted]

SEQ ID NO: 811846 - protein, 500 aa, Homo sapiens
THASADAWGVLQQKGMRKRAPQSEMAPAGVSLRATILCLLAWAGLAAGDRVYIHPFHLVIHNESTCEQLAKANAGKPKDPTFIPAPIQAKTSPVDEKALQDQLVLVAAKLDTEDKLRAAMVGMLANFLGFRIYGMHSELWGVVHGATVLSPTAVFGTLASLYLGALDHTADRLQAILGVPWKDKNCTSRLDAHKVLSALQAVQGLLVAQGRADSQAQLLLSTVVGVFTAPGLHLKQPFVQGLALYTPVVLPRSLDFTELDVAAEKIDRFMQAVTGWKTGCSLTGASVDSTLAFNTYVHFQGKMKGFSLLAEPQEFWVDNSTSVSVPMLSGMGTFQHWSDIQDNFSVTQVPFTESACLLLIQPHYASDLDKVEGLTFQQNSLNWMKKLSPRTIHLTMPQLVLQGSYDLQDLLAQAELPAILHTELNLQKLSNDRIRVGEVLNSIFFELEADEREPTESTQQLNKPEVLEVTLNRPFLFAVYDQSATALHFLGRVANPLSTA

SEQ ID NO: 811847 - protein, 467 aa, Homo sapiens
MRKRAPQSEMAPAGVSLRATILCLLAWAGLAAGDRVYIHPFHLVIHNESTCEQLAKANAGKPKDPTFIPAPIQAKTSPVDEKALQDQLVLVAAFLGFRIYGMHSELWGVVHGATVLSPTAVFGTLASLYLGALDHTADRLQAILGVPWKDKNCTSRLDAHKVLSALQAVQGLLVAQGRADSQAQLLLSTVVGVFTAPGLHLKQPFVQGLALYTPVVLPRSLDFTELDVAAEKIDRFMQAVTGWKTGCSLTGASVDSTLAFNTYVHFQGKMKGFSLLAEPQEFWVDNSTSVSVPMLSGMGTFQHWSDIQDNFSVTQVPFTESACLLLIQPHYASDLDKVEGLTFQQNSLNWMKKLSPRTIHLTMPQLVLQGSYDLQDLLAQAELPAILHTELNLQKLSNDRIRVGEVLNSIFFELEADEREPTESTQQLNKPEVLEVTLNRPFLFAVYDQSATALHFLGRVANPLSTA

SEQ ID NO: 811848 - protein, 485 aa, Homo sapiens [sequence omitted]

SEQ ID NO: 811849 - protein, 455 aa, Homo sapiens
MRKRAPQSEMAPAGVSLRATILCLLAWAGLAAGDRVYIHPFHLVIHNESTCEQLAKANAGKPKDPTFIPAPIQAKTSPVDEKALQDQLVLVAAKLDTEDKLRAAMVGMLANFLGFRIYGMHSELWGVVHGATVLSPTAVFGTLASLYLGALDHTADRLQAILGVPWKDKNCTSRLDAHKVLSALQAVQGLLVAQGRADSQAQLLLSTVVGVFTAPGLHLKQPFVQGLALYTPVVLPRSLDFTELDVAAEKIDRFMQAVTGWKTGCSLTGASVDSTLAFNTYVHFQGKMKGFSLLAEPQEFWVDNSTSVSVPMLSGMGTFQHWSDIQDNFSVTQVPFTESACLLLIQPHYASDLDKVEGLTFQQNSLNWMKKLSPRTIHLTMPQLVLQGSYDLQDLLAQAELPAILHTELNLQKLSNDRIRVGEVLNSIFFELEADEREPTESTSLPTFSFLMSRL

SEQ ID NO: 811850 - protein, 207 aa, Homo sapiens
LSPVWISGKMKGFSLLAEPQEFWVDNSTSVSVPMLSGMGTFQHWSDIQDNFSVTQVPFTESACLLLIQPHYASDLDKVEGLTFQQNSLNWMKKLSPRTIHLTMPQLVLQGSYDLQDLLAQAELPAILHTELNLQKLSNDRIRVGEVLNSIFFELEADEREPTESTQQLNKPEVLEVTLNRPFLFAVYDQSATALHFLGRVANPLSTA

SEQ ID NO: 811851 - protein, 121 aa, Homo sapiens
RHSWMKKLSPRTIHLTMPQLVLQGSYDLQDLLAQAELPAILHTELNLQKLSNDRIRVGEVLNSIFFELEADEREPTESTQQLNKPEVLEVTLNRPFLFAVYDQSATALHFLGRVANPLSTA

SEQ ID NO: 811852 - protein, 172 aa, Homo sapiens
MRKRAPQSEMAPAGVSLRATILCLLAWAGLAAGDRVYIHPFHLVIHNESTCEQLAKANAGKPKDPTFIPAPIQAKTSPVDEKALQDQLVLVAAKLDTEDKLRAAMVGMLANFLGFRIYGMHSELWGVVHGATVLSPTAVFGTLASLYLGALDHTADRLQAILGRVANPLSTA

SEQ ID NO: 811853 - protein, 73 aa, Homo sapiens
DELQVFFGPMLRVLHQLIDACRRCRRGFRPSPASGTFHQRSTMTVPWRPGKRRITYKEEEDLTLQPRSCLQCS

SEQ ID NO: 811854 - protein, 174 aa, Homo sapiens
IRHERHEPVPASSAPESLVGLQEGKSTEQGNHDQLKELYSAGNLTVLATDPLLHQDPVQLDFHFRLTSQTSAHWHGLLCDRRLFLDIPYQALDQGNRESLTATLEYVEEKTNVDSVFVNFQNDRNDRGALLRAFSYMGFEVVRPDHPALPPLDNVIFMVYPLERDVGHLPSEPP

SEQ ID NO: 811855 - protein, 130 aa, Homo sapiens
MTDTAEAVPKFEEMFASRFTENDKEYQEYLKRPPESPPIVEEWNSRAVTAFCLEPGFAWMAMVTHPLGSTATGPKGGSGLSGSLLWLLPLVVAPAFLGISAQRSRAEPRVLGVARRCLSPLRSRSIPAWE

SEQ ID NO: 811856 - protein, 118 aa, Homo sapiens
MTDTAEAVPKFEEMFASRFTENDKEYQEYLKRPPESPPIVEEWNSRAGGNQRNRGNRLQDNRQFRGRDNRWGWPSDNRSNQWHGRSWGNNYPQHRQEPYYPQQYGHYGYNQRPPYGYY

SEQ ID NO: 811857 - protein, 118 aa, Homo sapiens; identical to SEQ ID NO: 811856

SEQ ID NO: 811858 - protein, 118 aa, Homo sapiens; identical to SEQ ID NO: 811856

SEQ ID NO: 811859 - protein, 118 aa, Homo sapiens; identical to SEQ ID NO: 811856

SEQ ID NO: 811860 - protein, 134 aa, Homo sapiens
MTDTAEAVPKFEEMFASRFTENDKEYQEYLKRPPESPPIVEEWNSRAGGNQRNRGNRLQDNRQFRGRDNRWGWPSDNRSNQWHGRSWGNNYPQHRQEPYYPQQYGHYGYNQRPRSVSPSIGYACIPPSLLRLFF

SEQ ID NO: 811861 - protein, 295 aa, Homo sapiens
DPLPECDVRITMASYPYRQGCPGAAGQAPGAPPGSYYPGPPNSGGQYGSGLPPGGGYGGPAPGGPYGPPAGGGPYGHPNPGMFPSGTPGGPYGGAAPGGPYGQPPPSSYGAQQPGLYGQGGAPPNVDPEAYSWFQSVDSDHSGYISMKELKQALVNCNWSSFNDETCLMMINMFDKTKSGRIDVYGFSALWKFIQQWKNLFQQYDRDRSGSISYTELQQALSQMGYNLSPQFTQLLVSRYCPRSANPAMQLDRFIQVCTQLQVLTEAFREKDTAVQGNIRLSFEDFVTMTASRML

SEQ ID NO: 811862 - protein, 295 aa, Homo sapiens; identical to SEQ ID NO: 811861

SEQ ID NO: 811863 - protein, 295 aa, Homo sapiens; identical to SEQ ID NO: 811861

SEQ ID NO: 811864 - protein, 295 aa, Homo sapiens; identical to SEQ ID NO: 811861

SEQ ID NO: 811865 - protein, 295 aa, Homo sapiens; identical to SEQ ID NO: 811861

SEQ ID NO: 811866 - protein, 293 aa, Homo sapiens
HASDHASTHACGYPYRQGCPGAAGQAPGAPPGSYYPGPPNSGGQYGSGLPPGGGYGGPAPGGPYGPPAGGGPYGHPNPGMFPSGTPGGPYGGAAPGGPYGQPPPSSYGAQQPGLYGQGGAPPNVDPEAYSWFQSVDSDHSGYISMKELKQALVNCNWSSFNDETCLMMINMFDKTKSGRIDVYGFSALWKFIQQWKNLFQQYDRDRSGSISYTELQQALSQMGYNLSPQFTQLLVSRYCPRSANPAMQLDRFIQVCTQLQVLTEAFREKDTAVQGNIRLSFEDFVTMTASRML

SEQ ID NO: 811867 - protein, 348 aa, Homo sapiens
LGPHRSRLALAWAPQPPKALMGALGGGISHDRRFRVLVPPISFGASDKNPGFRTHPTLHQSHQETLVVAGPQGCPGAAGQAPGAPPGSYYPGPPNSGGQYGSGLPPGGGYGGPAPGGPYGPPAGGGPYGHPNPGMFPSGTPGGPYGGAAPGGPYGQPPPSSYGAQQPGLYGQGGAPPNVDPEAYSWFQSVDSDHSGYISMKELKQALVNCNWSSFNDETCLMMINMFDKTKSGRIDVYGFSALWKFIQQWKNLFQQYDRDRSGSISYTELQQALSQMGYNLSPQFTQLLVSRYCPRSANPAMQLDRFIQVCTQLQVLTEAFREKDTAVQGNIRLSFEDFVTMTASRML

SEQ ID NO: 811868 - protein, 295 aa, Homo sapiens
LVRGRVLIGRGMASYPLPAGCPGAAGQAPGAPPGSYYPGPPNSGGQYGSGLPPGGGYGGPAPGGPYGPPAGGGPYGHPNPGMFPSGTPGGPYGGAAPGGPYGQPPPSSYGAQQPGLYGQGGAPPNVDPEAYSWFQSVDSDHSGYISMKELKQALVNCNWSSFNDETCLMMINMFDKTKSGRIDVYGFSALWKFIQQWKNLFQQYDRDRSGSISYTELQQALSQMGYNLSPQFTQLLVSRYCPRSANPAMQLDRFIQVCTQLQVLTEAFREKDTAVQGNIRLSFEDFVTMTASRML

SEQ ID NO: 811869 - protein, 285 aa, Homo sapiens
MLKCTLVSEGCPGAAGQAPGAPPGSYYPGPPNSGGQYGSGLPPGGGYGGPAPGGPYGPPAGGGPYGHPNPGMFPSGTPGGPYGGAAPGGPYGQPPPSSYGAQQPGLYGQGGAPPNVDPEAYSWFQSVDSDHSGYISMKELKQALVNCNWSSFNDETCLMMINMFDKTKSGRIDVYGFSALWKFIQQWKNLFQQYDRDRSGSISYTELQQALSQMGYNLSPQFTQLLVSRYCPRSANPAMQLDRFIQVCTQLQVLTEAFREKDTAVQGNIRLSFEDFVTMTASRML

SEQ ID NO: 811870 - protein, 412 aa, Homo sapiens
LGPHRSRLALAWAPQPPKALMGALGGGISHDRRFRVLVPPISFGASDKNPGFRTHPTLHQSHQETLVVAGATSELVVTTDLVQHRHFACRKVNPEKTQNLPEVTRQLGSRAEVRTRAIFRCLFPSVSCFSQEYRSKGCPGAAGQAPGAPPGSYYPGPPNSGGQYGSGLPPGGGYGGPAPGGPYGPPAGGGPYGHPNPGMFPSGTPGGPYGGAAPGGPYGQPPPSSYGAQQPGLYGQGGAPPNVDPEAYSWFQSVDSDHSGYISMKELKQALVNCNWSSFNDETCLMMINMFDKTKSGRIDVYGFSALWKFIQQWKNLFQQYDRDRSGSISYTELQQALSQMGYNLSPQFTQLLVSRYCPRSANPAMQLDRFIQVCTQLQVLTEAFREKDTAVQGNIRLSFEDFVTMTASRML

SEQ ID NO: 811871 - protein, 388 aa, Homo sapiens
LGPHRSRLALAWAPQPPKALMGALGGGISHDRRFRVLVPPISFGASDKNPGFRTHPTLHQSHQETLVVAGATSELVVTTDLVQHRHFACRKVNPEKTQNLPEVTRQLGSRAEGCPGAAGQAPGAPPGSYYPGPPNSGGQYGSGLPPGGGYGGPAPGGPYGPPAGGGPYGHPNPGMFPSGTPGGPYGGAAPGGPYGQPPPSSYGAQQPGLYGQGGAPPNVDPEAYSWFQSVDSDHSGYISMKELKQALVNCNWSSFNDETCLMMINMFDKTKSGRIDVYGFSALWKFIQQWKNLFQQYDRDRSGSISYTELQQALSQMGYNLSPQFTQLLVSRYCPRSANPAMQLDRFIQVCTQLQVLTEAFREKDTAVQGNIRLSFEDFVTMTASRML

SEQ ID NO: 811872 - protein, 295 aa, Homo sapiens; identical to SEQ ID NO: 811861

SEQ ID NO: 811873 - protein, 332 aa, Homo sapiens
DPLPECDVRITMASYPYRQGCPGAAGQAPGAPPGSYYPGPPNSGGQYGSGLPPGGGYGGPAPGGPYGPPAGGGPYGHPNPGMFPSGTPGGPYGGAAPGGPYGQPPPSSYGAQQPGLYGQGIHAEGAAPVWDMLSLWQREGAGELARMHNASYSFSGSGAPPNVDPEAYSWFQSVDSDHSGYISMKELKQALVNCNWSSFNDETCLMMINMFDKTKSGRIDVYGFSALWKFIQQWKNLFQQYDRDRSGSISYTELQQALSQMGYNLSPQFTQLLVSRYCPRSANPAMQLDRFIQVCTQLQVLTEAFREKDTAVQGNIRLSFEDFVTMTASRML

SEQ ID NO: 811874 - protein, 149 aa, Homo sapiens
MKELKQALVNCNWSSFNDETCLMMINMFDKTKSGRIDVYGFSALWKFIQQWKNLFQQYDRDRSGSISYTELQQALSQMGYNLSPQFTQLLVSRYCPRSANPAMQLDRFIQVCTQLQVLTEAFREKDTAVQGNIRLSFEDFVTMTASRML

SEQ ID NO: 811875 - protein, 295 aa, Homo sapiens; identical to SEQ ID NO: 811861

SEQ ID NO: 811876 - protein, 295 aa, Homo sapiens; identical to SEQ ID NO: 811861

SEQ ID NO: 811877 - protein, 123 aa, Homo sapiens
IASFVSSSFVQSWDGRPAPLGWPKQYQHIIPWSGQVFPDHVGSHKALAVGPIFWGMIQSEPQLLVSRYCPRSANPAMQLDRFIQVCTQLQVLTEAFREKDTAVQGNIRLSFEDFVTMTASRML

SEQ ID NO: 811878 - protein, 413 aa, Homo sapiens
CLVLVEPLHRDGHRMSSKYPRSVRRCLPLWALTLEAALILLFYFFTHYDASLEDQKGLVASYQVGQDLTVMAAIGLGFLTSSFRRHSWSSVAFNLFMLALGVQWAILLDGFLSQFPSGKVVITLFSIRLATMSALSVLISVDAVLGKVNLAQLVVMVLVEVTALGNLRMVISNIFNTDYHMNMMHIYVFAAYFGLSVAWCLPKPLPEGTEDKDQTATIPSLSAMLGALFLWMFWPSVNSALLRSPIQRKNAMFNTYYALAVSVVTAISGSSLAHPQRKISKTYVHSAVLAGGVAVGTSCHLIPSPWLAMVLGLVAGLISVGGAKYLPVCCNRVLGIHHISIMGSIFSLLGLLGEIIYIVLLVLDTVWSRQWHDWLPGPPQHWGTQLGHRDSSHVWSPDRFAPKSQNMESTSCG

SEQ ID NO: 811879 - protein, 413 aa, Homo sapiens; identical to SEQ ID NO: 811878

SEQ ID NO: 811880 - protein, 413 aa, Homo sapiens; identical to SEQ ID NO: 811878

SEQ ID NO: 811881 - protein, 335 aa, Homo sapiens
CLVLVEPLHRDGHRMSSKYPRSVRRCLPLWALTLEAALILLFYFFTHYDASLEDQKGLVASYQVGQDLTVMAAIGLGFLTSSFRRHSWSSVAFNLFMLALGVQWAILLDGFLSQFPSGKVVITLFSIRLATMSALSVLISVDAVLGKVNLAQLVVMVLVEVTALGNLRMVISNIFNTDYHMNMMHIYVFAAYFGLSVAWCLPKPLPEGTEDKDQTATIPSLSAMLGALFLWMFWPSVNSALLRSPIQRKNAMFNTYYALAVSVVTAISGSSLAHPQRKISKTYVHSAVLAGGVAVGTSCHLIPSPWLAMVLGLVAGLISVGGAKYLPFPHLAVGF

SEQ ID NO: 811882 - protein, 67 aa, Homo sapiens
LLSYLDRHKLDVVSCGKSTVRVQKAICSGFFRNAAKKDPQEGYRTLIDQQVVYIHPSSALFNRQPEW

SEQ ID NO: 811883 - protein, 400 aa, Homo sapiens
QTRIFDPAPPGSRKVVIATNIAETSLTIDGIYYVVDPGFVKQKVYNSKTGIDQLVVTPISQAQAKQRAGRAGRTGPGKCYRLYTERAYRDEMLTTNVPEIQRTNLASTVLSLKAMGINDLLSFDFMDAPPMETLITAMEQLYTLGALDDEGLLTRLGRRMAEFPLEPMLCKMLIMSVHLGCSEEMLTIVSMLSVQNVFYRPKDKQALADQKKAKFHQTEGDHLTLLAVYNSWKNNKFSNPWCYENFIQARSLRRAQDIRKQMLGIMDRHKLDVVSCGKSTVRVQKAICSGFFRNAAKKDPQEGYRTLIDQQVVYIHPSSALFNRQPEWVVYHELVLTTKEYMREVTTIDPRWLVEFAPAFFKVSDPTKLSKQKKQQRLEPLYNRYEEPNAWRISRAFRRR

SEQ ID NO: 811884 - protein, 241 aa, Homo sapiens
MAEFPLEPMLCKMLIMSVHLGCSEEMLTIVSMLSVQNVFYRPKDKQALADQKKAKFHQTEGDHLTLLAVYNSWKNNKFSNPWCYENFIQARSLRRAQDIRKQMLGIMDRHKLDVVSCGKSTVRVQKAICSGFFRNAAKKDPQEGYRTLIDQQVVYIHPSSALFNRQPEWVVYHELVLTTKEYMREVTTIDPRWLVEFAPAFFKVSDPTKLSKQKKQQRLEPLYNRYEEPNAWRISRAFRRR

SEQ ID NO: 811885 - protein, 76 aa, Homo sapiens
RWGLALSPSLECSGAISAHCNLGLLGSTILLPLPPKALGLQLRATVLCTEEAPYLAEHQAGLARPGFGTYGKLVWM

SEQ ID NO: 811886 - protein, 400 aa, Homo sapiens; identical to SEQ ID NO: 811883

SEQ ID NO: 811887 - protein, 349 aa, Homo sapiens
QTRIFDPAPPGSRKVVIATNIAETSLTIDGIYYVVDPGFVKQKVYNSKTGIDQLVVTPISQAQAKQRAGRAGRTGPGKCYRLYTERAYRDEMLTTNVPEIQRTNLASTVLSLKAMGINDLLSFDFMDAPPMETLITAMEQLYTLGALDDEGLLTRLGRRMAEFPLEPMLCKMLIMSVHLGCSEEMLTIVSMLSVQNVFYRPKDKQALADQKKAKFHQTEGDHLTLLAVYNSWKNNKFSNPWCYENFIQARSLRRAQDIRKQMLGIMDRHKLDVVSCGKSTVRVQKAICSGFFRNAAKKDPQEGYRTLIDQQVVYIHPSSALFNRQPEWDLYSRFSEWKSGTNCSSLSGT

SEQ ID NO: 811888 - protein, 327 aa, Homo sapiens
QTRIFDPAPPGSRKVVIATNIAETSLTIDGIYYVVDPGFVKQKVYNSKTGIDQLVVTPISQAQAKQRAGRAGRTGPGKCYRLYTERAYRDEMLTTNVPEIQRTNLASTVLSLKAMGINDLLSFDFMDAPPMETLITAMEQLYTLGALDDEGLLTRLGRRMAEFPLEPMLCKMLIMSVHLGCSEEMLTIVSMLSVQNVFYRPKDKQALADQKKAKFHQTEGDHLTLLAVYNSWKNNKFSNPWCYENFIQARSLRRAQDIRKQMLGIMDRHKLDVVSCGKSTVRVQKAICSGFFRNAAKKDPQEGYRTLIDQQVVYIHPSSALFNRQPE

SEQ ID NO: 811889 - protein, 335 aa, Homo sapiens
QTRIFDPAPPGSRKVVIATNIAETSLTIDGIYYVVDPGFVKQKVYNSKTGIDQLVVTPISQAQAKQRAGRAGRTGPGKCYRLYTERAYRDEMLTTNVPEIQRTNLASTVLSLKAMGINDLLSFDFMDAPPMETLITAMEQLYTLGALDDEGLLTRLGRRMAEFPLEPMLCKMLIMSVHLGCSEEMLTIVSMLSVQNVFYRPKDKQALADQKKAKFHQTEGDHLTLLAVYNSWKNNKFSNPWCYENFIQARSLRRAQDIRKQMLGIMDRHKLDVVSCGKSTVRVQKAICSGFFRNAAKKDPQEGYRTLIDQQVVYIHPSSALFNRQPEWTVPMGHV

SEQ ID NO: 811890 - protein, 138 aa, Homo sapiens
STRIPVPVGLHQQAPVLRVPGILGVGWVGEFLPTGRYGRTGRHTFATLGGSGRGRAGVSPRAAVAGRAAVMDQVMQFVEPSRQFVKDSIRLVKRCTKPDRKEFQKIAMATAIGFAIMGFIGFFVKLIHIPINNIIVGG

SEQ ID NO: 811891 - protein, 119 aa, Homo sapiens
GGRGAEQPTHASGSARHRPFLGVRSRPCRPPRGSAPRAPGAASPPDARGPGGVCCSSSARGFQRRSFPRLGREGALIFDREDGCWLPAGLDSDTFPIFAHRPLVGGAVPFGRHYQIMGG

SEQ ID NO: 811892 - protein, 153 aa, Homo sapiens
LDKVLKTAYILSIAVNEATFTKSSSERVSNISETDVRISLSVNPLTLPLTSTRISMSLGDAAPWMYLVFCVHHKGQSYLEFYYYIKSWVDKMQEDLVTLAKTASGVNQLVDIYEKYQDLYTVEPNNARQLVEIAARDIEKLLSNRSKALVVSV

SEQ ID NO: 811893 - protein, 105 aa, Homo sapiens
MAAGCLLALTLTLFQSLLIGPSSEEPFPSAVTIKSWVDKMQEDLVTLAKTASGVNQLVDIYEKYQDLYTVEPNNARQLVEIAARDIEKLLSNRSKALVVSVSRSK

SEQ ID NO: 811894 - protein, 136 aa, Homo sapiens
MAAGCLLALTLTLFQSLLIGPSSEEPFPSAVTIKSWVDKMQEDLVTLAKTASGVNQLVDIYEKYQDLYTVEPNNARQLVEIAARDIEKLLSNRSKALVKMKMKLKEKIYLRSSTWNRKIQRNKRFSVVFLKSLQLM

SEQ ID NO: 811895 - protein, 113 aa, Homo sapiens
MAAGCLLALTLTLFQSLLIGPSSEEPFPSAVTIKSWVDKMQEDLVTLAKTASGVNQLVDIYEKYQDLYTVEPNNARQLVEIAARDIEKLLSNRSKALVEATGGSAPTKQGNKQ

SEQ ID NO: 811896 - protein, 70 aa, Homo sapiens
EAAAGAMSGREGGKKKPLKQPKKQAKEMDEEDKAFKQKQKEEQKKLEELKAKAAGKGALATGGIKKSGKK

SEQ ID NO: 811897 - protein, 70 aa, Homo sapiens; identical to SEQ ID NO: 811896

SEQ ID NO: 811898 - protein, 518 aa, Homo sapiens
MTCPDKPGQLINWFICSLCVPRVRKLWSSRRPRTRRNLLLGTACAIYLGFLVSQVGRASLQHGQAAEKGPHRSRDTAEPSFPEIPLDGTLAPPESQGNGSTLQPNVVYITLRSKRSKPANIRGTVKPKRRKKHAVASAAPGQEALVGPSLQPQEAAREADAVAPGYAQGANLVKIGERPWRLVRVRECEPGAQTSCSPAPGRATLGSTARAPSWLSKDDIRRMRLLADSAVAGLRPVSSRSGARLLVLEGGAPGAVLRCGPSPCGLLKQPLDMSEVFAFHLDRILGLNRTLPSVSRKAEFIQDGRPCPIILWDASLSSASNDTHSSVKLTWGTYQQLLKQKCWQNGRVPKPESGCTEIHHHEWSKMALFDFLLQIYNRLDTNCCGFRPRKEDACVQNGLRPKCDDQGSAALAHIIQRKHDPRHLVFIDNKGFFDRSEDNLNFKLLEGIKEFPASAVSVLKSQHLRQKLLQSLFLDKVYWESQGGRQGIEKLIDVIEHRAKILITYINAHGVKVLPMNE

SEQ ID NO: 811899 - protein, 518 aa, Homo sapiens; identical to SEQ ID NO: 811898

SEQ ID NO: 811900 - protein, 518 aa, Homo sapiens; identical to SEQ ID NO: 811898

SEQ ID NO: 811901 - protein, 500 aa, Homo sapiens
MTCPDKPGQLINWFICSLCVPRVRKLWSSRRPRTRRNLLLGTACAIYLGFLVSQVGRASLQHGQAAEKGPHRSRDTAEPSFPEIPLDGTLAPPESQGNGSTLQPNVVYITLRSKRSKPANIRGTVKPKRRKKHAVASAAPGQEALVGPSLQPQEAAREADAVAPGYAQGANLVKIGERPWRLVRVRECEPGAQTSCSPAPGRATLGSTARAPSWLSKDDIRRMRLLADSAVAGLRPVSSRSGARLLVLEGGAPGAVLRCGPSPCGLLKQPLDMSEVFAFHLDRILGLNRTLPSVSRKAEFIQDGRPCPIILWDASLSSASNDTHSSVKLTWGTYQQLLKQKCWQNGRVPKPESGCTEIHHHEWSKMALFDFLLQIYNRLDTNCCGFRPRKEDACVQNGLRPDPRHLVFIDNKGFFDRSEDNLNFKLLEGIKEFPASAVSVLKSQHLRQKLLQSLFLDKVYWESQGGRQGIEKLIDVIEHRAKILITYINAHGVKVLPMNE

SEQ ID NO: 811902 - protein, 225 aa, Homo sapiens
MLLISETLQDGRPCPIILWDASLSSASNDTHSSVKLTWGTYQQLLKQKCWQNGRVPKPESGCTEIHHHEWSKMALFDFLLQIYNRLDTNCCGFRPRKEDACVQNGLRPKCDDQGSAALAHIIQRKHDPRHLVFIDNKGFFDRSEDNLNFKLLEGIKEFPASAVSVLKSQHLRQKLLQSLFLDKVYWESQGGRQGIEKLIDVIEHRAKILITYINAHGVKVLPMNE

SEQ ID NO: 811903 - protein, 243 aa, Homo sapiens
PVGGARCSSRSLRTRNRAAAGGGPESRDGRPCPIILWDASLSSASNDTHSSVKLTWGTYQQLLKQKCWQNGRVPKPESGCTEIHHHEWSKMALFDFLLQIYNRLDTNCCGFRPRKEDACVQNGLRPKCDDQGSAALAHIIQRKHDPRHLVFIDNKGFFDRSEDNLNFKLLEGIKEFPASAVSVLKSQHLRQKLLQSLFLDKVYWESQGGRQGIEKLIDVIEHRAKILITYINAHGVKVLPMNE

SEQ ID NO: 811904 - protein, 93 aa, Homo sapiens
LVIVSHRCHREVREDGCYGPSRAGYHSWGSRRQGLTQGRLPPLCVCQAFGAAGLSSDYPLAQFFTWARALRFADGPDEVHRATVAKLELKHRI

SEQ ID NO: 811905 - protein, 285 aa, Homo sapiens
MCVRSCFQSPRLQWVWRTAFLKHTQRRHQGSHRWTHLGGSTYRAVIFDMGGVLIPSPGRVAAEWEVQNRIPSGTILKALMEGGENGPWMRFMRAEITAEGFLREFGRLCSEMLKTSVPVDSFFSLLTSERVAKQFPVMTEAITQIRAKGLQTAVLSNNFYLPNQKSFLPLDRKQFDVIVESCMEGICKPDPRIYKLCLEQLGLQPSESIFLDDLGTNLKEAARLGIHTIKVNDPETAVKELEALLGFTLRVGVPNTRPVKKTMEIPKDSLQKYLKDLLGIQTTGL

SEQ ID NO: 811906 - protein, 107 aa, Homo sapiens
SLNPSMYQCIPLLHILLPIEWEVQNRIPSGTILKALMEGGENGPWMRFMRAEITAEGFLREFGRLCSEMLKTSVPVDSFFSLLTSERVAKQFPVMTEAMITPVCSCY

SEQ ID NO: 811907 - protein, 1128 aa, Homo sapiens
MCVRSCFQSPRLQWVWRTAFLKHTQRRHQGSHRWTHLGGSTYRAVIFDMGGVLIPSPGRVAAEWEVQNRIPSGTILKALMEGGENGPWMRFMRAEITAEGFLREFGRLCSEMLKTSVPVDSFFSLLTSERVAKQFPVMTEAITQIRAKGLQTAVLSNNFYLPNQKSFLPLDRKQFDVIVESCMEGICKPDPRIYKLCLEQLGLQPSESIFLDDLGTNLKEAARLGIHTIKVNDPETAVKELEALLGFTLRVGVPNTRPVKKTMEIPKDSLQKYLKDLLGIQTTGPLELLQFDHGQSNPTYYIRLANRDLVLRKKPPGTLLPSAHAIEREFRIMKALANAGVPVPNVLDLCEDSSVIGTPFYVMEYCPGLIYKDPSLPGLEPSHRRAIYTAMNTVLCKIHSVDLQAVGLEDYGKQGDYIPRQVRTWVKQYRASETSTIPAMERLIEWLPLHLPRQQRTTVVHGDFRLDNLVFHPEEPEVLAVLDWELSTLGDPLADVAYSCLAHYLPSSFPVLRGINDCDLTQLGIPAAEEYFRMYCLQMGLPPTENWNFYMAFSFFRVAAILQGVYKRSLTGQASSTYAEQTGKLTEFVSNLAWDFAVKEGFRVFKEMPFTNPLTRSYHTWARPQSQWCPTGSRSYSSVPEASPAHTSRGGLVISPESLSPPVRELYHRLKHFMEQRVYPAEPELQSHQASAARWSPSPLIEDLKEKAKAEGLWNLFLPLEADPEKKYGAGLTNVEYAHLCELMGTSLYAPEVCNCSAPDTGNMELLVRYGTEAQKARWLIPLLEGKARSCFAMTEPQVASSDATNIEASIREEDSFYVINGHKWWITGILDPRCQLCVFMGKTDPHAPRHRQQSVLLVPMDTPGIKIIRPLTVYGLEDAPGGHGEVRFEHVRVPKENMVLGPGRGFEIAQGRLGPGRIHHCMRLIGFSERALALMKARVKSRLAFGKPLVEQGTVLADIAQSRVEIEQARLLVLRAAHLMDLAGNKAAALDIAMIKMVAPSMASRVIDRAIQKTSLQEAWSLFQARRRGFAEGQGGSGTESGKLVFRLSVPGWAGTVTSLQPFSPSLSACGNLDTFWEASQGCGTCLLWQLQGSCLASLVSRGAATAGGGLETQDLGAWENGMQPTL

SEQ ID NO: 811908 - protein, 1059 aa, Homo sapiens
MCVRSCFQSPRLQWVWRTAFLKHTQRRHQGSHRWTHLGGSTYRAVIFDMGGVLIPSPGRVAAEWEVQNRIPSGTILKALMEGGENGPWMRFMRAEITAEGFLREFGRLCSEMLKTSVPVDSFFSLLTSERVAKQFPVMTEAITQIRAKGLQTAVLSNNFYLPNQKSFLPLDRKQFDVIVESCMEGICKPDPRIYKLCLEQLGLQPSESIFLDDLGTNLKEAARLGIHTIKVNDPETAVKELEALLGFTLRVGVPNTRPVKKTMEIPKDSLQKYLKDLLGIQTTGPLELLQFDHGQSNPTYYIRLANRDLVLRKKPPGTLLPSAHAIEREFRIMKALANAGVPVPNVLDLCEDSSVIGTPFYVMEYCPGLIYKDPSLPGLEPSHRRAIYTAMNTVLCKIHSVDLQAVGLEDYGKQGDYIPRQVRTWVKQYRASETSTIPAMERLIEWLPLHLPRQQRTTVVHGDFRLDNLVFHPEEPEVLAVLDWELSTLGDPLADVAYSCLAHYLPSSFPVLRGINDCDLTQLGIPAAEEYFRMYCLQMGLPPTENWNFYMAFSFFRVAAILQGVYKRSLTGQASSTYAEQTGKLTEFVSNLAWDFAVKEGFRVFKEMPFTNPLTRSYHTWARPQSQWCPTGSRSYSSVPEASPAHTSRGGLVISPESLSPPVRELYHRLKHFMEQRVYPAEPELQSHQASAARWSPSPLIEDLKEKAKAEGLWNLFLPLEADPEKKYGAGLTNVEYAHLCELMGTSLYAPEVCNCSAPDTGNMELLVRYGTEAQKARWLIPLLEGKARSCFAMTEPQVASSDATNIEASIREEDSFYVINGHKWWITGILDPRCQLCVFMGKTDPHAPRHRQQSVLLVPMDTPGIKIIRPLTVYGLEDAPGGHGEVRFEHVRVPKENMVLGPGRGFEIAQGRLGPGRIHHCMRLIGFSERALALMKARVKSRLAFGKPLVEQGTVLADIAQSRVEIEQARLLVLRAAHLMDLAGNKAAALDIAMIKMVAPSMASRVIDRAIQAFGAAGLSSDYPLAQFFTWARALRFADGPDEVHRATVAKLELKHRI

SEQ ID NO: 811909 - protein, 971 aa, Homo sapiens
MCVRSCFQSPRLQWVWRTAFLKHTQRRHQGSHRWTHLGGSTYRAVIFDMGGVLIPSPGRVAAEWEVQNRIPSGTILKALMEGGENGPWMRFMRAEITAEGFLREFGRLCSEMLKTSVPVDSFFSLLTSERVAKQFPVMTEAITQIRAKGLQTAVLSNNFYLPNQKSFLPLDRKQFDVIVESCMEGICKPDPRIYKLCLEQLGLQPSESIFLDDLGTNLKEAARLGIHTIKVNDPETAVKELEALLGFTLRVGVPNTRPVKKTMEIPKDSLQKYLKDLLGIQTTGPLELLQFDHGQSNPTYYIRLANRDLVLRKKPPGTLLPSAHAIEREFRIMKALANAGVPVPNVLDLCEDSSVIGTPFYVMEYCPGLIYKDPSLPGLEPSHRRAIYTAMNTVLCKIHSVDLQAVGLEDYGKQGQASSTYAEQTGKLTEFVSNLAWDFAVKEGFRVFKEMPFTNPLTRSYHTWARPQSQWCPTGSRSYSSVPEASPAHTSRGGLVISPESLSPPVRELYHRLKHFMEQRVYPAEPELQSHQASAARWSPSPLIEDLKEKAKAEGLWNLFLPLEADPEKKYGAGLTNVEYAHLCELMGTSLYAPEVCNCSAPDTGNMELLVRYGTEAQKARWLIPLLEGKARSCFAMTEPQVASSDATNIEASIREEDSFYVINGHKWWITGILDPRCQLCVFMGKTDPHAPRHRQQSVLLVPMDTPGIKIIRPLTVYGLEDAPGGHGEVRFEHVRVPKENMVLGPGRGFEIAQGRLGPGRIHHCMRLIGFSERALALMKARVKSRLAFGKPLVEQGTVLADIAQSRVEIEQARLLVLRAAHLMDLAGNKAAALDIAMIKMVAPSMASRVIDRAIQKTSLQEAWSLFQARRRGFAEGQGGSGTESGKLVFRLSVPGWAGTVTSLQPFSPSLSACGNLDTFWEASQGCGTCLLWQLQGSCLASLVSRGAATAGGGLETQDLGAWENGMQPTL

SEQ ID NO: 811910 - protein, 881 aa, Homo sapiens
MCVRSCFQSPRLQWVWRTAFLKHTQRRHQGSHRWTHLGGSTYRAVIFDMGGVLIPSPGRVAAEWEVQNRIPSGTILKALMEGGENGPWMRFMRAEITAEGFLREFGRLCSEMLKTSVPVDSFFSLLTSERVAKQFPVMTEAITQIRAKGLQTAVLSNNFYLPNQKSFLPLDRKQFDVIVESCMEGICKPDPRIYKLCLEQLGLQPSESIFLDDLGTNLKEAARLGIHTIKVNDPETAVKELEALLGFTLRVGVPNTRPVKKTMEIPKDSLQKYLKDLLGIQTTGPLELLQFDHGQSNPTYYIRLANRDLVLRKKPPGTLLPSAHAIEREFRIMKALANAGVPVPNVLDLCEDSSVIGTPFYVMEYCPGLIYKDPSLPGLEPSHRRAIYTAMNTVLCKIHSVDLQAVGLEDYGKQGDYIPRQVRTWVKQYRASETSTIPAMERLIEWLPLHLPRQQRTTVVHGDFSITPLHSSLRNKVRPRLQKNNKKKKEKEVNKTRKKKEYLEPFLMPCDFQNLKSPLQIRPPTAEGRERDGAEGTLLPLELQGRKGCCGQQKGTLRLRRVQCLQSLPHSQEVALGQMLAQIYNCSCLVARPAQMCNGWNKGFLEAICYRHPVGLWLAVAHVKVVCQTYSLDMAQWLHTGTLAEKMHSPGFTLLPCPVLSASTQLCRPPAPASRGHPQPSMSSAAHLLCRQVKSRLAFGKPLVEQGTVLADIAQSRVEIEQARLLVLRAAHLMDLAGNKAAALDIAMIKMVAPSMASRVIDRAIQKTSLQEAWSLFQARRRGFAEGQGGSGTESGKLVFRLSVPGWAGTVTSLQPFSPSLSACGNLDTFWEASQGCGTCLLWQLQGSCLASLVSRGAATAGGGLETQDLGAWENGMQPTL

SEQ ID NO: 811911 - protein, 521 aa, Homo sapiens
MPFTNPLTRSYHTWARPQSQWCPTGSRSYSSVPEASPAHTSRGGLVISPESLSPPVRELYHRLKHFMEQRVYPAEPELQSHQASAARWSPSPLIEDLKEKAKAEGLWNLFLPLEADPEKKYGAGLTNVEYAHLCELMGTSLYAPEVCNCSAPDTGNMELLVRYGTEAQKARWLIPLLEGKARSCFAMTEPQVASSDATNIEASIREEDSFYVINGHKWWITGILDPRCQLCVFMGKTDPHAPRHRQQSVLLVPMDTPGIKIIRPLTVYGLEDAPGGHGEVRFEHVRVPKENMVLGPGRGFEIAQGRLGPGRIHHCMRLIGFSERALALMKARVKSRLAFGKPLVEQGTVLADIAQSRVEIEQARLLVLRAAHLMDLAGNKAAALDIAMIKMVAPSMASRVIDRAIQKTSLQEAWSLFQARRRGFAEGQGGSGTESGKLVFRLSVPGWAGTVTSLQPFSPSLSACGNLDTFWEASQGCGTCLLWQLQGSCLASLVSRGAATAGGGLETQDLGAWENGMQPTL

SEQ ID NO: 811912 - protein, 374 aa, Homo sapiens
MPCDFQNLKSPLQIRPPTAEGRERDGAEGTLLPLELQGRKGCCGQQKGTLRLRRVQCLQSLPHSQEVALGQMLAQIYNCSCLVARPAQMCNGWNKGFLEAICYRHPVGLWLAVAHVKVVCQTYSLDMAAWLHTGTLAEKMHSPGFTLLPCPVLSASTQLCRPPAPASRGHPQPSMSSAAHLLCRQVKSRLAFGKPLVEQGTVLADIAQSRVEIEQARLLVLRAAHLMDLAGNKAAALDIAMIKMVAPSMASRVIDRAIQKTSLQEAWSLFQARRRGFAEGQGGSGTESGKLVFRLSVPGWAGTVTSLQPFSPSLSACGNLDTFWEASQGCGTCLLWQLQGSCLASLVSRGAATAGGGLETQDLGAWENGMQPTL

SEQ ID NO: 811913 - protein, 259 aa, Homo sapiens
MAIAHSDRLGLSGGHGEVRFEHVRVPKENMVLGPGRGFEIAQGRLGPGRIHHCMRLIGFSERALALMKARVKSRLAFGKPLVEQGTVLADIAQSRVEIEQARLLVLRAAHLMDLAGNKAAALDIAMIKMVAPSMASRVIDRAIQKTSLQEAWSLFQARRRGFAEGQGGSGTESGKLVFRLSVPGWAGTVTSLQPFSPSLSACGNLDTFWEASQGCGTCLLWQLQGSCLASLVSRGAATAGGGLETQDLGAWENGMQPTL

SEQ ID NO: 811914 - protein, 939 aa, Homo sapiens
MCVRSCFQSPRLQWVWRTAFLKHTQRRHQGSHRWTHLGGSTYRAVIFDMGGVLIPSPGRVAAEWEVQNRIPSGTILKALMEGGENGPWMRFMRAEITAEGFLREFGRLCSEMLKTSVPVDSFFSLLTSERVAKQFPVMTEAITQIRAKGLQTAVLSNNFYLPNQKSFLPLDRKQFDVIVESCMEGICKPDPRIYKLCLEQLGLQPSESIFLDDLGTNLKEAARLGIHTIKVNDPETAVKELEALLGFTLRVGVPNTRPVKKTMEIPKDSLQKYLKDLLGIQTTGPLELLQFDHGQSNPTYYIRLANRDLVLRKKPPGTLLPSAHAIEREFRIMKALANAGVPVPNVLDLCEDSSVIGTPFYVMEYCPGLIYKDPSLPGLEPSHRRAIYTAMNTVLCKIHSVDLQAVGLEDYGKQGDYIPRQVRTWVKQYRASETSTIPAMERLIEWLPLHLPRQQRTTVVHGDFRLDNLVFHPEEPEVLAVLDWELSTLGDPLADVAYSCLAHYLPSSFPVLRGINDCDLTQLGIPAAEEYFRMYCLQMGLPPTENWNFYMAFSFFRVAAILQGVYKRSLTGQASSTYAEQTGKLTEFVSNLAWDFAVKEGFRVFKEMPFTNPLTRSYHTWARPQSQWCPTGSRSYSSVPEASPAHTSRGGLVISPESLSPPVRELYHRLKHFMEQRVYPAEPELQSHQASAARWSPSPLIEDLKEKAKAEGLWNLFLPLEADPEKKYGAGLTNVEYAHLCELMGTSLYAPEVCNCSAPDTGNMELLVRYGTEAQKARWLIPLLEGKARSCFAMTEPQVASSDATNIEASIREEDSFYVINGHKWWITGILDPRCQLCVFMGKTDPHAPRHRQQSVLLVPMDTPGIKIIRPLTVYGLEDAPGGHGEVRFEHVRVPKENMVLGPGRGFEIAQGRLGPGRIHHCMRLIGFSERALALMKAR

SEQ ID NO: 811915 - protein, 710 aa, Homo sapiens
MCVRSCFQSPRLQWVWRTAFLKHTQRRHQGSHRWTHLGGSTYRAVIFDMGGVLIPSPGRVAAEWEVQNRIPSGTILKALMEGGENGPWMRFMRAEITAEGFLREFGRLCSEMLKTSVPVDSFFSLLTSERVAKQFPVMTEAITQIRAKGLQTAVLSNNFYLPNQKSFLPLDRKQFDVIVESCMEGICKPDPRIYKLCLEQLGLQPSESIFLDDLGTNLKEAARLGIHTIKVNDPETAVKELEALLGFTLRVGVPNTRPVKKTMEIPKDSLQKYLKDLLGIQTTGPLELLQFDHGQSNPTYYIRLANRDLVLRKKPPGTLLPSAHAIEREFRIMKALANAGVPVPNVLDLCEDSSVIGTPFYVMEYCPGLIYKDPSLPGLEPSHRRAIYTAMNTVLCKIHSVDLQAVGLEDYGKQGDYIPRQVRTWVKQYRASETSTIPAMERLIEWLPLHLPRQQRTTVVHGDFRLDNLVFHPEEPEVLAVLDWELSTLGDPLADVAYSCLAHYLPSSFPVLRGINDCDLTQLGIPAAEEYFRMYCLQMGLPPTENWNFYMAFSFFRVAAILQGVYKRSLTGQASSTYAEQTGKLTEFVSNLAWDFAVKEGFRVFKEMPFTNPLTRSYHTWARPQSQWCPTGSRSYSSVPEASPAHTSRGGLVISPESLSPPVRELYHRLKHFMEQRVYPAEPELQSHQASAARWSPSPLIEDLKVKQPW

SEQ ID NO: 811916 - protein, 1041 aa, Homo sapiens [sequence omitted]

SEQ ID NO: 811917 - protein, 939 aa, Homo sapiens; identical to SEQ ID NO: 811914

SEQ ID NO: 811918 - protein, 794 aa, Homo sapiens
MCVRSCFQSPRLQWVWRTAFLKHTQRRHQGSHRWTHLGGSTYRAVIFDMGGVLIPSPGRVAAEWEVQNRIPSGTILKALMEGGENGPWMRFMRAEITAEGFLREFGRLCSEMLKTSVPVDSFFSLLTSERVAKQFPVMTEAITQIRAKGLQTAVLSNNFYLPNQKSFLPLDRKQFDVIVESCMEGICKPDPRIYKLCLEQLGLQPSESIFLDDLGTNLKEAARLGIHTIKVNDPETAVKELEALLGFTLRVGVPNTRPVKKTMEIPKDSLQKYLKDLLGIQTTGPLELLQFDHGQSNPTYYIRLANRDLVLRKKPPGTLLPSAHAIEREFRIMKALANAGVPVPNVLDLCEDSSVIGTPFYVMEYCPGLIYKDPSLPGLEPSHRRAIYTAMNTVLCKIHSVDLQAVGLEDYGKQGDYIPRQVRTWVKQYRASETSTIPAMERLIEWLPLHLPRQQRTTVVHGDFSITPLHSSLRNKVRPRLQKNNKKKKEKEVNKTRKKKEYLEPFLMPCDFQNLKSPLQIRPPTAEGRERDGAEGTLLPLELQGRKGCCGQQKGTLRLRRVQCLQSLPHSQEVALGQMLAQIYNCSCLVARPAQMCNGWNKGFLEAICYRHPVGLWLAVAHVKVVCQTYSLDMAQWLHTGTLAEKMHSPGFTLLPCPVLSASTQLCRPPAPASRGHPQPSMSSAAHLLCRQVKSRLAFGKPLVEQGTVLADIAQSRVEIEQARLLVLRAAHLMDLAGNKAAALDIAMIKMVAPSMASRVIDRAIQVSTDQTVGLFEPSILDAKLSYLQPPSLP

SEQ ID NO: 811919 - protein, 476 aa, Homo sapiens
MCVRSCFQSPRLQWVWRTAFLKHTQRRHQGSHRWTHLGGSTYRAVIFDMGGVLIPSPGRVAAEWEVQNRIPSGTILKALMEGGENGPWMRFMRAEITAEGFLREFGRLCSEMLKTSVPVDSFFSLLTSERVAKQFPVMTEAITQIRAKGLQTAVLSNNFYLPNQKSFLPLDRKQFDVIVESCMEGICKPDPRIYKLCLEQLGLQPSESIFLDDLGTNLKEAARLGIHTIKVNDPETAVKELEALLGFTLRVGVPNTRPVKKTMEIPKDSLQKYLKDLLGIQTTGPLELLQFDHGQSNPTYYIRLANRDLVLRKKPPGTLLPSAHAIEREFRIMKALANAGVPVPNVLDLCEDSSVIGTPFYVMEYCPGLIYKDPSLPGLEPSHRRAIYTAMNTVLCKIHSVDLQAVGLEDYGKQGDYIPRQVRTWVKQYRASETSTIPAMERLIEWLPLHLPRQQRTTVVHGDFRSRHCTPACATK

SEQ ID NO: 811920 - protein, 354 aa, Homo sapiens
MCVRSCFQSPRLQWVWRTAFLKHTQRRHQGSHRWTHLGGSTYRAVIFDMGGVLIPSPGRVAAEWEVQNRIPSGTILKALMEGGENGPWMRFMRAEITAEGFLREFGRLCSEMLKTSVPVDSFFSLLTSERVAKQFPVMTEAITQIRAKGLQTAVLSNNFYLPNQKSFLPLDRKQFDVIVESCMEGICKPDPRIYKLCLEQLGLQPSESIFLDDLGTNLKEAARLGIHTIKVNDPETAVKELEALLGFTLRVGVPNTRPVKKTMEIPKDSLQKYLKDLLGIQTTGPLELLQFDHGQSNPTYYIRLANRDLVLRKKPPGTLLPSAHAIEREFRIMKALANAGVPVPNVLDLCEDSR

SEQ ID NO: 811921 - protein, 85 aa, Homo sapiens
LIYKDPSLPGLEPSHRRAIYTAMNTVLCKIHSVDLQAVGLEDYGKQGEQEATSPMLVVSSLVLLLLGSESFWVVLSISTPSVRQT

SEQ ID NO: 811922 - protein, 606 aa, Homo sapiens
FCVASRGQRRWRRRRRRRWRRGGGEEAQLPLHRDRRCGASPPAPGARLPGAPPPSPPPQRRCLLQMSDSPAGSNPRTPESSGSGSGGGGKRPAVPAAVSLLPPADPLRQANRLPIRVLKMLSAHTGHLLHPEYLQPLSSTPVSPIELDAKKSPLALLAQTCSQIGKPDPPPSSKLNSVAAAANGLGAEKDPGRSAPGAASAAAALKQLGDSPAEDKSSFKPYSKGSGGGDSRKDSGSSSVSSTSSSSSSSPGDKAGFRVPSAACPPFPPHGAPVSASSSSSSPGGSRGGSPHHSDCKNGGGVGGGELDKKDQEPKPSPEPAAVSRGGGGEPGAHGGAESGASGRKSEPPSALVGAGHVAPVSPYKPGHSVFPLPPSSIGYHGSIVGAYAGYPSQFVPGLDPSKSGLVGGQLSGGLGLPPGKPPSSSPLTGASPPSFLQGLCRDPYCLGGYHGASHLGGSSCSTCSAHDPAGPSLKAGGYPLVYPGHPLQPAALSSSAAQAALPGHPLYTYGFMLQNEPLPHSCNWVAASGPCDKRFATSEELLSHLRTHTALPGAEKLLAAYPGASGLGSAAAAAAAAASCHLHLPPPAAPAAPGRCPCGIHTLWA

SEQ ID NO: 811923 - protein, 606 aa, Homo sapiens; identical to SEQ ID NO: 811922

SEQ ID NO: 811924 - protein, 487 aa, Homo sapiens
ARNPSQAKFPQTKGISFFLGLEEGDIELDAKKSPLALLAQTCSQIGKPDPPPSSKLNSVAAAANGLGAEKDPGRSAPGAASAAAALKQLGDSPAEDKSSFKPYSKGSGGGDSRKDSGSSSVSSTSSSSSSSPGDKAGFRVPSAACPPFPPHGAPVSASSSSSSPGGSRGGSPHHSDCKNGGGVGGGELDKKDQEPKPSPEPAAVSRGGGGEPGAHGGAESGASGRKSEPPSALVGAGHVAPVSPYKPGHSVFPLPPSSIGYHGSIVGAYAGYPSQFVPGLDPSKSGLVGGQLSGGLGLPPGKPPSSSPLTGASPPSFLQGLCRDPYCLGGYHGASHLGGSSCSTCSAHDPAGPSLKAGGYPLVYPGHPLQPAALSSSAAQAALPGHPLYTYGFMLQNEPLPHSCNWVAASGPCDKRFATSEELLSHLRTHTALPGAEKLLAAYPGASGLGSAAAAAAAAASCHLHLPPPAAPAAPGRCPCGIHTLWA

SEQ ID NO: 811925 - protein, 655 aa, Homo sapiens
MSSSNVEVFIPVSQGNTNGFPATASNDLKAFTEGAVLSFHNICYRVKLKSGFLPCRKPVEKEILSNINGIMKPGLNAILGPTGGGKSSLLDVLAARKDPSGLSGDVLINGAPRPANFKCNSGYVVQDDVVMGTLTVRENLQFSAALRLATTMTNHEKNERINRVIQELGLDKVADSKVGTQFIRGVSGGERKRTSIGMELITDPSILFLDEPTTGLDSSTANAVLLLLKRMSKQGRTIIFSIHQPRYSIFKLFDSLTLLASGRLMFHGPAQEALGYFESAGYHCEAYNNPADFFLDIINGDSTAVALNREEDFKATEIIEPSKQDKPLIEKLAEIYVNSSFYKETKAELHQLSGGEKKKKITVFKEISYTTSFCHQLRWVSKRSFKNLLGNPQASIAQIIVTVVLGLVIGAIYFGLKNDSTGIQNRAGVLFFLTTNQCFSSVSAVELFVVEKKLFIHEYISGYYRVSSYFLGKLLSDLLPMRMLPSIIFTCIVYFMLGLKPKADAFFVMMFTLMMVAYSASSMALAIAAGQSVVSVATLLMTICFVFMMIFSGLLVNLTTIASWLSWLQYFSIPRYGFTALQHNEFLGQNFCPGLNATGNNPCNYATCTGEEYLVKQGIDLSPWGLWKNHVALACMIVIFLTIAYLKLLFLKKYS

SEQ ID NO: 811926 - protein, 655 aa, Homo sapiens; identical to SEQ ID NO: 811925

SEQ ID NO: 811927 - protein, 655 aa, Homo sapiens; identical to SEQ ID NO: 811925

SEQ ID NO: 811928 - protein, 655 aa, Homo sapiens; identical to SEQ ID NO: 811925

SEQ ID NO: 811929 - protein, 775 aa, Homo sapiens
GPLRSALAVHSPKRGLGSSCQRCLSSSPGCPGLPRRPPAGSHRDLQPQRLPRRPPREGSARARRVWLGEGVVPRAGCVLCPLKRFRARRREEAVPATPTEIERRGKEAACGGTGKIKTLQMSSSNVEVFIPVSQGNTNGFPATASNDLKAFTEGAVLSFHNICYRVKLKSGFLPCRKPVEKEILSNINGIMKPGLNAILGPTGGGKSSLLDVLAARKDPSGLSGDVLINGAPRPANFKCNSGYVVQDDVVMGTLTVRENLQFSAALRLATTMTNHEKNERINRVIQELGLDKVADSKVGTQFIRGVSGGERKRTSIGMELITDPSILFLDEPTTGLDSSTANAVLLLLKRMSKQGRTIIFSIHQPRYSIFKLFDSLTLLASGRLMFHGPAQEALGYFESAGYHCEAYNNPADFFLDIINGDSTAVALNREEDFKATEIIEPSKQDKPLIEKLAEIYVNSSFYKETKAELHQLSGGEKKKKITVFKEISYTTSFCHQLRWVSKRSFKNLLGNPQASIAQIIVTVVLGLVIGAIYFGLKNDSTGIQNRAGVLFFLTTNQCFSSVSAVELFVVEKKLFIHEYISGYYRVSSYFLGKLLSDLLPMRMLPSIIFTCIVYFMLGLKPKADAFFVMMFTLMMVAYSASSMALAIAAGQSVVSVATLLMTICFVFMMIFSGLLVNLTTIASWLSWLQYFSIPRYGFTALQHNEFLGQNFCPGLNATGNNPCNYATCTGEEYLVKQGIDLSPWGLWKNHVALACMIVIFLTIAYLKLLFLKKYS

SEQ ID NO: 811930 - protein, 688 aa, Homo sapiens
GQPVRQRPRCFGAPASDGDQTQLGQTRKIKTLQMSSSNVEVFIPVSQGNTNGFPATASNDLKAFTEGAVLSFHNICYRVKLKSGFLPCRKPVEKEILSNINGIMKPGLNAILGPTGGGKSSLLDVLAARKDPSGLSGDVLINGAPRPANFKCNSGYVVQDDVVMGTLTVRENLQFSAALRLATTMTNHEKNERINRVIQELGLDKVADSKVGTQFIRGVSGGERKRTSIGMELITDPSILFLDEPTTGLDSSTANAVLLLLKRMSKQGRTIIFSIHQPRYSIFKLFDSLTLLASGRLMFHGPAQEALGYFESAGYHCEAYNNPADFFLDIINGDSTAVALNREEDFKATEIIEPSKQDKPLIEKLAEIYVNSSFYKETKAELHQLSGGEKKKKITVFKEISYTTSFCHQLRWVSKRSFKNLLGNPQASIAQIIVTVVLGLVIGAIYFGLKNDSTGIQNRAGVLFFLTTNQCFSSVSAVELFVVEKKLFIHEYISGYYRVSSYFLGKLLSDLLPMRMLPSIIFTCIVYFMLGLKPKADAFFVMMFTLMMVAYSASSMALAIAAGQSVVSVATLLMTICFVFMMIFSGLLVNLTTIASWLSWLQYFSIPRYGFTALQHNEFLGQNFCPGLNATGNNPCNYATCTGEEYLVKQGIDLSPWGLWKNHVALACMIVIFLTIAYLKLLFLKKYS

SEQ ID NO: 811931 - protein, 632 aa, Homo sapiens
MSSSNVEVFIPVSQGNTNGFPATASNDLKAFTEGAVLSFHNICYRVKLKSGFLPCRKPVEKEILSNINGIMKPGLNAILGPTGGGKSSLLDVLAARKDPSGLSGDVLINGAPRPANFKCNSGYVVQDDVVMGTLTVRENLQFSAALRLATTMTNHEKNERINRVIQELGLDKVADSKVGTQFIRGVSGGERKRTSIGMELITDPSILFLDEPTTGLDSSTANAVLLLLKRMSKQGRTIIFSIHQPRYSIFKLFDSLTLLASGRLMFHGPAQEALGYFESAGYHCEAYNNPADFFLDIINGDSTAVALNREEDFKATEIIEPSKQDKPLIEKLAEIYVNSSFYKETKAELHQLSGGEKKKKITVFKEISYTTSFCHQLRWVSKRSFKNLLGNPQASIAQIIVTVVLGLVIGAIYFGLKNDSTGIQNRAGVLFFLTTNQCFSSVSAVELFVVEKKLFIHEYISGYYRVSSYFLGKLLSDLLPMRMLPSIIFTCIVYFMLGLKPKADAFFVMMFTLMMVAYSASSMALAIAAGQSVVSVATLLMTICFVFMMIFSGLLVNLTTIASWLSWLQYFSIPRYGFTALQHNEFLGQNFCPGLNATGNIFLLFSVPLPSHCCTAAIVLKRYIFRNHNKLN

SEQ ID NO: 811932 - protein, 623 aa, Homo sapiens
MSSSNVEVFIPVSQGNTNGFPATASNDLKAFTEGAVLSFHNICYRVKLKSGFLPCRKPVEKEILSNINGIMKPGLNAILGPTGGGKSSLLDVLAARKDPSGLSGDVLINGAPRPANFKCNSGYVVQDDVVMGTLTVRENLQFSAALRLATTMTNHEKNERINRVIQELGLDKVADSKVGTQFIRGVSGGERKRTSIGMELITDPSILFLDEPTTGLDSSTANAVLLLLKRMSKQGRTIIFSIHQPRYSIFKLFDSLTLLASGRLMFHGPAQEALGYFESAGYHCEAYNNPADFFLDIINGDSTAVALNREEDFKATEIIEPSKQDKPLIEKLAEIYVNSSFYKETKAELHQLSGGEKKKKITVFKEISYTTSFCHQLRWVSKRSFKNLLGNPQASIAQIIVTVVLGLVIGAIYFGLKNDSTGIQNRAGVLFFLTTNQCFSSVSAVELFVVEKKLFIHEYISGYYRVSSYFLGKLLSDLLPMRMLPSIIFTCIVYFMLGLKPKADAFFVMMFTLMMVAYSASSMALAIAAGQSVVSVATLLMTICFVFMMIFSGLLVNLTTIASWLSWLQYFSIPRYGFTMYWRRIFGKAGHRSLTLGLVEESRGLGLYDCYFPHNCLPEIVIS

SEQ ID NO: 811933 - protein, 405 aa, Homo sapiens
GHDQGRPAPSAGPALEEVSSAKLGLELGGNSSMRPSRRLSLRAKNTAALGTGLGLSVWAAPAGPLCCPTWHGLGYRHGLTSATSNQGNQIPREPAPLGARGPKPEVPAPPRQAAPPTPVAVPPPAAAPPPAWSRVPAPPAENRSMEGGLGRAVCLLTGASRGFGRTLAPLLASLLSPGSVLVLSARNDEALRQLEAELGAERSGLRVVRVPADLGAEAGLQQLLGALRELPRPKGLQRLLLINNAGSLGDVSKGFVDLSDSTQVNNYWALNLTSMLCLTSSVLKAFPDSPGLNRTVVNISSLCALQPFKGWALYCAGKAARDMLFQVLALEEPNVRVLNYAPGPLDTDMQQLARETSVDPDMRKGLQELKAKGKLVDCKVSAQKLLSLLEKDEFKSGAHVDFYDK

SEQ ID NO: 811934 - protein, 405 aa, Homo sapiens; identical to SEQ ID NO: 811933

SEQ ID NO: 811935 - protein, 405 aa, Homo sapiens; identical to SEQ ID NO: 811933

SEQ ID NO: 811936 - protein, 190 aa, Homo sapiens [sequence omitted]

SEQ ID NO: 811937 - protein, 131 aa, Homo sapiens [sequence omitted]

SEQ ID NO: 811938 - protein, 360 aa, Homo sapiens
GHDQGRPAPSAGPALEEVSSAKLGLELGGNSSMRPSRRLSLRAKNTAALGTGLGLSVWAAPAGPLCCPTWHGLGYRHGLTSATSNQGNQIPREPAPLGARGPKPEVPAPPRQAAPPTPVAVPPPAAAPPPAWSRVPAPPAENRSMEGGLGRAVCLLTGASRGFGRTLAPLLASLLSPGSVLVLSARNDEALRQLEAELGAERSGLRVVRVPADLGAEAGLQQLLGALRELPRPKGLQRLLLINNAGSLGDVSKGFVDLSDSTQVNNYWALNLTSMLCLTSSVLKAFPDSPGLNRTVVNISSLCALQPFKGWALYCAGKAARDMLFQVLALEEPNVLWTQTCSSWPGRPPWTQTCEKGCRS

SEQ ID NO: 811939 - protein, 152 aa, Homo sapiens
MDNVQPKIKHRPFCFSVKGHVKMLRLALTVTSMTFFIIAQAPEPYIVITGFEVTVILFFILLYVLRLDRLMKWLFWPLLDIINSLVTTVFMLIVSVLALIPETTTLTVGGGVFALVTAVCCLADGALIYRKLLFNPSGPYQKKPVHEKKEVL

SEQ ID NO: 811940 - protein, 117 aa, Homo sapiens
DRKTPQESWSAAVINARPEHGGLTGLLACVPTSRSANMCPALGPLMCYAITERQHKPERTAAGSRWGACARANAAPCACAQESGKPSWARSRGGRCSAAVAVAIASQNLLRQPAEKS

SEQ ID NO: 811941 - protein, 152 aa, Homo sapiens; identical to SEQ ID NO: 811939

SEQ ID NO: 811942 - protein, 99 aa, Homo sapiens
MDNVQPKIKHRPFCFSVKGHVKMLRLDIINSLVTTVFMLIVSVLALIPETTTLTVGGGVFALVTAVCCLADGALIYRKLLFNPSGPYQKKPVHEKKEVL

SEQ ID NO: 811943 - protein, 120 aa, Homo sapiens
MDNVQPKIKHRPFCFSVKGHVKMLRLALTVTSMTFFIIAQAPEPYIVITGFEVTVILFFILLYVLRLDRLMKWLFWPLLVFALVTAVCCLADGALIYRKLLFNPSGPYQKKPVHEKKEVL

SEQ ID NO: 811944 - protein, 117 aa, Homo sapiens; identical to SEQ ID NO: 811940

SEQ ID NO: 811945 - protein, 103 aa, Homo sapiens
MIQPRTRTRRELLVSGSRLPTGSTAVTSEQDIINSLVTTVFMLIVSVLALIPETTTLTVGGGVFALVTAVCCLADGALIYRKLLFNPSGPYQKKPVHEKKEVL

SEQ ID NO: 811946 - protein, 120 aa, Homo sapiens [sequence omitted]

SEQ ID NO: 811947 - protein, 772 aa, Homo sapiens
MRRREGHGTDSEMGQGPVRESQSSDPPALQFRISEYKPLNMAGVEQPPSPELRQEGVTEYEDGGAPAGDGEAGPQQAEDHPQNPPEDPNQDPPEDDSTCQCQACGPHQAAGPDLGSSNDGCPQLFQERSVIVENSSGSTSASELLKPMKKRKRREYQSPSEEESEPEAMEKQEEGKDPEGQPTASTPESEEWSSSQPATGEKKECWSWESYLEEQKAITAPVSLFQDSQAVTHNKNGFKLGMKLEGIDPQHPSMYFILTVAEVCGYRLRLHFDGYSECHDFWVNANSPDIHPAGWFEKTGHKLQPPKGYKEEEFSWSQYLRSTRAQAAPKHLFVSQSHSPPPLGFQVGMKLEAVDRMNPSLVCVASVTDVVDSRFLVHFDNWDDTYDYWCDPSSPYIHPVGWCQKQGKPLTPPQDYPDPDNFCWEKYLEETGASAVPTWAFKVRPPHSFLVNMKLEAVDRRNPALIRVASVEDVEDHRIKIHFDGWSHGYDFWIDADHPDIHPAGWCSKTGHPLQPPLGPREPSSASPGGCPPLSYRSLPHTRTSKYSFHHRKCPTPGCDGSGHVTGKFTAHHCLSGCPLAERNQSRLKAELSDSEASARKKNLSGFSPRKKPRHHGRIGRPPKYRKIPQEDFQTLTPDVVHQSLFMSALSAHPDRSLSVCWEQHCKLLPGVAGISASTVAKWTIDEVFGFVQTLTGCEDQARLFKDEARIVRVTHVSGKTLVWTVAQLGDLVCSDHLQEGKGILETGVHSLLCSLPTHLLAKLSFASDSQY

SEQ ID NO: 811948 - protein, 752 aa, Homo sapiens
MRRREGHGTDSEMGQGPVRESQSSDPPALQFRISEYKPLNMAGVEQPPSPELRQEGVTEYEDGGAPAGDGEAGPQQAEDHPQNPPEDPNQDPPEDDSTCQCQACGPHQAAGPDLGSSNDGCPQLFQERSVIVENSSGSTSASELLKPMKKRKRREYQSPSEEESEPEAMEKQEEGKDPEGQPTASTPESEEWSSSQPATGEKKECWSWESYLEEQKAITAPVSLFQDSQAVTHNKNGFKLGMKLEGIDPQHPSMYFILTVAEVCGYRLRLHFDGYSECHDFWVNANSPDIHPAGWFEKTGHKLQPPKGYKEEEFSWSQYLRSTRAQAAPKHLFVSQSHSPPPLGFQVGMKLEAVDRMNPSLVCVASVTDVVDSRFLVHFDNWDDTYDYWCDPSSPYIHPVGWCQKQGKPLTPPQDYPDPDNFCWEKYLEETGASAVPTWAFKVRPPHSFLVNMKLEAVDRRNPALIRVASVEDVEDHRIKIHFDGWSHGYDFWIDADHPDIHPAGWCSKTGHPLQPPLGPREPSSASPGGCPPLSYRSLPHTRTSKYSFHHRKCPTPGCDGSGHVTGKFTAHHCLSGCPLAERNQSRLKAELSDSEASARKKNLSGFSPRKKPRHHGRIGRPPKYRKIPQEDFQTLTPDVVHQSLFMSALSAHPDRSLSVCWEQHCKLLPGVAGISASTVAKWTIDEVFGFVQTLTGCEDQARLFKDEMIDGEAFLLLTQADIVKIMSVKLGPALKIYNAILMFKNADDTLK

SEQ ID NO: 811949 - protein, 916 aa, Homo sapiens
GLCLACRPARMEGHAGMEGHAEMEMLRTLKGPSTGEVSMHLVAGDSPGSGPHLPATAFIIPASSATLGLPSSALDVSCFPREPIHVGAPEQVAGCEPVSATVLPQLSAGPASSSTSTVRLLEWTEAAAPPPGGGLRFRISEYKPLNMAGVEQPPSPELRQEGVTEYEDGGAPAGDGEAGPQQAEDHPQNPPEDPNQDPPEDDSTCQCQACGPHQAAGPDLGSSNDGCPQLFQERSVIVENSSGSTSASELLKPMKKRKRREYQSPSEEESEPEAMWIGGCLLELHSCWRPRRNSACLGQNTTWPESQEGPGSDPRASSQTMRRRSWDQACLLQEKQEEGKDPEGQPTASTPESEEWSSSQPATGEKKECWSWESYLEEQKAITAPVSLFQDSQAVTHNKNGFKLGMKLEGIDPQHPSMYFILTVAEVCGYRLRLHFDGYSECHDFWVNANSPDIHPAGWFEKTGHKLQPPKGYKEEEFSWSQYLRSTRAQAAPKHLFVSQSHSPPPLGFQVGMKLEAVDRMNPSLVCVASVTDVVDSRFLVHFDNWDDTYDYWCDPSSPYIHPVGWCQKQGKPLTPPQDYPDPDNFCWEKYLEETGASAVPTWAFKVRPPHSFLVNMKLEAVDRRNPALIRVASVEDVEDHRIKIHFDGWSHGYDFWIDADHPDIHPAGWCSKTGHPLQPPLGPREPSSASPGGCPPLSYRSLPHTRTSKYSFHHRKCPTPGCDGSGHVTGKFTAHHCLSGCPLAERNQSRLKAELSDSEASARKKNLSGFSPRKKPRHHGRIGRPPKYRKIPQEDFQTLTPDVVHQSLFMSALSAHPDRSLSVCWEQHCKLLPGVAGISASTVAKWTIDEVFGFVQTLTGCEDQARLFKDEMIDGEAFLLLTQADIVKIMSVKLGPALKIYNAILMFKNADDTLK

SEQ ID NO: 811950 - protein, 343 aa, Homo sapiens
MRRREGHGTDSEMGQGPVRESQSSDPPALQFRISEYKPLNMAGVEQPPSPELRQEGVTEYEDGGAPAGDGEAGPQQAEDHPQNPPEDPNQDPPEDDSTCQCQACGPHQAAGPDLGSSNDGCPQLFQERSVIVENSSGSTSASELLKPMKKRKRREYQSPSEEESEPEAMEKQEEGKDPEGQPTASTPESEEWSSSQPATGEKKECWSWESYLEEQKAITAPVSLFQDSQAVTHNKNGFKLGMKLEGIDPQHPSMYFILTVAEVCGYRLRLHFDGYSECHDFWVNANSPDIHPAGWFEKTGHKLQPPKGYKEEEFSWSQYLRSTRAQAAPKHLFVSQSHVSAPE

SEQ ID NO: 811951 - protein, 541 aa, Homo sapiens
MSAVSSQPPHCCHNCLRTSWEGLVWVGKIYTWFTRFFGRTHSLLPGTYLLTQARPLSAPWRPEVPECLRAQVMILPWRALFPSLFLLPFSLPTPQAFLENLFLCLPMGSGLVLASLALAVAAPFFPQSPPPLGFQVGMKLEAVDRMNPSLVCVASVTDVVDSRFLVHFDNWDDTYDYWCDPSSPYIHPVGWCQKQGKPLTPPQDYPDPDNFCWEKYLEETGASAVPTWAFKVRPPHSFLVNMKLEAVDRRNPALIRVASVEDVEDHRIKIHFDGWSHGYDFWIDADHPDIHPAGWCSKTGHPLQPPLGPREPSSASPGGCPPLSYRSLPHTRTSKYSFHHRKCPTPGCDGSGHVTGKFTAHHCLSGCPLAERNQSRLKAELSDSEASARKKNLSGFSPRKKPRHHGRIGRPPKYRKIPQEDFQTLTPDVVHQSLFMSALSAHPDRSLSVCWEQHCKLLPGVAGISASTVAKWTIDEVFGFVQTLTGCEDQARLFKDEMIDGEAFLLLTQADIVKIMSVKLGPALKIYNAILMFKNADDTLK

SEQ ID NO: 811952 - protein, 328 aa, Homo sapiens
MPLENVVAKTDYCRVGPLVLSIQDLASDRSQGWGEDLLAELGSMRNASLPRAFPPQIHFDGWSHGYDFWIDADHPDIHPAGWCSKTGHPLQPPLGPREPSSASPGGCPPLSYRSLPHTRTSKYSFHHRKCPTPGCDGSGHVTGKFTAHHCLSGCPLAERNQSRLKAELSDSEASARKKNLSGFSPRKKPRHHGRIGRPPKYRKIPQEDFQTLTPDVVHQSLFMSALSAHPDRSLSVCWEQHCKLLPGVAGISASTVAKWTIDEVFGFVQTLTGCEDQARLFKDEMIDGEAFLLLTQADIVKIMSVKLGPALKIYNAILMFKNADDTLK

SEQ ID NO: 811953 - protein, 462 aa, Homo sapiens
LWPSLCTALCSCPSRGLGYKEEEFSWSQYLRSTRAQAAPKHLFVSQSHSPPPLGFQVGMKLEAVDRMNPSLVCVASVTDVVDSRFLVHFDNWDDTYDYWCDPSSPYIHPVGWCQKQGKPLTPPQDYPDPDNFCWEKYLEETGASAVPTWAFKVRPPHSFLVNMKLEAVDRRNPALIRVASVEDVEDHRIKIHFDGWSHGYDFWIDADHPDIHPAGWCSKTGHPLQPPLGPREPSSASPGGCPPLSYRSLPHTRTSKYSFHHRKCPTPGCDGSGHVTGKFTAHHCLSGCPLAERNQSRLKAELSDSEASARKKNLSGFSPRKKPRHHGRIGRPPKYRKIPQEDFQTLTPDVVHQSLFMSALSAHPDRSLSVCWEQHCKLLPGVAGISASTVAKWTIDEVFGFVQTLTGCEDQARLFKDEMIDGEAFLLLTQADIVKIMSVKLGPALKIYNAILMFKNADDTLK

SEQ ID NO: 811954 - protein, 541 aa, Homo sapiens; identical to SEQ ID NO: 811951

SEQ ID NO: 811955 - protein, 343 aa, Homo sapiens; identical to SEQ ID NO: 811950

SEQ ID NO: 811956 - protein, 343 aa, Homo sapiens; identical to SEQ ID NO: 811950

SEQ ID NO: 811957 - protein, 170 aa, Homo sapiens
MRRREGHGTDSEMGQGPVRESQSSDPPALQFRISEYKPLNMAGVEQPPSPELRQEGVTEYEDGGAPAGDGEAGPQQAEDHPQNPPEDPNQDPPEDDSTCQCQACGPHQAAGPDLGSSNDGCPQLFQERRSKKKERTQRDNPLLAPQRVRSGAAASLQQVRRRNAGRGSPT

SEQ ID NO: 811958 - protein, 45 aa, Homo sapiens
SGAPWDWTPQVIGGVAWSEGLAGVAWSEAPWRGVLRPAEGVSWHE

SEQ ID NO: 811959 - protein, 283 aa, Homo sapiens
MASGTTTTAVKIGIIGGTGLDDPEILEGRTEKYVDTPFGKPSDALILGKIKNVDCILLARHGRQHTIMPSKVNYQANIWALKEEGCTHVIVTTACGSLREEIQPGDIVIIDQFIDRTTMRPQSFYDGSHSCARGVCHIPMAEPFCPKTREVLIETAKKLGLRCHSKGTMVTIEGPRFSSRAESFMFRTWGADVINMTTVPEVVLAKEAGICYASIAMATDYDCWKEHEEAVSVDRVLKTLKENANKAKSLLLTTIPQIGSTEWSETLHNLKNMAQFSVLLPRH

SEQ ID NO: 811960 - protein, 281 aa, Homo sapiens
MASGTTTTAVKIGIIGGTGLDDPEILEGRTEKYVDTPFGKPSDALILGKIKNVDCILLARHGRQHTIMPSKVNYQANIWALKEEGCTHVIVTTACGSLREEIQPGDIVIIDQFIDRTTMRPQSFYDGSHSCARGVCHIPMAEPFCPKTREVLIETAKKLGLRCHSKGTMVTIEGPRFSSRAESFMFRTWGADVINMTTVPEVVLAKEAGICYASIAMATDYDCWKEHEEAVSVDRVLKTLKENANKAKSLLLTTIPQIGSTEWSETLHNLKKKSAGMALNF

SEQ ID NO: 811961 - protein, 143 aa, Homo sapiens [sequence omitted]

SEQ ID NO: 811962 - protein, 283 aa, Homo sapiens; identical to SEQ ID NO: 811959

SEQ ID NO: 811963 - protein, 283 aa, Homo sapiens; identical to SEQ ID NO: 811959

SEQ ID NO: 811964 - protein, 300 aa, Homo sapiens
MASGTTTTAVKIGIIGGTGLDDPEILEGRTEKYVDTPFGKPSDALILGKIKNVDCILLARHGRQHTIMPSKVNYQANIWALKEEGCTHVIVTTACGSLREEIQPGDIVIIDQFIDRTTMRPQSFYDGSHSCARGVCHIPMAEPFCPKTREVLIETAKKLGLRCHSKGTMVTIEGPRFSSRAESFMFRTWGADVINMTTVPEVVLAKEAGICYASIAMATDYDCWKEHEEAVSVDRVLKTLKENANKAKSLLLTTIPQIGSTEWSETLHNLKEREVRNQEFRVPEVPHLNMAQFSVLLPRH

SEQ ID NO: 811965 - protein, 300 aa, Homo sapiens
MRPARASLAAAGRDWGAALGTHLPREERIGIIGGTGLDDPEILEGRTEKYVDTPFGKPSDALILGKIKNVDCILLARHGRQHTIMPSKVNYQANIWALKEEGCTHVIVTTACGSLREEIQPGDIVIIDQFIDRTTMRPQSFYDGSHSCARGVCHIPMAEPFCPKTREVLIETAKKLGLRCHSKGTMVTIEGPRFSSRAESFMFRTWGADVINMTTVPEVVLAKEAGICYASIAMATDYDCWKEHEEAVSVDRVLKTLKENANKAKSLLLTTIPQIGSTEWSETLHNLKNMAQFSVLLPRH

SEQ ID NO: 811966 - protein, 321 aa, Homo sapiens
MAICGRIDILILNSACDCTNTYITQCPDSGPRAVQNQTARERIRDSLVTWSIVLRMSRYKFSSGDRTDSLWSCTPFGKPSDALILGKIKNVDCILLARHGRQHTIMPSKVNYQANIWALKEEGCTHVIVTTACGSLREEIQPGDIVIIDQFIDRTTMRPQSFYDGSHSCARGVCHIPMAEPFCPKTREVLIETAKKLGLRCHSKGTMVTIEGPRFSSRAESFMFRTWGADVINMTTVPEVVLAKEAGICYASIAMATDYDCWKEHEEAVSVDRVLKTLKENANKAKSLLLTTIPQIGSTEWSETLHNLKNMAQFSVLLPRH

SEQ ID NO: 811967 - protein, 293 aa, Homo sapiens
MASGTTTTAVKIGIIGGTGLDDPEILEGRTEKYVDTPFGKPSDALILGKIKNVDCILLARHGRQHTIMPSKVNYQANIWALKEEGCTHVIVTTACGSLREEIQPGDIVIIDQFIDRTTMRPQSFYDGSHSCARGVCHIPMAEPFCPKTREVLIETAKKLGLRCHSKGTMVTIEGPRFSSRAESFMFRTWGADVINMTTVPEVVLAKEAGICYASIAMATDYDCWKEHEEAMIKFQMILSEGYHPFNIQESPFYRGLLDFPSVGHGRGEILPLSPLDLAGYCFQQPMQPPCPDS

SEQ ID NO: 811968 - protein, 117 aa, Homo sapiens
MASGTTTTAVKIGIIGGTGLDDPEILEGRTEKYVDTPFGKPSDALILGKIKNVDCILLARHGRQHTIMPSKVNYQANIWALKEEGCTHVIVTTACGSLREEIQPGDIVIIDQFIDRL

SEQ ID NO: 811969 - protein, 226 aa, Homo sapiens
MTVQRLVAAAVLVALVSLILNNVAAFTSNWVCQTLEDGRRRSVGLWRSCWLVDRTRGGPSPGARAGQVDAHDCEALGWGSEAAGFQESRGTVKLQFDMMRACNLVATAALTAGQLTFLLGLVGLPLLSPDAPCWEEAMAAAFQLASFVLVIGLVTFYRIGPYTNLSWSCYLNIGACLLATLAAAMLIWNILHKREDCMAPRVIVISRSLTARFRRGLDNDYVESPC

SEQ ID NO: 811970 - protein, 226 aa, Homo sapiens; identical to SEQ ID NO: 811969

SEQ ID NO: 811971 - protein, 226 aa, Homo sapiens; identical to SEQ ID NO: 811969

SEQ ID NO: 811972 - protein, 226 aa, Homo sapiens; identical to SEQ ID NO: 811969

SEQ ID NO: 811973 - protein, 163 aa, Homo sapiens
AAASGAGAAGALRRPGLLGAPRCCRLGGLGYLQSLFSEFLMSGGPEARPPMLVEGGGPESLQKAPCTRGPPSHPVPPALAFTVGNGSGPGVRCPRNMAEGHPGPERRQSQQGLFRAAWLPGSRPSPLFCVCSVTSPGWDVPQVHRVEVGHGRRQETHPVRRRA

SEQ ID NO: 811974 - protein, 120 aa, Homo sapiens
AVLGRGRAFSLNSLCPGAVSGRVAPRVSAVSPLLRLFRDFAWVGCTAGASRRGGARPPARNPPCPEAGVRQAQPARAHLSSFFDQFIQNCSIIYQLYVFNLFLWKKKVFHYIFISEFQTA

SEQ ID NO: 811975 - protein, 64 aa, Homo sapiens
MVSNGCLNQMVPFLTPKEVPTARGLCDALMSSGEERGPHMKGPLGQILRVAHLSADSWAPPQTY

SEQ ID NO: 811976 - protein, 64 aa, Homo sapiens; identical to SEQ ID NO: 811975

SEQ ID NO: 811977 - protein, 64 aa, Homo sapiens; identical to SEQ ID NO: 811975

SEQ ID NO: 811978 - protein, 1441 aa, Homo sapiens
AAAVVAAREVWILVPSARSLRARIMAAVPQNNLQEQLERHSARTLNNKLSLSKPKFSGFTFKKKTSSDNNVSVTNVSVAKTPVLRNKDVNVTEDFSFSEPLPNTTNQQRVKDFFKNAPAGQETQRGGSKSLLPDFLQTPKEVVCTTQNTPTVKKSRDTALKKLEFSSSPDSLSTINDWDDMDDFDTSETSKSFVTPPQSHFVRVSTAQKSKKGKRNFFKAQLYTTNTVKTDLPPPSSESEQIDLTEEQKDDSEWLSSDVICIDDGPIAEVHINEDAQESDSLKTHLEDERDNSEKKKNLEEAELHSTEKVPCIEFDDDDYDTDFVPPSPEEIISASSSSSKCLSTLKDLDTSDRKEDVLSTSKDLLSKPEKMSMQELNPETSTDCDARQISLQQQLIHVMEHICKLIDTIPDDKLKLLDCGNELLQQRNIRRKLLTEVDFNKSDASLLGSLWRYRPDSLDGPMEGDSCPTGNSMKELNFSHLPSNSVSPGDCLLTTTLGKTGFSATRKNLFERPLFNTHLQKSFVSSNWAETPRLGKKNESSYFPGNVLTSTAVKDQNKHTASINDLERETQPSYDIDNFDIDDFDDDDDWEDIMHNLAASKSSTAAYQPIKEGRPIKSVSERLSSAKTDCLPVSSTAQNINFSESIQNYTDKSAQNLASRNLKHERFQSLSFPHTKEMMKIFHKKFGLHNFRTNQLEAINAALLGEDCFILMPTGGGKSLCYQLPACVSPGVTVVISPLRSLIVDQVQKLTSLDIPATYLTGDKTDSEATNIYLQLSKKDPIIKLLYVTPEKICASNRLISTLENLYERKLLARFVIDEAHCVSQWGHDFRQDYKRMNMLRQKFPSVPVMALTATANPRVQKDILTQLKILRPQVFSMSFNRHNLKYYVLPKKPKKVAFDCLEWIRKHHPYDSGIIYCLSRRECDTMADTLQRDGLAALAYHAGLSDSARDEVQQKWINQDGCQVICATIAFGMGIDKPDVRFVIHASLPKSVEGYYQESGRAGRDGEISHCLLFYTYHDVTRLKRLIMMEKDGNHHTRETHFNNLYSMVHYCENITECRRIQLLAYFGENGFNPDFCKKHPDVSCDNCCKTKDYKTRDVTDDVKSIVRFVQEHSSSQGMRNIKHVGPSGRFTMNMLVDIFLGSKSAKIQSGIFGKGSAYSRHNAERLFKKLILDKILDEDLYINANDQAIAYVMLGNKAQTVLNGNLKVDFMETENSSSVKKQKALVAKVSQREEMVKKCLGELTEVCKSLGKVFGVHYFNIFNTVTLKKLAESLSSDPEVLLQIDGVTEDKLEKYGAEVISVLQKYSEWTSPAEDSSPGISLSSSRGPGRSAAEELDEEIPVSSHYFASKTRNERKRKKMPASQRSKRRKTASSGSKAKGGSATCRKISSKTKSSSIIGSSSASHTSQATSGANSKLGIMAPPKPINRPFLKPSYAFS

SEQ ID NO: 811979 - protein, 213 aa, Homo sapiens
MSTGHGNSGQEQICSTPRTWHRSHPQLPPALALALALPWPMPLELDESLSSDPEVLLQIDGVTEDKLEKYGAEVISVLQKYSEWTSPAEDSSPGISLSSSRGPGRSAAEELDEEIPVSSHYFASKTRNERKRKKMPASQRSKRRKTASSGSKAKGGSATCRKISSKTKSSSIIGSSSASHTSQATSGANSKLGIMAPPKPINRPFLKPSYAFS

SEQ ID NO: 811980 - protein, 1441 aa, Homo sapiens; identical to SEQ ID NO: 811978

SEQ ID NO: 811981 - protein, 1070 aa, Homo sapiens
MSMQELNPETSTDCDARQISLQQQLIHVMEHICKLIDTIPDDKLKLLDCGNELLQQRNIRRKLLTEVDFNKSDASLLGSLWRYRPDSLDGPMEGDSCPTGNSMKELNFSHLPSNSVSPGDCLLTTTLGKTGFSATRKNLFERPLFNTHLQKSFVSSNWAETPRLGKKNESSYFPGNVLTSTAVKDQNKHTASINDLERETQPSYDIDNFDIDDFDDDDDWEDIMHNLAASKSSTAAYQPIKEGRPIKSVSERLSSAKTDCLPVSSTAQNINFSESIQNYTDKSAQNLASRNLKHERFQSLSFPHTKEMMKIFHKKFGLHNFRTNQLEAINAALLGEDCFILMPTGGGKSLCYQLPACVSPGVTVVISPLRSLIVDQVQKLTSLDIPATYLTGDKTDSEATNIYLQLSKKDPIIKLLYVTPEKICASNRLISTLENLYERKLLARFVIDEAHCVSQWGHDFRQDYKRMNMLRQKFPSVPVMALTATANPRVQKDILTQLKILRPQVFSMSFNRHNLKYYVLPKKPKKVAFDCLEWIRKHHPYDSGIIYCLSRRECDTMADTLQRDGLAALAYHAGLSDSARDEVQQKWINQDGCQVICATIAFGMGIDKPDVRFVIHASLPKSVEGYYQESGRAGRDGEISHCLLFYTYHDVTRLKRLIMMEKDGNHHTRETHFNNLYSMVHYCENITECRRIQLLAYFGENGFNPDFCKKHPDVSCDNCCKTKDYKTRDVTDDVKSIVRFVQEHSSSQGMRNIKHVGPSGRFTMNMLVDIFLGSKSAKIQSGIFGKGSAYSRHNAERLFKKLILDKILDEDLYINANDQAIAYVMLGNKAQTVLNGNLKVDFMETENSSSVKKQKALVAKVSQREEMVKKCLGELTEVCKSLGKVFGVHYFNIFNTVTLKKLAESLSSDPEVLLQIDGVTEDKLEKYGAEVISVLQKYSEWTSPAEDSSPGISLSSSRGPGRSAAEELDEEIPVSSHYFASKTRNERKRKKMPASQRSKRRKTASSGSKAKGGSATCRKISSKTKSSSIIGSSSASHTSQATSGANSKLGIMAPPKPINRPFLKPSYAFS

SEQ ID NO: 811982 - protein, 1207 aa, Homo sapiens
AAAVVAAREVWILVPSARSLRARIMAAVPQNNLQEQLERHSARTLNNKLSLSKPKFSGFTFKKKTSSDNNVSVTNVSVAKTPVLRNKDVNVTEDFSFSEPLPNTTNQQRVKDFFKNAPAGQETQRGGSKSLLPDFLQTPKEVVCTTQNTPTVKKSRDTALKKLEFSSSPDSLSTINDWDDMDDFDTSETSKSFVTPPQSHFVRVSTAQKSKKGKRNFFKAQLYTTNTVKTDLPPPSSESEQIDLTEEQKDDSEWLSSDVICIDDGPIAEVHINEDAQESDSLKTHLEDERDNSEKKKNLEEAELHSTEKVPCIEFDDDDYDTDFVPPSPEEIISASSSSSKCLSTLKDLDTSDRKEDVLSTSKDLLSKPEKMSMQELNPETSTDCDARQISLQQQLIHVMEHICKLIDTIPDDKLKLLDCGNELLQQRNIRRKLLTEVDFNKSDASLLGSLWRYRPDSLDGPMEGDSCPTGNSMKELNFSHLPSNSVSPGDCLLTTTLGKTGFSATRKNLFERPLFNTHLQKSFVSSNWAETPRLGKKNESSYFPGNVLTSTAVKDQNKHTASINDLERETQPSYDIDNFDIDDFDDDDDWEDIMHNLAASKSSTAAYQPIKEGRPIKSVSERLSSAKTDCLPVSSTAQNINFSESIQNYTDKSAQNLASRNLKHERFQSLSFPHTKEMMKIFHKKFGLHNFRTNQLEAINAALLGEDCFILMPTGGGKSLCYQLPACVSPGVTVVISPLRSLIVDQVQKLTSLDIPATYLTGDKTDSEATNIYLQLSKKDPIIKLLYVTPEKICASNRLISTLENLYERKLLARFVIDEAHCVSQWGHDFRQDYKRMNMLRQKFPSVPVMALTATANPRVQKDILTQLKILRPQVFSMSFNRHNLKYYVLPKKPKKVAFDCLEWIRKHHPYDSGIIYCLSRRECDTMADTLQRDGLAALAYHAGLSDSARDEVQQKWINQDGCQVICATIAFGMGIDKPDVRFVIHASLPKSVEGYYQESGRAGRDGEISHCLLFYTYHDVTRLKRLIMMEKDGNHHTRETHFNNLYSMVHYCENITECRRIQLLAYFGENGFNPDFCKKHPDVSCDNCCKTKDYKTRDVTDDVKSIVRFVQEHSSSQGMRNIKHVGPSGRFTMNMLVDIFLGSKSAKIQSGIFGKGSAYSRHNAERLFKKLILDKILDEDLYINANDQAIAYVMLGNKSLASLAS

SEQ ID NO: 811983 - protein, 979 aa, Homo sapiens
MEGDSCPTGNSMKELNFSHLPSNSVSPGDCLLTTTLGKTGFSATRKNLFERPLFNTHLQKSFVSSNWAETPRLGKKNESSYFPGNVLTSTAVKDQNKHTASINDLERETQPSYDIDNFDIDDFDDDDDWEDIMHNLAASKSSTAAYQPIKEGRPIKSVSERLSSAKTDCLPVSSTAQNINFSESIQNYTDKSAQNLASRNLKHERFQSLSFPHTKEMMKIFHKKFGLHNFRTNQLEAINAALLGEDCFILMPTGGGKSLCYQLPACVSPGVTVVISPLRSLIVDQVQKLTSLDIPATYLTGDKTDSEATNIYLQLSKKDPIIKLLYVTPEKICASNRLISTLENLYERKLLARFVIDEAHCVSQWGHDFRQDYKRMNMLRQKFPSVPVMALTATANPRVQKDILTQLKILRPQVFSMSFNRHNLKYYVLPKKPKKVAFDCLEWIRKHHPYDSGIIYCLSRRECDTMADTLQRDGLAALAYHAGLSDSARDEVQQKWINQDGCQVICATIAFGMGIDKPDVRFVIHASLPKSVEGYYQESGRAGRDGEISHCLLFYTYHDVTRLKRLIMMEKDGNHHTRETHFNNLYSMVHYCENITECRRIQLLAYFGENGFNPDFCKKHPDVSCDNCCKTKDYKTRDVTDDVKSIVRFVQEHSSSQGMRNIKHVGPSGRFTMNMLVDIFLGSKSAKIQSGIFGKGSAYSRHNAERLFKKLILDKILDEDLYINANDQAIAYVMLGNKAQTVLNGNLKVDFMETENSSSVKKQKALVAKVSQREEMVKKCLGELTEVCKSLGKVFGVHYFNIFNTVTLKKLAESLSSDPEVLLQIDGVTEDKLEKYGAEVISVLQKYSEWTSPAEDSSPGISLSSSRGPGRSAAEELDEEIPVSSHYFASKTRNERKRKKMPASQRSKRRKTASSGSKAKGGSATCRKISSKTKSSSIIGSSSASHTSQATSGANSKLGIMAPPKPINRPFLKPSYAFS

SEQ ID NO: 811984 - protein, 467 aa, Homo sapiens
MGIDKPDVRFVIHASLPKSVEGYYQESGRAGRDGEISHCLLFYTYHDVTRLKRLIMMEKDGNHHTRETHFNNLYSMVHYCENITECRRIQLLAYFGENGFNPDFCKKHPDVSCDNCCKTKDYKTRDVTDDVKSIVRFVQEHSSSQGMRNIKHVGPSGRFTMNMLVDIFLGSKSAKIQSGIFGKGSAYSRHNAERLFKKLILDKILDEDLYINANDQAIAYVMLGNKAQTVLNGNLKVDFMETENSSSVKKQKALVAKVSQREEMVKKCLGELTEVCKSLGKVFGVHYFNIFNTVTLKKLAESLSSDPEVLLQIDGVTEDKLEKYGAEVISVLQKYSEWTSPAEDSSPGISLSSSRGPGRSAAEELDEEIPVSSHYFASKTRNERKRKKMPASQRSKRRKTASSGSKAKGGSATCRKISSKTKSSSIIGSSSASHTSQATSGANSKLGIMAPPKPINRPFLKPSYAFS

SEQ ID NO: 811985 - protein, 380 aa, Homo sapiens
RGVPRQRRPGGPGTQESMATLRRLREAPRHLLVCEKSNFGNHKSRHRHLVQTHYYNYRVSFLIPECGILSEELKNLVMNTGPYYFVKNLPLHELITPEFISTFIKKGSCYALTYNTHIDEDNTVALLPNGKLILSLDKDTYEETGLQGHPSQFSGRKIMKFIVSIDLMELSLNLDSKKYERISWSFKEKKPLKFDFLLAWHKTGSEESTMMSYFSKYQIQEHQPKVALSTLRDLQCPVLQSSELEGTPEVSCRALELFDWLGAVFSNVDLNNEPNNFISTYCCPEPSTVVAKAYLCTITGFILPEKICLLLEHLCHYFDEPKLAPWVTLSVQGFADSPVSWEKNEHGFRKGGEHLYNFVIFNNQDYWLQMAVGANDHCPP

SEQ ID NO: 811986 - protein, 357 aa, Homo sapiens
RGVPRQRRPGGPGTQESMATLRRLREAPRHLLVCEKSNFGNHKSRHRHLVQTHYYNYRVSFLIPECGILSEELKNLVMNTGPYYFVKNLPLHELITPEFISTFIKKGKLILSLDKDTYEETGLQGHPSQFSGRKIMKFIVSIDLMELSLNLDSKKYERISWSFKEKKPLKFDFLLAWHKTGSEESTMMSYFSKYQIQEHQPKVALSTLRDLQCPVLQSSELEGTPEVSCRALELFDWLGAVFSNVDLNNEPNNFISTYCCPEPSTVVAKAYLCTITGFILPEKICLLLEHLCHYFDEPKLAPWVTLSVQGFADSPVSWEKNEHGFRKGGEHLYNFVIFNNQDYWLQMAVGANDHCPP

SEQ ID NO: 811987 - protein, 315 aa, Homo sapiens
RGVPRQRRPGGPGTQESMATLRRLREAPRHLLVCEKSNFGNHKSRHRHLVQTHYYNYRVSFLIPECGILSEELKNLVMNTGPYYFVKNLPLHELITPEFISTFIKKGSCYALTYNTHIDEDNTVALLPNGKLILSLDKDTYEETGLQGHPSQFSGRKIMKFIVSIDLMELSLNLDSKKYERISWSFKEKKPLKFDFLLAWHKTGSEESTMMSYFSKYQIQEHQPKVALSTLRDLQCPVLQSSELEGTPEVSCRALELFDWLGAVFSNVDLNNEPNNFISTYCCPEPSTVVAKAYLCTITGFILPEKICLLLEHLW

SEQ ID NO: 811988 - protein, 276 aa, Homo sapiens
RGVPRQRRPGGPGTQESMATLRRLREAPRHLLVCEKSNFGNHKSRHRHLVQTHYYNYRVSFLIPECGILSEELKNLVMNTGPYYFVKNLPLHELITPEFISTFIKKGSCYALTYNTHIDEDNTVALLPNGKLILSLDKDTYEETGLQGHPSQFSGRKIMKFIVSIDLMELSLNLDSKKYERISWSFKEKKPLKFDFLLAWHKTGSEESTMMSYFSKYQIQEHQPKVALSTLRDLQCPVLQSSELEGTPEVSCRALELFDWLGAVFSNVDLRVPELR

SEQ ID NO: 811989 - protein, 498 aa, Homo sapiens
MVTWLYRFLPTSNMAAKLRSLLPPDLRLQFWLHARLQKCFLSRGCGSYCAGAKASPLPPGKMAMGLMCGRRELLRLLQSGRRVHSVAGPSQWLGKPLTTRLLFPVAPCCCRPHYLFLAASGPRSLSTSAISFAEVQVQAPPVVAATPSPTAVPEVASGETADVVQTAAEQSFAELGLGSYTPVGLIQNLLEFMHVDLGLPWWGAIAACTVFARCLIFPLIVTGQREAARIHNHLPEIQKFSSRIREAKLAGDHIEYYKASSEMALYQKKHGIKLYKPLILPVTQAPIFISFFIALREMANLPVPSLQTGGLWWFQDLTVSDPIYILPLAVTATMWAVLELGAETGVQSSDLQWMRNVIRMMPLITLPITMHFPTAVFMYWLSSNLFSLVQVSCLRIPAVRTVLKIPQRVVHDLDKLPPREGFLESFKKGWKNAEMTRQLREREQRMRNQLELAARGPLRQTFTHNPLLQPGKDNPPNIPSSSSSSKPKSKYPWHDTLG

SEQ ID NO: 811990 - protein, 437 aa, Homo sapiens
MAMGLMCGRRELLRLLQSGRRVHSVAGPSQWLGKPLTTRLLFPVAPCCCRPHYLFLAASGPRSLSTSAISFAEVQVQAPPVVAATPSPTAVPEVASGETADVVQTAAEQSFAELGLGSYTPVGLIQNLLEFMHVDLGLPWWGAIAACTVFARCLIFPLIVTGQREAARIHNHLPEIQKFSSRIREAKLAGDHIEYYKASSEMALYQKKHGIKLYKPLILPVTQAPIFISFFIALREMANLPVPSLQTGGLWWFQDLTVSDPIYILPLAVTATMWAVLELGAETGVQSSDLQWMRNVIRMMPLITLPITMHFPTAVFMYWLSSNLFSLVQVSCLRIPAVRTVLKIPQRVVHDLDKLPPREGFLESFKKGWKNAEMTRQLREREQRMRNQLELAARGPLRQTFTHNPLLQPGKDNPPNIPSSSSSSKPKSKYPWHDTLG

SEQ ID NO: 811991 - protein, 498 aa, Homo sapiens; identical to SEQ ID NO: 811989

SEQ ID NO: 811992 - protein, 498 aa, Homo sapiens; identical to SEQ ID NO: 811989

SEQ ID NO: 811993 - protein, 498 aa, Homo sapiens; identical to SEQ ID NO: 811989

SEQ ID NO: 811994 - protein, 504 aa, Homo sapiens
MVTWLYRFLPTSNMAAKLRSLLPPDLRLQFWLHARLQKCFLSRGCGSYCAGAKASPLPPGKMAMGLMCGRRELLRLLQSGRRVHSVAGPSQWLGKPLTTRLLFPVAPCCCRPHYLFLAASGPRSLSTSAISFAEVQVQAPPVVAATPSPTAVPEVASGETADVVQTAAEQSFAELGLGSYTPVGLIQNLLEFMHVDLGLPWWGAIAACTVFARCLIFPLIVTGQREAARIHNHLPEIQKFSSRIREAKLAGDHIEYYKASSEMALYQKKHGIKLYKPLILPVTQAPIFISFFIALREMANLPVPSLQTGGLWWFQDLTVSDPIYILPLAVTATMWAVLELGAETGVQSSDLQWMRNVIRMMPLITLPITMHFPTAVFMYWLSSNLFSLVQVSCLRIPAVRTVLKIPQRVVHDLDKLPPREGFLESFKKGWKNAEMTRQLREREQRMRNQLELAARGPLRQTFTHNPLLQPGKDNPPNIPSSSSSSKPKSKYPWHCLDSGHCLDS

SEQ ID NO: 811995 - protein, 306 aa, Homo sapiens
MHVDLGLPWWGAIAACTVFARCLIFPLIVTGQREAARIHNHLPEIQKFSSRIREAKLAGDHIEYYKASSEMALYQKKHGIKLYKPLILPVTQAPIFISFFIALREMANLPVPSLQTGGLWWFQDLTVSDPIYILPLAVTATMWAVLELGAETGVQSSDLQWMRNVIRMMPLITLPITMHFPTAVFMYWLSSNLFSLVQVSCLRIPAVRTVLKIPQRVVHDLDKLPPREGFLESFKKGWKNAEMTRQLREREQRMRNQLELAARGPLRQTFTHNPLLQPGKDNPPNIPSSSSSSKPKSKYPWHDTLG

SEQ ID NO: 811996 - protein, 306 aa, Homo sapiens; identical to SEQ ID NO: 811995

SEQ ID NO: 811997 - protein, 474 aa, Homo sapiens
MVTWLYRFLPTSNMAAKLRSLLPPDLRLQFWLHARLQKCFLSRGCGSYCAGAKASPLPPGKMAMGLMCGRRELLRLLQSGRRVHSVAGPSQWLGKPLTTRLLFPVAPCCCRPHYLFLAASGPRSLSTSAISFAEVQVQAPPVVAATPSPTAVPEVASGETADVVQTAAEQSFAELGLGSYTPVGLIQNLLEFMHVDLGLPWWGAIAACTVFARCLIFPLIVTGQREAARIHNHLPEIQKFSSRIREAKLAGDHIEYYKASSEMALYQKKHGIKLYKPLILPVTQAPIFISFFIALREMANLPVPSLQTGGLWWFQDLTVSDPIYILPLAVTATMWAVLELGAETGVQSSDLQWMRNVIRMMPLITLPITMHFPTAVFMYWLSSNLFSLVQVSCLRIPAVRTVLKIPQRVVHDLDKLPPREGFLESFKKGWKNAEMTRQLREREQRMRNQLELAARAPLAQTFTRDPIIQGVWKQ

SEQ ID NO: 811998 - protein, 326 aa, Homo sapiens
MVTWLYRFLPTSNMAAKLRSLLPPDLRLQFWLHARLQKCFLSRGCGSYCAGAKASPLPPGKMAMGLMCGRRELLRLLQSGRRVHSVAGPSQWLGKPLTTRLLFPVAPCCCRPHYLFLAASGPRSLSTSAISFAEVQVQAPPVVAATPSPTAVPEVASGETADVVQTAAEQSFAELGLGSYTPVGLIQNLLEFMHVDLGLPWWGAIAACTVFARCLIFPLIVTGQREAARIHNHLPEIQKFSSRIREAKLAGDHIEYYKASSEMALYQKKHGIKLYKPLILPVTQVSKNISFLISSSTHEISSLCFMCPRSPKKQVVVDYTWLSVVG

SEQ ID NO: 811999 - protein, 501 aa, Homo sapiens
PQLPPFSPQKKRKIGKLTGQNGDGTNVRTPGASALATVRASAHHASTEALSTGFGKSLYHYGVLFPVATVPAVSLTRIALSFAVSSQVTPSSTSCTSTDYHRSCWNFQVLGAPSLIVGLSDIPSTHDYSTLPESWLLERLARSVGRKTQLAVVTTLLLKLVAWVVTTIPMLRTLDPRNVYVCILVLSLFCNSRGLALGCGRVHLAVFDDRSTVFARCLIFPLIVTGQREAARIHNHLPEIQKFSSRIREAKLAGDHIEYYKASSEMALYQKKHGIKLYKPLILPVTQAPIFISFFIALREMANLPVPSLQTGGLWWFQDLTVSDPIYILPLAVTATMWAVLELGAETGVQSSDLQWMRNVIRMMPLITLPITMHFPTAVFMYWLSSNLFSLVQVSCLRIPAVRTVLKIPQRVVHDLDKLPPREGFLESFKKGWKNAEMTRQLREREQRMRNQLELAARGPLRQTFTHNPLLQPGKDNPPNIPSSSSSSKPKSKYPWHDTLG

SEQ ID NO: 812000 - protein, 236 aa, Homo sapiens
MALYQKKHGIKLYKPLILPVTQAPIFISFFIALREMANLPVPSLQTGGLWWFQDLTVSDPIYILPLAVTATMWAVLELGAETGVQSSDLQWMRNVIRMMPLITLPITMHFPTAVFMYWLSSNLFSLVQVSCLRIPAVRTVLKIPQRVVHDLDKLPPREGFLESFKKGWKNAEMTRQLREREQRMRNQLELAARGPLRQTFTHNPLLQPGKDNPPNIPSSSSSSKPKSKYPWHDTLG

SEQ ID NO: 812001 - protein, 523 aa, Homo sapiens
MAMGLMCGRRELLRLLQSGRRVHSVAGPSQWLGKPLTTRLLFPVAPCCCRPHYLFLAASGPRSLSTSAISFAEVQVQAPPVVAATPSPTAVPEVASGETADVVQTAAEQSFAELGLGSYTPVGLIQNLLEFMHVDLGLPWWGAIAACTVFARCLIFPLIVTGQREAARIHNHLPEIQKFSSRIREAKLAGDHIECESVQNERGRSPHLHFSLHSAGGKEQCKSEVATVGKVLKVYLFLRPNAPKEWPGLVRNFTGQVDNEDVPPPLMYLLPQPLISPHLTDYKASSEMALYQKKHGIKLYKPLILPVTQAPIFISFFIALREMANLPVPSLQTGGLWWFQDLTVSDPIYILPLAVTATMWAVLELGAETGVQSSDLQWMRNVIRMMPLITLPITMHFPTAVFMYWLSSNLFSLVQVSCLRIPAVRTVLKIPQRVVHDLDKLPPREGFLESFKKGWKNAEMTRQLREREQRMRNQLELAARGPLRQTFTHNPLLQPGKDNPPNIPSSSSSSKPKSKYPWHDTLG

SEQ ID NO: 812002 - protein, 481 aa, Homo sapiens
MVTWLYRFLPTSNMAAKLRSLLPPDLRLQFWLHARLQKCFLSRGCGSYCAGAKASPLPPGKMAMGLMCGRRELLRLLQSGRRVHSVAGPSQWLGKPLTTRLLFPVAPCCCRPHYLFLAASGPRSLSTSAISFAEVQVQAPPVVAATPSPTAVPEVASGETADVVQTAAEQSFAELGLGSYTPVGLIQNLLEFMHVDLGLPWWGAIAACTVFARCLIFPLIVTGQREAARIHNHLPEIQKFSSRIREAKLAGDHIEYYKASSEMALYQKKHGIKLYKPLILPVTQAPIFISFFIALREMANLPVPSLQTGGLWWFQDLTVSDPIYILPLAVTATMWAVLELGAETGVQSSDLQWMRNVIRMMPLITLPITMHFPTHQQCPGLALTARPLLMLMGLLFSFLSYSFAKPLLMTFTTVTHIISFKPHSNSVRDCYLHFMDEEADSEEMNFQIHPTGKEKGSLLGDFEFQNCFRFQVGGSIFKAPW

SEQ ID NO: 812003 - protein, 200 aa, Homo sapiens
MAMGLMCGRRELLRLLQSGRRVHSVAGPSQWLGKPLTTRLLFPVAPCCCRPHYLFLAASGPRSLSTSAISFAEVQVQAPPVVAATPSPTAVPEVASGETADVVQTAAEQSFAELGLGSYTPVGLIQNLLEFMHVDLGLPWWGAIAACTVFARCLIFPLIVTGQREAARIHNHLPEIQKFSSRIREAKLAGDHIECESVAE

SEQ ID NO: 812004 - protein, 389 aa, Homo sapiens
MAMGLMCGRRELLRLLQSGRRVHSVAGPSQWLGKPLTTRLLFPVAPCCCRPHYLFLAASGPRSLSTSAISFAEVQVQAPPVVAATPSPTAVPEVASGETADVVQTAAEQSFAELGLGSYTPVGLIQNLLEFMHVDLGLPWWGAIAAYYKASSEMALYQKKHGIKLYKPLILPVTQAPIFISFFIALREMANLPVPSLQTGGLWWFQDLTVSDPIYILPLAVTATMWAVLELGAETGVQSSDLQWMRNVIRMMPLITLPITMHFPTAVFMYWLSSNLFSLVQVSCLRIPAVRTVLKIPQRVVHDLDKLPPREGFLESFKKGWKNAEMTRQLREREQRMRNQLELAARGPLRQTFTHNPLLQPGKDNPPNIPSSSSSSKPKSKYPWHDTLG

SEQ ID NO: 812005 - protein, 217 aa, Homo sapiens
MAMGLMCGRRELLRLLQSGRRVHSVAGPSQWLGKPLTTRLLFPVAPCCCRPHYLFLAASGPRSLSTSAISFAEVQVQAPPVVAATPSPTAVPEVASGETADVVQTAAEQSFAELGLGSYTPVGLIQNLLEFMHVDLGLPWWGAIAAYYKASSEMALYQKKHGIKLYKPLILPVTQVSKNISFLISSSTHEISSLCFMCPRSPKKQVVVDYTWLSVVG

SEQ ID NO: 812006 - protein, 260 aa, Homo sapiens
GRGIGGYPFKLAGDHIEYYKASSEMALYQKKHGIKLYKPLILPVTQAPIFISFFIALREMANLPVPSLQTGGLWWFQDLTVSDPIYILPLAVTATMWAVLELGAETGVQSSDLQWMRNVIRMMPLITLPITMHFPTAVFMYWLSSNLFSLVQVSCLRIPAVRTVLKIPQRVVHDLDKLPPREGFLESFKKGWKNAEMTRQLREREQRMRNQLELAARGPLRQTFTHNPLLQPGKDNPPNIPSSSSSSKPKSKYPWHDTLG

SEQ ID NO: 812007 - protein, 143 aa, Homo sapiens
ASSEMALYQKKHGIKLYKPLILPGVQAPPVVAATPSPTAVPEVASGETADVVQTAAEQSFAELGLGSYTPVGLIQNLLEFMHVDLGLPWWGAIAACTVFARCLIFPLIVTGQREAARIHNHLPEIQKFSSRIREAKLAGDHIE

SEQ ID NO: 812008 - protein, 345 aa, Homo sapiens
MVTWLYRFLPTSNMAAKLRSLLPPDLRLQFWLHARLQKCFLSRGCGSYCAGAKASPLPPGKMAMGLMCGRRELLRLLQSGRRVHSVAGPSQWLGKPLTTRLLFPVAPCCCRPHYLFLAASGPRSLSTSAISFAEVQVQAPPVVAATPSPTAVPEVASGETADVVQTAAEQSFAELGLGSYTPVGLIQNLLEFMHVDLGLPWWGAIAACTVFARCLIFPLIVTGQREAARIHNHLPEIQKFSSRIREAKLAGDHIEYYKASSEMALYQKKHGIKLYKPLILPVTQPPIFISFFIGFEEQWAPCGSQESHGIRSHLNINQWLITWEHCGWLLGNGPEQGVKGSAFNG

SEQ ID NO: 812009 - protein, 326 aa, Homo sapiens; identical to SEQ ID NO: 811998

SEQ ID NO: 812010 - protein, 113 aa, Homo sapiens
MAMGLMCGRRELLRLLQSGRRVHSVAGPSQWLGKPLTTRLLFPVAPCCCRPHYLFLAASGPRSLSTSAISFAEVQVQAPPVVAATPSPTAVPEVASGETADVVQTAAETKNFR

SEQ ID NO: 812011 - protein, 669 aa, Homo sapiens
MGTALVYHEDMTATRLLWDDPECEIERPERLTAALDRLRQRGLEQRCLRLSAREASEEELGLVHSPEYVSLVRETQVLGKEELQALSGQFDAIYFHPSTFHCARLAAGAGLQLVDAVLTGAVQNGLALVRPPGHHGQRAAANGFCVFNNVAIAAAHAKQKHGLHRILVVDWDVHHGQGIQYLFEDDPSVLYFSWHRYEHGRFWPFLRESDADAVGRGQGLGFTVNLPWNQVGMGNADYVAAFLHLLLPLAFEFDPELVLVSAGFDSAIGDPEGQMQATPECFAHLTQLLQVLAGGRVCAVLEGGYHLESLAESVCMTVQTLLGDPAPPLSGPMAPCQSALESIQSARAAQAPHWKSLQQQDVTAVPMSPSSHSPEGRPPPLLPGGPVCKAAASAPSSLLDQPCLCPAPSVRTAVALTTPDITLVLPPDVIQQEASALREETEAWARPHESLAREEALTALGKLLYLLDGMLDGQVNSGIAATPASAAAATLDVAVRRGLSHGAQRLLCVALGQLDRPPDLAHDGRSLWLNIRGKEAAALSMFHVSTPLPVMTGGFLSCILGLVLPLAYGFQPDLVLVALGPGHGLQGPHAALLAAMLRGLAGGRVLALLEENSTPQLAGILARVLNGEAPPSLGPSSVASPEDVQALMYLRGQLEPQWKMLQCHPHLVA

SEQ ID NO: 812012 - protein, 669 aa, Homo sapiens; identical to SEQ ID NO: 812011

SEQ ID NO: 812013 - protein, 649 aa, Homo sapiens
MGTALVYHEDMTATRLLWDDPECEIERPERLTAALDRLRQRGLEQRCLRLSAREASEEELGLVHSPEYVSLVRETQVLGKEELQALSGQFDAIYFHPSTFHCARLAAGAGLQLVDAVLTGAVQNGLALVRPPGHHGQRAAANGFCVFNNVAIAAAHAKQKHGLHRILVVDWDVHHGQGIQYLFEDDPSVLYFSWHRYEHGRFWPFLRESDADAVGRGQGLGFTVNLPWNQVGMGNADYVAAFLHLLLPLAFEGQMQATPECFAHLTQLLQVLAGGRVCAVLEGGYHLESLAESVCMTVQTLLGDPAPPLSGPMAPCQSALESIQSARAAQAPHWKSLQQQDVTAVPMSPSSHSPEGRPPPLLPGGPVCKAAASAPSSLLDQPCLCPAPSVRTAVALTTPDITLVLPPDVIQQEASALREETEAWARPHESLAREEALTALGKLLYLLDGMLDGQVNSGIAATPASAAAATLDVAVRRGLSHGAQRLLCVALGQLDRPPDLAHDGRSLWLNIRGKEAAALSMFHVSTPLPVMTGGFLSCILGLVLPLAYGFQPDLVLVALGPGHGLQGPHAALLAAMLRGLAGGRVLALLEENSTPQLAGILARVLNGEAPPSLGPSSVASPEDVQALMYLRGQLEPQWKMLQCHPHLVA

SEQ ID NO: 812014 - protein, 437 aa, Homo sapiens [sequence omitted]

SEQ ID NO: 812015 - protein, 437 aa, Homo sapiens [sequence omitted]

SEQ ID NO: 812016 - protein, 437 aa, Homo sapiens [sequence omitted]

SEQ ID NO: 812017 - protein, 508 aa, Homo sapiens
MGNADYVAAFLHLLLPLAFEVTARRAPPGQPGGRGTLCLECASEGRRRVMSCPTPVWLGKVLRRGWDGPGSPSPGLQPLSVDPPHSGLACEFDPELVLVSAGFDSAIGDPEGQMQATPECFAHLTQLLQVLAGGRVCAVLEGGYHLESLAESVCMTVQTLLGDPAPPLSGPMAPCQSALESIQSARAAQAPHWKSLQQQDVTAVPMSPSSHSPEGRPPPLLPGGPVCKAAASAPSSLLDQPCLCPAPSVRTAVALTTPDITLVLPPDVIQQEASALREETEAWARPHESLAREEALTALGKLLYLLDGMLDGQVNSGIAATPASAAAATLDVAVRRGLSHGAQRLLCVALGQLDRPPDLAHDGRSLWLNIRGKEAAALSMFHVSTPLPVMTGGFLSCILGLVLPLAYGFQPDLVLVALGPGHGLQGPHAALLAAMLRGLAGGRVLALLEENSTPQLAGILARVLNGEAPPSLGPSSVASPEDVQALMYLRGQLEPQWKMLQCHPHLVA

SEQ ID NO: 812018 - protein, 437 aa, Homo sapiens [sequence omitted]

SEQ ID NO: 812019 - protein, 437 aa, Homo sapiens [sequence omitted]

SEQ ID NO: 812020 - protein, 303 aa, Homo sapiens
MSPSSHSPEGRPPPLLPGGPVCKAAASAPSSLLDQPCLCPAPSVRTAVALTTPDITLVLPPDVIQQEASALREETEAWARPHESLAREEALTALGKLLYLLDGMLDGQVNSGIAATPASAAAATLDVAVRRGLSHGAQRLLCVALGQLDRPPDLAHDGRSLWLNIRGKEAAALSMFHVSTPLPVMTGGFLSCILGLVLPLAYGFQPDLVLVALGPGHGLQGPHAALLAAMLRGLAGGRVLALLEENSTPQLAGILARVLNGEAPPSLGPSSVASPEDVQALMYLRGQLEPQWKMLQCHPHLVA

SEQ ID NO: 812021 - protein, 395 aa, Homo sapiens [sequence omitted]

SEQ ID NO: 812022 - protein, 395 aa, Homo sapiens [sequence omitted]

SEQ ID NO: 812023 - protein, 508 aa, Homo sapiens; identical to SEQ ID NO: 812017

SEQ ID NO: 812024 - protein, 303 aa, Homo sapiens; identical to SEQ ID NO: 812020

SEQ ID NO: 812025 - protein, 313 aa, Homo sapiens
MGTALVYHEDMTATRLLWDDPECEIERPERLTAALDRLRQRGLEQRCLRLSAREASEEELGLVHSTLVLPPDVIQQEASALREETEAWARPHESLAREEALTALGKLLYLLDGMLDGQVNSGIAATPASAAAATLDVAVRRGLSHGAQRLLCVALGQLDRPPDLAHDGRSLWLNIRGKEAAALSMFHVSTPLPVMTGGFLSCILGLVLPLAYGFQPDLVLVALGPGHGLQGPHAALLAAMLRGLAGGRVLALLEENSTPQLAGILARVLNGEAPPSLGPSSVASPEDVQALMYLRGQLEPQWKMLQCHPHLVA

SEQ ID NO: 812026 - protein, 285 aa, Homo sapiens
MGNADYVAAFLHLLLPLAFEVTARRAPPGQPGGRGTLCLECASEGRRRVMSCPTPVWLGKVLRRGWDGPGSPSPGLQPLSVDPPHSGLACEFDPELVLVSAGFDSAIGDPEGQMQATPECFAHLTQLLQVLAGGRVCAVLEGGYHLESLAESVCMTVQTLLGDPAPPLSGPMAPCQSALESIQSARAAQAPHWKSLQQQDVTAVPMSPSSHSPEGRPPPLLPGGPVCKAAASAPSSLLDQPCLCPAPSVRTAVALTTPDITLVLPPDVIQQEASALREETEAWAR

SEQ ID NO: 812027 - protein, 176 aa, Homo sapiens
MNTCPEASSSSRLLCVALGQLDRPPDLAHDGRSLWLNIRGKEAAALSMFHVSTPLPVMTGGFLSCILGLVLPLAYGFQPDLVLVALGPGHGLQGPHAALLAAMLRGLAGGRVLALLEENSTPQLAGILARVLNGEAPPSLGPSSVASPEDVQALMYLRGQLEPQWKMLQCHPHLVA

SEQ ID NO: 812028 - protein, 205 aa, Homo sapiens
MAGGFILIIVVNSGIAATPASAAAATLDVAVRRGLSHGAQRLLCVALGQLDRPPDLAHDGRSLWLNIRGKEAAALSMFHVSTPLPVMTGGFLSCILGLVLPLAYGFQPDLVLVALGPGHGLQGPHAALLAAMLRGLAGGRVLALLEENSTPQLAGILARVLNGEAPPSLGPSSVASPEDVQALMYLRGQLEPQWKMLQCHPHLVA

SEQ ID NO: 812029 - protein, 110 aa, Homo sapiens
MGNADYVAAFLHLLLPLAFEFDPELVLVSAGFDSAIGDPEGQMQATPECFAHLTQLLQVLAGGRVCAVLEGGYHLESLAESVCMTVQTLLGDPAPPLSGPMAPCQRCEGR

SEQ ID NO: 812030 - protein, 427 aa, Homo sapiens
MGNADYVAAFLHLLLPLAFEFDPELVLVSAGFDSAIGDPEGQMQATPECFAHLTQLLQVLAGGRVCAVLEGGYHLESLAESVCMTVQTLLGDPAPPLSGPMAPCQSALESIQSARAAQAPHWKSLQQQDVTAVPMSPSSHSPEGRPPPLLPGGPVCKAAASAPSSLLDQPCLCPAPSVRTAVALTTPDITLVLPPDVIQQEASALREETEAWARPHESLAREEALTALGKLLYLLDGMLDGQVNSGIAATPASAAAATLDVAVRRGLSHGAQRLLCVALGQLDRPPDLAHDGRSLWLNIRGKEAAALSMFHVSTPLPVMTGGFLSCILGLVLPLAYGFQPDLVLVALGPGHGLQGPHAALLAAMLRGLAGGRVLALLEEEVSWAGWRCCGVGRGEGPVTASVFAPGPELHTPASRDPGPGAEWRGTS

SEQ ID NO: 812031 - protein, 110 aa, Homo sapiens; identical to SEQ ID NO: 812029

SEQ ID NO: 812032 - protein, 237 aa, Homo sapiens
MLGGSLGSRLLRGVGGSHGRFGARGVREGGAAMAAGESMAQRMVWVDLEMTGLDIEKDQIIEMACLITDSDLNILAEGPNLIIKQPDELLDSMSDWCKEHHGKSGLTKAVKESTITLQQAEYEFLSFVRQQTPPGLCPLAGNSVHEDKKFLDKYMPQFMKHLHYRIIDVSTVKELCRRWYPEEYEFAPKKAASHRALDDISESIKELQFYRNNIFKKKIDEKKRKIIENGENEKTVS

SEQ ID NO: 812033 - protein, 105 aa, Homo sapiens
NSLISTATGNSVHEDKKFLDKYMPQFMKHLHYRIIDVSTVKELCRRWYPEEYEFAPKKAASHRALDDISESIKELQFYRNNIFKKKIDEKKRKIIENGENEKTVS

SEQ ID NO: 812034 - protein, 105 aa, Homo sapiens; identical to SEQ ID NO: 812033

SEQ ID NO: 812035 - protein, 146 aa, Homo sapiens
KRDDSLNLPPLHSGLTKAVKESTITLQQAEYEFLSFVRQQTPPGLCPLAGNSVHEDKKFLDKYMPQFMKHLHYRIIDVSTVKELCRRWYPEEYEFAPKKAASHRALDDISESIKELQFYRNNIFKKKIDEKKRKIIENGENEKTVS

SEQ ID NO: 812036 - protein, 87 aa, Homo sapiens
ARGLPVVLRRLATIAPAPAPAARLGPWLLVPGDARRLPGLQAVAGCRWESRTVRGPRCPRRWRSHGGRGEHGSADGLGGPGDDRIGH

SEQ ID NO: 812037 - protein, 87 aa, Homo sapiens; identical to SEQ ID NO: 812036

SEQ ID NO: 812038 - protein, 87 aa, Homo sapiens; identical to SEQ ID NO: 812036

SEQ ID NO: 812039 - protein, 237 aa, Homo sapiens; identical to SEQ ID NO: 812032

SEQ ID NO: 812040 - protein, 237 aa, Homo sapiens; identical to SEQ ID NO: 812032

SEQ ID NO: 812041 - protein, 237 aa, Homo sapiens; identical to SEQ ID NO: 812032

SEQ ID NO: 812042 - protein, 237 aa, Homo sapiens; identical to SEQ ID NO: 812032

SEQ ID NO: 812043 - protein, 237 aa, Homo sapiens; identical to SEQ ID NO: 812032

SEQ ID NO: 812044 - protein, 237 aa, Homo sapiens; identical to SEQ ID NO: 812032

SEQ ID NO: 812045 - protein, 237 aa, Homo sapiens; identical to SEQ ID NO: 812032

SEQ ID NO: 812046 - protein, 138 aa, Homo sapiens
MLGGSLGSRLLRGVGGSHGRFGARGVREGGAAMAAGESMAQRMVWVDLEMTGLDIEKDQIIEMACLITDSDLNILAEGPNLIIKQPDELLDSMSDWCKEHHGKVTLPNNRIAALGISSKLFAPTPESDTIVGWYFKKA

SEQ ID NO: 812047 - protein, 148 aa, Homo sapiens
PPGSQFGTREHHGKSGLTKAVKESTITLQQAEYEFLSFVRQQTPPGLCPLAGNSVHEDKKFLDKYMPQFMKHLHYRIIDVSTVKELCRRWYPEEYEFAPKKAASHRALDDISESIKELQFYRNNIFKKKIDEKKRKIIENGENEKTVS

SEQ ID NO: 812048 - protein, 121 aa, Homo sapiens
MLGGSLGSRLLRGVGGSHGRFGARGVREGGAAMAAGESMAQRMVWVDLEMTGLDIEKDQIIEMACLITDSDLNILAEGPNLIIKQPDELLDSMSDWCKEHHGKEIQFMKIRSFLTNTCPSS

SEQ ID NO: 812049 - protein, 87 aa, Homo sapiens; identical to SEQ ID NO: 812036

SEQ ID NO: 812050 - protein, 234 aa, Homo sapiens
MLTNETGFEISSSDATVKILITTVPPNLRKLDPELHLDIKVLQSALAAIRHARWFEENASQSTVKVLIRLLKDLRIRFPGFEPLTPWILDLLGHYAVMNNPTRQPLALNVAYRRCLQILAAGLFLPGSVGITDPCESGNFRVHTVMTLEQQDMVCYTAQTLVRILSHGGFRKILGQEGDASYLASEISTWDGVIVTPSEKAYEKPPEKKEGEEEEENTEEPPQGEEEESMETQE

SEQ ID NO: 812051 - protein, 234 aa, Homo sapiens; identical to SEQ ID NO: 812050

SEQ ID NO: 812052 - protein, 390 aa, Homo sapiens
MRGDRGRGRGGRFGSRGGPGGGFRPFVPHIPFDFYLCEMAFPRVKPAPDETSFSEALLKRNQDLAPNSAEQASILSLVTKINNVIDNLIVAPGTFEVQIEEVRQVGSYKKGTMTTGHNVADLVVILKILPTLEAVAALGNKVVESLRAQDPSEVLTMLTNETGFEISSSDATVKILITTVPPNLRKLDPELHLDIKVLQSALAAIRHARWFEENASQSTVKVLIRLLKDLRIRFPGFEPLTPWILDLLGHYAVMNNPTRQPLALNVAYRRCLQILAAGLFLPGSVGITDPCESGNFRVHTVMTLEQQDMVCYTAQTLVRILSHGGFRKILGQEGDASYLASEISTWDGVIVTPSEKAYEKPPEKKEGEEEEENTEEPPQGEEEESMETQE

SEQ ID NO: 812053 - protein, 390 aa, Homo sapiens; identical to SEQ ID NO: 812052

SEQ ID NO: 812054 - protein, 390 aa, Homo sapiens; identical to SEQ ID NO: 812052

SEQ ID NO: 812055 - protein, 390 aa, Homo sapiens; identical to SEQ ID NO: 812052

SEQ ID NO: 812056 - protein, 390 aa, Homo sapiens; identical to SEQ ID NO: 812052

SEQ ID NO: 812057 - protein, 390 aa, Homo sapiens; identical to SEQ ID NO: 812052

SEQ ID NO: 812058 - protein, 390 aa, Homo sapiens; identical to SEQ ID NO: 812052

SEQ ID NO: 812059 - protein, 390 aa, Homo sapiens; identical to SEQ ID NO: 812052

SEQ ID NO: 812060 - protein, 390 aa, Homo sapiens; identical to SEQ ID NO: 812052

SEQ ID NO: 812061 - protein, 275 aa, Homo sapiens
MRGDRGRGRGGRFGSRGGPGGGFRPFVPHIPFDFYLCEMAFPRVKPAPDETSFSEALLKRNQDLAPNSAEQASILSLVTKINNVIDNLIVAPGTFEVQIEEVRQVGSYKKGTMTTGHNVADLVVILKILPTLEAVAALGNKVVESLRAQDPSEVLTMLTNETGFEISSSDATVKILITTVPPNLRKLDPELHLDIKVLQSALAAIRHARWFEENASQSTVKVLIRLLKDLRIRFPGFEPLTPWILDLLGHYAVMNNPTRQPLALNVAYRYSMLWV

SEQ ID NO: 812062 - protein, 390 aa, Homo sapiens; identical to SEQ ID NO: 812052

SEQ ID NO: 812063 - protein, 318 aa, Homo sapiens
MRGDRGRGRGGRFGSRGGPGGGFRPFVPHIPFDFYLCEMAFPRVKPAPDETSFSEALLKRNQDLAPNSAEQASILSLVTKINNVIDNLIVAPGTFEVQIEEVRQVGSYKKGTMTTGHNVADLVVILKILPTLEAVAALGNKVVESLRAQDPSEVLTMLTNETGFEISSSDATVKILITTVPPNLRKLDPELHLDIKVLQSALAAIRHARWFEENASQSTVKVLIRLLKDLRIRFPGFEPLTPWILDLLGHYAVMNNPTRQPLALNVAYRRCLQILAAGLFLPGSVGITDPCESGNFRVHTVMTLEQQILLLKYLPGME

SEQ ID NO: 812064 - protein, 275 aa, Homo sapiens; identical to SEQ ID NO: 812061

SEQ ID NO: 812065 - protein, 390 aa, Homo sapiens; identical to SEQ ID NO: 812052

SEQ ID NO: 812066 - protein, 340 aa, Homo sapiens
DAWVDPRVERNQDLAPNSAEQASILSLVTKINNVIDNLIVAPGTFEVQIEEVRQVGSYKKGTMTTGHNVADLVVILKILPTLEAVAALGNKVVESLRAQDPSEVLTMLTNETGFEISSSDATVKILITTVPPNLRKLDPELHLDIKVLQSALAAIRHARWFEENASQSTVKVLIRLLKDLRIRFPGFEPLTPWILDLLGHYAVMNNPTRQPLALNVAYRRCLQILAAGLFLPGSVGITDPCESGNFRVHTVMTLEQQDMVCYTAQTLVRILSHGGFRKILGQEGDASYLASEISTWDGVIVTPSEKAYEKPPEKKEGEEEEENTEEPPQGEEEESMETQE

SEQ ID NO: 812067 - protein, 333 aa, Homo sapiens
KPITYNYSQIKAENSSILSLVTKINNVIDNLIVAPGTFEVQIEEVRQVGSYKKGTMTTGHNVADLVVILKILPTLEAVAALGNKVVESLRAQDPSEVLTMLTNETGFEISSSDATVKILITTVPPNLRKLDPELHLDIKVLQSALAAIRHARWFEENASQSTVKVLIRLLKDLRIRFPGFEPLTPWILDLLGHYAVMNNPTRQPLALNVAYRRCLQILAAGLFLPGSVGITDPCESGNFRVHTVMTLEQQDMVCYTAQTLVRILSHGGFRKILGQEGDASYLASEISTWDGVIVTPSEKAYEKPPEKKEGEEEEENTEEPPQGEEEESMETQE

SEQ ID NO: 812068 - protein, 368 aa, Homo sapiens
MRGDRGRGRGGRFGSRGGPGGGFRPFVPHIPFDFYLCEMAFPRVKPAPDETSFSEALLKRNQDLAPNSAEQASILSLVTKINNVIDNLIVAPGTFEVQIEEVRQVGSYKKGTMTTGHNVADLVVILKILPTLEAVAALGNKVVESLRAQDPSEVLTMLTNETGFEISSSDATVKILITTVPPNLRKLDPELHLDIKVLQSALAAIRHARWFEENASQSTVKVLIRLLKDLRIRFPGFEPLTPWILDLLGHYAVMNNPTRQPLALNVAYRRCLQILAAGLFLPGSVGITDPCESGNFRVHTVMTLEQQDMVCYTAQTLVRILSHGGFRKILGQEGDASYLASEISTWDGVIVTPSDQKTTPGEEEEALN

SEQ ID NO: 812069 - protein, 339 aa, Homo sapiens
MRGDRGRGRGGRFGSRGGPGGGFRPFVPHIPFDFYLCEMAFPRVKPAPDETSFSEALLKRNQDLAPNSAEQASILSLVTKINNVIDNLIVAPGTFEVQIEEVRQVGSYKKGTMTTGHNVADLVVILKILPTLEAVAALGNKVVESLRAQDPSEVLTMLTNETGFEISSSDATVKILITTVPPNLRKLDPELHLDIKVLQSALAAIRHARWFEENASQSTVKVLIRLLKDLRIRFPGFEPLTPWILDLLGHYAVMNNPTRQPLALNVAYRRCLQILAAGLFLPGSVGITDPCESGNFRVHTVMTLEQQDMVCYTAQTLVRILSHGGFRKILGQEGDASCE

SEQ ID NO: 812070 - protein, 278 aa, Homo sapiens
MTTGHNVADLVVILKILPTLEAVAALGNKVVESLRAQDPSEVLTMLTNETGFEISSSDATVKILITTVPPNLRKLDPELHLDIKVLQSALAAIRHARWFEENASQSTVKVLIRLLKDLRIRFPGFEPLTPWILDLLGHYAVMNNPTRQPLALNVAYRRCLQILAAGLFLPGSVGITDPCESGNFRVHTVMTLEQQDMVCYTAQTLVRILSHGGFRKILGQEGDASYLASEISTWDGVIVTPSEKAYEKPPEKKEGEEEEENTEEPPQGEEEESMETQE

SEQ ID NO: 812071 - protein, 219 aa, Homo sapiens
MRGDRGRGRGGRFGSRGGPGGGFRPFVPHIPFDFYLCEMAFPRVKPAPDETSFSEALLKRNQDLAPNSAEQASILSLVTKINNVIDNLIVAPGTFEVQIEEVRQVGSYKKGTMTTGHNVADLVVILKILPTLEAVAALGNKVVESLRAQDPSEVLTMLTNETGFEISSSDATVKILITTVPPNLRKLDPELHLDIKVLQSALAAIRHARWFEENASQST

SEQ ID NO: 812072 - protein, 193 aa, Homo sapiens
MRGDRGRGRGGRFGSRGGPGGGFRPFVPHIPFDFYLCEMAFPRVKPAPDETSFSEALLKRNQDLAPNSAEQASILSLVTKINNVIDNLIVAPGTFEVQIEEVRQVGSYKKGTMTTGHNVADLVVILKILPTLEAVAALGNKVVESLRAQDPSEVLTMLTNETGFEISSSDATVKILITTVPPNLRKLDPELHC

SEQ ID NO: 812073 - protein, 372 aa, Homo sapiens
MRGDRGRGRGGRFGSRGGPGGGFRPFVPHIPFDFYLCEMAFPRVKPAPDETSFSEALLKRNQDLAPNSAEQASILSLVTKINNVIDNLIVAPGTFEVQIEEVRQVGSYKKGTMTTGHNVADLVVILKILPTLEAVAALGNKVVESLRAQDPSEVLTMLTNETGFEISSSDATVKILITTVPPNLRKLDPELHLDIKVLQSALAAIRHARWFEEIRFPGFEPLTPWILDLLGHYAVMNNPTRQPLALNVAYRRCLQILAAGLFLPGSVGITDPCESGNFRVHTVMTLEQQDMVCYTAQTLVRILSHGGFRKILGQEGDASYLASEISTWDGVIVTPSEKAYEKPPEKKEGEEEEENTEEPPQGEEEESMETQE

SEQ ID NO: 812074 - protein, 227 aa, Homo sapiens
IQNSIWIQFSKIGWHCCNENLRKLDPELHLDIKVLQSALAAIRHARWFEENASQSTVKVLIRLLKDLRIRFPGFEPLTPWILDLLGHYAVMNNPTRQPLALNVAYRRCLQILAAGLFLPGSVGITDPCESGNFRVHTVMTLEQQDMVCYTAQTLVRILSHGGFRKILGQEGDASYLASEISTWDGVIVTPSEKAYEKPPEKKEGEEEEENTEEPPQGEEEESMETQE

SEQ ID NO: 812075 - protein, 199 aa, Homo sapiens
LRLGTRLGVNLAAIRHARWFEENASQSTVKVLIRLLKDLRIRFPGFEPLTPWILDLLGHYAVMNNPTRQPLALNVAYRRCLQILAAGLFLPGSVGITDPCESGNFRVHTVMTLEQQDMVCYTAQTLVRILSHGGFRKILGQEGDASYLASEISTWDGVIVTPSEKAYEKPPEKKEGEEEEENTEEPPQGEEEESMETQE

SEQ ID NO: 812076 - protein, 295 aa, Homo sapiens
MRGDRGRGRGGRFGSRGGPGGGFRPFVPHIPFDFYLCEMAFPRVKPAPDETSFSEALLKRNQDLAPNSAEQASILSLVTKINNVIDNLIVAPGTFEVQIEEVRQVGSYKKGTMTTGHNVADLVVILKILPTLEAVAALGNKVVESLRAQDPSEGHYAVMNNPTRQPLALNVAYRRCLQILAAGLFLPGSVGITDPCESGNFRVHTVMTLEQQDMVCYTAQTLVRILSHGGFRKILGQEGDASYLASEISTWDGVIVTPSEKAYEKPPEKKEGEEEEENTEEPPQGEEEESMETQE

SEQ ID NO: 812077 - protein, 135 aa, Homo sapiens
YPRPMAHGLNVAYRRCLQILAAGLFLPGSVGITDPCESGNFRVHTVMTLEQQDMVCYTAQTLVRILSHGGFRKILGQEGDASYLASEISTWDGVIVTPSEKAYEKPPEKKEGEEEEENTEEPPQGEEEESMETQE

SEQ ID NO: 812078 - protein, 270 aa, Homo sapiens
MRGDRGRGRGGRFGSRGGPGGGFRPFVPHIPFDFYLCEMAFPRVKPAPDETSFSEALLKRNQDLAPNSAEQASILSLVTKINNVIDNLIVAPGTFEVQIEEVRQVGSYKKGTMTTGHNVADLVVILKILPTLEAVAALGNKVVESLRAQDPSEVLTMLTNETGFEISSSDATVKILITTVPPNLRKLDPELHLDIKVLQSALAAIRHARWFEENASQSTVKVLIRLLKDLRIRFPGFEPLTPWILDLLGHNAVNEQARTLIQPRTRIEVR

SEQ ID NO: 812079 - protein, 263 aa, Homo sapiens [sequence omitted]

SEQ ID NO: 812080 - protein, 255 aa, Homo sapiens
MRGDRGRGRGGRFGSRGGPGGGFRPFVPHIPFDFYLCEMAFPRVKPAPDETSFSEALLKRNQDLAPNSAEQASILSLVTKINNVIDNLIVAPGTFEVQIEEVRQVGSYKKGTMTTGHNVADLVVILKILPTLEAVAALGNKVVESLRAQDPSEVLTMLTNETGFEISSSDATVKILITTVPPNLRKLDPELHLDIKVLQSALAAIRHARWFEENASQSTVKVLIRLLKDLRIRFPGFEPLTPWILDLLVKPAPPI

SEQ ID NO: 812081 - protein, 193 aa, Homo sapiens; identical to SEQ ID NO: 812072

SEQ ID NO: 812082 - protein, 241 aa, Homo sapiens
MNSGRPETMENLPALYTIFQGEVAMVTDYGAFIKIPGCRKQGLVHRTHMSSCRVDKPSEIVDVGDKVWVKLIGREMKNDRIKVSLSMKVVNQGTGKDLDPNNVIIEQEERRRRSFQDYTGQKITLEAVLNTTCKKCGCKGHFAKDCFMQPGGTKYSLIPDEEEEKEEAKSAEFEKPDPTRNPSRKRKKEKKKKKHRDRKSSDSDSSDSESDTGKRARHTSKDSKAAKKKKKKKKHKKKHKE

SEQ ID NO: 812083 - protein, 241 aa, Homo sapiens; identical to SEQ ID NO: 812082

SEQ ID NO: 812084 - protein, 241 aa, Homo sapiens; identical to SEQ ID NO: 812082

SEQ ID NO: 812085 - protein, 241 aa, Homo sapiens; identical to SEQ ID NO: 812082

SEQ ID NO: 812086 - protein, 233 aa, Homo sapiens [sequence omitted]

SEQ ID NO: 812087 - protein, 264 aa, Homo sapiens
MTRKNGVGGCLSLEATPRLCSLNLPFSAEGADSKGWEAGPESPAVVAMVTDYGAFIKIPGCRKQGLVHRTHMSSCRVDKPSEIVDVGDKVWVKLIGREMKNDRIKVSLSMKVVNQGTGKDLDPNNVIIEQEERRRRSFQDYTGQKITLEAVLNTTCKKCGCKGHFAKDCFMQPGGTKYSLIPDEEEEKEEAKSAEFEKPDPTRNPSRKRKKEKKKKKHRDRKSSDSDSSDSESDTGKRARHTSKDSKAAKKKKKKKKHKKKHKE

SEQ ID NO: 812088 - protein, 233 aa, Homo sapiens
MKQLIEDTEKNKVYVAMVTDYGAFIKIPGCRKQGLVHRTHMSSCRVDKPSEIVDVGDKVWVKLIGREMKNDRIKVSLSMKVVNQGTGKDLDPNNVIIEQEERRRRSFQDYTGQKITLEAVLNTTCKKCGCKGHFAKDCFMQPGGTKYSLIPDEEEEKEEAKSAEFEKPDPTRNPSRKRKKEKKKKKHRDRKSSDSDSSDSESDTGKRARHTSKDSKAAKKKKKKKKHKKKHKE

SEQ ID NO: 812089 - protein, 146 aa, Homo sapiens
MNSGRPETMENLPALYTIFQGEVAMVTDYGAFIKIPGCRKQGLVHRTHMSSCRVDKPSEIVDVGDKVWVKLIGREMKNDRIKVSLSMKVVNQGTGKDLDPNNVIIEQEERRRRSFQDYTGQKITLEAVLNTTCKKCGCKGEEEKET

SEQ ID NO: 812090 - protein, 168 aa, Homo sapiens
MNSGRPETMENLPALYTIFQGEVAMVTDYGAFIKIPGCRKQGLVHRTHMSSCRVDKPSEIVDVGDKVWVKLIGREMKNDRIKVSLSMKVVNQGTGKDLDPNNVIIERRRKRNIEIGSHLTLTAQTLRVIQARGQGTHQKTARQQRRRKRRRSTRRSTRSESIKSVGGG

SEQ ID NO: 812091 - protein, 138 aa, Homo sapiens
MKQLIEDTEKNKVYVAMVTDYGAFIKIPGCRKQGLVHRTHMSSCRVDKPSEIVDVGDKVWVKLIGREMKNDRIKVSLSMKVVNQGTGKDLDPNNVIIEQEERRRRSFQDYTGQKITLEAVLNTTCKKCGCKGEEEKET

SEQ ID NO: 812092 - protein, 195 aa, Homo sapiens
MNSGRPETMENLPALYTIFQGEVAMVTDYGAFIKIPGCRKQGLVHRTHMSSCRVDKPSEIVDVGDKVWVKLIGREMKNDRIKVSLSMKVVNQGTGKDLDPNNVIIEQEERRRRSFQDYTGQKITLEAVLNTTCKKCGCKGHFAKDCFMQPGGTKYSLIPDEEEVQSSGEVQSSGEVQSSGEVHSSGEVHLPERST

SEQ ID NO: 812093 - protein, 201 aa, Homo sapiens
MKQLIEDTEKNKVYVAMVTDYGAFIKIPGCRKQGLVHRTHMSSCRVDKPSEIVDVGDKVWVKLIGREMKNDRIKVSLSMKVVNQGTGKDLDPNNVIIEQEERRRRSFQDYTGQKITLEAVLNTTCKKCGCKGHFAKDCFMQPGGTKYSLIPDEEEEKEEAKSAEFEKPDPTRNPSRKRKKEGEEEKKHRDRKSSDSDSSDL

SEQ ID NO: 812094 - protein, 138 aa, Homo sapiens
MNSGRPETMENLPALYTIFQGEVAMVTDYGAFIKIPGCRKQGLVHRTHMSSCRVDKPSEIVDVGDKVWVKLIGREMKNDRIKVSLSMKVVNQGTGKDLDPNNVIIERRRRGGRIPFPRLTTGARKNHPLRRLTLLQVC

SEQ ID NO: 812095 - protein, 205 aa, Homo sapiens
MASADELTFHEFEEATNLLADTPDAATTSRSDQLTPQGHVAVAVGSGGSYGAEDEVEEESDKAALLQEQQQQQQPGFWTFSYYQSFFDVDTSQFPPYKPPPRAFARDNVFFVHRSFVNRSVIVYFRSFIVFDVFFFFSRFNRYFFVSRYLFYATYDISNFYRFRDDDRTSYSFSFFVSFFSFSFFEFFSDLSRFRVHVPVYTFFR

SEQ ID NO: 812096 - protein, 316 aa, Homo sapiens
MASADELTFHEFEEATNLLADTPDAATTSRSDQLTPQGHVAVAVGSGGSYGAEDEVEEESDKAALLQEQQQQQQPGFWTFSYYQSFFDVDTSQVLDRIKGSLLPRPGHNFVRHHLRNRPDLYGPFWICATLAFVLAVTGNLTLVLAQRRDPSIHYSPQFHKVTVAGISIYCYAWLVPLALWGFLRWRKGVQERMGPYTFLETVCIYGYSLFVFIPMVVLWLIPVPWLQWLFGALALGLSAAGLVFTLWPVVREDTRLVATVLLSVVVLLHALLAMGCKLYFFQSLPPENVAPPPQITSLPSNIALSPTLPQSLAPS

SEQ ID NO: 812097 - protein, 316 aa, Homo sapiens; identical to SEQ ID NO: 812096

SEQ ID NO: 812098 - protein, 316 aa, Homo sapiens; identical to SEQ ID NO: 812096

SEQ ID NO: 812099 - protein, 316 aa, Homo sapiens; identical to SEQ ID NO: 812096

SEQ ID NO: 812100 - protein, 287 aa, Homo sapiens
MASADELTFHEFEEATNLLADTPDAATTSRSDQLTPQGHVAVAVGSGGSYGAEDEVEEESDKAAVLDRIKGSLLPRPGHNFVRHHLRNRPDLYGPFWICATLAFVLAVTGNLTLVLAQRRDPSIHYSPQFHKVTVAGISIYCYAWLVPLALWGFLRWRKGVQERMGPYTFLETVCIYGYSLFVFIPMVVLWLIPVPWLQWLFGALALGLSAAGLVFTLWPVVREDTRLVATVLLSVVVLLHALLAMGCKLYFFQSLPPENVAPPPQITSLPSNIALSPTLPQSLAPS

SEQ ID NO: 812101 - protein, 343 aa, Homo sapiens
MASADELTFHEFEEATNLLADTPDAATTSRSDQLTPQGHVAVAVGSGGSYGAEDEVEEESDKAALLQEQQQQQQPGFWTFSYYQSFFDVDTSQVLDRIKGSLLPRPGHNFVRHHLRNRPDLYGPFWICATLAFVLAVTGNLTLVLAQRRDPSIHYSPQFHKASTAMRGWCPWPCGASCGGARVSRSAWGPTPSWRLCASTATPSLSSSPWWSCGSSLCLGCSGSLGRWPWACQPPGWYSPSGPWSVRTPGWWPQCCCPWSCCSTPSWPWAVSCTSSSRCLRRTWLLHPKSHLCPQTSRCPLPCRSPWPPPRKARVPQATPKWTNPSACPAPQTMTEGSFDTLR

SEQ ID NO: 812102 - protein, 108 aa, Homo sapiens [sequence omitted]

SEQ ID NO: 812103 - protein, 1019 aa, Homo sapiens
QKYLEKIWVITEEMYEYSKVRSWGKQLLHNHQATNMIALLTGALVTGVDKGSKANIWKQAVVDVMEKTMFLLSHIVDGSLDEGVAYGSYTAKSVTQYVFLAQRHFNINNLDNNWLKMHFWFYYATLLPGFQRTVGIADSNYNWFYGPESQLVFLDKFILKNGAGNWLAQQIRKHRPKDGPMVPSTAQRWSTLHTEYIWYDPQLTPQPPADYGTAKIHTFPNWGVVTYGAGLPNTQTNTFVSFKSGKLGGRAVYDIVHFQPYSWIDGWRSFNPGHEHPDQNSFTFAPNGQVFVSEALYGPKLSHLNNVLVFAPSPSSQCNKPWEGQLGECAQWLKWTGEEVGDAAGEIITASQHGEMVFVSGEAVSAYSSAMRLKSVYRALLLLNSQTLLVVDHIERQEDSPINSVSAFFHNLDIDFKYIPYKFMNRYNGAMMDVWDAHYKMFWFDHHGNSPMASIQEAEQAAEFKKRWTQFVNVTFQMESTITRIAYVFYGPYINVSSCRFIDSSNPGLQISLNVNNTEHVVSIVTDYHNLKTRFNYLGFGGFASVADQGQITRFGLGTQAIVKPVRHDRIIFPFGFKFNIAVGLILCISLVILTFQWRFYLSFRKLMRWILILVIALWFIELLDVWSTCSQPICAKWTRTEAEGSKKSLSSEGHHMDLPDVVITSLPGSGAEILKQLFFNSSDFLYIRVPTAYIDIPETELEIDSFVDACEWKVSDIRSGHFRLLRGWLQSLVQDTKLHLQNIHLHEPNRGKLAQYFAMNKDKKRKFKRRESLPEQRSQMKGAFDRDAEYIRALRRHLVYYPSARPVLSLSSGSWTLKLHFFQEVLGASMRALYIVRDPRAWIYSMLYNSKPSLYSLKNVPEHLAKLFKIEGGKGKCNLNSGYAFEYEPLRKELSKSKSNAVSLLSHLWLANTAAALRINTDLLPTSYQLVKFEDIVHFPQKTTERIFAFLGIPLSPASLNQILFATSTNLFYLPYEGEISPTNTNVWKQNLPRDEIKLIENICWTLMDRLGYPKFMD

SEQ ID NO: 812104 - protein, 997 aa, Homo sapiens
QKYLEKIWVITEEMYEYSKVRSWGKQLLHNHQATNMIALLTGALVTGVDKGSKANIWKQAVVDVMEKTMFLLSHIVDGSLDEGVAYGSYTAKSVTQYVFLAQRHFNINNLDNNWLKMHFWFYYATLLPGFQRTVGIADSNYNWFYGPESQLVFLDKFILKNGAGNWLAQQIRKHRPKDGPMVPSTAQRWSTLHTEYIWYDPQLTPQPPADYGTAKIHTFPNWGVVTYGAGLPNTQTNTFVSFKSGKLGGRAVYDIVHFQPYSWIDGWRSFNPGHEHPDQNSFTFAPNGQVFVSEALYGPKLSHLNNVLVFAPSPSSQCNKPWEGQLGECAQWLKWTGEEVGDAAGEIITASQHGEMVFVSGEAVSAYSSAMRLKSVYRALLLLNSQTLLVVDHIERQEDSPINSVSAFFHNLDIDFKYIPYKFMNRYNGAMMDVWDAHYKMFWFDHHGNSPMASIQEAEQAAEFKKRWTQFVNVTFQMESTITRIAYVFYGPYINVSSCRFIDSSNPGLQISLNVNNTEHVVSIVTDYHNLKTRFNYLGFGGFASVADQGQITRFGLGTQAIVKPVRHDRIIFPFGFKFNIAVGLILCISLVILTFQWRFYLSFRKLMRWILILVIALWFIELLDVWSTCSQPICAKWTRTEAEGSKKSLSSEGHHMDLPDVVITSLPGSGAEILKQLFFNSSDFLYIRVPTAYIDIPETELEIDSFVDACEWKVSDIRSGHFRLLRGWLQSLVQDTKLHLQNIHLHEPNRGKLAQYFAMNKDKKRKFKRRESLPEQRSQMKGAFDRDAEYIRALRRHLVYYPSARPVLSLSSGSWTLKLHFFQEVLGASMRALYIVRDPRAWIYSMLYNSKPSLYSLKNVPEHLAKLFKIEGGKGKCNLNSGYAFEYEPLRKELSKSKSNAVSLLSHLWLANTAAALRINTDLLPTSYQLVKFEDIVHFPQKTTERIFAFLGIPLSPASLNQILFATSTNLFYLPYEGEISPTNTNVWKQNLHRVQ

SEQ ID NO: 812105 - protein, 560 aa, Homo sapiens
MALMFTGHLLFLALLMFAFSTFEESVSNYSEWAVFTDDIDQFKTQKVQDFRPNQKLKKSMLHPSLYFDAGEIQAMRQKSRASHLHLFRAIRSAVTVMLSNPTYYLPPPKHADFAAKWNEIYGNNLPPLALYCLLCPEDKVAFEFVLEYMDRMVGYKDWLVENAPGDEVPIGHSLTGFATAFDFLYNCKKSLSSEGHHMDLPDVVITSLPGSGAEILKQLFFNSSDFLYIRVPTAYIDIPETELEIDSFVDACEWKVSDIRSGHFRLLRGWLQSLVQDTKLHLQNIHLHEPNRGKLAQYFAMNKDKKRKFKRRESLPEQRSQMKGAFDRDAEYIRALRRHLVYYPSARPVLSLSSGSWTLKLHFFQEVLGASMRALYIVRDPRAWIYSMLYNSKPSLYSLKNVPEHLAKLFKIEGGKGKCNLNSGYAFEYEPLRKELSKSKSNAVSLLSHLWLANTAAALRINTDLLPTSYQLVKFEDIVHFPQKTTERIFAFLGIPLSPASLNQILFATSTNLFYLPYEGEISPTNTNVWKQNLPRDEIKLIENICWTLMDRLGYPKFMD

SEQ ID NO: 812106 - protein, 76 aa, Homo sapiens
ELAQRILGRGDITAWGRGRCSGYGATERTRRPRVSVLRSVVAPTSVRRFLRAGVSGPCGSRGPSAAEETELGQRLP

SEQ ID NO: 812107 - protein, 113 aa, Homo sapiens
RARVPYIVRPRSWRRRSGSLDFISAPEPALSSCSLGTSAGWSPTMAAIRKKLVIVGDGACGKTCLLIVFSKDQFPEVYVPTVFENYIADIEVDGKLKPRRKGTYSADRASLLL

SEQ ID NO: 812108 - protein, 118 aa, Homo sapiens
EGTMGRGCGRWGVLGTRPQESTFPSSLARRSGPVRGGASAWAWTPFPPSGVGIRAGRWSDRVGPSPGCSEGARTCRQGLWPPEVRVGAPSLLLPASRNLPRRARGEGTSTQTPQPPGW

SEQ ID NO: 812109 - protein, 128 aa, Homo sapiens
MIDCGLSPTRTLMSSSCASPSTALTAWENIPEKWTPEVKHFCPNVPIILVGNKKDLRQDEHTRRELAKMKQEPVRSEEGRDMANRISAFGYLECSAKTKEGVREVFEMATRAGLQVRKNKRRRGCPIL

SEQ ID NO: 812110 - protein, 128 aa, Homo sapiens; identical to SEQ ID NO: 812109

SEQ ID NO: 812111 - protein, 128 aa, Homo sapiens; identical to SEQ ID NO: 812109

SEQ ID NO: 812112 - protein, 128 aa, Homo sapiens; identical to SEQ ID NO: 812109

SEQ ID NO: 812113 - protein, 128 aa, Homo sapiens; identical to SEQ ID NO: 812109

SEQ ID NO: 812114 - protein, 128 aa, Homo sapiens; identical to SEQ ID NO: 812109

SEQ ID NO: 812115 - protein, 128 aa, Homo sapiens; identical to SEQ ID NO: 812109

SEQ ID NO: 812116 - protein, 128 aa, Homo sapiens; identical to SEQ ID NO: 812109

SEQ ID NO: 812117 - protein, 128 aa, Homo sapiens; identical to SEQ ID NO: 812109

SEQ ID NO: 812118 - protein, 128 aa, Homo sapiens; identical to SEQ ID NO: 812109

SEQ ID NO: 812119 - protein, 128 aa, Homo sapiens; identical to SEQ ID NO: 812109

SEQ ID NO: 812120 - protein, 128 aa, Homo sapiens; identical to SEQ ID NO: 812109

SEQ ID NO: 812121 - protein, 128 aa, Homo sapiens; identical to SEQ ID NO: 812109

SEQ ID NO: 812122 - protein, 128 aa, Homo sapiens; identical to SEQ ID NO: 812109

SEQ ID NO: 812123 - protein, 128 aa, Homo sapiens; identical to SEQ ID NO: 812109

SEQ ID NO: 812124 - protein, 128 aa, Homo sapiens; identical to SEQ ID NO: 812109

SEQ ID NO: 812125 - protein, 128 aa, Homo sapiens; identical to SEQ ID NO: 812109

SEQ ID NO: 812126 - protein, 128 aa, Homo sapiens; identical to SEQ ID NO: 812109

SEQ ID NO: 812127 - protein, 346 aa, Homo sapiens
PCNPSSRGVSLSLRHRPRSWRRRSGSLDFISAPEPALSSCSLGTSAGWSPTMAAIRKKLVIVGDGACGKTCLLIVFSKDQFPEVYVPTVFENYIADIEVDGKQVELALWDTAGQEDYDRLRPLSYPDTDVILMCFSIDSPDSLGEGIGGRGLRTPWNQPEVSCLGLSSVIFRGGGGDAGEHSGPVGLLYCGNWPSEGILLLRFLSCERDHHAEWLLRLLWEDEGPPRGAFYLSGGTDTCWCMSTQENIPEKWTPEVKHFCPNVPIILVGNKKDLRQDEHTRRELAKMKQEPVRSEEGRDMANRISAFGYLECSAKTKEGVREVFEMATRAGLQVRKNKRRRGCPIL

SEQ ID NO: 812128 - protein, 119 aa, Homo sapiens
ELGYPILSGRAAGGGGAEENIPEKWTPEVKHFCPNVPIILVGNKKDLRQDEHTRRELAKMKQEPVRSEEGRDMANRISAFGYLECSAKTKEGVREVFEMATRAGLQVRKNKRRRGCPIL

SEQ ID NO: 812129 - protein, 153 aa, Homo sapiens
PCNPSSRGVSLSLRHRPRSWRRRSGSLDFISAPEPALSSCSLGTSAGWSPTMAAIRKKLVIVGDGACGKTCLLIVFSKDQFPEVYVPTVFENYIADIEVDGKQVELALWDTAGQEDYDRLRPLSYPDTDVILMCFSIDSPDSLPSSWWGIRRT

SEQ ID NO: 812130 - protein, 203 aa, Homo sapiens
PCNPSSRGVSLSLRHRPRSWRRRSGSLDFISAPEPALSSCSLGTSAGWSPTMAAIRKKLVIVGDGACGKTCLLIVFSKDQFPEVYVPTVFENYIADIEVDGKQVELALWDTAGQEDYDRLRPLSYPDTDVILMCFSIDSPDSLGEGIGGRGLRTPWNQPEVSCLGLSSVIFRGGGGDAGEHSGPVGLLYCGNWPSEGILLLRF

SEQ ID NO: 812131 - protein, 102 aa, Homo sapiens
MAAIRKKLVIVGDGACGKTCLLIVFSKDQFPEVYVPTVFENYIADIEVDGKQVELALWDTAGQEDYDRLRPLSYPDTDVILMCFSIDSPDSLPSSWWGIRRT

SEQ ID NO: 812132 - protein, 147 aa, Homo sapiens
PCNPSSRGVSLSLRHRPRSWRRRSGSLDFISAPEPALSSCSLGTSAGWSPTMAAIRKKLVIVGDGACGKTCLLIVFSKDQFPEVYVPTVFENYIADIEVDGKQVELALWDTAGQEDYDRLRPLSYPDTDVILMCFSIDSPDSLGKHS

SEQ ID NO: 812133 - protein, 225 aa, Homo sapiens
PCNPSSRGVSLSLRHRPRSWRRRSGSLDFISAPEPALSSCSLGTSAGWSPTMAAIRKKLVIVGDGACGKTCLLIVFSKDQFPEVYVPTVFENYIADIEVDGKQVELALWDTAGQEDYDRLRPLSYPDTDVILMCFSIDSPDSLPFGLRKAGTWRTGSVPLATLSAQPRPRRECGRCLRWPLGLASRSARTSVGGAVPFSEIPKAFPTCPLPSQGYRNYPPTTPAS

SEQ ID NO: 812134 - protein, 111 aa, Homo sapiens
MIDCGLSPTRTLMSSSCASPSTALTAWENIPEKWTPEVKHFCPNVPIILVGNKKDPVRSEEGRDMANRISAFGYLECSAKTKEGVREVFEMATRAGLQVRKNKRRRGCPIL

SEQ ID NO: 812135 - protein, 147 aa, Homo sapiens; identical to SEQ ID NO: 812132

SEQ ID NO: 812136 - protein, 147 aa, Homo sapiens; identical to SEQ ID NO: 812132

SEQ ID NO: 812137 - protein, 128 aa, Homo sapiens; identical to SEQ ID NO: 812109

SEQ ID NO: 812138 - protein, 199 aa, Homo sapiens
MIDCGLSPTRTLMSSSCASPSTALTAWENIPEKWTPEVKHFCPNVPIILVGNKKDLRQDEHTRRELAKMKQEPVRSEEGRDMANRISAFGYLECSAKTKEGVREVFEMATRAGLQVRKNKRRRGCPILQRCQGTQRQPYFIYFPQIKTEKSGSIGAADSPENWEKVWDNWRLLTMAIFDLLGAPRGEMSCISYYHHYSG

SEQ ID NO: 812139 - protein, 148 aa, Homo sapiens
MIDCGLSPTRTLMSSSCASPSTALTAWENIPEKWTPEVKHFCPNVPIILVGNKKDLRQDEHTRRELAKMKQEPVRSEEGRDMANRISAFGYLECSAKTKEGVREVFEMATRAGLQVRKNKRRRGCPAAPARRGKECCLRLPSAGHSVA

SEQ ID NO: 812140 - protein, 147 aa, Homo sapiens; identical to SEQ ID NO: 812132

SEQ ID NO: 812141 - protein, 73 aa, Homo sapiens
PCNPSSRGVSLSLRHRPRSWRRRSGGNFSRLEPHHGCNPKEAGDRWGWCLWEDLPPHRLQQGSVSGGLRPYCL

SEQ ID NO: 812142 - protein, 147 aa, Homo sapiens; identical to SEQ ID NO: 812132

SEQ ID NO: 812143 - protein, 147 aa, Homo sapiens; identical to SEQ ID NO: 812132

SEQ ID NO: 812144 - protein, 52 aa, Homo sapiens
MIDCGLSPTRTLMSSSCASPSTALTAWENIPEKWTPEVKHFCPNVPVPSSIY

SEQ ID NO: 812145 - protein, 115 aa, Homo sapiens
MIDCGLSPTRTLMSSSCASPSTALTAWENIPEKWTPEVKHFCPNVPIHPGGADTEGPEAEQHTESWPHEHEPVRLRRPIGNRSELWYLSVSHTTRSAGVFNGTRLPQSQTVEGVS

SEQ ID NO: 812146 - protein, 121 aa, Homo sapiens
PCNPSSRGVSLSLRHRPRSWRRRSGSLDFISAPEPALSSCSLGTSAGWSPTMAAIRKKLVIVGDGACGKTCLLIVFSKDQFPEVYVPTVFENYIADIEVDGKQVKAEMPFPPHPETPPPSH

SEQ ID NO: 812147 - protein, 490 aa, Homo sapiens
MTSRASELSPGRSVTAGIIIVGDEILKGHTQDTNTFFLCRTLRSLGVQVCRVSVVPDEVATIAAEVTSFSNRFTHVLTAGGIGPTHDDVTFEAVAQAFGDELKPHPKLEAATKALGGEGWEKLSLVPSSARLHYGTDPCTGQPFRFPLVSVRNVYLFPGIPELLRRVLEGMKGLFQNPAVQFHSKELYVAADEASIAPILAEAQAHFGRRLGLGSYPDWGSNYYQVKLTLDSEEEGPLEECLAYLTARLPQGSLVPYMPNAVEQASEAVYKLAESGSSLGKKVAGALQTIETSLAQYSLTQLCVGFNGGKDCTALLHLFHAAVQRKLPDVPNPLQILYIRSISPFPELEQFLQDTIKRYNLQMLEAEGSMKQALGELQARHPQLEAVLMGTRRTDPYSCSLCPFSPTDPGWPAFMRINPLLDWTYRDIWDFLRQLFVPYCILYDRGYTSLGSRENTVRNPALKCLSPGGHPTYRPAYLLENEEEERNSRT

SEQ ID NO: 812148 - protein, 294 aa, Homo sapiens
MQPSSSTPPLHPYSTDGLIFPFNPQGHTQDTNTFFLCRTLRSLGVQVCRVSVVPDEVATIAAEVTSFSNRFTHVLTAGGIGPTHDDVTFEAVAQAFGDELKPHPKLEAATKALGGEGWEKLSLVPSSARLHYGTDPCTGQPFRFPLVSVRNVYLFPGIPELLRRVLEGMKGLFQNPAVQFHSKELYVAADEASIAPILAEAQAHFGRRLGLGSYPDWGSNYYQVKLTLDSEEEGPLEECLAYLTARLPQGSLVPYMPNAVEQASEAVYKLAESGRDLMEEGHYAQSHWWHPRSQ

SEQ ID NO: 812149 - protein, 511 aa, Homo sapiens
SWYGPSSLGSVKGQNRQVPSTQDPLFPGYGPQCPVDLAGPPCLRPLFGGLGGYWRALQRGREGRTMTSRASELSPGRSVTAGIIIVGDEILKGHTQDTNTFFLCRTLRSLGVQVCRVSVVPDEVATIAAEVTSFSNRFTHVLTAGGIGPTHDDVTFEAVAQAFGDELKPHPKLEAATKALGGEGWEKLSLVPSSARLHYGTDPCTGQPFRFPLVSVRNVYLFPGIPELLRRVLEGMKGLFQNPAVQFHSKELYVAADEASIAPILAEAQAHFGRRLGLGSYPDWGSNYYQVKLTLDSEEEGPLEECLAYLTARLPQGSLVPYMPNAVEQASEAVYKLAESGSSLGKKVAGALQTIETSLAQYSLTQLCVGFNGGKDCTALLHLFHAAVQRKLPDVPNPLQILYIRSISPFPELEQFLQDTIKRYNLQMLEAEGSMKQALGELQARHPQLEAVLMGTRRTDPYSCSLCPFSPTDPGWPAFMRINPLLDWTYRDIWDFLRQLFVPYCILYDRG

SEQ ID NO: 812150 - protein, 179 aa, Homo sapiens
LEDYWGNSGLRHFSAGFRRYSPDSPVMCILGHTGYSMGQTVDAEDPRYNLQMLEAEGSMKQALGELQARHPQLEAVLMGTRRTDPYSCSLCPFSPTDPGWPAFMRINPLLDWTYRDIWDFLRQLFVPYCILYDRGYTSLGSRENTVRNPALKCLSPGGHPTYRPAYLLENEEEERNSRT

SEQ ID NO: 812151 - protein, 490 aa, Homo sapiens; identical to SEQ ID NO: 812147

SEQ ID NO: 812152 - protein, 587 aa, Homo sapiens
MGWDLGTRLFQRQEQRSRLSRIWLEKTRVFLEGSTRTPALPHCLFWLLQVPSTQDPLFPGYGPQCPVDLAGPPCLRPLFGGLGGYWRALQRGREGRTMTSRASELSPGRSVTAGIIIVGDEILKGHTQDTNTFFLCRTLRSLGVQVCRVSVVPDEVATIAAEVTSFSNRFTHVLTAGGIGPTHDDVTFEAVAQAFGDELKPHPKLEAATKALGGEGWEKLSLVPSSARLHYGTDPCTGQPFRFPLVSVRNVYLFPGIPELLRRVLEGMKGLFQNPAVQFHSKELYVAADEASIAPILAEAQAHFGRRLGLGSYPDWGSNYYQVKLTLDSEEEGPLEECLAYLTARLPQGSLVPYMPNAVEQASEAVYKLAESGSSLGKKVAGALQTIETSLAQYSLTQLCVGFNGGKDCTALLHLFHAAVQRKLPDVPNPLQILYIRSISPFPELEQFLQDTIKRYNLQMLEAEGSMKQALGELQARHPQLEAVLMGTRRTDPYSCSLCPFSPTDPGWPAFMRINPLLDWTYRDIWDFLRQLFVPYCILYDRGYTSLGSRENTVRNPALKCLSPGGHPTYRPAYLLENEEEERNSRT

SEQ ID NO: 812153 - protein, 490 aa, Homo sapiens; identical to SEQ ID NO: 812147

SEQ ID NO: 812154 - protein, 518 aa, Homo sapiens
MTSRASELSPGRSVTAGIIIVGDEILKGHTQDTNTFFLCRTLRSLGVQVCRVSVVPDEVATIAAEVTSFSNRFTHVLTAGGIGPTHDDVTFEAVAQAFGDELKPHPKLEAATKALGGEGWEKLSLVPSSARLHYGTDPCTGQPFRFPLVSVRNVYLFPGIPELLRRVLEGMKGLFQNPAVQFHSKELYVAADEASIAPILAEAQAHFGRRLGLGSYPDWGSNYYQVKLTLDSEEEGPLEECLAYLTARLPQGSLVPYMPNAVEQASEAVYKLAESGSSLGKKVAGALQTIETSLAQYSLTQLCVGFNGGKDCTALLHLFHAAVQRKLPDVPNPLQILYIRSISPFPELEQFLQDTIKRYYGAWRFGLQEKLDRAHARPLLLFLPKVYNLQMLEAEGSMKQALGELQARHPQLEAVLMGTRRTDPYSCSLCPFSPTDPGWPAFMRINPLLDWTYRDIWDFLRQLFVPYCILYDRGYTSLGSRENTVRNPALKCLSPGGHPTYRPAYLLENEEEERNSRT

SEQ ID NO: 812155 - protein, 490 aa, Homo sapiens; identical to SEQ ID NO: 812147

SEQ ID NO: 812156 - protein, 488 aa, Homo sapiens [sequence omitted]

SEQ ID NO: 812157 - protein, 555 aa, Homo sapiens
SWYGPSSLGSVKGQNRQVPSTQDPLFPGYGPQCPVDLAGPPCLRPLFGGLGGYWRALQRGREGRTMTSRASELSPGRSVTAGIIIVGDEILKGHTQDTNTFFLCRTLRSLGVQVCRVSVVPDEVATIAAEVTSFSNRFTHVLTAGGIGPTHDDVTFEAVAQAFGDELKPHPKLEAATKALGGEGWEKLSLVPSSARLHYGTDPCTGQPFRFPLVSVRNVYLFPGIPELLRRVLEGMKGLFQNPAVQFHSKELYVAADEASIAPILAEAQAHFGRRLGLGSYPDWGSNYYQVKLTLDSEEEGPLEECLAYLTARLPQGSLVPYMPNAVEQASEAVYKLAESGSSLGKKVAGALQTIETSLAQYSLTQLCVGFNGGKDCTALLHLFHAAVQRKLPDVPNPLQILYIRSISPFPELEQFLQDTIKRYNLQMLEAEGSMKQALGELQARHPQLEAVLMGTRRTDPYSCSLCPFSPTDPGWPAFMRINPLLDWTYRDIWDFLRQLFVPYCILYDRGYTSLGSRENTVRNPALKCLSPGGHPTYRPAYLLENEEEERNSRT

SEQ ID NO: 812158 - protein, 488 aa, Homo sapiens [sequence omitted]

SEQ ID NO: 812159 - protein, 320 aa, Homo sapiens
MTSRASELSPGRSVTAGIIIVGDEILKGHTQDTNTFFLCRTLRSLGVQVCRVSVVPDEVATIAAEVTSFSNRFTHVLTAGGIGPTHDDVTFEAVAQAFGDELKPHPKLEAATKALGGEGWEKLSLVPSSARLHYGTDPCTGQPFRFPLVSVRNVYLFPGIPELLRRVLEGMKGLFQNPAVQFHSKELYVAADEASIAPILAEAQAHFGRRLGLGSYPDWGSNYYQVKLTLDSEEEGPLEECLAYLTARLPQGSLVPYMPNAVEQASEAVYKLAESGNYLMFQTPSRSCISAASPLSLSWNSFYRTLSRGIICRCWKLRAA

SEQ ID NO: 812160 - protein, 429 aa, Homo sapiens
MTSRASELSPGRSVTAGIIIVGDEILKGHTQDTNTFFLCRTLRSLGVQVCRVSVVPDEVATIAAEVTSFSNRFTHVLTAGGIGPTHDDVTFEAVAQAFGDELKPHPKLEAATKALGGEGWEKLSLVPSSARLHYGTDPCTGQPFRFPLVSVRNVYLFPGIPELLRRVLEGMKGLFQNPAVQFHSKELYVAADEASIAPILAEAQAHFGRRLGLGSYPDWGSNYYQVKLTLDSEEEGPLEECLAYLTARLPQGSLVPYMPNAVEQASEAVYKLAESGSSLGKKVAGALQTIETSLAQYSLTQLCVGFNGGKDCTALLHLFHAAVQRKLPDVPNPLQILYIRSISPFPELEQFLQDTIKRYNLQMLEAEGSMKQALGELQARHPQLEAVLMGTRRTDPYSCSLCPFSPTDPGWPAFMRINPLLSKLYQRIR

SEQ ID NO: 812161 - protein, 429 aa, Homo sapiens; identical to SEQ ID NO: 812160

SEQ ID NO: 812162 - protein, 296 aa, Homo sapiens [sequence omitted]

SEQ ID NO: 812163 - protein, 425 aa, Homo sapiens
MTSRASELSPGRSVTAGIIIVGDEILKGHTQDTNTFFLCRTLRSLGVQVCRVSVVPDEVATIAAEVTSFSNRFTHVLTAGGIGPTHDDVTFEAVAQAFGDELKPHPKLEAATKALGGEGWEKLSLVPSSARLHYGTDPCTGQPFRFPLVSVRNVYLFPGIPELLRRVLEGMKGLFQNPAVQFHSKELYVAADEASIAPILAEAQAHFGRRLGLGSYPDWGSNYYQVKLTLDSEEEGPLEECLAYLTARLPQGSLVPYMPNAVEQASEAVYKLAESGSSLGKKVAGALQTIETSLAQYSLTQLCVGFNGGKDCTALLHLFHAAVQRKLPDVPNPLQILYIRSIDPGWPAFMRINPLLDWTYRDIWDFLRQLFVPYCILYDRGYTSLGSRENTVRNPALKCLSPGGHPTYRPAYLLENEEEERNSRT

SEQ ID NO: 812164 - protein, 420 aa, Homo sapiens
MTSRASELSPGRSVTAGIIIVGDEILKGHTQDTNTFFLCRTLRSLGVQVCRVSVVPDEVATIAAEVTSFSNRFTHVLTAGGIGPTHDDVTFEAVAQAFGDELKPHPKLEAATKALGGEGWEKLSLVPSSARLHYGTDPCTGQPFRFPLVSVRNVYLFPGIPELLRRVLEGMKGLFQNPAVQFHSKELYVAADEASIAPILAEAQAHFGRRLGLGSYPDWGSNYYQVKLTLDSEEEGPLEECLAYLTARLPQGSLVPYMPNAVEQASEAVYKLAESGSSLGKKVAGALQTIETSLAQYSLTQLCVGFNGGKDCTALLHLFHAAVQRKLPDVPNPLQILYIRSISPFPELEQFDWTYRDIWDFLRQLFVPYCILYDRGYTSLGSRENTVRNPALKCLSPGGHPTYRPAYLLENEEEERNSRT

SEQ ID NO: 812165 - protein, 347 aa, Homo sapiens
MTSRASELSPGRSVTAGIIIVGDEILKGHTQDTNTFFLCRTLRSLGVQVCRVSVVPDEVATIAAEVTSFSNRFTHVLTAGGIGPTHDDVTFEAVAQAFGDELKPHPKLEAATKALGGEGWEKLSLVPSSARLHYGTDPCTGQPFRFPLVSVRNVYLFPGIPELLRRVLEGMKGLFQNPAVQFHSKELYVAADEASIAPILAEAQAHFGRRLGLGSYPDWGSNYYQVKLTLDSEEEGPLEECLAYLTARLPQGSLVPYMPNAVEQASEAVYKLAESGNYLMFQTPSRSCISAALTQAGPHSCASTHCWTGPTETSGIFCVSCLSHTVSCMTEDTHHWGVGRIPCGTRP

SEQ ID NO: 812166 - protein, 433 aa, Homo sapiens
MTSRASELSPGRSVTAGIIIVGDEILKGHTQDTNTFFLCRTLRSLGVQVCRVSVVPDEVATIAAEVTSFSNRFTHVLTAGGIGPTHDDVTFEAVAQAFGDELKPHPKLEAATKALGGEGWEKLSLVPSSARLHYGTDPCTGQPFRFPLVSVRNVYLFPGIPELLRRVLEGMKGLFQNPAVQFHSKELYVAADEASIAPILAEAQAHFGRRLGLGSYPDWGSNYYQVAGALQTIETSLAQYSLTQLCVGFNGGKDCTALLHLFHAAVQRKLPDVPNPLQILYIRSISPFPELEQFLQDTIKRYNLQMLEAEGSMKQALGELQARHPQLEAVLMGTRRTDPYSCSLCPFSPTDPGWPAFMRINPLLDWTYRDIWDFLRQLFVPYCILYDRGYTSLGSRENTVRNPALKCLSPGGHPTYRPAYLLENEEEERNSRT

SEQ ID NO: 812167 - protein, 320 aa, Homo sapiens
MKGLFQNPAVQFHSKELYVAADEASIAPILAEAQAHFGRRLGLGSYPDWGSNYYQVKLTLDSEEEGPLEECLAYLTARLPQGSLVPYMPNAVEQASEAVYKLAESGSSLGKKVAGALQTIETSLAQYSLTQLCVGFNGGKDCTALLHLFHAAVQRKLPDVPNPLQILYIRSISPFPELEQFLQDTIKRYNLQMLEAEGSMKQALGELQARHPQLEAVLMGTRRTDPYSCSLCPFSPTDPGWPAFMRINPLLDWTYRDIWDFLRQLFVPYCILYDRGYTSLGSRENTVRNPALKCLSPGGHPTYRPAYLLENEEEERNSRT

SEQ ID NO: 812168 - protein, 296 aa, Homo sapiens [sequence omitted]

SEQ ID NO: 812169 - protein, 233 aa, Homo sapiens [sequence omitted]

SEQ ID NO: 812170 - protein, 318 aa, Homo sapiens [sequence omitted]

SEQ ID NO: 812171 - protein, 338 aa, Homo sapiens
MQPSSSTPPLHPYSTDGLIFPFNPQGHTQDTNTFFLCRTLRSLGVQVCRVSVVPDEVATIAAEVTSFSNRFTHVLTAGGIGPTHDDVTFEAVAQAFGDELKPHPKLEAATKALGGEGWEKLSLVPSSARLHYGTDPCTGQPFRFPLVSVRNVYLFPGIPELLRRVLEGMKGLFQNPAVQFHSKELYVAADEASIAPILAEAQAHFGRRLGLGSYPDWGSNYYQVKLTLDSEEEGPLEECLAYLTARLPQGSLVPYMPNAVEQASEAVYKLAESGNYLMFQTPSRSCISAASPLSLSWNSFYRTLSREQAIPENQIASPPSEAKGAEEPWMGPFPGQQG

SEQ ID NO: 812172 - protein, 69 aa, Homo sapiens
RDMRKGTRERAGEGAEQAGSLDPGPPVPRLWPPVPCRPGRPPVLATPIWGSGWLLEGLAEGQRRQDHDI

SEQ ID NO: 812173 - protein, 140 aa, Homo sapiens [sequence omitted]

SEQ ID NO: 812174 - protein, 463 aa, Homo sapiens
MAQGLVTFADVAIDFSQEEWACLNSAQRDLYWDVMLENYSNLVSLDLESAYENKSLPTEKNIHEIRASKRNSDRRSKSLGRNWICEGTLERPQRSRGRYVNQMIINYVKRPATREGTPPRTHQRHHKENSFECKDCGKAFSRGYQLSQHQKIHTGEKPYECKECKKAFRWGNQLTQHQKIHTGEKPYECKDCGKAFRWGSSLVIHKRIHTGEKPYECKDCGKAFRRGDELTQHQRFHTGEKDYECKDCGKTFSRVYKLIQHKRIHSGEKPYECKDCGKAFICGSSLIQHKRIHTGEKPYECQECGKAFTRVNYLTQHQKIHTGEKPHECKECGKAFRWGSSLVKHERIHTGEKPYKCTECGKAFNCGYHLTQHERIHTGETPYKCKECGKAFIYGSSLVKHERIHTGVKPYGCTECGKSFSHGHQLTQHQKTHSGAKSYECKECGKACNHLNHLREHQRIHNS

SEQ ID NO: 812175 - protein, 463 aa, Homo sapiens; identical to SEQ ID NO: 812174

SEQ ID NO: 812176 - protein, 463 aa, Homo sapiens; identical to SEQ ID NO: 812174

SEQ ID NO: 812177 - protein, 463 aa, Homo sapiens; identical to SEQ ID NO: 812174

SEQ ID NO: 812178 - protein, 463 aa, Homo sapiens; identical to SEQ ID NO: 812174

SEQ ID NO: 812179 - protein, 463 aa, Homo sapiens; identical to SEQ ID NO: 812174

SEQ ID NO: 812180 - protein, 463 aa, Homo sapiens; identical to SEQ ID NO: 812174

SEQ ID NO: 812181 - protein, 151 aa, Homo sapiens
MAVLEPEVLSVHTTWTTRGSNLKNRIPFGEERAGLQEKHPGGGRRSVICPKVRFQAGVQWHDLSSLEPLRPGLQRFSCLSLPSSWNYRHPPPCLANFCIFSRDGVSSCWPGWSQTPDFKLSARLSLPKSWDYRCEPPCPAFVPIFNQIFFS

SEQ ID NO: 812182 - protein, 72 aa, Homo sapiens
GLVTFADVAIDFSQEEWACLNSAQRDLYWDVMLENYSNLVSLGELHASDNLDCLLEYPLSPVNFRTAFQETS

SEQ ID NO: 812183 - protein, 311 aa, Homo sapiens
GFRNCLLNLKRTMVGKARSSNFTLSEKLDLLKLVKPYVKILEEHTNKHSVIVEKNRCWDIIAVNYNAIGVDRPPRTAQGLRTLYKRLKEYAKQELLQQKETQSDFKSNISEPTKKVMEMIPQISSFCLVRDRNHIQSANLDEEAQAGTSSLQVMLDHHPVAITVEVKQEEDIKPPPPLVLNSQQSDTLEQREEHELVHVMERSLSPSLSSVDMRMTSSPSSIPRRDDFFRHESGEHFRSLLGYDPQILQMLKEEHQIILENQKNFGLYVQEKRDGLKRRQQLEEELLRAKIEVEKLKAIRLRHDLPEYNSL

SEQ ID NO: 812184 - protein, 140 aa, Homo sapiens
VTRRTSLQGQWFLSDFRRSRLLNMRRSAAPSQLQGNSFKKPKFIPPGRSNPGLNEEITKLNPDIKLFEGVAINNTFLPSQNDLRICSLNLPSEESTREINNRDNCSGKYCFEAPTLATLDPPHTVQTWMRRHRLVPVHYR

SEQ ID NO: 812185 - protein, 684 aa, Homo sapiens
MENLQTNFSLVQGSTKKLNGMGDDGSPPAKKMITDIHVNGKTINKVPTVKKEHLDDYGEAPVETDGEHVKRTCTSVPETLHLNPSLKHTLAQFHLSSQSSLGGPAAFSARHSQESMSPTVFLPLPSPQVLPGPLLIPSDSSTELTQTVLEGESISCFQVGGEKRLCLPQVLNSVLREFTLQQINTVCDELYIYCSRCTSDQLHILKVLGILPFNAPSCGLITLTDAQRLCNALLRPRTFPQNGSVLPAKSSLAQLKETGSAFEVEHECLGKCQGLFAPQFYVQPDAPCIQCLECCGMFAPQTFVMHSHRSPDKRTCHWGFESAKWHCYLHVNQKYLGTPEEKKLKIILEEMKEKFSMRSGKRNQSKTDAPSGMELQSWYPVIKQEGDHVSQTHSFLHPSYYLYMCDKVVAPNVSLTSAVSQSKELTKTEASKSISRQSEKAHSSGKLQKTVSYPDVSLEEQEKMDLKTSRELCSRLDASISNNSTSKRKSESATCNLVRDINKVGIGLVAAASSPLLVKDVICEDDKGKIMEEVMRTYLKQQEKLNLILQKKQQLQMEVKMLSSSKSMKELTEEQQNLQKELESLQNEHAQRMEEFYVEQKDLEKKLEQIMKQKCTCDSNLEKDKEAEYAGQLAELRQRLDHAEADRQELQDELRQEREARQKLEMMIKELKLQILKSSKTAKE

SEQ ID NO: 812186 - protein, 684 aa, Homo sapiens; identical to SEQ ID NO: 812185

SEQ ID NO: 812187 - protein, 638 aa, Homo sapiens [sequence omitted]

SEQ ID NO: 812188 - protein, 415 aa, Homo sapiens
MENLQTNFSLVQGSTKKLNGMGDDGSPPAKKMITDIHVNGKTINKVPTVKKEHLDDYGEAPVETDGEHVKRTCTSVPETLHLNPSLKHTLAQFHLSSQSSLGGPAAFSARHSQESMSPTVFLPLPSPQVLPGPLLIPSDSSTELTQTVLEGESISCFQVGGEKRLCLPQVLNSVLREFTLQQINTVCDELYIYCSRCTSDQLHILKVLGILPFNAPSCGLITLTDAQRLCNALLRPRTFPQNGSVLPAKSSLAQLKETGSAFEVEHECLGKCQGLFAPQFYVQPDAPCIQCLECCGMFAPQTFVMHSHRSPDKRTCHWGFESAKWHCYLHVNQKYLGTPEEKKLKIILEEMKEKFSMRSGKRNQSKASFLYQFLIMVMVYFEMKILCLVCNLTCMLNIAHATTTKYRLIYLYCSF

SEQ ID NO: 812189 - protein, 684 aa, Homo sapiens; identical to SEQ ID NO: 812185

SEQ ID NO: 812190 - protein, 137 aa, Homo sapiens
MLQAPRGRARAALRRLAVATRTMAGAPTVSLPELRSLLASGRARLFDVRSREEAAAGTIPGALNIPVSELESALQMEPAAFQALYSAEKPKLEDEHLVFFCQMGKRGLQATQLARSLGYTGARNYAGAYREWLEKES

SEQ ID NO: 812191 - protein, 137 aa, Homo sapiens; identical to SEQ ID NO: 812190

SEQ ID NO: 812192 - protein, 101 aa, Homo sapiens
LWLISEDPRCDVRSREEAAAGTIPGALNIPVSELESALQMEPAAFQALYSAEKPKLEDEHLVFFCQMGKRGLQATQLARSLGYTGARNYAGAYREWLEKES

SEQ ID NO: 812193 - protein, 109 aa, Homo sapiens
MAGAPTVSLPELRSLLASGRARLFDVRSREEAAAGTIPGALNIPVSELESALQMEPAAFQALYSAEKPKLEDEHLVFFCQMGKRGLQATQLARSLGYTGYGEVWLLAGR

SEQ ID NO: 812194 - protein, 299 aa, Homo sapiens
MGTKAQVERKLLCLFILAILLCSLALGSVTVHSSEPEVRIPENNPVKLSCAYSGFSSPRVEWKFDQGDTTRLVCYNNKITASYEDRVTFLPTGITFKSVTREDTGTYTCMVSEEGGNSYGEVKVKLIVLVPPSKPTVNIPSSATIGNRAVLTCSEQDGSPPSEYTWFKDGIVMPTNPKSTRAFSNSSYVLNPTTGELVFDPLSASDTGEYSCEARNGYGTPMTSNAVRMEAVERNVGVIVAAVLVTLILLGILVFGIWFAYSRGHFDRTKKGTSSKKVIYSQPSARSEGEFKQTSSFLV

SEQ ID NO: 812195 - protein, 299 aa, Homo sapiens; identical to SEQ ID NO: 812194

SEQ ID NO: 812196 - protein, 299 aa, Homo sapiens; identical to SEQ ID NO: 812194

SEQ ID NO: 812197 - protein, 299 aa, Homo sapiens; identical to SEQ ID NO: 812194

SEQ ID NO: 812198 - protein, 299 aa, Homo sapiens; identical to SEQ ID NO: 812194

SEQ ID NO: 812199 - protein, 299 aa, Homo sapiens; identical to SEQ ID NO: 812194

SEQ ID NO: 812200 - protein, 299 aa, Homo sapiens; identical to SEQ ID NO: 812194

SEQ ID NO: 812201 - protein, 299 aa, Homo sapiens; identical to SEQ ID NO: 812194

SEQ ID NO: 812202 - protein, 299 aa, Homo sapiens; identical to SEQ ID NO: 812194

SEQ ID NO: 812203 - protein, 299 aa, Homo sapiens; identical to SEQ ID NO: 812194

SEQ ID NO: 812204 - protein, 402 aa, Homo sapiens
MASGVLCMHMLPEERAGPRYLRLSVTIVCSDVLIAVSHLYGLSVTFVRYHSEASHISIIPRRLSYMRYVRLTLSGIHPRPITGSPTPAERSPSAAVVSVSLIAMGTKAQVERKLLCLFILAILLCSLALGSVTVHSSEPEVRIPENNPVKLSCAYSGFSSPRVEWKFDQGDTTRLVCYNNKITASYEDRVTFLPTGITFKSVTREDTGTYTCMVSEEGGNSYGEVKVKLIVLVPPSKPTVNIPSSATIGNRAVLTCSEQDGSPPSEYTWFKDGIVMPTNPKSTRAFSNSSYVLNPTTGELVFDPLSASDTGEYSCEARNGYGTPMTSNAVRMEAVERNVGVIVAAVLVTLILLGILVFGIWFAYSRGHFDRTKKGTSSKKVIYSQPSARSEGEFKQTSSFLV

SEQ ID NO: 812205 - protein, 299 aa, Homo sapiens; identical to SEQ ID NO: 812194

SEQ ID NO: 812206 - protein, 299 aa, Homo sapiens; identical to SEQ ID NO: 812194

SEQ ID NO: 812207 - protein, 273 aa, Homo sapiens
PSRVFAAVLPSAHLTLSAAVKLSCAYSGFSSPRVEWKFDQGDTTRLVCYNNKITASYEDRVTFLPTGITFKSVTREDTGTYTCMVSEEGGNSYGEVKVKLIVLVPPSKPTVNIPSSATIGNRAVLTCSEQDGSPPSEYTWFKDGIVMPTNPKSTRAFSNSSYVLNPTTGELVFDPLSASDTGEYSCEARNGYGTPMTSNAVRMEAVERNVGVIVAAVLVTLILLGILVFGIWFAYSRGHFDRTKKGTSSKKVIYSQPSARSEGEFKQTSSFLV

SEQ ID NO: 812208 - protein, 299 aa, Homo sapiens; identical to SEQ ID NO: 812194

SEQ ID NO: 812209 - protein, 337 aa, Homo sapiens
ARPLRMCLGPHKSFNVVAMSSLPMESSMGRGHSCLSFIDHLCDSLDELTIRFCDSLQNGAICRVDGTAYLITEESPIRMLNIPVKLSCAYSGFSSPRVEWKFDQGDTTRLVCYNNKITASYEDRVTFLPTGITFKSVTREDTGTYTCMVSEEGGNSYGEVKVKLIVLVPPSKPTVNIPSSATIGNRAVLTCSEQDGSPPSEYTWFKDGIVMPTNPKSTRAFSNSSYVLNPTTGELVFDPLSASDTGEYSCEARNGYGTPMTSNAVRMEAVERNVGVIVAAVLVTLILLGILVFGIWFAYSRGHFDRTKKGTSSKKVIYSQPSARSEGEFKQTSSFLV

SEQ ID NO: 812210 - protein, 188 aa, Homo sapiens
MGQAFHLEYASLASSSVLVPPSKPTVNIPSSATIGNRAVLTCSEQDGSPPSEYTWFKDGIVMPTNPKSTRAFSNSSYVLNPTTGELVFDPLSASDTGEYSCEARNGYGTPMTSNAVRMEAVERNVGVIVAAVLVTLILLGILVFGIWFAYSRGHFDRTKKGTSSKKVIYSQPSARSEGEFKQTSSFLV

SEQ ID NO: 812211 - protein, 82 aa, Homo sapiens
EGTLEDQYAVRMEAVERNVGVIVAAVLVTLILLGILVFGIWFAYSRGHFDRTKKGTSSKKVIYSQPSARSEGEFKQTSSFLV

SEQ ID NO: 812212 - protein, 299 aa, Homo sapiens; identical to SEQ ID NO: 812194

SEQ ID NO: 812213 - protein, 299 aa, Homo sapiens; identical to SEQ ID NO: 812194

SEQ ID NO: 812214 - protein, 299 aa, Homo sapiens; identical to SEQ ID NO: 812194

SEQ ID NO: 812215 - protein, 299 aa, Homo sapiens; identical to SEQ ID NO: 812194

SEQ ID NO: 812216 - protein, 299 aa, Homo sapiens; identical to SEQ ID NO: 812194

SEQ ID NO: 812217 - protein, 299 aa, Homo sapiens; identical to SEQ ID NO: 812194

SEQ ID NO: 812218 - protein, 299 aa, Homo sapiens; identical to SEQ ID NO: 812194

SEQ ID NO: 812219 - protein, 130 aa, Homo sapiens
AAVTPRPPLPEGCRAPSSAPTVSLPELRSLLASGRARLFDVRSREEAAAGTIPGALNIPVSELESALQMEPAAFQALYSAEKPKLEDEHLVFFCQMGKRGLQATQLARSLGYTGARNYAGAYREWLEKES

SEQ ID NO: 812220 - protein, 137 aa, Homo sapiens; identical to SEQ ID NO: 812190

SEQ ID NO: 812221 - protein, 137 aa, Homo sapiens; identical to SEQ ID NO: 812190

SEQ ID NO: 812222 - protein, 299 aa, Homo sapiens; identical to SEQ ID NO: 812194

SEQ ID NO: 812223 - protein, 101 aa, Homo sapiens; identical to SEQ ID NO: 812192

SEQ ID NO: 812224 - protein, 190 aa, Homo sapiens [sequence omitted]

SEQ ID NO: 812225 - protein, 297 aa, Homo sapiens
MGTKAQVERKLLCLFILAILLCSLALGSVTVHSSEPEVRIPENNPVKLSCAYSGFSSPRVEWKFDQGDTTRLVCYNNKITASYEDRVTFLPTGITFKSVTREDTGTYTCMVSEEGGNSYGEVKVKLIVLVPPSKPTVNIPSSATIGNRAVLTCSEQDGSPPSEYTWFKDGIVMPTNPKSTRAFSNSSYVLNPTTGELVFDPLSASDTGEYSCEARNGYGTPMTSNAVRMEAVERNVGVIVAAVLVTLILLGILVFGIWFAYSRGHFDRTKKGTSSKKVIYSQPSARSEVSMPPLGRG

SEQ ID NO: 812226 - protein, 291 aa, Homo sapiens
MGTKAQVERKLLCLFILAILLCSLALGSVTVHSSEPEVRIPENNPVKLSCAYSGFSSPRVEWKFDQGDTTRLVCYNNKITASYEDRVTFLPTGITFKSVTREDTGTYTCMVSEEGGNSYGEVKVKLIVLVPPSKPTVNIPSSATIGNRAVLTCSEQDGSPPSEYTWFKDGIVMPTNPKSTRAFSNSSYVLNPTTGELVFDPLSASDTGEYSCEARNGYGTPMTSNAVRMEAVERNVGVIVAAVLVTLILLGILVFGIWFAYSRGHFDRTKNLPPEALLCTAPIPGPGMGVI

SEQ ID NO: 812227 - protein, 299 aa, Homo sapiens
MGTKAQVERKLLCLFILAILLCSLALGSVTVHSSEPEVRIPENNPVKLSCAYSGFSSPRVEWKFDQGDTTRLVCYNNKITASYEDRVTFLPTGITFKSVTREDTGTYTCMVSEEGGNSYGEVKVKLIVLVPPSKPTVNIPSSATIGNRAVLTCSEQDGSPPSEYTWFKDGIVMPTNPKSTRAFSNSSYVLNPTTGELVFDPLSASDTGEYSCEARNGYGTPMTSNAVRMEAVERNVGVIVAAVLVTLILLGILVFGIWFAYSRGHFDRTKKRNRDIEVRQVTTQPGQATRSEERQSARP

SEQ ID NO: 812228 - protein, 108 aa, Homo sapiens [sequence omitted]

SEQ ID NO: 812229 - protein, 105 aa, Homo sapiens
NRLGTRPGGMLQAPRGRARAALRRLAVATRTMAGVSELESALQMEPAAFQALYSAEKPKLEDEHLVFFCQMGKRGLQATQLARSLGYTGARNYAGAYREWLEKES

SEQ ID NO: 812230 - protein, 178 aa, Homo sapiens
MGTKAQVERKLLCLFILAILLSLLALGSVTDAQIKNELLESEMKNLKKCVSELEEEKQQLVKEKTKVESEIRKEYLEKIQGAQKEPGNKSHAKELQELLKEKQQEVKQLQKDCIRYQEKISALERTVKALELFKLNLKKIGNNQRKSGLKQLNTSKKAQAELASFKVLLDDTQSEAAR

SEQ ID NO: 812231 - protein, 102 aa, Homo sapiens [sequence omitted]

SEQ ID NO: 812232 - protein, 102 aa, Homo sapiens [sequence omitted]

SEQ ID NO: 812233 - protein, 624 aa, Homo sapiens
MQPDPRPSGAGACCRFLPLQSQCPEGAGDAVMYASTECKAEVTPSQHGNRTFSYTLEDHTKQAFGIMNELRLSQQLCDVTLQVKYQDAPAAQFMAHKVVLASSSPVFKAMFTNGLREQGMEVVSIEGIHPKVMERLIEFAYTASISMGEKCVLHVMNGAVMYQIDSVVRACSDFLVQQLDPSNAIGIANFAEQIGCVELHQRAREYIYMHFGEVAKQEEFFNLSHCQLVTLISRDDLNVRCESEVFHACINWVKYDCEQRRFYVQALLRAVRCHSLTPNFLQMQLQKCEILQSDSRCKDYLVKIFEELTLHKPTQVMPCRAPKVGRLIYTAGGYFRQSLSYLEAYNPSDGTWLRLADLQVPRSGLAGCVVGGLLYAVGGRNNSPDGNTDSSALDCYNPMTNQWSPCAPMSVPRNRIGVGVIDGHIYAVGGSHGCIHHNSVERYEPERDEWHLVAPMLTRRIGVGVAVLNRLLYAVGGFDGTNRLNSAECYYPERNEWRMITAMNTIRSGAGVCVLHNCIYAAGGYDGQDQLNSVERYDVETETWTFVAPMKHRRSALGITVHQGRIYVLGGYDGHTFLDSVECYDPDTDTWSEVTRMTSGRSGVGVAVTMEPCRKQIDQQNCTC

SEQ ID NO: 812234 - protein, 624 aa, Homo sapiens; identical to SEQ ID NO: 812233

SEQ ID NO: 812235 - protein, 624 aa, Homo sapiens; identical to SEQ ID NO: 812233

SEQ ID NO: 812236 - protein, 565 aa, Homo sapiens
MQPDPRPSGAGACCRFLPLQSQCPEGAGDAVMYASTECKAEVTPSQHGNRTFSYTLEDHTKQAFGIMNELRLSQQLCDVTLQVKYQDAPAAQFMAHKVVLASSSPVFKAMFTNGLREQGMEVVSIEGIHPKVMERLIEFAYTASISMGEKCVLHVMNGAVMYQIDSVVRACSDFLVQQLDPSNAIGIANFAEQIGCVELHQRAREYIYMHFGEVAKQEEFFNLSHCQLVTLISRDDLNVRCESEVFHACINWVKYDCEQRRFYVQALLRAVRCHSLTPNFLQMQLQKCEILQSDSRCKDYLVKIFEELTLHKPTQVMPCRAPKVGRLIYTAGGYFRQSLSYLEAYNPSDGTWLRLADLQVPRSGLAGCVVGGLLYAVGGRNNSPDGNTDSSALDCYNPMTNQWSPCAPMSVPRNRIGVGVIDGHIYAVGGSHGCIHHNSVERYEPERDEWHLVAPMLTRRIGVGVAVLNRLLYAVGGFDGTNRLNSAECYYPERNEWRMITAMNTIRSGAGGYDGHTFLDSVECYDPDTDTWSEVTRMTSGRSGVGVAVTMEPCRKQIDQQNCTC

SEQ ID NO: 812237 - protein, 608 aa, Homo sapiens
MQPDPRPSGAGACCRFLPLQSQCPEGAGDAVMYASTECKAEVTPSQHGNRTFSYTLEDHTKQAFGIMNELRLSQQLCDVTLQVKYQDAPAAQFMAHKVVLASSSPVFKAMFTNGLREQGMEVVSIEGIHPKVMERLIEFAYTASISMGEKCVLHVMNGAVMYQIDSVVRACSDFLVQQLDPSNAIGIANFAEQIGCVELHQRAREYIYMHFGEVAKQEEFFNLSHCQLVTLISRDDLNVRCESEVFHACINWVKYDCEQRRFYVQALLRAVRCHSLTPNFLQMQLQKCEILQSDSRCKDYLVKIFEELTLHKPTQVMPCRAPKVGRLIYTAGGYFRQSLSYLEAYNPSDGTWLRLADLQVPRSGLAGCDGNTDSSALDCYNPMTNQWSPCAPMSVPRNRIGVGVIDGHIYAVGGSHGCIHHNSVERYEPERDEWHLVAPMLTRRIGVGVAVLNRLLYAVGGFDGTNRLNSAECYYPERNEWRMITAMNTIRSGAGVCVLHNCIYAAGGYDGQDQLNSVERYDVETETWTFVAPMKHRRSALGITVHQGRIYVLGGYDGHTFLDSVECYDPDTDTWSEVTRMTSGRSGVGVAVTMEPCRKQIDQQNCTC

SEQ ID NO: 812238 - protein, 456 aa, Homo sapiens
MQPDPRPSGAGACCRFLPLQSQCPEGAGDAVMYASTECKAEVTPSQHGNRTFSYTLEDHTKQAFGIMNELRLSQQLCDVTLQVKYQDAPAAQFMAHKVVLASSSPVFKAMFTNGLREQGMEVVSIEGIHPKVMERLIEFAYTASISMGEKCVLHVMNGAVMYQIDSVVRACSDFLVQQLDPSNAIGIANFAEQIGCVELHQRAREYIYMHFGEVAKQEEFFNLSHCQLVTLISRDDLNVRCESEVFHACINWVKYDCEQRRFYVQALLRAVRCHSLTPNFLQMQLQKCEILQSDSRCKDYLVKIFEELTLHKPTQVMPCRAPKVGRLIYTAGGYFRQSLSYLEAYNPSDGTWLRLADLQVPRSGLAGCVVGGLLYAVGGRNNSPDGNTDSSALDCYNPMTNQWSPCAPMSVPRNRIGVGVIDGHIYAVGGSHGCIHHNSVERRLRPAQLYLCCWGL

SEQ ID NO: 812239 - protein, 636 aa, Homo sapiens
MQPDPRPSGAGACCRFLPLQSQCPEGAGDAVMYASTECKAEVTPSQHGNRTFSYTLEDHTKQAFEAFQFGHRERPLAGAFQGPQEQRLCDVTLQVKYQDAPAAQFMAHKVVLASSSPVFKAMFTNGLREQGMEVVSIEGIHPKVMERLIEFAYTASISMGEKCVLHVMNGAVMYQIDSVVRACSDFLVQQLDPSNAIGIANFAEQIGCVELHQRAREYIYMHFGEVAKQEEFFNLSHCQLVTLISRDDLNVRCESEVFHACINWVKYDCEQRRFYVQALLRAVRCHSLTPNFLQMQLQKCEILQSDSRCKDYLVKIFEELTLHKPTQVMPCRAPKVGRLIYTAGGYFRQSLSYLEAYNPSDGTWLRLADLQVPRSGLAGCVVGGLLYAVGGRNNSPDGNTDSSALDCYNPMTNQWSPCAPMSVPRNRIGVGVIDGHIYAVGGSHGCIHHNSVERYEPERDEWHLVAPMLTRRIGVGVAVLNRLLYAVGGFDGTNRLNSAECYYPERNEWRMITAMNTIRSGAGVCVLHNCIYAAGGYDGQDQLNSVERYDVETETWTFVAPMKHRRSALGITVHQGRIYVLGGYDGHTFLDSVECYDPDTDTWSEVTRMTSGRSGVGVAVTMEPCRKQIDQQNCTC

SEQ ID NO: 812240 - protein, 136 aa, Homo sapiens
GGDGWGSQSQTPRVTFSAWCPLGVCVLHNCIYAAGGYDGQDQLNSVERYDVETETWTFVAPMKHRRSALGITVHQGRIYVLGGYDGHTFLDSVECYDPDTDTWSEVTRMTSGRSGVGVAVTMEPCRKQIDQQNCTC

SEQ ID NO: 812241 - protein, 278 aa, Homo sapiens
MQPDPRPSGAGACCRFLPLQSQCPEGAGDAVMYASTECKAEVTPSQHGNRTFSYTLEDHTKQAFGIMNELRLSQQLCDVTLQVKYQDAPAAQFMAHKVVLASSSPVFKAMFTNGLREQGMEVVSIEGIHPKVMERLIEFAYTASISMGEKCVLHVMNGAVMYQIDSVVRACSDFLVQQLDPSNAIGIANFAEQIGCVELHQRAREYIYMHFGEVAKQEEFFNLSHCQLVTLISRDDLNVRCESEVFHACINWVKYDCESVGQRCSQHASPSQPKRGTR

SEQ ID NO: 812242 - protein, 64 aa, Homo sapiens
DGNTDSSALDCYNPMTNQWSPCAPMSVPRNRIGVGVIDGHIYAVGGSHGCIHHNSVERLSGRAW

SEQ ID NO: 812243 - protein, 725 aa, Homo sapiens
MDTVPQLLMCLCVYSIFIKMVVSQYIYPDAVYYLFTNSRSLKVVNISISEGKPIADYVEPSYFFSFCIILFWFCAVIEVHLATLDNLALPLVWPRLLNPYTDILLKSKSHHFSRQILRGFSVLWTGSSLRRHPHPALLEEMGWGGRWLHHNYVLIWVILSMICKGLRQTVVEACFCGISELWQSLDPAPRGLFFKQHLAQFCEQKALLLKEVEEEFRVKRRKGWTDPGEERPGDWGSCHLSVNNQLASNTLAYQGRSSSPVGGVESPWARVFGGTGASAGWPGGVGEGNVFTGWCSAGTVQVGQVRDPRGPGALSWDGFEELITHHLFSFGFCCFCFVLFVLFCISLLFYWEGKRNVLIDHQTLVEGRSSHVIAQDKEVSVCDGSMLCRHIVESRNSLVPAAVPLLCSLPGEDCQLLRNIPGAVSAVPFVGDFRLPAFVVLFLGFVFLLPSLPTCRPQLWLDVIAFRPRWLPFIKLWSSTPFFFFLIWSGREGGGREKARKVLLVFQKIRGDDSTRELTDRSVCRAGKVRRHPTTTTRKAASPDRLGRGLDTLVYLKSISVNFFSYVLKFVNGVLFWTFLNMNSPKAFSLDLILNPKDFMYGFFATYLIFFKCLTSEVHKPVVCVLELKRNSLIHIGSPGIPSAGSIWLEKAVCLTHCNLPWLENAFNVSTLSFLCHVLVGIFKIGGRNRYFSETLPEYLLFPLTSNQLKEKEVFMLIFCLVLFY

SEQ ID NO: 812244 - protein, 730 aa, Homo sapiens
MDTVPQLLMCLCVYSIFIKMVVSQYIYPDAVYYLFTNSRSLKVVNISISEGKPIADLFWFCAVIEVHLATLDNLALPLVWPRLLNPYTDILLKSKSHHFSRQILRGFSVLWTGSSLRRHPHPALLEEMGWGGRWLHHNYVLIWVILSMICKGLRQTVVEACFCGISELWQSLDPAPRGLFFKQHLAQFCEQKALLLKEVEEEFRVKRRKGWTDPGEERPGDWGSCHLSVNNQLASNTLAYQGRSSSPVGGVESPWARVFGGTGASAGWPGGVGEGNVFTGWCSAGTVQVGQVRDPRGPGALSWDGFEELITHHLFSFGFCCFCFVLFVLFCISLLFYWEGKRNVLIDHQTLVEGGPSHVIAQDKEVSVCDGSMLCRHIVESRNSLVPAAVPLLCSLPGEDCQLLRNIPGAVSAVPFVGDFRLPAFVVLFLGFVFLLPSLPTCRPQLWLDVIAFRPRLASLHYSYDPPPHFFLFLIWSGREGGGREKARKVLLVFQKIRGDDSTRELTDRSVCRAGKVRRHPTTTTRKAASPDRLGRGLDTLVYLKSISVNFFSYVLKFVNGVLFWTFLNMNSPKAFSLDLILNPKDFMYGFFATYLIFFKCLTSEVHKPVVCVLELKRNSLIHIGSPGIPSAGSIWLEKAVCLTHCNLPWLENAFNVSTLSFLCHVLVGIFKIGGRNRYFSETLPEYLLFPLTSNQLKEKEVFMLIFCLVLFYCFKRYIEKCRPLKRNSM

SEQ ID NO: 812245 - protein, 725 aa, Homo sapiens; identical to SEQ ID NO: 812243

SEQ ID NO: 812246 - protein, 694 aa, Homo sapiens
MKVNQIADYVEPSYFFSFCIILFWFCAVIEVHLATLDNLALPLVWPRLLNPYTDILLKSKSHHFSRQILRGFSVLWTGSSLRRHPHPALLEEMGWGGRWLHHNYVLIWVILSMICKGLRQTVVEACFCGISELWQSLDPAPRGLFFKQHLAQFCEQKALLLKEVEEEFRVKRRKGWTDPGEERPGDWGSCHLSVNNQLASNTLAYQGRSSSPVGGVESPWARVFGGTGASAGWPGGVGEGNVFTGWCSAGTVQVGQVRDPRGPGALSWDGFEELITHHLFSFGFCCFCFVLFVLFCISLLFYWEGKRNVLIDHQTLVKAGPSHVIAQDKEVSVCDGSMLCRHIVESRNSLVPAAVPLLCSLPGEDCQLLRNIPGAVSAVPFVGDFRLPAFVVLFLGFVFLLPSLPTCRPQLWLDVIAFRPRWLPFLSYDPPPHFFVFLIWSGREGGGREKARKVLLVFQKIRGDDSTRELTDRSVCRAGKVRRHPTTTTRKAASPDRLGRGLDTLVYLKSISVNFFSYVLKFVNGVLFWTFLNMNSPKAFSLDLILNPKDFMYGFFATYLIFLKCLTSEVHKPVVCVLELKRNSLIHIGSPGIPSAGSIWLEKAVCLTHCNLPWLENAFNVSTLSFLCHVLVGIFKIGGRNRYFSETLPEYLLFPLTSNQLKEKEVFMLIFCLVLFYDFKRYIEKCRPLKRNSM

SEQ ID NO: 812247 - protein, 725 aa, Homo sapiens; identical to SEQ ID NO: 812243

SEQ ID NO: 812248 - protein, 725 aa, Homo sapiens; identical to SEQ ID NO: 812243

SEQ ID NO: 812249 - protein, 848 aa, Homo sapiens
EYARLVMEAQPEWLRAEVKRLSHELAETTREKIQAAEYGLAVLEEKHQLKLQFEELEVDYEAIRSEMEQLKEAFGQAHTNHKKVAADGESREESLIQESASKEQYYVRKVLELQTELKQLRNVLTNTQSENERLASVAQELKEINQNVEIQRGRLRDDIKEYKFREARLLQDYSELRSEENISLQKQVSVLRQNQVEFEGLKHEIKRLEEETEYLNSQLEDAIRLKEISERQLEEALETLKTEREQKNSLRKELSHYMSINDSFYTSHLHVSLDGLKFSDDAAEPNNDAEALVNGFEHGGLAKLPLDNKTSTPKKEGLAPPSPSLVSDLLSELNISEIQKLKQQLMQMEREKAGLLATLQDTQKQLEHTRGSLSEQQEKVTRLTENLSALRRLQASKERQTALDNEKDRDSHEDGDYYEVDINGPEILACKYHVAVAEAGELREQLKALRSTHEAREAQHAEEKGRYEAEGQALTEKVSLLEKASRQDRELLARLEKELKKVSDVAGETQGSLSVAQDELVTFSEELANLYHHVCMCNNETPNRVMLDYYREGQGGAGRTSPGGRTSPEARGRRSPILLPKGLLAPEAGRADGGTGDSSPSPGSSLPSPLSDPRREPMNIYNLIAIIRDQIKHLQAAVDRTTELSRQRIASQELGPAVDKDKEALMEEILKLKSLLSTKREQITTLRTVLKANKQTAEVALANLKSKYENEKAMVTETMMKLRNELKALKEDAATFSSLRAMFATRCDEYITQLDEMQRQLAAAEDEKKTLNSLLRMAIQQKLALTQRLELLELDHEQTRRGRAKAAPKTKPATPSVSHTCACASDRAEGTGLANQVFCSEKHSIYCD

SEQ ID NO: 812250 - protein, 753 aa, Homo sapiens
PQQTQLKEAFGQAHTNHKKVAADGESREESLIQESASKEQYYVRKVLELQTELKQLRNVLTNTQSENERLASVAQELKEINQNVEIQRGRLRDDIKEYKFREARLLQDYSELRSEENISLQKQVSVLRQNQVEFEGLKHEIKRLEEETEYLNSQLEDAIRLKEISERQLEEALETLKTEREQKNSLRKELSHYMSINDSFYTSHLHVSLDGLKFSDDAAEPNNDAEALVNGFEHGGLAKLPLDNKTSTPKKEGLAPPSPSLVSDLLSELNISEIQKLKQQLMQMEREKAGLLATLQDTQKQLEHTRGSLSEQQEKVTRLTENLSALRRLQASKERQTALDNEKDRDSHEDGDYYEVDINGPEILACKYHVAVAEAGELREQLKALRSTHEAREAQHAEEKGRYEAEGQALTEKVSLLEKASRQDRELLARLEKELKKVSDVAGETQGSLSVAQDELVTFSEELANLYHHVCMCNNETPNRVMLDYYREGQGGAGRTSPGGRTSPEARGRRSPILLPKGLLAPEAGRADGGTGDSSPSPGSSLPSPLSDPRREPMNIYNLIAIIRDQIKHLQAAVDRTTELSRQRIASQELGPAVDKDKEALMEEILKLKSLLSTKREQITTLRTVLKANKQTAEVALANLKSKYENEKAMVTETMMKLRNELKALKEDAATFSSLRAMFATRCDEYITQLDEMQRQLAAAEDEKKTLNSLLRMAIQQKLALTQRLELLELDHEQTRRGRAKAAPKTKPATPSL

SEQ ID NO: 812251 - protein, 753 aa, Homo sapiens; identical to SEQ ID NO: 812250

SEQ ID NO: 812252 - protein, 132 aa, Homo sapiens
MKLELDSVFLFVCLFFKTGSWSITGLECSGMITAHCSLHLLGSSDPPTSASPIAKIPGACCHAWLIFIFFVWRQGVSVLPRLVLNSWAQVILPPRSPKVLGVHVSHYSLSWTPLLVYGHSRCPVIEKKGNDD

SEQ ID NO: 812253 - protein, 211 aa, Homo sapiens
MDAPGALAQTAAPGPGRKELKIVIVGDGGCGKTSLLMVYSQGSFPEHYAPSVFEKYTASVTVGSKEVTLNLYDTAGQEDYDRLRPLSYQNTHLVLICYDVMNPTSYDNVLIKWFPEVTHFCRGIPMVLIGCKTDLRKDKEQLRKLRAAQLEPITYMQGLSACEQIRAALYLECSAKFRENVEDVFREAAKVALSALKKAQRQKKRRLCLLL

SEQ ID NO: 812254 - protein, 211 aa, Homo sapiens; identical to SEQ ID NO: 812253

SEQ ID NO: 812255 - protein, 211 aa, Homo sapiens; identical to SEQ ID NO: 812253

SEQ ID NO: 812256 - protein, 211 aa, Homo sapiens; identical to SEQ ID NO: 812253

SEQ ID NO: 812257 - protein, 211 aa, Homo sapiens; identical to SEQ ID NO: 812253

SEQ ID NO: 812258 - protein, 211 aa, Homo sapiens; identical to SEQ ID NO: 812253

SEQ ID NO: 812259 - protein, 111 aa, Homo sapiens
MNPTSYDNVLIKWFPEVTHFCRGIPMVLIGCKTDLRKDKEQLRKLRAAQLEPITYMQGLSACEQIRAALYLECSAKFRENVEDVFREAAKVALSALKKAQRQKKRRLCLLL

SEQ ID NO: 812260 - protein, 170 aa, Homo sapiens
MDAPGALAQTAAPGPGRKELKIVIVGDGGCGKTSLLMVYSQGSFPEHYAPSVFEKYTASVTVGSKEVTLNLYDTAGQEDYDRLRPLSYQNTHLVLICYDVMNPTSYDNVLIKWFPEVTHFCRGIPMVLIGCKTDLRKDKEQLRKLRAAQLEPITYMQVGRGQDPGAQPWL

SEQ ID NO: 812261 - protein, 94 aa, Homo sapiens
NPTSYDNVLIKVRPASWVVAPHLGPAAPLTRLLPPQWFPEVTHFCRGIPMVLIGCKTDLRKDKEQLRKLRAAQLEPITYMQVGRGQDPGAQPWL

SEQ ID NO: 812262 - protein, 146 aa, Homo sapiens
RPRAALRSPEGTGDEGTMYRDPEAASPGAPSRDVLLVSAIITVSLSVTVVLCGLCHWCQRKLGKRYKNSLETVGTPDSGRGRSEKKAINDLDRDFWNNNESTVQQKWSSYPPKEFILNISPYAPYGDPRLSLNGTLLSGAKVAAAA

SEQ ID NO: 812263 - protein, 420 aa, Homo sapiens
RPRAALRSPEGTGDEGTMYRDPEAASPGAPSRDVLLVSAIITVSLSVTVVLCGLCHWCQRKLGKRYKNSLETVGTPDSGRGRSEKKAIKLPAGGKAVNTAPVPGQTPHDESDRRTEPRSSVSDLVNSLTSEMLMLSPGSEEDEAHEGCSRENLGRIQFSVGYNFQESTLTVKIMKAQELPAKDFSGTSDPFVKDLPAARQEHKLETKVKRKNLNPHWNETFLFEGFPYEKVVQRILYLQVLDYDRFSRNDPIGEVSIPLNKVDLTQMQTFWKDLKPCSDGSGSRGELLLSLCYNPSANSIIVNIIKARNLKAMDIGGTSDPYVKVWLMYKDKRVEKKKTVTMKRNLNPIFNESFAFDIPTEKLRETTIIITVMDKDKLSRNDVIGKIYLSWKSGPGEVKHWKDMIARPRQPVAQWHQLKA

SEQ ID NO: 812264 - protein, 420 aa, Homo sapiens; identical to SEQ ID NO: 812263

SEQ ID NO: 812265 - protein, 420 aa, Homo sapiens; identical to SEQ ID NO: 812263

SEQ ID NO: 812266 - protein, 414 aa, Homo sapiens
MNLQRYWGEIPISSSQTNRSSFDLLPREFRLVEVHDPPLHQPSANKPKPPTMLDIPSEPCSLTIHTIQLIQHNRRLRNLIATAQAQNQQQTEGVKTEESEPLPSCPGSPPLPDDLLPLDCKNPNAPFQIRHSDPESDFYRGKGEPVTELSWHSCRQLLYQAVATILAHAGFDCANESVLETLTDVAHEYCLKFTKLLRFAVDREARLGQTPFPDVMEQVFHEVGIGSVLSLQKFWQHRIKDYHSYMLQISKQLSEEYERIVNPEKATEDAKPVKIKEEPVSDITFPVSEELEADLASGDQSLPMGVLGAQSERFPSNLEVEASPQASSAEVNASPLWNLAHVKMEPQESEEGNVSGHGVLGSDVFEEPMSGMSEAGIPQSPDDSDSSYGSHSTDSLMGSSPVFNQRCKKRMRKI

SEQ ID NO: 812267 - protein, 414 aa, Homo sapiens; identical to SEQ ID NO: 812266

SEQ ID NO: 812268 - protein, 412 aa, Homo sapiens
MLRYWGEIPISSSQTNRSSFDLLPREFRLVEVHDPPLHQPSANKPKPPTMLDIPSEPCSLTIHTIQLIQHNRRLRNLIATAQAQNQQQTEGVKTEESEPLPSCPGSPPLPDDLLPLDCKNPNAPFQIRHSDPESDFYRGKGEPVTELSWHSCRQLLYQAVATILAHAGFDCANESVLETLTDVAHEYCLKFTKLLRFAVDREARLGQTPFPDVMEQVFHEVGIGSVLSLQKFWQHRIKDYHSYMLQISKQLSEEYERIVNPEKATEDAKPVKIKEEPVSDITFPVSEELEADLASGDQSLPMGVLGAQSERFPSNLEVEASPQASSAEVNASPLWNLAHVKMEPQESEEGNVSGHGVLGSDVFEEPMSGMSEAGIPQSPDDSDSSYGSHSTDSLMGSSPVFNQRCKKRMRKI

SEQ ID NO: 812269 - protein, 140 aa, Homo sapiens
MNLQRYWGEIPISSSQTNRSSFDLLPREFRLVEVHDPPLHQPSANKPKPPTMLDIPSEPCSLTIHTIQLIQHNRRLRNLIATAQAQNQQQTEGVKTEESEPLPSCPGSPPLPDDLLPLDCKNPNAPFQIRHSDPESDFYR

SEQ ID NO: 812270 - protein, 414 aa, Homo sapiens; identical to SEQ ID NO: 812266

SEQ ID NO: 812271 - protein, 414 aa, Homo sapiens; identical to SEQ ID NO: 812266

SEQ ID NO: 812272 - protein, 412 aa, Homo sapiens; identical to SEQ ID NO: 812268

SEQ ID NO: 812273 - protein, 412 aa, Homo sapiens; identical to SEQ ID NO: 812268

SEQ ID NO: 812274 - protein, 199 aa, Homo sapiens [sequence omitted]

SEQ ID NO: 812275 - protein, 301 aa, Homo sapiens
MYEAGGGENPNAPFQIRHSDPESDFYRGKGEPVTELSWHSCRQLLYQAVATILAHAGFDCANESVLETLTDVAHEYCLKFTKLLRFAVDREARLGQTPFPDVMEQVFHEVGIGSVLSLQKFWQHRIKDYHSYMLQISKQLSEEYERIVNPEKATEDAKPVKIKEEPVSDITFPVSEELEADLASGDQSLPMGVLGAQSERFPSNLEVEASPQASSAEVNASPLWNLAHVKMEPQESEEGNVSGHGVLGSDVFEEPMSGMSEAGIPQSPDDSDSSYGSHSTDSLMGSSPVFNQRCKKRMRKI

SEQ ID NO: 812276 - protein, 434 aa, Homo sapiens
MNLQRYWGEIPISSSQTNRSSFDLLPREFRLVEVHDPPLHQPSANKPKPPTMLDIPSEPCSLTIHTIQLIQHNRRLRNLIATAQAQNQQQTEGVKTEESEPLPSCPGSPPLPDDLLPLDCKNPNAPFQIRHSDPESDFYRGKGEPVTELSWHSCRQLLYQAVATILAHAGFDCANESVLETLTDVAHEYCLKFTKLLRFAVDREARLGQTPFPDVMEQVFHEVGIGSVLSLQKFWQHRIKDYHSYMLQISKQLSEEYERIVNPEKATEDAKPVKIKEEPVSDITFPVSEELEADLASGDQSLPMGVLGAQSERFPSNLEVEASPQASSAEVNASPLWNLAHVKMEPQESEEGNVSGHGVLGSDVFEEPMSGMSEAGIPQSPDDSDSSYGSHSTDSLMGSSPVFNQRCSLVAMPRKIEEIKDFLLTARRKDAKSV

SEQ ID NO: 812277 - protein, 99 aa, Homo sapiens
LQDSARAKACYKPLESFPDNRTFNDKSPNAKGLVCSQRVYWEECGDLSAALLLWMAAADGPNAVVSSGGGSCGAADASLLEVNPEQKEQSESCSSCWPL

SEQ ID NO: 812278 - protein, 271 aa, Homo sapiens
MASADSRRVADGGGAGGTFQPYLDTLRQELQQTDPTLLSVVVAVLAVLLTLVFWKLIRSRRSSQRAVLLVGLCDSGKTLLFVRLLTGLYRDTQTSITDSCAVYRVNNNRGNSLTLIDLPGHESLRLQFLERFKSSARAIVFVVDSAAFQREVKDVAEFLYQVLIDSMGLKNTPSFLIACNKQDIAMAKSAKLIQQQLEKELNTLRVTRSAAPSTLDSSSTAPAQLGKKGKEFEFSQLPLKVEFLECSAKGGRGDVGSADIQDLEKWLAKIA

SEQ ID NO: 812279 - protein, 271 aa, Homo sapiens; identical to SEQ ID NO: 812278

SEQ ID NO: 812280 - protein, 285 aa, Homo sapiens
MAGWYWSGVYGYSSMASADSRRVADGGGAGGTFQPYLDTLRQELQQTDPTLLSVVVAVLAVLLTLVFWKLIRSRRSSQRAVLLVGLCDSGKTLLFVRLLTGLYRDTQTSITDSCAVYRVNNNRGNSLTLIDLPGHESLRLQFLERFKSSARAIVFVVDSAAFQREVKDVAEFLYQVLIDSMGLKNTPSFLIACNKQDIAMAKSAKLIQQQLEKELNTLRVTRSAAPSTLDSSSTAPAQLGKKGKEFEFSQLPLKVEFLECSAKGGRGDVGSADIQDLEKWLAKIA

SEQ ID NO: 812281 - protein, 271 aa, Homo sapiens; identical to SEQ ID NO: 812278

SEQ ID NO: 812282 - protein, 271 aa, Homo sapiens; identical to SEQ ID NO: 812278

SEQ ID NO: 812283 - protein, 271 aa, Homo sapiens; identical to SEQ ID NO: 812278

SEQ ID NO: 812284 - protein, 271 aa, Homo sapiens; identical to SEQ ID NO: 812278

SEQ ID NO: 812285 - protein, 271 aa, Homo sapiens; identical to SEQ ID NO: 812278

SEQ ID NO: 812286 - protein, 271 aa, Homo sapiens; identical to SEQ ID NO: 812278

SEQ ID NO: 812287 - protein, 271 aa, Homo sapiens; identical to SEQ ID NO: 812278

SEQ ID NO: 812288 - protein, 271 aa, Homo sapiens; identical to SEQ ID NO: 812278

SEQ ID NO: 812289 - protein, 271 aa, Homo sapiens; identical to SEQ ID NO: 812278

SEQ ID NO: 812290 - protein, 70 aa, Homo sapiens
KGRRSRSRTDAWVDDIGESGRLHTGSGTRSSSSVPVGSEVTGCQLSSPLRISLICGHSYEVSPHVKTGTK

SEQ ID NO: 812291 - protein, 102 aa, Homo sapiens [sequence omitted]

SEQ ID NO: 812292 - protein, 451 aa, Homo sapiens
MPREIITLQLGQCGNQIGFEFWKQLCAEHGISPEGIVEEFATEGTDRKDVFFYQADDEHYIPRAVLLDLEPRVIHSILNSPYAKLYNPENIYLSEHGGGAGNNWASGFSQGEKIHEDIFDIIDREADGSDSLEGFVLCHSIAGGTGSGLGSYLLERLNDRYPKKLVQTYSVFPNQDEMSDVVVQPYNSLLTLKRLTQNADCVVVLDNTALNRIATDRLHIQNPSFSQINQLVSTIMSASTTTLRYPGYMNNDLIGLIASLIPTPRLHFLMTGYTPLTTDQSVASVRKTTVLDVMRRLLQPKNVMVSTGRDRQTNHCYIAILNIIQGEVDPTQVHKSLQRIRERKLANFIPWGPASIQVALSRKSPYLPSAHRVSGLMMANHTSISSLFERTCRQYDKLRKREAFLEQFRKEDMFKDNFDEMDTSREIVQQLIDEYHAATRPDYISWGTQEQ

SEQ ID NO: 812293 - protein, 120 aa, Homo sapiens
LVRSEGPEIRERKLANFIPWGPASIQVALSRKSPYLPSAHRVSGLMMANHTSISSLFERTCRQYDKLRKREAFLEQFRKEDMFKDNFDEMDTSREIVQQLIDEYHAATRPDYISWGTQEQ

SEQ ID NO: 812294 - protein, 479 aa, Homo sapiens
MPREIITLQLGQCGNQIGFEFWKQLCAEHGISPEGIVEEFATEGTDRKDVFFYQADDEHYIPRAVLLDLEPRVIHSILNSPYAKLYNPENIYLSEHGGGAGNNWASGFSQGEKIHEDIFDIIDREADGSDSLEGFVLCHSIAGGTGSGLGSYLLERLNDRYPKKLVQTYSVFPNQDEMSDVVVQPYNSLLTLKRLTQNADCVVVLDNTALNRIATDRLHIQNPSFSQINQLVSTIMSASTTTLRYPGYMNNDLIGLIASLIPTPRLHFLMTGYTPLTTDQSVASVRKTTVLDVMRRLLQPKNVMVSTGRDRQTNHCYIAILNIIQGEVDPTQVGEAPSSHTLDLQEVEERPPPLLLCPPQVHKSLQRIRERKLANFIPWGPASIQVALSRKSPYLPSAHRVSGLMMANHTSISSLFERTCRQYDKLRKREAFLEQFRKEDMFKDNFDEMDTSREIVQQLIDEYHAATRPDYISWGTQEQ

SEQ ID NO: 812295 - protein, 429 aa, Homo sapiens
MPREIITLQLGQCGNQIGFEFWKQLCAEHGISPEGIVEEFATEGTDRKDVFFYQADDEHYIPRAVLLDLEPRVIHSILNSPYAKLYNPENIYLSEHGGGAGNNWASGFSQGEKIHEDIFDIIDREADGSDSLEGFVLCHSIAGGTGSGLGSYLLERLNDRYPKKLVQTYSVFPNQDEMSDVVVQPYNSLLTLKRLTQNADCVVVLDNTALNRIATDRLHIQNPSFSQINQLVSTIMSASTTTLRYPGYMNNDLCLLSYQVASVRKTTVLDVMRRLLQPKNVMVSTGRDRQTNHCYIAILNIIQGEVDPTQVHKSLQRIRERKLANFIPWGPASIQVALSRKSPYLPSAHRVSGLMMANHTSISSLFERTCRQYDKLRKREAFLEQFRKEDMFKDNFDEMDTSREIVQQLIDEYHAATRPDYISWGTQEQ

SEQ ID NO: 812296 - protein, 451 aa, Homo sapiens; identical to SEQ ID NO: 812292

SEQ ID NO: 812297 - protein, 203 aa, Homo sapiens
MNNDLIGLIASLIPTPRLHFLMTGYTPLTTDQSVASVRKTTVLDVMRRLLQPKNVMVSTGRDRQTNHCYIAILNIIQGEVDPTQVHKSLQRIRERKLANFIPWGPASIQVALSRKSPYLPSAHRVSGLMMANHTSISSLFERTCRQYDKLRKREAFLEQFRKEDMFKDNFDEMDTSREIVQQLIDEYHAATRPDYISWGTQEQ

SEQ ID NO: 812298 - protein, 444 aa, Homo sapiens
PKVGQIGDQIGFEFWKQLCAEHGISPEGIVEEFATEGTDRKDVFFYQADDEHYIPRAVLLDLEPRVIHSILNSPYAKLYNPENIYLSEHGGGAGNNWASGFSQGEKIHEDIFDIIDREADGSDSLEGFVLCHSIAGGTGSGLGSYLLERLNDRYPKKLVQTYSVFPNQDEMSDVVVQPYNSLLTLKRLTQNADCVVVLDNTALNRIATDRLHIQNPSFSQINQLVSTIMSASTTTLRYPGYMNNDLIGLIASLIPTPRLHFLMTGYTPLTTDQSVASVRKTTVLDVMRRLLQPKNVMVSTGRDRQTNHCYIAILNIIQGEVDPTQVHKSLQRIRERKLANFIPWGPASIQVALSRKSPYLPSAHRVSGLMMANHTSISSLFERTCRQYDKLRKREAFLEQFRKEDMFKDNFDEMDTSREIVQQLIDEYHAATRPDYISWGTQEQ

SEQ ID NO: 812299 - protein, 464 aa, Homo sapiens
MPREIITLQLGQCGNQIGFEFWKQLCAEHGISPEGIVEEFATEGTDRKDVFFYQADDEHYIPRAVLLDLEPRVIHSILNSPYAKLYNPENIYLSEHGGGAGNNWASGFSQVVSYSLAGPTTRWGEKIHEDIFDIIDREADGSDSLEGFVLCHSIAGGTGSGLGSYLLERLNDRYPKKLVQTYSVFPNQDEMSDVVVQPYNSLLTLKRLTQNADCVVVLDNTALNRIATDRLHIQNPSFSQINQLVSTIMSASTTTLRYPGYMNNDLIGLIASLIPTPRLHFLMTGYTPLTTDQSVASVRKTTVLDVMRRLLQPKNVMVSTGRDRQTNHCYIAILNIIQGEVDPTQVHKSLQRIRERKLANFIPWGPASIQVALSRKSPYLPSAHRVSGLMMANHTSISSLFERTCRQYDKLRKREAFLEQFRKEDMFKDNFDEMDTSREIVQQLIDEYHAATRPDYISWGTQEQ

SEQ ID NO: 812300 - protein, 398 aa, Homo sapiens
LGESAGPVVASSSSMFRQVDVLWVVELGIGGVEDGVDHPGFQVQQHGPGDVVLIVLPGEKIHEDIFDIIDREADGSDSLEGFVLCHSIAGGTGSGLGSYLLERLNDRYPKKLVQTYSVFPNQDEMSDVVVQPYNSLLTLKRLTQNADCVVVLDNTALNRIATDRLHIQNPSFSQINQLVSTIMSASTTTLRYPGYMNNDLIGLIASLIPTPRLHFLMTGYTPLTTDQSVASVRKTTVLDVMRRLLQPKNVMVSTGRDRQTNHCYIAILNIIQGEVDPTQVHKSLQRIRERKLANFIPWGPASIQVALSRKSPYLPSAHRVSGLMMANHTSISSLFERTCRQYDKLRKREAFLEQFRKEDMFKDNFDEMDTSREIVQQLIDEYHAATRPDYISWGTQEQ

SEQ ID NO: 812301 - protein, 339 aa, Homo sapiens
MTPGGGIDIIDREADGSDSLEGFVLCHSIAGGTGSGLGSYLLERLNDRYPKKLVQTYSVFPNQDEMSDVVVQPYNSLLTLKRLTQNADCVVVLDNTALNRIATDRLHIQNPSFSQINQLVSTIMSASTTTLRYPGYMNNDLIGLIASLIPTPRLHFLMTGYTPLTTDQSVASVRKTTVLDVMRRLLQPKNVMVSTGRDRQTNHCYIAILNIIQGEVDPTQVHKSLQRIRERKLANFIPWGPASIQVALSRKSPYLPSAHRVSGLMMANHTSISSLFERTCRQYDKLRKREAFLEQFRKEDMFKDNFDEMDTSREIVQQLIDEYHAATRPDYISWGTQEQ

SEQ ID NO: 812302 - protein, 409 aa, Homo sapiens
MPREIITLQLGQCGNQIGFEFWKQLCAEHGISPEGIVEEFATEGTDRKDVFFYQADDEHYIPRAVLLDLEPRVIHSILNSPYAKLYNPENIYLSEHGGGAGNNWASGFSQGEKIHEDIFDIIDREADGSDSLEDEMSDVVVQPYNSLLTLKRLTQNADCVVVLDNTALNRIATDRLHIQNPSFSQINQLVSTIMSASTTTLRYPGYMNNDLIGLIASLIPTPRLHFLMTGYTPLTTDQSVASVRKTTVLDVMRRLLQPKNVMVSTGRDRQTNHCYIAILNIIQGEVDPTQVHKSLQRIRERKLANFIPWGPASIQVALSRKSPYLPSAHRVSGLMMANHTSISSLFERTCRQYDKLRKREAFLEQFRKEDMFKDNFDEMDTSREIVQQLIDEYHAATRPDYISWGTQEQ

SEQ ID NO: 812303 - protein, 334 aa, Homo sapiens
VPTRMGWEADGSDSLEGFVLCHSIAGGTGSGLGSYLLERLNDRYPKKLVQTYSVFPNQDEMSDVVVQPYNSLLTLKRLTQNADCVVVLDNTALNRIATDRLHIQNPSFSQINQLVSTIMSASTTTLRYPGYMNNDLIGLIASLIPTPRLHFLMTGYTPLTTDQSVASVRKTTVLDVMRRLLQPKNVMVSTGRDRQTNHCYIAILNIIQGEVDPTQVHKSLQRIRERKLANFIPWGPASIQVALSRKSPYLPSAHRVSGLMMANHTSISSLFERTCRQYDKLRKREAFLEQFRKEDMFKDNFDEMDTSREIVQQLIDEYHAATRPDYISWGTQEQ

SEQ ID NO: 812304 - protein, 299 aa, Homo sapiens
MPREIITLQLGQCGNQIGFEFWKQLCAEHGISPEGIVEEFATEGTDRKDVFFYQADDEHYIPRAVLLDLEPRVIHSILNSPYAKLYNPENIYLSEHGGGAGNNWASGFSQGEKIHEDIFDIIDREADGSDSLEGFVLCHSIAGGTGSGLGSYLLERLNDRYPKKLVQTYSVFPNQDEMSDVVVQPYNSLLTLKRLTQNADCVVVLDNTALNRIATDRLHIQNPSFSQINQLVSTIMSASTTTLRYPGYMNNDLIGLIASLIPTPRLHFLMTGYTPLTTDQSVRAAFSVPGQAGPGPNRP

SEQ ID NO: 812305 - protein, 273 aa, Homo sapiens
MPREIITLQLGQCGNQIGFEFWKQLCAEHGISPEGIVEEFATEGTDRKDVFFYQADDEHYIPRAVLLDLEPRVIHSILNSPYAKLYNPENIYLSEHGGGAGNNWASGFSQGEKIHEDIFDIIDREADGSDSLEGFVLCHSIAGGTGSGLGSYLLERLNDRYPKKLVQTYSVFPNQDEMSDVVVQPYNSLLTLKRLTQNADCVVVLDNTALNRIATDRLHIQNPSFSQINQLVSTIMSASTTTLRYPGYMNNDLIGLIASLIPTPYMQGVRSSN

SEQ ID NO: 812306 - protein, 280 aa, Homo sapiens
MPREIITLQLGQCGNQIGFEFWKQLCAEHGISPEGIVEEFATEGTDRKDVFFYQADDEHYIPRAVLLDTTTLRYPGYMNNDLIGLIASLIPTPRLHFLMTGYTPLTTDQSVASVRKTTVLDVMRRLLQPKNVMVSTGRDRQTNHCYIAILNIIQGEVDPTQVHKSLQRIRERKLANFIPWGPASIQVALSRKSPYLPSAHRVSGLMMANHTSISSLFERTCRQYDKLRKREAFLEQFRKEDMFKDNFDEMDTSREIVQQLIDEYHAATRPDYISWGTQEQ

SEQ ID NO: 812307 - protein, 232 aa, Homo sapiens
MPREIITLQLGQCGNQIGFEFWKQLCAEHGISPEGIVEEFATEGTDRKDVFFYQADDEHYIPRAVLLDLEPRVIHSILNSPYAKLYNPENIYLSEHGGGAGNNWASGFSQGEKIHEDIFDIIDREADGSDSLEGFVLCHSIAGGTGSGLGSYLLERLNDRYPKKLVQTYSVFPNQYDKLRKREAFLEQFRKEDMFKDNFDEMDTSREIVQQLIDEYHAATRPDYISWGTQEQ

SEQ ID NO: 812308 - protein, 215 aa, Homo sapiens
MPREIITLQLGQCGNQIGFEFWKQLCAEHGISPEGIVEEFATEGTDRKDVFFYQADDEHYIPRAVLLDLEPRVIHSILNSPYAKLYNPENIYLSEHGGGAGNNWASGFSQGEKIHEDIFDIIDREADGSDSLEGFVLCHSIAGGTGSGLGSYLLERLNDRYPKKLVQTYSVFPNQDEMSDVVVQPYNSLLTLKRLTQNADCVQHSLNRDLRLVPS

SEQ ID NO: 812309 - protein, 228 aa, Homo sapiens
MPREIITLQLGQCGNQIGFEFWKQLCAEHGISPEGIVEEFATEGTDRKDVFFYQADDEHYIPRAVLLDLEPRVIHSILNSPYAKLYNPENIYLSEHGGGAGNNWASGFSQGEKIHEDIFDIIDREADGSDSLEGFVLCHSIAGGTGSGLGSYLLERLNDRYPKKLVQTYSVFPNQDEMSDVVVQPYNSLLTLKRLTQNADCVGESWILPLPTLNTPYPLESIKSFSCI

SEQ ID NO: 812310 - protein, 790 aa, Homo sapiens
MRTYRYFLLLFWVGQPYPTLSTPLSKRTSGFPAKKRALELSGNSKNELNRSKRSWMWNQFFLLEEYTGSDYQYVGKLHSDQDRGDGSLKYILSGDGAGDLFIINENTGDIQATKRLDREEKPVYILRAQAINRRTGRPVEPESEFIIKIHDINDNEPIFTKEVYTATVPEMSDVGTFVVQVTATDADDPTYGNSAKVVYSILQGQPYFSVESETGIIKTALLNMDRENREQYQVVIQAKDMGGQMGGLSGTTTVNITLTDVNDNPPRFPQSTYQFKTPESSPPGTPIGRIKASDADVGENAEIEYSITDGEGLDMFDVITDQETQEGIITVKKLLDFEKKKVYTLKVEASNPYVEPRFLYLGPFKDSATVRIVVEDVDEPPVFSKLAYILQIREDAQINTTIGSVTAQDPDAARNPVKYSVDRHTDMDRIFNIDSGNGSIFTSKLLDRETLLWHNITVIATEINNPKQSSRVPLYIKVLDVNDNAPEFAEFYETFVCEKAKADQLIQTLHAVDKDDPYSGHQFSFSLAPEAASGSNFTIQDNKDNTAGILTRKNGYNRHEMSTYLLPVVISDNDYPVQSSTGTVTVRVCACDHHGNMQSCHAEALIHPTGLSTGALVAILLCIVILLVTVVLFAALRRQRKKEPLIISKEDIRDNIVSYNDEGGGEEDTQAFDIGTLRNPEAIEDNKLRRDIVPEALFLPRRTPTARDNTDVRDFINQRLKENDTDPTAPPYDSLATYAYEGTGSVADSLSSLESVTTDADQDYDYLSDWGPRFKKLADMYGGVDSDKDS

SEQ ID NO: 812311 - protein, 663 aa, Homo sapiens
MRTYRYFLLLFWVGQPYPTLSTPLSKRTSGFPAKKRALELSGNSKNELNRSKRSWMWNQFFLLEEYTGSDYQYVGKLHSDQDRGDGSLKYILSGDGAGDLFIINENTGDIQATKRLDREEKPVYILRAQAINRRTGRPVEPESEFIIKIHDINDNEPIFTKEVYTATVPEMSDVGTFVVQVTATDADDPTYGNSAKVVYSILQGQPYFSVESETGIIKTALLNMDRENREQYQVVIQAKDMGGQMGGLSGTTTVNITLTDVNDNPPRFPQSTYQFKTPESSPPGTPIGRIKASDADVGENAEIEYSITDGEGLDMFDVITDQETQEGIITVKKLLDFEKKKVYTLKVEASNPYVEPRFLYLGPFKDSATVRIVVEDVDEPPVFSKLAYILQIREDAQINTTIGSVTAQDPDAARNPVKYSVDRHTDMDRIFNIDSGNGSIFTSKLLDRETLLWHNITVIATEINNPKQSSRVPLYIKVLDVNDNAPEFAEFYETFVCEKAKADQLIQTLHAVDKDDPYSGHQFSFSLAPEAASGSNFTIQDNKDNTAGILTRKNGYNRHEMSTYLLPVVISDNDYPVQSSTGTVTVRVCACDHHGNMQSCHAEALIHPTGLSTGALVAILLCIVILLGKLVLPASYLPMVRGSHCYCDTLDLSASPIKAYSLI

SEQ ID NO: 812312 - protein, 663 aa, Homo sapiens; identical to SEQ ID NO: 812311

SEQ ID NO: 812313 - protein, 568 aa, Homo sapiens
MPSTDLLMLKAFEPYLEILEVYSTKAKNYVNGHCTKYEPWQLIAWSVVWTLLIVWGYEFVFQPESLWSRFKKKCFKLTRKMPIIGRKIQDKLNKTKDDISKNMSFLKVDKEYVKALPSQGLSSSAVLEKLKEYSSMDAFWQEGRASGTVYSGEEKLTELLVKAYGDFAWSNPLHPDIFPGLRKIEAEIVRIACSLFNGGPDSCGCVTSGGTESILMACKAYRDLAFEKGIKTPEIVAPQSAHAAFNKAASYFGMKIVRVPLTKMMEVDVRAMRRAISRNTAMLVCSTPQFPHGVIDPVPEVAKLAVKYKIPLHVDACLGGFLIVFMEKAGYPLEHPFDFRVKGVTSISADTHKYGYAPKGSSLVLYSDKKYRNYQFFVDTDWQGGIYASPTIAGSRPGGISAACWAALMHFGENGYVEATKQIIKTARFLKSELENIKGIFVFGNPQLSVIALGSRDFDIYRLSNLMTAKGWNLNQLQFPPSIHFCITLLHARKRVAIQFLKDIRESVTQIMKNPKAKTTGMGAIYGMAQTTVDRNMVAELSSVFLDSLYSTDTVTQGSQMNGSPKPH

SEQ ID NO: 812314 - protein, 568 aa, Homo sapiens; identical to SEQ ID NO: 812313

SEQ ID NO: 812315 - protein, 405 aa, Homo sapiens
MPSTDLLMLKAFEPYLEILEVYSTKAKNYVNGHCTKYEPWQLIAWSVVWTLLIVWGYEFVFQPESLWSRFKKKCFKLTRKMPIIGRKIQDKLNKTKDDISKNMSFLKVDKEYVKALPSQGLSSSAVLEKLKEYSSMDAFWQEGRASGTVYSGEEKLTELLVKAYGDFAWSNPLHPDIFPGLRKIEAEIVRIACSLFNGGPDSCGCVTSGGTESILMACKAYRDLAFEKGIKTPEIVAPQSAHAAFNKAASYFGMKIVRVPLTKMMEVDVRAMRRAISRNTAMLVCSTPQFPHGVIDPVPEVAKLAVKYKIPLHVDACLGGFLIVFMEKAGYPLEHPFDFRVKGVTSISADTHKYGYAPKGSSLVLYSDKKYRNMVAELSSVFLDSLYSTDTVTQGSQMNGSPKPH

SEQ ID NO: 812316 - protein, 568 aa, Homo sapiens; identical to SEQ ID NO: 812313

SEQ ID NO: 812317 - protein, 568 aa, Homo sapiens; identical to SEQ ID NO: 812313

SEQ ID NO: 812318 - protein, 415 aa, Homo sapiens
MPSTDLLMLKAFEPYLEILEVYSTKAKNYVNGHCTKYEPWQLIAWSVVWTLLIVWGYEFVFQPESLWSRFKKKCFKLTRKMPIIGRKIQDKLNKTKDDISKNMSFLKVDKEYVKALPSQGLSSSAVLEKLKEYSSMDAFWQEGRASGTVYSGEEKLTELLVKAYGDFAWSNPLHPDIFPGLRKIEAEIVRIACSLFNGGPDSCGCVTSGGTESILMACKAYRDLAFEKGIKTPEIVAPQSAHAAFNKAASYFGMKIVRVPLTKMMEVDVRAMRRAISRNTAMLVCSTPQFPHGVIDPVPEVAKLAVKYKIPLHVDACLGGFLIVFMEKAGYPLEHPFDFRVKGVTSISADTHKQTPLWLASCQDGEACAPVERLPRTRPRATRFLCAVTTLVPGEMVFFKGTYCSHFNLQLRALV

SEQ ID NO: 812319 - protein, 568 aa, Homo sapiens; identical to SEQ ID NO: 812313

SEQ ID NO: 812320 - protein, 568 aa, Homo sapiens; identical to SEQ ID NO: 812313

SEQ ID NO: 812321 - protein, 219 aa, Homo sapiens
MPSTDLLMLKAFEPYLEILEVYSTKAKNYVNGHCTKYEPWQLIAWSVVWTLLIVWGYEFVFQPESLWSRFKKKCFKLTRKMPIIGRKIQDKLNKTKDDISKNMSFLKVDKEYVKALPSQGLSSSAVLEKLKEYSSMDAFWQEGRASGTVYSGEEKLTELLVKAYGDFAWSNPLHPDIFPGLRKIEAEIVRIACSLFNGGPDSCGCEALFLFCFSNMLAP

SEQ ID NO: 812322 - protein, 463 aa, Homo sapiens
MPSTDLLMLKAFEPYLEILEVYSTKAKNYVNGHCTKYEPWQLIAWSVVWTLLIVWGYEFVFQPESLWSRFKKKCFKLTRKMPIIGRKIQDKLNKTKDDISKNMSFLKVDKEYVKALPSQGLSSSAVLEKLKEYSSMDAFWQEGRASGTVYSGEEKLTELLVKAYGDFAWSNPLHPDIFPGLRKIEAEIVRIACSLFNGGPDSCGCVTSGGTESILMACKAYRDLAFEKGIKTPEIVAPQSAHAAFNKAASYFGMKIVRVPLTKMMEVDVRAMRRAISRNTAMLVCSTPQFPHGVIDPVPEVAKLAVKYKIPLHVDACLGGFLIVFMEKAGYPLEHPFDFRVKGVTSISADTHKYGYAPKGSSLVLYSDKKYRNYQFFVDTDWQGGIYASPTIAGSRPGGISAACWAALMHFGENGYVEATKQIIKTARFLKSELENIKGIFVFGNPQLSVIALGSRDCHTSLV

SEQ ID NO: 812323 - protein, 221 aa, Homo sapiens
MPSTDLLMLKAFEPYLEILEVYSTKAKNYVNGHCTKYEPWQLIAWSVVWTLLIVWGYEFVFQPESLWSRFKKKCFKLTRKMPIIGRKIQDKLNKTKDDISKNMSFLKVDKEYVKALPSQGLSSSAVLEKLKEYSSMDAFWQEGRASGTVYSGEEKLTELLVKAYGDFAWSNPLHPDIFPGLRKIEAEIVRIACSLFNGGPDSCGCVSICKGHPIALFFRLK

SEQ ID NO: 812324 - protein, 58 aa, Homo sapiens
EVYSTKAKNYVNGHCTKYEPWQLIAWSVVWTLLIVWGYEFVFQPESKYAVSSVKVEWC

SEQ ID NO: 812325 - protein, 382 aa, Homo sapiens
TKGGRTAQLTAVLRKFLDPRLISTEENTQAAETMGPISAPSCRWRIPWQGLLLTASLFTFWNPPTTAQLTIEAVPSNAAEGKEVLLLVHNLPQDPRGYNWYKGETVDANRRIIGYVISNQQITPGPAYSNRETIYPNASLLMRNVTRNDTGSYTLQVIKLNLMSEEVTGQFSVHPETPKPSISSNNSNPVEDKDAVAFTCEPETQNTTYLWWVNGQSLPVSPRLQLSNGNRTLTLLSVTRNDVGPYECEIQNPASANFSDPVTLNVLYGPDAPTISPSDTYYHAGVNLNLSCHAASNPPSQYSWSVNGTFQQYTQKLFIPNITTKNSGSYACHTTNSATGRNRTTVRMITVSDALVQGSSPGLSARATVSIMIGVLARVALI

SEQ ID NO: 812326 - protein, 237 aa, Homo sapiens
HWVDVETSLVTRETHLATAGLHVKTITVSAETPKPSISSNNSNPVEDKDAVAFTCEPETQNTTYLWWVNGQSLPVSPRLQLSNGNRTLTLLSVTRNDVGPYECEIQNPASANFSDPVTLNVLYGPDAPTISPSDTYYHAGVNLNLSCHAASNPPSQYSWSVNGTFQQYTQKLFIPNITTKNSGSYACHTTNSATGRNRTTVRMITVSDALVQGSSPGLSARATVSIMIGVLARVALI

SEQ ID NO: 812327 - protein, 225 aa, Homo sapiens
PPPPRRTRLILGAFCVHPETPKPSISSNNSNPVEDKDAVAFTCEPETQNTTYLWWVNGQSLPVSPRLQLSNGNRTLTLLSVTRNDVGPYECEIQNPASANFSDPVTLNVLYGPDAPTISPSDTYYHAGVNLNLSCHAASNPPSQYSWSVNGTFQQYTQKLFIPNITTKNSGSYACHTTNSATGRNRTTVRMITVSDALVQGSSPGLSARATVSIMIGVLARVALI

SEQ ID NO: 812328 - protein, 181 aa, Homo sapiens
MFSAIRSQHSGVDICINNAGLARPDTLLSGSTSGWKDMFNVNVLALSICTREAYQSMKERNVDDGHIININSMSGHRVLPLSVTHFYSATKYAVTALTEGLRQELREAQTHIRATCISPGVVETQFAFKLHDKDPEKAAATYEQMKCLKPEDVAEAVIYVLSTPAHIQIGDIQMRPTEQVT

SEQ ID NO: 812329 - protein, 111 aa, Homo sapiens
TLVATKPEKLAPSRQDIFQEQLAAIPEFLNIGPLFKSSEPVQLTEAETEYFVRCIKHMFTNHIVFQFDCTNTLNDQLLEKVTVQMEPSDSYEVLSCIPAPTLHGLPPASGF

SEQ ID NO: 812330 - protein, 216 aa, Homo sapiens
VIENEELITGKRQELVTKIINEEDILSMFSAIRSEPRCLHFAVAGRLGGSGRLCMEAESCHQDMVNVNVLALSICTREAYQSMKERNVDDGHIININSMSGHRVLPLSVTHFYSATKYAVTALTEGLRQELREAQTHIRATCISPGVVETQFAFKLHDKDPEKAAATYEQMKCLNPRCGAVFLRLRPPTHSDETSNKPPSRELRTGELFFPSNLIG

SEQ ID NO: 812331 - protein, 260 aa, Homo sapiens
MARPGMERWRDRLALVTGASGGIGAAVARALVQQGLKVVGCARTVGNIEELAAECKSAGYPGTLIPYRCDLSNEEDILSMFSAIRSQHSGVDICINNAGLARPDTLLSGSTSGWKDMFNVNVLALSICTREAYQSMKERNVDDGHIININSMSGHRVLPLSVTHFYSATKYAVTALTEGLRQELREAQTHIRATCISPGVVETQFAFKLHDKDPEKAAATYEQMKCLKPEDVAEAVIYVLSTPAHIQIGDIQMRPTEQVT

SEQ ID NO: 812332 - protein, 260 aa, Homo sapiens; identical to SEQ ID NO: 812331

SEQ ID NO: 812333 - protein, 229 aa, Homo sapiens
MARPGMERWRDRLALVTGASGGIGAAVARALVQQGLKVVGCARTVGNIEELAAECKSAGYPGTLIPYRCDLSNEEDILSMFSAIRSQHSGVDICINNAGLARPDTLLSGSTSGWKDMFNVNVLALSICTREAYQSMKERNVDDGHIININSMSGHRVLPLSVTHFYSATKYAVTALTEGLRQELREAQTHIRATCLKPEDVAEAVIYVLSTPAHIQIGDIQMRPTEQVT

SEQ ID NO: 812334 - protein, 255 aa, Homo sapiens [sequence omitted]

SEQ ID NO: 812335 - protein, 181 aa, Homo sapiens; identical to SEQ ID NO: 812328

SEQ ID NO: 812336 - protein, 260 aa, Homo sapiens; identical to SEQ ID NO: 812331

SEQ ID NO: 812337 - protein, 260 aa, Homo sapiens; identical to SEQ ID NO: 812331

SEQ ID NO: 812338 - protein, 260 aa, Homo sapiens; identical to SEQ ID NO: 812331

SEQ ID NO: 812339 - protein, 82 aa, Homo sapiens
FRLHSSSLCGSSWRVGVDVWMPQRSSVVGGNLSPFCPCLNPFPWCSQCLKPEDVAEAVIYVLSTPAHIQIGDIQMRPTEQVT

SEQ ID NO: 812340 - protein, 119 aa, Homo sapiens
MARPGMERWRDRLALVTGASGGIGAAVARALVQQGLKVVGCARTVGNIEELAAECKSAGYPGTLIPYRCDLSNEEDILSMFSAIRSQHSGVDICINNAGLARPDTLLSGSTSGWKDMFN

SEQ ID NO: 812341 - protein, 122 aa, Homo sapiens
WSPWNFILSSFPFLSPPSMSGHRVLPLSVTHFYSATKYAVTALTEGLRQELREAQTHIRATVRLWPSPGGHRVAQALPTHTHRSGSPCSECAAQSSWEWTGHRTGCCCSRHGPMQPFISSFH

SEQ ID NO: 812342 - protein, 104 aa, Homo sapiens
SSATAVLASVKREEERLRPQRLSTEPSSPVVKPSLTLSSCSPPGGRRPDHRSPAALTGGLREPLSPLHPRRLLLGTQETSPREAVTQDPASTSPSSVRRSERRR

SEQ ID NO: 812343 - protein, 104 aa, Homo sapiens; identical to SEQ ID NO: 812342

SEQ ID NO: 812344 - protein, 311 aa, Homo sapiens
WYAPEVMGSDTMQSDDVIWDTLGNKQFCSFKIRTKTQSFCRNEYSLTGLCNRSSCPLANSQYATIKEEKGQCYLYMKVIERAAFPRRLWERVRLSKNYEKALEQIDENLIYWPRFIRHKCKQRFTKITQYLIRIRKLTLKRQRKLVPLSKKVERREKRREEKALIAAQLDNAIEKELLERLKQDTYGDIYNFPIHAFDKALEQQEAESDSSDTEEKDDDDDDEEDVGKREFVEDGEVDESDISDFEDMDKLDASSDEDQDGKSSSEEEEEKALSAKHKGKMPLRGPLRRKRAYVEIEYEQETEPVAKAKTT

SEQ ID NO: 812345 - protein, 311 aa, Homo sapiens; identical to SEQ ID NO: 812344

SEQ ID NO: 812346 - protein, 300 aa, Homo sapiens
MQSDDVIWDTLGNKQFCSFKIRTKTQSFCRNEYSLTGLCNRSSCPLANSQYATIKEEKGQCYLYMKVIERAAFPRRLWERVRLSKNYEKALEQIDENLIYWPRFIRHKCKQRFTKITQYLIRIRKLTLKRQRKLVPLSKKVERREKRREEKALIAAQLDNAIEKELLERLKQDTYGDIYNFPIHAFDKALEQQEAESDSSDTEEKDDDDDDEEDVGKREFVEDGEVDESDISDFEDMDKLDASSDEDQDGKSSSEEEEEKALSAKHKGKMPLRGPLRRKRAYVEIEYEQETEPVAKAKTT

SEQ ID NO: 812347 - protein, 161 aa, Homo sapiens
SLVEPGGKSAEKALIAAQLDNAIEKELLERLKQDTYGDIYNFPIHAFDKALEQQEAESDSSDTEEKDDDDDDEEDVGKREFVEDGEVDESDISDFEDMDKLDASSDEDQDGKSSSEEEEEKALSAKHKGKMPLRGPLRRKRAYVEIEYEQETEPVAKAKTT

SEQ ID NO: 812348 - protein, 289 aa, Homo sapiens
RRRGRRGASGACDLRASRPEVPEGPRWSWGSRALGSAAGKAGAMTLIEGVGDEVTVLFSVLACLLVLALAWVSTHTAEGGDPLPQPSGTPTPSQPSAAMAATDSMRGEAPGAETPSLRHRGQAAQPEPSTGFTATPPAPDSPQEPLVLRLKFLNDSEQVARAWPHDTIGSLKRTQFPGREQQVRLIYQGQLLGDDTQTLGSLHLPPNCVLHCHVSTRVGPPNPPCPPGSEPGPSGLEIGSLLLPLLLLLLLLLWYCQIQYRPFFPLTATLGLAGFTLLLSLLAFAMYRP

SEQ ID NO: 812349 - protein, 246 aa, Homo sapiens
MTLIEGVGDEVTVLFSVLACLLVLALAWVSTHTAEGGDPLPQPSGTPTPSQPSAAMAATDSMRGEAPGAETPSLRHRGQAAQPEPSTGFTATPPAPDSPQEPLVLRLKFLNDSEQVARAWPHDTIGSLKRTQFPGREQQVRLIYQGQLLGDDTQTLGSLHLPPNCVLHCHVSTRVGPPNPPCPPGSEPGPSGLEIGSLLLPLLLLLLLLLWYCQIQYRPFFPLTATLGLAGFTLLLSLLAFAMYRP

SEQ ID NO: 812350 - protein, 246 aa, Homo sapiens; identical to SEQ ID NO: 812349

SEQ ID NO: 812351 - protein, 246 aa, Homo sapiens; identical to SEQ ID NO: 812349

SEQ ID NO: 812352 - protein, 289 aa, Homo sapiens; identical to SEQ ID NO: 812348

SEQ ID NO: 812353 - protein, 246 aa, Homo sapiens; identical to SEQ ID NO: 812349

SEQ ID NO: 812354 - protein, 164 aa, Homo sapiens
MGLGTSWVVPRWSWGSRAEPLVLRLKFLNDSEQVARAWPHDTIGSLKRTQFPGREQQVRLIYQGQLLGDDTQTLGSLHLPPNCVLHCHVSTRVGPPNPPCPPGSEPGPSGLEIGSLLLPLLLLLLLLLWYCQIQYRPFFPLTATLGLAGFTLLLSLLAFAMYRP

SEQ ID NO: 812355 - protein, 199 aa, Homo sapiens
MKTFIIGISGVTNSGKTTLAKNLQKHLPNCSVISQDDFFKPESEIETDKNGFLQYDVLEALNMEKMMSAISCWMESARHSVVSTDQESAEEIPILIIEGFLLFNYKPLDTIWNRSYFLTIPYEECKRRRSTRVYQPPDSPGYFDGHVWPMYLKYRQEMQDITWEVVYLDGTKSEEDLFLQVYEDLIQELAKQKCLQVTA

SEQ ID NO: 812356 - protein, 102 aa, Homo sapiens
PPEQSRARAGPTRKWTPPSRALIGSRAGSFAAAGARAARTAAEPAGAERGRSGRAPVQCRGPRALPIGKGRSCAGARGRGQASRSPAPPRPAPTGAGTRRRE

SEQ ID NO: 812357 - protein, 69 aa, Homo sapiens
MKTFIIGISGVTNSGKTTLAKNLQKHLPNCSVISQDDFFKPESEIETDMDFCSTMCLKHLTWNPDQGAE

SEQ ID NO: 812358 - protein, 203 aa, Homo sapiens
MGKRRHRRGNVISCVTNSGKTTLAKNLQKHLPNCSVISQDDFFKPESEIETDKNGFLQYDVLEALNMEKMMSAISCWMESARHSVVSTDQESAEEIPILIIEGFLLFNYKPLDTIWNRSYFLTIPYEECKRRRSTRVYQPPDSPGYFDGHVWPMYLKYRQEMQDITWEVVYLDGTKSEEDLFLQVYEDLIQELAKQKCLQVTA

SEQ ID NO: 812359 - protein, 203 aa, Homo sapiens; identical to SEQ ID NO: 812358

SEQ ID NO: 812360 - protein, 106 aa, Homo sapiens
MKTFIIGISGVTNSGKTTLAKNLQKHLPNCSVISQDDFFKPESEIETDKNGFLQYDVLEALNMEKMMSAISCWMESARHSVVSTDQESAEEIPILIIEGFLLFNYK

SEQ ID NO: 812361 - protein, 106 aa, Homo sapiens; identical to SEQ ID NO: 812360

SEQ ID NO: 812362 - protein, 203 aa, Homo sapiens; identical to SEQ ID NO: 812358

SEQ ID NO: 812363 - protein, 699 aa, Homo sapiens
MSASASVGGPVPQPPPGPAAALPPGSAARALHVELPSQQRRLRHLRNIAARNIVNRNGHQLLDTYFTLHLCSTEKIYKEFYRSEVIKNSLNPTWRSLDFGIMPDRLDTSVSCFVVKIWGGKENIYQLLIEWKVCLDGLKYLGQQIHARNQNEIIFGLNDGYYGAPFEHKGYSNAQKTILLQVDQNCVRNSYDVFSLLRLHRAQCAIKQTQVTVQKIGKEIEEKLRLTSTSNELKKKSECLQLKILVLQNELERQKKALGREVALLHKQQIALQDKGSAFSAEHLKLQLQKESLNELRKECTAKRELFLKTNAQLTIRCRQLLSELSYIYPIDLNEHKDYFVCGVKLPNSEDFQAKDDGSIAVALGYTAHLVSMISFFLQVPLRYPIIHKGSRSTIKDNINDKLTEKEREFPLYPKGGEKLQFDYGVYLLNKNIAQLRYQHGLGTPDLRQTLPNLKNFMEHGLMVRCDRHHTSSAIPVPKRQSSIFGGADVGFSGGIPSPDKGHRKRASSENERLQYKTPPPSYNSALAQPVTTVPSMGETERKITSLSSSLDTSLDFSKENKKKGEDLVGSLNGGHANVHPSQEQGEALSGHRATVNGTLLPSEQAGSASVQLPGEFHPVSEAELCCTVEQAEEIIGLEATGFASGDQLEAFNCIPVDSAVAVECDEQVLGEFEEFSRRIYALNENVSSFRRPRRSSDK

SEQ ID NO: 812364 - protein, 681 aa, Homo sapiens
MSASASVGGPVPQPPPGPAAALPPGSAARALHVELPSQQRRLRHLRNIAARNIVNRNGHQLLDTYFTLHLCSTEKIYKEFYRSEVIKNSLNPTWRSLDFGIMPDRLDTSVSCFVVKIWGGKENIYQLLIEWKVCLDGLKYLGQQIHARNQNEIIFGLNDGYYGAPFEHKGYSNAQKTILLQVDQNCVRNSYDVFSLLRLHRAQCAIKQTQVTVQKIGKEIEEKLRLTSTSNELKKKSECLQLKILVLQNELERQKKALGREVALLHKQQIALQDKGSAFSAEHLKLQLQKESLNELRKECTAKRELFLKTNAQLTIRCRQLLSELSYIYPIDLNEHKDYFVCGVKLPNSEDFQAKDDGSIAVALGYTAHLVSMISFFLQVPLRYPIIHKGSRSTIKDNINDKLTEKEREFPLYPKGGEKLQFDYGVYLLNKNIAQLRYQHGLGTPDLRQTLPNLKNFMEHGLMVRCDRHHTSSAIPVPKRQSSIFGGADVGFSGGIPSPDKGHRKRASSENERLQYKTPPPSYNSALAQPVTTVPSMGETERKITSLSSSLDTSLDFSKENKNSQEQGEALSGHRATVNGTLLPSEQAGSASVQLPGEFHPVSEAELCCTVEQAEEIIGLEATGFASGDQLEAFNCIPVDSAVAVECDEQVLGEFEEFSRRIYALNENVSSFRRPRRSSDK

SEQ ID NO: 812365 - protein, 699 aa, Homo sapiens; identical to SEQ ID NO: 812363

SEQ ID NO: 812366 - protein, 325 aa, Homo sapiens
MSASASVGGPVPQPPPGPAAALPPGSAARALHVELPSQQRRLRHLRNIAARNIVNRNGHQLLDTYFTLHLCSTEKIYKEFYRSEVIKNSLNPTWRSLDFGIMPDRLDTSVSCFVVKIWGGKENIYQLLIEWKVCLDGLKYLGQQIHARNQNEIIFGLNDGYYGAPFEHKGYSNAQKTILLQVDQNCVRNSYDVFSLLRLHRAQCAIKQTQVTVQKIGKEIEEKLRLTSTSNELKKKSECLQLKILVLQNELERQKKALGREVALLHKQQIALQDKGEWKYHTNSLTSTFSSSPFFFFTSSNSHFLCKYSHTSLNDRDIFWKCILW

SEQ ID NO: 812367 - protein, 699 aa, Homo sapiens; identical to SEQ ID NO: 812363

SEQ ID NO: 812368 - protein, 299 aa, Homo sapiens
MSASASVGGPVPQPPPGPAAALPPGSAARALHVELPSQQRRLRHLRNIAARNIVNRNGHQLLDTYFTLHLCSTEKIYKEFYRSEVIKNSLNPTWRSLDFGIMPDRLDTSVSCFVVKIWGGKENIYQLLIEWKVCLDGLKYLGQQIHARNQNEIIFGLNDGYYGAPFEHKGYSNAQKTILLQVDQNCVRNSYDVFSLLRLHRAQCAIKQTQVTVQKIGKEIEEKLRLTSTSNELKKKSECLQLKILVLQNELERQKKALGREVALLHKQQIALQDKASINYLHIYVGSPCLLSPVRSISG

SEQ ID NO: 812369 - protein, 205 aa, Homo sapiens
MSASASVGGPVPQPPPGPAAALPPGSAARALHVELPSQQRRLRHLRNIAARNIVNRNGHQLLDTYFTLHLCSTEKIYKEFYRSEVIKNSLNPTWRSLDFGIMPDRLDTSVSCFVVKIWGGKENIYQLLIEWKVCLDGLKYLGQQIHARNQNEIIFGLNDGYYGAPFEHKGYSNAQKTILLQVDQNCVRNSYDVFSLLRNILLLPV

SEQ ID NO: 812370 - protein, 707 aa, Homo sapiens
HKAVEIEQERVKSAGAWIIHPYSDFRFYWDLIMLLLMVGNLIVLPVGITFFKEENSPPWIVFNVLSDTFFLLDLVLNFRTGIVVEEGAEILLAPRAIRTRYLRTWFLVDLISSIPVDYIFLVVELEPRLDAEVYKTARALRIVRFTKILSLLRLLRLSRLIRYIHQWEEIFHMTYDLASAVVRIFNLIGMMLLLCHWDGCLQFLVPMLQDFPPDCWVSINHMVNHSWGRQYSHALFKAMSHMLCIGYGQQAPVGMPDVWLTMLSMIVGATCYAMFIGHATALIQSLDSSRRQYQEKYKQVEQYMSFHKLPADTRQRIHEYYEHRYQGKMFDEESILGELSEPLREEIINFTCRGLVAHMPLFAHADPSFVTAVLTKLRFEVFQPGDLVVREGSVGRKMYFIQHGLLSVLARGARDTRLTDGSYFGEICLLTRGRRTASVRADTYCRLYSLSVDHFNAVLEEFPMMRRAFETVAMDRLLRIGKKNSILQRKRSEPSPGSSGGIMEQHLVQHDRDMARGVRGRAPSTGAQLSGKPVLWEPLVHAPLQAAAVTSNVAIALTHQRGPLPLSPDSPATLLARSAWRSAGSPASPLVPVRAGPWASTSRLPAPPARTLHASLSRAGRSQVSLLGPPPGGGGRRLGPRGRPLSASQPSLPQRATGDGSPGRKGSGSERLPPSGLLAKPPRTAQPPRPPVPEPATPRGLQLSANM

SEQ ID NO: 812371 - protein, 94 aa, Homo sapiens
LVVREGSVGRKMYFIQHGLLSVLARGARDTRLTDGSYFGGQQASGRVAGSRADSGEGNCSQALGPCLSTLQNHRAPAPPQAYSVRISGLGSGAL

SEQ ID NO: 812372 - protein, 63 aa, Homo sapiens
MPGLVDSNPAPPESQEKKPLKPCCACPETKKARDACIIEKGEEHCGHLIEAHKECMRALGFKI

SEQ ID NO: 812373 - protein, 63 aa, Homo sapiens; identical to SEQ ID NO: 812372

SEQ ID NO: 812374 - protein, 63 aa, Homo sapiens; identical to SEQ ID NO: 812372

SEQ ID NO: 812375 - protein, 199 aa, Homo sapiens
MSIVTVQLGQCGNQIGFEVFDALLSDSHSSQGLCSMRENEAYQASCKERFFSEEENGGIDRHVWPPLSGLPPLSKMSLNKDLHFNTSIANLVILRGKDVQSADVEGFKDPALYTSWLKPVNAFNVWKTQRAFSKYEKSAVLVSNSQFLVKPLDMIVGKAWNMFASKAYIHQYTKFGIEEEDFLDSFTSLEQVVASYCNL

SEQ ID NO: 812376 - protein, 453 aa, Homo sapiens
MSIVTVQLGQCGNQIGFEVFDALLSDSHSSQGLCSMRENEAYQASCKERFFSEEENGVPIARAVLVDMEPKVINQMLSKAAQSGQWKYGQHACFCQKQGSGNNWAYGYSVHGPRHEESIMNIIRKEVEKCDSFSGFFIIMSMAGGTGSGLGAFVTQNLEDQYSNSLKMNQIIWPYGTGEVIVQNYNSILTLSHLYRSSDALLLHENDAIHKICAKLMNIKQISFSDINQVLAHQLGSVFQPTYSAESSFHYRRNPLGRLMEHLVPHPEFKMLSVRNIPHMSENSLAYTTFTWAGLLKHLRQMLISNAKMEEGIDRHVWPPLSGLPPLSKMSLNKDLHFNTSIANLVILRGKDVQSADVEGFKDPALYTSWLKPVNAFNVWKTQRAFSKYEKSAVLVSNSQFLVKPLDMIVGKAWNMFASKAYIHQYTKFGIEEEDFLDSFTSLEQVVASYCNL

SEQ ID NO: 812377 - protein, 398 aa, Homo sapiens
MSIVTVQLGQCGNQIGFEVFDALLSDSHSSQGLCSMRENEAYQASCKERFFSEEENGVPIARAVLVDMEPKVINQMLSKAAQSGQWKYGQHACFCQKQGSGNNWAYGYSVHGPRHEESIMNIIRKEVEKCDSFSGFFIIMSMAGGTGSGLGAFVTQNLEDQYSNSLKMNQIIWPYGTGEVIVQNYNSILTLSHLYRSSDALLLHENDAIHKICAKLMNIKQISFSDINQVLAHQLGSVFQPTYSAESSFHYRRNPLGIDRHVWPPLSGLPPLSKMSLNKDLHFNTSIANLVILRGKDVQSADVEGFKDPALYTSWLKPVNAFNVWKTQRAFSKYEKSAVLVSNSQFLVKPLDMIVGKAWNMFASKAYIHQYTKFGIEEEDFLDSFTSLEQVVASYCNL

SEQ ID NO: 812378 - protein, 398 aa, Homo sapiens; identical to SEQ ID NO: 812377

SEQ ID NO: 812379 - protein, 163 aa, Homo sapiens
MRHIKHLAKKDSSVRRRMEFQLPGLFLLTWNPKLSIKCCQRLPSLANGNMVNMHASVKNKVLETTGHMEGFKDPALYTSWLKPVNAFNVWKTQRAFSKYEKSAVLVSNSQFLVKPLDMIVGKAWNMFASKAYIHQYTKFGIEEEDFLDSFTSLEQVVASYCNL

SEQ ID NO: 812380 - protein, 453 aa, Homo sapiens; identical to SEQ ID NO: 812376

SEQ ID NO: 812381 - protein, 131 aa, Homo sapiens
MRQLENAGQHHTLQFTLPSSCANWNHPLAVLRNGPQCCCGCVKSPFILKSSLLPLDYFNTVISLFASRKGTNVPIPLFCCVPLAQRSKAVRGWAETWEESPSPIHSTQRQCTQRNDMEIDAGRLVPAVINE

SEQ ID NO: 812382 - protein, 131 aa, Homo sapiens; identical to SEQ ID NO: 812381

SEQ ID NO: 812383 - protein, 231 aa, Homo sapiens
RGPVAKRLGGGPRSRSASGRDPAYLEAAGGVLLVALTHPVRVYLQGHLVVASSDLAVGGLASHAQHPVKVGGAEHFLAKVQQPHAGRRYDPGGSSRSQLRGYNPGLLLFRAQKAQGACVTSTEGAWPRRASALYGGRKMRCGESGAGPDPRSNSAEVSSSQPALASKSQSKWGPTSNNPRGALTTTEFEMAGNRSQNIKHKQTALIAIPMSSQTPRMLGRPRNQGQLYPQP

SEQ ID NO: 812384 - protein, 259 aa, Homo sapiens
RGPVAKRLGGGPRSRSASGRDPAYLEAAGGVLLVALTHPVRVYLQGHLVVASSDLAVGGLASHAQHPVKVGGAEHFLAKVQQPHAGRRYDPGGSSRSQLRGYNPGLLLFRAQKAQGACVTSTEGAWPRRASALYGGRKMRCGESGAGPDPRSNSAEVSSSQPALASKSQSKWGPTSNNPRGALTTTEFEMAGNRSQNIKHKRSHQDIYKPWSFRCKVGNPQELTLMCASFSDFSTHSGLSDTFIVFFLYIVHPFLEVKI

SEQ ID NO: 812385 - protein, 399 aa, Homo sapiens
MSSKYPRSVRRCLPLWALTLEAALILLFYFFTHYDASLEDQKGLVASYQVGQDLTVMAALGLGFLTSSFRRHSWSSVAFNLFMLALGVQWAILLDGFLSQFPPGKVVITLFSIRLATMSAMSVLISAGAVLGKVNLAQLVVMVLVEVTALGTLRMVISNIFNTDYHMNMMHIYVFAAYFGLSVAWCLPKPLPEGTEDKDQRATIPSLSAMLGALFLWMFWPSVNSALLRSPIERKNAVFNTYYAVAVSVVTAISGSSLAHPQRKISKTYVHSAVLAGGVAVGTSCHLIPSPWLAMVLGLVAGLISIGGAKYLPVCCNRVLGIHHISVMHSIFSLLGLLGEITYIVLLVLHTVWRRQWHDWLPGPPQHWGTQLGHRDSSHVWSPDRFAPKSQNMESTSCG

SEQ ID NO: 812386 - protein, 256 aa, Homo sapiens
MSSKYPRSVRRCLPLWALTLEAALILLFYFFTHYDASLEDQKGLVASYQVGQDLTVMAALGLGFLTSSFRRHSWSSVAFNLFMLALGVQWAILLDGFLSQFPPGKVVITLFSIRLATMSAMSVLISAGAVLGKVNLAQLVVMVLVEVTALGTLRMVISNIFNTYVHSAVLAGGVAVGTSCHLIPSPWLAMVLGLVAGLISIGGAKYLPVCCNRVLGIHHISVMHSIFSLLGLLGEITYIVLLVLHTVWRRQWHVCS

SEQ ID NO: 812387 - protein, 248 aa, Homo sapiens
MSSKYPRSVRRCLPLWALTLEAALILLFYFFTHYDASLEDQKGLVASYQVGQDLTVMAALGLGFLTSSFRRHSWSSVAFNLFMLALGVQWAILLDGFLSQFPPGKVVITLFSIRLATMSAMSVLISAGAVLGKVNLAQLVVMVLVEVTALGTLRMVISNIFNVCCNRVLGIHHISVMHSIFSLLGLLGEITYIVLLVLHTVWRRQWHDWLPGPPQHWGTQLGHRDSSHVWSPDRFAPKSQNMESTSCG

SEQ ID NO: 812388 - protein, 186 aa, Homo sapiens
PAPIQSLRLTLRHTHHAIMQGRIGFQVLLSIGELSLAIVIALTSGLLTGLLLNLKIWKAPHVAKYFDDQVFWKSRSLIMALRQIIPTLIPEIPQTSGHIHNQLSIPSPVALRSCTDRQRSMTTTRLTYHLLNPPRNLTHPHHHNDDRLPSQPSSPLVCTRPPLRQTSRATIHFRLLRRRVLTPEPP

SEQ ID NO: 812389 - protein, 196 aa, Homo sapiens
ACAAVRPGLHVHRLGSAVGPAGAESAGPARALPRSIGLRAGPGRTGSLLGGSGLLQGGDAGPATLHASYSLSADFMPGTVLDLPVPGRENPFCFEGHPELVTVGTHPPFPGYARGWEVCMLSINPEPEVGQDLTVMAALGLGFLTSSFRRHSWSSVAFNLFMLALGVQWAILLDGFLSQFPPGKVVITLFRYWDGG

SEQ ID NO: 812390 - protein, 399 aa, Homo sapiens; identical to SEQ ID NO: 812385

SEQ ID NO: 812391 - protein, 354 aa, Homo sapiens
MSSKYPRSVRRCLPLWALTLEAALILLFYFFTHYDASLEDQKGLVASYQVGQDLTVMAALGLGFLTSSFRRHSWSSVAFNLFMLALGVQWAILLDGFLSQFPPGKVVITLFSIRLATMSAMSVLISAGAVLGKVNLAQLVVMVLVEVTALGTLRMVISNIFNTDYHMNMMHIYVFAAYFGLSVAWCLPKPLPEGTEDKDQRATIPSLSAMLGALFLWMFWPSVNSALLRSPIERKNAVFNTYYAVAVSVVTAISGSSLAHPQRKISKTYVHSAVLAGGVAVGTSCHLIPSPWLAMVLGLVAGLISIGGAKYLPDWLPGPPQHWGTQLGHRDSSHVWSPDRFAPKSQNMESTSCG

SEQ ID NO: 812392 - protein, 36 aa, Homo sapiens
MMHIYVFAAYFGLSVAWCLPKPLPEGTEDKDQRATI

SEQ ID NO: 812393 - protein, 122 aa, Homo sapiens
RGSGRAAGDGGAGRANGRWVAGGRAWRPGALGRGAGGRPDRLTCELHRGRRMAGMALARAWKQMSWFYYQYLLVTALYMLEPWERTVFNSMLVSIVGMALYTGYVFMPQHIMAILHYFEIVQ

SEQ ID NO: 812394 - protein, 122 aa, Homo sapiens; identical to SEQ ID NO: 812393

SEQ ID NO: 812395 - protein, 122 aa, Homo sapiens; identical to SEQ ID NO: 812393

SEQ ID NO: 812396 - protein, 122 aa, Homo sapiens; identical to SEQ ID NO: 812393

SEQ ID NO: 812397 - protein, 122 aa, Homo sapiens; identical to SEQ ID NO: 812393

SEQ ID NO: 812398 - protein, 122 aa, Homo sapiens; identical to SEQ ID NO: 812393

SEQ ID NO: 812399 - protein, 121 aa, Homo sapiens
MTSVFLNQSCTQHSSQQLLRGMLRKPQGRTFPAVAEPEQPGPEKALSCGRITAKQESFSFCKAGTEGSSLNVVICISAQESCWLKSRVSFLIPEVDEQPRHHKEEQAQHEAPDSTQHSSQQ

SEQ ID NO: 812400 - protein, 1015 aa, Homo sapiens
MYVSSEHKGRRVTALCWDTAILRVFVGDHAGKVSAIKLNTSKQAKAAAAFVMFPVQTITTVDSCVVQLDYLDGRLLISSLTRSFLCDTEREKFWKIGNKERDGEYGACFFPGRCSGGQQPLIYCARPGSRMWEVNFDGEVISTHQFKKLLSLPPLPVITLRSEPQYDHTAGSSQSLSFPKLLHLSEHCVLTWTERGIYIFIPQNVQVLLWSEVKDIQDVAVCRNELFCLHLNGKVSHLSLISVERCVERLLRRGLWNLAARTCCLFQNSVIASRARKTLTADKLEHLKSQLDHGTYNDLISQLEELILKFEPLDSACSSRRSSISSHESFSILDSGIYRIISSRRGSQSDEDSCSLHSQTLSEDERFKEFTSQQEEDLPDQCCGSHGNEDNVSHAPVMFETDKNETFLPFGIPLPFRSPSPLVSLQAVKESVSSFVRKTTEKIGTLHTSPDLKVRPELRGDEQSCEEDVSSDTCPKEEDTEEEKEVTSPPPEEDRFQELKVATAEAMTKLQDPLVLFESESLRMVLQEWLSHLEKTFAMKDFSGVSDTDNSSMKLNQDVLLVNESKKGILDEDNEKEKRDSLGNEESVDKTACECVRSPRESLDDLFQICSPCAIASGLRNDLAELTTLCLELNVLNSKIKSTSGHVDHTLQQYSPEILACQFLKKYFFLLNLKRAKESIKLSYSNSPSVWDTFIEGLKEMASSNPVYMEMEKGDLPTRLKLLDDEVPFDSPLLVVYATRLYEKFGESALRSLIKFFPSILPSDIIQLCHHHPAEFLAYLDSLVKSRPEDQRSSFLESLLQPESLRLDWLLLAVSLDAPPSTSTMDDEGYPRPHSHLLSWGYSQLILHLIKLPADFITKEKMTDICRSCGFWPGYLILCLELERRREAFTNIVYLNDMSLMEGDNGWIPETVEEWKLLLHLIQSKSTRPAPQESLNGSLSDGPSPINVENVALLLAKAMGPDRAWSLLQECGLALELSEKFTRTCDILRIAEKRQRALIQSMLEKCDRFLWSQQA

SEQ ID NO: 812401 - protein, 1015 aa, Homo sapiens; identical to SEQ ID NO: 812400

SEQ ID NO: 812402 - protein, 1129 aa, Homo sapiens
MAFVPVIPESYSHVLAEFESLDPLLSALRLDSSRLKCTSIAVSRKWLALGSSGGGLHLIQKEGWKHRLFLSHREGAISQVACCLHDDDYVAVATSQGLVVVWELNQERRGKPEQMYVSSEHKGRRVTALCWDTAILRVFVGDHAGKVSAIKLNTSKQAKAAAAFVMFPVQTITTVDSCVVQLDYLDGRLLISSLTRSFLCDTEREKFWKIGNKERDGEYGACFFPGRCSGGQQPLIYCARPGSRMWEVNFDGEVISTHQFKKLLSLPPLPVITLRSEPQYDHTAGSSQSLSFPKLLHLSEHCVLTWTERGIYIFIPQNVQVLLWSEVKDIQDVAVCRNELFCLHLNGKVSHLSLISVERCVERLLRRGLWNLAARTCCLFQNSVIASRARKTLTADKLEHLKSQLDHGTYNDLISQLEELILKFEPLDSACSSRRSSISSHESFSILDSGIYRIISSRRGSQSDEDSCSLHSQTLSEDERFKEFTSQQEEDLPDQCCGSHGNEDNVSHAPVMFETDKNETFLPFGIPLPFRSPSPLVSLQAVKESVSSFVRKTTEKIGTLHTSPDLKVRPELRGDEQSCEEDVSSDTCPKEEDTEEEKEVTSPPPEEDRFQELKVATAEAMTKLQDPLVLFESESLRMVLQEWLSHLEKTFAMKDFSGVSDTDNSSMKLNQDVLLVNESKKGILDEDNEKEKRDSLGNEESVDKTACECVRSPRESLDDLFQICSPCAIASGLRNDLAELTTLCLELNVLNSKIKSTSGHVDHTLQQYSPEILACQFLKKYFFLLNLKRAKESIKLSYSNSPSVWDTFIEGLKEMASSNPVYMEMEKGDLPTRLKLLDDEVPFDSPLLVVYATRLYEKFGESALRSLIKFFPSILPSDIIQLCHHHPAEFLAYLDSLVKSRPEDQRSSFLESLLQPESLRLDWLLLAVSLDAPPSTSTMDDEGYPRPHSHLLSWGYSQLILHLIKLPADFITKEKMTDICRSCGFWPGYLILCLELERRREAFTNIVYLNDMSLMEGDNGWIPETVEEWKLLLHLIQSKSTRPAPQESLNGSLSDGPSPINVENVALLLAKAMGPDRAWSLLQECGLALELSEKFTRTCDILRIAEKRQRALIQSMLEKCDRFLWSQQA

SEQ ID NO: 812403 - protein, 1129 aa, Homo sapiens; identical to SEQ ID NO: 812402

SEQ ID NO: 812404 - protein, 1015 aa, Homo sapiens; identical to SEQ ID NO: 812400

SEQ ID NO: 812405 - protein, 1178 aa, Homo sapiens
GSPGLHEFGTRETEVHVPLLVRGEFPGAKPGDKIRSTESCEVLPWMWWSWAGTSGLLVCEPGFENWLLGLLSRNLKILKLLLLKSCTSIAVSRKWLALGSSGGGLHLIQKEGWKHRLFLSHREGAISQVACCLHDDDYVAVATSQGLVVVWELNQERRGKPEQMYVSSEHKGRRVTALCWDTAILRVFVGDHAGKVSAIKLNTSKQAKAAAAFVMFPVQTITTVDSCVVQLDYLDGRLLISSLTRSFLCDTEREKFWKIGNKERDGEYGACFFPGRCSGGQQPLIYCARPGSRMWEVNFDGEVISTHQFKKLLSLPPLPVITLRSEPQYDHTAGSSQSLSFPKLLHLSEHCVLTWTERGIYIFIPQNVQVLLWSEVKDIQDVAVCRNELFCLHLNGKVSHLSLISVERCVERLLRRGLWNLAARTCCLFQNSVIASRARKTLTADKLEHLKSQLDHGTYNDLISQLEELILKFEPLDSACSSRRSSISSHESFSILDSGIYRIISSRRGSQSDEDSCSLHSQTLSEDERFKEFTSQQEEDLPDQCCGSHGNEDNVSHAPVMFETDKNETFLPFGIPLPFRSPSPLVSLQAVKESVSSFVRKTTEKIGTLHTSPDLKVRPELRGDEQSCEEDVSSDTCPKEEDTEEEKEVTSPPPEEDRFQELKVATAEAMTKLQDPLVLFESESLRMVLQEWLSHLEKTFAMKDFSGVSDTDNSSMKLNQDVLLVNESKKGILDEDNEKEKRDSLGNEESVDKTACECVRSPRESLDDLFQICSPCAIASGLRNDLAELTTLCLELNVLNSKIKSTSGHVDHTLQQYSPEILACQFLKKYFFLLNLKRAKESIKLSYSNSPSVWDTFIEGLKEMASSNPVYMEMEKGDLPTRLKLLDDEVPFDSPLLVVYATRLYEKFGESALRSLIKFFPSILPSDIIQLCHHHPAEFLAYLDSLVKSRPEDQRSSFLESLLQPESLRLDWLLLAVSLDAPPSTSTMDDEGYPRPHSHLLSWGYSQLILHLIKLPADFITKEKMTDICRSCGFWPGYLILCLELERRREAFTNIVYLNDMSLMEGDNGWIPETVEEWKLLLHLIQSKSTRPAPQESLNGSLSDGPSPINVENVALLLAKAMGPDRAWSLLQECGLALELSEKFTRTCDILRIAEKRQRALIQSMLEKCDRFLWSQQA

SEQ ID NO: 812406 - protein, 669 aa, Homo sapiens
GSPGLHEFGTRETEVHVPLLVRGEFPGAKPGDKIRSTESCEVLPWMWWSWAGTSGLLVCEPGFENWLLGLLSRNLKILKLLLLKSVSSFVRKTTEKIGTLHTSPDLKVRPELRGDEQSCEEDVSSDTCPKEEDTEEEKEVTSPPPEEDRFQELKVATAEAMTKLQDPLVLFESESLRMVLQEWLSHLEKTFAMKDFSGVSDTDNSSMKLNQDVLLVNESKKGILDEDNEKEKRDSLGNEESVDKTACECVRSPRESLDDLFQICSPCAIASGLRNDLAELTTLCLELNVLNSKIKSTSGHVDHTLQQYSPEILACQFLKKYFFLLNLKRAKESIKLSYSNSPSVWDTFIEGLKEMASSNPVYMEMEKGDLPTRLKLLDDEVPFDSPLLVVYATRLYEKFGESALRSLIKFFPSILPSDIIQLCHHHPAEFLAYLDSLVKSRPEDQRSSFLESLLQPESLRLDWLLLAVSLDAPPSTSTMDDEGYPRPHSHLLSWGYSQLILHLIKLPADFITKEKMTDICRSCGFWPGYLILCLELERRREAFTNIVYLNDMSLMEGDNGWIPETVEEWKLLLHLIQSKSTRPAPQESLNGSLSDGPSPINVENVALLLAKAMGPDRAWSLLQECGLALELSEKFTRTCDILRIAEKRQRALIQSMLEKCDRFLWSQQA

SEQ ID NO: 812407 - protein, 645 aa, Homo sapiens
MAFVPVIPESYSHVLAEFESLDPLLSALRLDSSRLKCTSIAVSRKWLALGSSGGGLHLIQKEGWKHRLFLSHREGAISQVACCLHDDDYVAVATSQGLVVVWELNQERRGKPEQMYVSSEHKGRRVTALCWDTAILRVFVGDHAGKVSAIKLNTSKQAKAAAAFVMFPVQTITTVDSCVVQLDYLDGRLLISSLTRSFLCDTEREKFWKIGNKERDGEYGACFFPGRCSGGQQPLIYCARPGSRMWEVNFDGEVISTHQFKKLLSLPPLPVITLRSEPQYDHTAGSSQSLSFPKLLHLSEHCVLTWTERGIYIFIPQNVQVLLWSEVKDIQDVAVCRNELFCLHLNGKVSHLSLISVERCVERLLRRGLWNLAARTCCLFQNSVIASRARKTLTADKLEHLKSQLDHGTYNDLISQLEELILKFEPLDSACSSRRSSISSHESFSILDSGIYRIISSRRGSQSDEDSCSLHSQTLSEDERFKEFTSQQEEDLPDQCCGSHGNEDNVSHAPVMFETDKNETFLPFGIPLPFRSPSPLVSLQAVKESVSSFVRKTTEKIGTLHTSPDLKVRPELRGDEQSCEEDVSSDTCPKEEDTEEEKEVTSPPPEEDRFQELKVATAEAINGKFQSCVYGDGKRRSTNKVKVTR

SEQ ID NO: 812408 - protein, 236 aa, Homo sapiens [sequence omitted]

SEQ ID NO: 812409 - protein, 1129 aa, Homo sapiens; identical to SEQ ID NO: 812402

SEQ ID NO: 812410 - protein, 1045 aa, Homo sapiens
MAFVPVIPESYSHVLAEFESLDPLLSALRLDSSRLKCTSIAVSRKWLALGSSGGGLHLIQKEGWKHRLFLSHREGAISQVACCLHDDDYVAVATSQGLVVVWELNQERRGKPEQMYVSSEHKGRRVTALCWDTAILRVFVGDHAGKVSAIKLNTSKQAKAAAAFVMFPVQTITTVDSCVVQLDYLDGRLLISSLTRSFLCDTEREKFWKIGNKERDGEYGACFFPGRCSGGQQPLIYCARPGSRMWEVNFDGEVISTHQFKKLLSLPPLPVITLRSEPQYDHTAGSSQSLSFPKLLHLSEHCVLTWTERGIYIFIPQNVQVLLWSEVKDIQDVAVCRNELFCLHLNGKVSHLSLISVERCVERLLRRGLWNLAARTCCLFQNSVIASRARKTLTADKLEHLKSQLDHGTYNDLISQLEELILKFEPLDSACSSRRSSISSHESFSILDSGIYRIISSRRGSQSDEDSCSLHSQTLSEDERFKEFTSQQEEDLPDQCCGSHGNEDNVSHAPVMFETDKNETFLPFGIPLPFRSPSPLVSLQAVKESVSSFVRKTTEKIGTLHTSPDLKVRPELRGDEQSCEEDVSSDTCPKEEDTEEEKEVTSPPPEEDRFQELKVATAEAMTKLQDPLVLFESESLRMVLQEWLSHLEKTFAMKDFSGVSDTDNSSMKLNQDVLLVNESKKGILDEDNEKEKRDSLGNEESVDKTACECVRSPRESLDDLFQICSPCAIASGLRNDLAELTTLCLELNVLNSKIKSTSGHVDHTLQQYSPEILACQFLKKYFFLLNLKRAKESIKLSYSNSPSVWDTFIEGLKEMASSNPVYMEMEKGDLPTRLKLLDDEVPFDSPLLVVYATRLYEKFGESALRSLIKFFPSILPSDIIQLCHHHPAEFLAYLDSLVKSRPEDQRSSFLESLLQPESLRLDWLLLAVSLDAPPSTSTMDDEGYPRPHSHLLSWGYSQLILHLIKLPADFITKEKMTDICRSCGFWPGYLILCLELERRREAFTNIVYLNDMSLMEGDNGMSILTGYSWLSIFRSYSRPLNKKIW

SEQ ID NO: 812411 - protein, 134 aa, Homo sapiens
GSPGLHEFGTRETEVHVPLLVRGEFPGAKPGDKIRSTESCEVLPWMWWSWAGTSGLLVCEPGFENWLLGLLSRNLKILKLLLLKRLHEHSCVSEMVGFGQFRRRTPSHSERRLEAQAFSFTQGRCNFSSRLLFT

SEQ ID NO: 812412 - protein, 67 aa, Homo sapiens
CCALLAGFLAIVATALETLHQNSITQVSIYEVDKQDCRKFCTTGIDGAMTIWDFKTLESSIQGLRIM

SEQ ID NO: 812413 - protein, 215 aa, Homo sapiens
FRDLSAAPSGLPSSARARRSLFASTAQSPRILRSEPVRTPPIPAFSPLKTLRIMSLHQFLLEPITCHAWNRDRTQIALSPNNHEVHIYKKNGSQWVKAHELKEHNGHITATIPQAVIFFLRGGEKKKGPPRFFLGGGGWGPSPPKGRARGKPPGAYVVQLWLGGGRPQCGPYVWSQKDGVRKPTLVILRINPAPGGPKGLLTLFFFGLEKLGSPR

SEQ ID NO: 812414 - protein, 423 aa, Homo sapiens
FRDLSAAPSGLPSSARARRSLFASTAQSPRILRSEPVRTPPIPAFSPLKTLRIMSLHQFLLEPITCHAWNRDRTQIALSPNNHEVHIYKKNGSQWVKAHELKEHNGHITGIDWAPKSDRIVTCGADRNAYVWSQKDGVWKPTLVILRINRAATFVKWSPLENKFAVGSGARLISVCYFESENDWWVSKHIKKPIRSTVLSLDWHPNNVLLAAGSCDFKCRVFSAYIKEVDEKPASTPWGSKMPFGQLMSEFGGSGTGGWVHGVSFSASGSRLAWVSHDSTVSVADASKSVQVSTLKTEFLPLLSVSFVSENSVVAAGHDCCPMLFNYDDRGCLTFVSKLDIPKQSIQRNMSAMERFRNMDKRATTEDRNTALETLHQNSITQVSIYEVDKQDCRKFCTTGIDGAMTIWDFKTLESSIQGLRIM

SEQ ID NO: 812415 - protein, 423 aa, Homo sapiens; identical to SEQ ID NO: 812414

SEQ ID NO: 812416 - protein, 423 aa, Homo sapiens; identical to SEQ ID NO: 812414

SEQ ID NO: 812417 - protein, 423 aa, Homo sapiens; identical to SEQ ID NO: 812414

SEQ ID NO: 812418 - protein, 423 aa, Homo sapiens; identical to SEQ ID NO: 812414

SEQ ID NO: 812419 - protein, 423 aa, Homo sapiens; identical to SEQ ID NO: 812414

SEQ ID NO: 812420 - protein, 423 aa, Homo sapiens; identical to SEQ ID NO: 812414

SEQ ID NO: 812421 - protein, 429 aa, Homo sapiens
FRDLSAAPSGLPSSARARRSLFASTAQSPRILRSEPVRTPPIPAFSPLKTLRIMSLHQFLLEPITCHAWNRDRTQIALSPNNHEVHIYKKNGSQWVKAHELKEHNGHITGIDWAPKSDRIVTCGADRNAYVWSQKDGVWKPTLVILRINRAATFVKWSPLENKFAVGSGARLISVCYFESENDWWVSKHIKKPIRSTVLSLDWHPNNVLLAAGSCDFKCRVFSAYIKEVDEKPASTPWGSKMPFGQLMSEFGGSGTGGWVHGVSFSASGSRLAWVSHDSTVSVADASKSVQVSTLKTEFLPLLSVSFVSENSVVAAGHDCCPMLFNYDDRGCLTFVSKLDIPKQSIQRNMSAMERFRNMDKRATTEDRNTALETLHQNSITQVSIYEVDKQDCRKFCTTGIDGAMTIWDFKTSSLPIQGLPDNTFARYR

SEQ ID NO: 812422 - protein, 385 aa, Homo sapiens
FRDLSAAPSGLPSSARARRSLFASTAQSPRILRSEPVRTPPIPAFSPLKTLRIMSLHQFLLEPITCHAWNRDRTQIALSPNNHEVHIYKKNGSQWVKAHELKEHNGHITGIDWAPKSDRIVTCGADRNAYVWSQKDGVWKPTLVILRINRAATFVKWSPLENKFAVGSGARLISVCYFESENDWWVSKHIKKPIRSTVLSLDWHPNNVLLAAGSCDFKCRVFSAYIKEVDEKPASTPWGSKMPFGQLMSEFGGSGTGGWVHGVSFSASGSRLAWVSHDSTVSVADASKSVQVSTLKTEFLPLLSVSFVSENSVVAAGHDCCPMLFNYDDRGCLTFVSKLDIPKQSIQRNMSAMERFRNMDKRATTEDRNTALETLHQNSITLCLY

SEQ ID NO: 812423 - protein, 409 aa, Homo sapiens
FRDLSAAPSGLPSSARARRSLFASTAQSPRILRSEPVRTPPIPAFSPLKTLRIMSLHQFLLEPITCHAWNRDRTQIALSPNNHEVHIYKKNGSQWVKAHELKEHNGHITGIDWAPKSDRIVTCGADRNAYVWSQKDGVWKPTLVILRINRAATFVKWSPLENKFAVGSGARLISVCYFESENDWWVSKHIKKPIRSTVLSLDWHPNNVLLAAGSCDFKCRVFSAYIKEVDEKPASTPWGSKMPFGQLMSEFGGSGTGGWVHGVSFSASGSRLAWVSHDSTVSVADASKSVQVSTLKTEFLPLLSVSFVSENSVVAAGHDCCPMLFNYDDRGCLTFVSKLDIPKQSIQRNMSAMERFRNMDKRATTEDRNTALETLHQNSITCRLQGSSQQEQCRPCCNLRWWGLRAAAS

SEQ ID NO: 812424 - protein, 182 aa, Homo sapiens
MPFGQLMSEFGGSGTGGWVHGVSFSASGSRLAWVSHDSTVSVADASKSVQVSTLKTEFLPLLSVSFVSENSVVAAGHDCCPMLFNYDDRGCLTFVSKLDIPKQSIQRNMSAMERFRNMDKRATTEDRNTALETLHQNSITQVSIYEVDKQDCRKFCTTGIDGAMTIWDFKTLESSIQGLRIM

SEQ ID NO: 812425 - protein, 182 aa, Homo sapiens; identical to SEQ ID NO: 812424

SEQ ID NO: 812426 - protein, 182 aa, Homo sapiens; identical to SEQ ID NO: 812424

SEQ ID NO: 812427 - protein, 352 aa, Homo sapiens
FRDLSAAPSGLPSSARARRSLFASTAQSPRILRSEPVRTPPIPAFSPLKTLRIMSLHQFLLEPITCHAWNRDRTQIALSPNNHEVHIYKKNGSQWVKAHELKEHNGHITGIDWAPKSDRIVTCGADRNAYVWSQKDGVWKPTLVILRINRAATFVKWSPLENKFAVGSGARLISVCYFESENDWWVSKHIKKPIRSTVLSLDWHPNNVLLAAGSCDFKCRVSTLKTEFLPLLSVSFVSENSVVAAGHDCCPMLFNYDDRGCLTFVSKLDIPKQSIQRNMSAMERFRNMDKRATTEDRNTALETLHQNSITQVSIYEVDKQDCRKFCTTGIDGAMTIWDFKTLESSIQGLRIM

SEQ ID NO: 812428 - protein, 291 aa, Homo sapiens
FRDLSAAPSGLPSSARARRSLFASTAQSPRILRSEPVRTPPIPAFSPLKTLRIMSLHQFLLEPITCHAWNRDRTQIALSPNNHEVHIYKKNGSQWVKAHELKEHNGHITGIDWAPKSDRIVTCGADRNAYVWSQKDGVWKPTLVILRINRAATFVKWSPLENKFAVGSGARLISVCYFESENDWWVSKHIKKPIRSTVLSLDWHPNNVLLAAGSCDFKCRVFSAYIKEVDEKPASTPWGSKMPFGQLMSEFGGSGTGGWVHGVSFSASGSRLAWVSHDSTVSVADASKSVQ

SEQ ID NO: 812429 - protein, 178 aa, Homo sapiens
MGAAWQRSLPRWSQPPVPLVSASGSRLAWVSHDSTVSVADASKSVQVSTLKTEFLPLLSVSFVSENSVVAAGHDCCPMLFNYDDRGCLTFVSKLDIPKQSIQRNMSAMERFRNMDKRATTEDRNTALETLHQNSITQVSIYEVDKQDCRKFCTTGIDGAMTIWDFKTLESSIQGLRIM

SEQ ID NO: 812430 - protein, 118 aa, Homo sapiens
MLILPVDEVTVGHDCCPMLFNYDDRGCLTFVSKLDIPKQSIQRNMSAMERFRNMDKRATTEDRNTALETLHQNSITQVSIYEVDKQDCRKFCTTGIDGAMTIWDFKTLESSIQGLRIM

SEQ ID NO: 812431 - protein, 282 aa, Homo sapiens
FRDLSAAPSGLPSSARARRSLFASTAQSPRILRSEPVRTPPIPAFSPLKTLRIMSLHQFLLEPITCHAWNRDRTQIALSPNNHEVHIYKKNGSQWVKAHELKEHNGHITGIDWAPKSDRIVTCGADRNAYVWSQKDGVWKPTLVILRINRAATFVKWSPLENKFAVGSGARLISVCYFESENDWWVSKHIKKPIRSTVLSLDWHPNNVLLAAGSCDFKCRVFSAYIKEVDEKPASTPWGSKMPFGQLMSEFGGSGTGGWVHGVSLALAEEALLVTEPVGDPR

SEQ ID NO: 812432 - protein, 156 aa, Homo sapiens
FRDLSAAPSGLPSSARARRSLFASTAQSPRILRSEPVRTPPIPAFSPLKTLRIMSLHQFLLEPITCHAWNRDRTQIALSPNNHEVHIYKKNGSQWVKAHELKEHNGHITGIDWAPKSDRIVTCGADRNAYVWSQKDGVWKPTLVILRINRAATFVN

SEQ ID NO: 812433 - protein, 69 aa, Homo sapiens
RHLAIHRHLAIHRHRWSHDNLGFQDPRVFHPGPPDNVKLSEPPPSSMTNCGRPQLCRGTMARKPAPRKH

SEQ ID NO: 812434 - protein, 84 aa, Homo sapiens
FRDLSAAPSGLPSSARARRSLFASTAQSPRILRSEPVRTPPIPAFSPLKTLRIMSLHQFLLEPNCGRPQLCRGTMARKPAPRKH

SEQ ID NO: 812435 - protein, 110 aa, Homo sapiens
FRDLSAAPSGLPSSARARRSLFASTAQSPRILRSEPVRTPPIPAFSPLKTLRIMSLHQFLLEPITCHAWNRDRTQIALSPNNHEVHIYKKNGSQWVKAHELKEHNGHITG

SEQ ID NO: 812436 - protein, 84 aa, Homo sapiens
DAWVDPRVPALCLEGTRRHLRSLGFARAHRRKLTTRFCNPYGRPTLCLREIHSPTWKRTGSQASKKALPPRSALGLSGRNSQRR

SEQ ID NO: 812437 - protein, 115 aa, Homo sapiens
DLADGHLPDSDDDSELSVEEHQRERQALFDLSSCSLRPKSFKCQTCKKSYIGKWGLAQHFKLNPGHGQLDPEMVLSEKANGSTLRGCTEERTLSLTFPGLSVPALRVREGPAPAW

SEQ ID NO: 812438 - protein, 83 aa, Homo sapiens
RDSRTRRIAPEQSRPCELSQDSLQYGREELNFIETKGWGVFKCRGEMLRRNWRHQEEVRKCRKAICVGSLEFFKTGNLPFYKN

SEQ ID NO: 812439 - protein, 68 aa, Homo sapiens
CGPSHTPSEGQHFKLNPGHGQLDPEMVLSEKANGSTLRGCTEERTLSLTFPGLSVPALRVREGPAPAW

SEQ ID NO: 812440 - protein, 84 aa, Homo sapiens; identical to SEQ ID NO: 812436

SEQ ID NO: 812441 - protein, 84 aa, Homo sapiens; identical to SEQ ID NO: 812436

SEQ ID NO: 812442 - protein, 84 aa, Homo sapiens; identical to SEQ ID NO: 812436

SEQ ID NO: 812443 - protein, 84 aa, Homo sapiens; identical to SEQ ID NO: 812436

SEQ ID NO: 812444 - protein, 110 aa, Homo sapiens
MVLSEKANGSTLRGCTEERTLSLTFPGLSVPAAPREGGARSCLVRESARSGLQGYRVESPTIFFFSIFRKTLTSWRECKEGNACLYTVGELSPLQLSLQPALATSFPTLS

SEQ ID NO: 812445 - protein, 84 aa, Homo sapiens; identical to SEQ ID NO: 812436

SEQ ID NO: 812446 - protein, 84 aa, Homo sapiens; identical to SEQ ID NO: 812436

SEQ ID NO: 812447 - protein, 84 aa, Homo sapiens; identical to SEQ ID NO: 812436

SEQ ID NO: 812448 - protein, 249 aa, Homo sapiens
WRGTPRSLAPGLGRGRGGARAKATPPAPRPRPGGFRPPLQRARCYRAAGGRGRETGNAQGPRLALQARAAAPAFPAASRRSVPAPRGRRLLLPGAVAACAVSDGQPLSPPLRQPRPAARAPEGALASCGLRAGWAGWPPQAAWRAWGASVDAAAPPSEAASAEARLPERSGPARRPGPECVPMKAPGLAQAAVAEETPDWAPELCPSSEARSPEPPANRLQDFDTLVTVGKQLEAICVKVTSGETKGQE

SEQ ID NO: 812449 - protein, 84 aa, Homo sapiens; identical to SEQ ID NO: 812436

SEQ ID NO: 812450 - protein, 259 aa, Homo sapiens
WRGTPRSLAPGLGRGRGGARAKATPPAPRPRPGGFRPPLQRARCYRAAGGRGRETGNAQGPRLALQARAAAPAFPAASRRSVPAPRGRRLLLPGAVAACAVSDGQPLSPPLRQPRPAARAPEGALASCGLRAGWAGWPPQAAWRAWGASVDAAAPPSEAASAEARLPERSGPARRPGPECVPMKAPGLAQAAVAEETPDWAPELCPSSEARSPEPPANRLQDFDTLVTVGKQLEAICVKKNVDLLARMQRRERLLIHCW

SEQ ID NO: 812451 - protein, 70 aa, Homo sapiens
RARYPGKVEKLSQDSLQYGREELNFIETKGWGVFKCRGEMLRRNWRHQEEKNVDLLARMQRRERLLIHCW

SEQ ID NO: 812452 - protein, 1265 aa, Homo sapiens
MSPALQDLSQPEGLKKTLRDEINAILQKRIMVLDGGMGTMIQREKLNEEHFRGQEFKDHARPLKGNNDILSITQPDVIYQIHKEYLLAGADIIETNTFSSTSIAQADYGLEHLAYRMNMCSAGVARKAAEEVTLQTGIKRFVAGALGPTNKTLSVSPSVERPDYRNITFDELVEAYQEQAKGLLDGGVDILLIETIFDTANAKAALFALQNLFEEKYAPRPIFISGTIVDKSGRTLSGQTGEGFVISVSHGEPLCIGLNCALGAAEMRPFIEIIGKCTTAYVLCYPNAGLPNTFGDYDETPSMMAKHLKDFAMDGLVNIVGGCCGSTPDHIREIAEAVKNCKPRVPPATAFEGHMLLSGLEPFRIGPYTNFVNIGERCNVAGSRKFAKLIMAGNYEEALCVAKVQVEMGAQVLDVNMDDGMLDGPSAMTRFCNLIASEPDIAKVPLCIDSSNFAVIEAGLKCCQGKCIVNSISLKEGEDDFLEKARKIKKYGAAMVVMAFDEEGQATETDTKIRVCTRAYHLLVKKLGFNPNDIIFDPNILTIGTGMEEHNLYAINFIHATKVIKETLPGARISGGLSNLSFSFRGMEAIREAMHGVFLYHAIKSGMDMGIVNAGNLPVYDDIHKELLQLCEDLIWNKDPEATEKLLRYAQTQGTGGKKVIQTDEWRNGPVEERLEYALVKGIEKHIIEDTEEARLNQKKYPRPLNIIEGPLMNGMKIVGDLFGAGKMFLPQVIKSARVMKKAVGHLIPFMEKEREETRVLNGTVEEEDPYQGTIVLATVKGDVHDIGKNIVGVVLGCNNFRVIDLGVMTPCDKILKAALDHKADIIGLSGLITPSLDEMIFVAKEMERLAIRIPLLIGGATTSKTHTAVKIAPRYSAPVIHVLDASKSVVVCSQLLDENLKDEYFEEIMEEYEDIRQDHYESLKERRYLPLSQARKSGFQMDWLSEPHPVKPTFIGTQVFEDYDLQKLVDYIDWKPFFDVWQLRGKYPNRGFPKIFNDKTVGGEARKVYDDAHNMLNTLISQKKLRARGVVGFWPAQSIQDDIHLYAEAAVPQAAEPIATFYGLRQQAEKDSASTEPYYCLSDFIAPLHSGIRDYLGLFAVACFGVEELSKAYEDDGDDYSSIMVKALGDRLAEAFAEELHERVRRELWAYCGSEQLDVADLRRLRYKGIRPAPGYPSQPDHTEKLTMWRLADIEQSTGIRLTESLAMAPASAVSGLYFSNLKSKYFAVGKISKDQVEDYALRKNISVAEVEKWLGPILGYDTD

SEQ ID NO: 812453 - protein, 151 aa, Homo sapiens
KGSKCLRGSEPDVTSSSSAGFLLGPFPCRPATPPLAARVWLLGRHQGLAGYPGRKHVLQQLPRPAPREALGRCGLSGSAVPPRREPTGGVKRPGPCVAGSPGAGWRGPWPSSPVESTSSLPRPLRKEETRQHVTRAPRPVATRRSEENPAG

SEQ ID NO: 812454 - protein, 1265 aa, Homo sapiens; identical to SEQ ID NO: 812452

SEQ ID NO: 812455 - protein, 1120 aa, Homo sapiens
MCSAGVARKAAEEVTLQTGIKRFVAGALGPTNKTLSVSPSVERPDYRNITFDELVEAYQEQAKGLLDGGVDILLIETIFDTANAKAALFALQNLFEEKYAPRPIFISGTIVDKSGRTLSGQTGEGFVISVSHGEPLCIGLNCALGAAEMRPFIEIIGKCTTAYVLCYPNAGLPNTFGDYDETPSMMAKHLKDFAMDGLVNIVGGCCGSTPDHIREIAEAVKNCKPRVPPATAFEGHMLLSGLEPFRIGPYTNFVNIGERCNVAGSRKFAKLIMAGNRNGPSAMTRFCNLIASEPDIAKVPLCIDSSNFAVIEAGLKCCQGKCIVNSISLKEGEDDFLEKARKIKKYGAAMVVMAFDEEGQATETDTKIRVCTRAYHLLVKKLGFNPNDIIFDPNILTIGTGMEEHNLYAINFIHATKVIKETLPGARISGGLSNLSFSFRGMEAIREAMHGVFLYHAIKSGMDMGIVNAGNLPVYDDIHKELLQLCEDLIWNKDPEATEKLLRYAQTQGTGGKKVIQTDEWRNGPVEERLEYALVKGIEKHIIEDTEEARLNQKKYPRPLNIIEGPLMNGMKIVGDLFGAGKMFLPQVIKSARVMKKAVGHLIPFMEKEREETRVLNGTVEEEDPYQGTIVLATVKGDVHDIGKNIVGVVLGCNNFRVIDLGVMTPCDKILKAALDHKADIIGLSGLITPSLDEMIFVAKEMERLAIRIPLLIGGATTSKTHTAVKIAPRYSAPVIHVLDASKSVVVCSQLLDENLKDEYFEEIMEEYEDIRQDHYESLKERRYLPLSQARKSGFQMDWLSEPHPVKPTFIGTQVFEDYDLQKLVDYIDWKPFFDVWQLRGKYPNRGFPKIFNDKTVGGEARKVYDDAHNMLNTLISQKKLRARGVVGFWPAQSIQDDIHLYAEAAVPQAAEPIATFYGLRQQAEKDSASTEPYYCLSDFIAPLHSGIRDYLGLFAVACFGVEELSKAYEDDGDDYSSIMVKALGDRLAEAFAEELHERVRRELWAYCGSEQLDVADLRRLRYKGIRPAPGYPSQPDHTEKLTMWRLADIEQSTGIRLTESLAMAPASAVSGLYFSNLKSKYFAVGKISKDQVEDYALRKNISVAEVEKWLGPILGYDTD

SEQ ID NO: 812456 - protein, 401 aa, Homo sapiens
MCSAGVARKAAEEVTLQTGIKRFVAGALGPTNKTLSVSPSVERPDYRNITFDELVEAYQEQAKGLLDGGVDILLIETIFDTANAKAALFALQNLFEEKYAPRPIFISGTIVDKSGRTLSGQTGEGFVISVSHGEPLCIGLNCALGAAEMRPFIEIIGKCTTAYVLCYPNAGLPNTFGDYDETPSMMAKHLKDFAMDGLVNIVGGCCGSTPDHIREIAEAVKNCKPRVPPATAFEGHMLLSGLEPFRIGPYTNFVNIGERCNVAGSRKFAKLIMAGNYEEALCVAKVQVEMGAQVLDVNMDDGMLDGPSAMTRFCNLIASEPDIAKVPLCIDSSNFAVIEAGLKCCQGKCIVNSISLKEGEDDFLEKARKIKKYGAAMVVMAFDEEGQVSGFFWPNPLCFPG

SEQ ID NO: 812457 - protein, 234 aa, Homo sapiens
MPHRKERPSGSSLHTHGSTGTAEGGNMSRLSLTRSPVSPLAAQGIPLPAQLTKSNAPVHIDVGGHMYTSSLATLTKYPDSRISRLFNGTEPIVLDSLKQHYFIDRDGEIFRYVLSFLRTSKLLLPDDFKDFSLLYEEARYYQLQPMVRELERWQQEQEQRRRSRACDCLVVRVTPDLGERIALSGEKALIEEVFPETGDVMCNSVNAGWNQDPTHVIRFPLNGYCRLNSVQDVL

SEQ ID NO: 812458 - protein, 283 aa, Homo sapiens
MPHRKERPSGSSLHTHGSTGTAEGGNMSRLSLTRSPVSPLAAQGIPLPAQLTKSNAPVHIDVGGHMYTSSLATLTKYPDSRISRLFNGTEPIVLDSLKQHYFIDRDGEIFRYVLSFLRTSKLLLPDDFKDFSLLYEEARYYQLQPMVRELERWQQEQEQRRRSRACDCLVVRVTPDLGERIALSGEKALIEEVFPETGDVMCNSVNAGWNQDPTHVIRFPLNGYCRLNSVQVLERLFQRGFSVAASCGGGVDSSQFSEYVLCREERRPQPTPTAVRIKQEPLD

SEQ ID NO: 812459 - protein, 283 aa, Homo sapiens; identical to SEQ ID NO: 812458

SEQ ID NO: 812460 - protein, 283 aa, Homo sapiens; identical to SEQ ID NO: 812458

SEQ ID NO: 812461 - protein, 283 aa, Homo sapiens; identical to SEQ ID NO: 812458

SEQ ID NO: 812462 - protein, 283 aa, Homo sapiens; identical to SEQ ID NO: 812458

SEQ ID NO: 812463 - protein, 283 aa, Homo sapiens; identical to SEQ ID NO: 812458

SEQ ID NO: 812464 - protein, 418 aa, Homo sapiens
MPHRKERPSGSSLHTHGSTGTAEGGNMSRLSLTRSPVSPLAAQGIPLPAQLTKSNAPVHIDVGGHMYTSSLATLTKYPDSRISRLFNGTEPIVLDSLKQHYFIDRDGEIFRYVLSFLRTSKLLLPDDFKDFSLLYEEARYYQLQPMVRELERWQQEQEQRRRSRACDCLVVRVTPDLGERIALSGEKALIEEVFPETGDVMCNSVNAGWNQDPTHVIRFPLNGYCRLNSVQVLERLFQRGFSVAASCGGGVDSSQFSEYVLCREERRPQPTPTAFSAHLGPPRDLETVLGSSACVYLAVGMRPRVRLEGPKLAQRAPGSQVSWQQNVGCWRHACRRTVDATQRYSGGISAASSPSPSASQPGAASSEAPGPVGAGLEEPSAATSEELFIPLHAGQTLAGLLASERWLIFLQYLKWMQP

SEQ ID NO: 812465 - protein, 264 aa, Homo sapiens
MPHRKERPSGSSLHTHGSTGTAEGGNMSRLSLTRSPVSPLAAQGIPLPAQLTKSNAPVHIDVGGHMYTSSLATLTKYPDSRISRLFNGTEPIVLDSLKQHYFIDRDGEIFRYVLSFLRTSKLLLPDDFKDFSLLYEEARYYQLQPMVRELERWQQEQEQRRRSRACDCLVVRVTPDLGERIALSGEKALIEEVFPETGDVMCNSVNAGWNQDPTHVIRFPLNGYCRLNSVQVRAARCPLPAAPPASAEPSRGRVSWREARSLKR

SEQ ID NO: 812466 - protein, 283 aa, Homo sapiens; identical to SEQ ID NO: 812458

SEQ ID NO: 812467 - protein, 404 aa, Homo sapiens
FLGAAGAPEGSGSNSSSSSSGGGVEMAAAAAQGGGGGEPRRTEGVGPGVPGEVEMVKGQPFDVGPRYTQLQYIGEGAYGMVSSAYDHVRKTRVAIKKISPFEHQTYCQRTLREIQILLRFRHENVIGIRDILRASTLEAMRDVYIVQDLMETDLYKLLKSQQLSNDHICYFLYQILRGLKYIHSANVLHRDLKPSNLLINTTCDLKICDFGLARIADPEHDHTGFLTEYVATRWYRAPEIMLNSKGYTKSIDIWSVGCILAEMLSNRPIFPGKHYLDQLNHILGILGSPSQEDLNCIINMKARNYLQSLPSKTKVAWAKLFPKSDSKALDLLDRMLTFNPNKRITVEEALAHPYLEQYYDPTDEPVAEEPFTFAMELDDLPKERLKELIFQETARFQPGVLEAP

SEQ ID NO: 812468 - protein, 294 aa, Homo sapiens
RLVPPGYGMSAFRDVETRSVPRSSAYDHVRKTRVAIKKISPFEHQTYCQRTLREIQILLRFRHENVIGIRDILRASTLEAMRDVYIVQDLMETDLYKLLKSQQLSNDHICYFLYQILRGLKYIHSANVLHRDLKPSNLLINTTCDLKICDFGLARIADPEHDHTGFLTEYVATRWYRAPEIMLNSKGYTKSIDIWSVGCILAEMLSNRPIFPGKHYLDQLNHILDILGSPSQGGPDIVINPTMECAPKNVPTRTSVPFRRTKGGLGAASELSTPRSDSRRPLNTAGTGNVQPLK

SEQ ID NO: 812469 - protein, 379 aa, Homo sapiens
MAAAAAQGGGGGEPRRTEGVGPGVPGEVEMVKGQPFDVGPRYTQLQYIGEGAYGMVSSAYDHVRKTRVAIKKISPFEHQTYCQRTLREIQILLRFRHENVIGIRDILRASTLEAMRDVYIVQDLMETDLYKLLKSQQLSNDHICYFLYQILRGLKYIHSANVLHRDLKPSNLLINTTCDLKICDFGLARIADPEHDHTGFLTEYVATRWYRAPEIMLNSKGYTKSIDIWSVGCILAEMLSNRPIFPGKHYLDQLNHILGILGSPSQEDLNCIINMKARNYLQSLPSKTKVAWAKLFPKSDSKALDLLDRMLTFNPNKRITVEEALAHPYLEQYYDPTDEPVAEEPFTFAMELDDLPKERLKELIFQETARFQPGVLEAP

SEQ ID NO: 812470 - protein, 379 aa, Homo sapiens; identical to SEQ ID NO: 812469

SEQ ID NO: 812471 - protein, 379 aa, Homo sapiens; identical to SEQ ID NO: 812469

SEQ ID NO: 812472 - protein, 379 aa, Homo sapiens; identical to SEQ ID NO: 812469

SEQ ID NO: 812473 - protein, 381 aa, Homo sapiens
MYRPSLGCSGGGGGEPRRTEGVGPGVPGEVEMVKGQPFDVGPRYTQLQYIGEGAYGMVSSAYDHVRKTRVAIKKISPFEHQTYCQRTLREIQILLRFRHENVIGIRDILRASTLEAMRDVYIVQDLMETDLYKLLKSQQLSNDHICYFLYQILRGLKYIHSANVLHRDLKPSNLLINTTCDLKICDFGLARIADPEHDHTGFLTEYVATRWYRAPEIMLNSKGYTKSIDIWSVGCILAEMLSNRPIFPGKHYLDQLNHILGILGSPSQEDLNCIINMKARNYLQSLPSKTKVAWAKLFPKSDSKALDLLDRMLTFNPNKRITVEEALAHPYLEQYYDPTDEPVAEEPFTFAMELDDLPKERLKELIFQETARFQPGVLEAP

SEQ ID NO: 812474 - protein, 379 aa, Homo sapiens; identical to SEQ ID NO: 812469

SEQ ID NO: 812475 - protein, 360 aa, Homo sapiens
MAAAAAQGGGGGEPRRTEGVGPGVPGEVEMVKGQPFDVGPRYTQLQYIGEGAYGMVSSAYDHVRKTRVAIKKISPFEHQTYCQRTLREIQILLRFRHENVIGIRDILRASTLEAMRDVYIVQDLMETDLYKLLKSQQLSNDHICYFLYQILRGLKYIHSANVLHRDLKPSNLLINTTCDLKICDFGLARIADPEHDHTGFLTEYVATRWYRAPEIMLNSKGYTKSIDIWSVGCILAEMLSNRPIFPGKHYLDQLNHILGILGSPSQEDLNCIINMKARNYLQSLPSKTKVAWAKLFPKSDSKALDLLDRMLTFNPNKRITPVAEEPFTFAMELDDLPKERLKELIFQETARFQPGVLEAP

SEQ ID NO: 812476 - protein, 379 aa, Homo sapiens; identical to SEQ ID NO: 812469

SEQ ID NO: 812477 - protein, 379 aa, Homo sapiens; identical to SEQ ID NO: 812469

SEQ ID NO: 812478 - protein, 343 aa, Homo sapiens
MYEAGGAQLQYIGEGAYGMVSSAYDHVRKTRVAIKKISPFEHQTYCQRTLREIQILLRFRHENVIGIRDILRASTLEAMRDVYIVQDLMETDLYKLLKSQQLSNDHICYFLYQILRGLKYIHSANVLHRDLKPSNLLINTTCDLKICDFGLARIADPEHDHTGFLTEYVATRWYRAPEIMLNSKGYTKSIDIWSVGCILAEMLSNRPIFPGKHYLDQLNHILGILGSPSQEDLNCIINMKARNYLQSLPSKTKVAWAKLFPKSDSKALDLLDRMLTFNPNKRITVEEALAHPYLEQYYDPTDEPVAEEPFTFAMELDDLPKERLKELIFQETARFQPGVLEAP

SEQ ID NO: 812479 - protein, 361 aa, Homo sapiens
SRFLSLNGSIPEEQCGPNPLPVKAVTSRYIGEGAYGMVSSAYDHVRKTRVAIKKISPFEHQTYCQRTLREIQILLRFRHENVIGIRDILRASTLEAMRDVYIVQDLMETDLYKLLKSQQLSNDHICYFLYQILRGLKYIHSANVLHRDLKPSNLLINTTCDLKICDFGLARIADPEHDHTGFLTEYVATRWYRAPEIMLNSKGYTKSIDIWSVGCILAEMLSNRPIFPGKHYLDQLNHILGILGSPSQEDLNCIINMKARNYLQSLPSKTKVAWAKLFPKSDSKALDLLDRMLTFNPNKRITVEEALAHPYLEQYYDPTDEPVAEEPFTFAMELDDLPKERLKELIFQETARFQPGVLEAP

SEQ ID NO: 812480 - protein, 362 aa, Homo sapiens
MIDQSQLLLSPLPAKAWVGPPGPDSPFVRPQQQPLSGPLSSAYDHVRKTRVAIKKISPFEHQTYCQRTLREIQILLRFRHENVIGIRDILRASTLEAMRDVYIVQDLMETDLYKLLKSQQLSNDHICYFLYQILRGLKYIHSANVLHRDLKPSNLLINTTCDLKICDFGLARIADPEHDHTGFLTEYVATRWYRAPEIMLNSKGYTKSIDIWSVGCILAEMLSNRPIFPGKHYLDQLNHILGILGSPSQEDLNCIINMKARNYLQSLPSKTKVAWAKLFPKSDSKALDLLDRMLTFNPNKRITVEEALAHPYLEQYYDPTDEPVAEEPFTFAMELDDLPKERLKELIFQETARFQPGVLEAP

SEQ ID NO: 812481 - protein, 405 aa, Homo sapiens
FLGAAGAPEGSGSNSSSSSSGGGVEMAAAAAQGGGGGEPRRTEGVGPGVPGEVEMVKGQPFDVGPRYTQLQYIGEVRVTGMVSSAYDHVRKTRVAIKKISPFEHQTYCQRTLREIQILLRFRHENVIGIRDILRASTLEAMRDVYIVQDLMETDLYKLLKSQQLSNDHICYFLYQILRGLKYIHSANVLHRDLKPSNLLINTTCDLKICDFGLARIADPEHDHTGFLTEYVATRWYRAPEIMLNSKGYTKSIDIWSVGCILAEMLSNRPIFPGKHYLDQLNHILGILGSPSQEDLNCIINMKARNYLQSLPSKTKVAWAKLFPKSDSKALDLLDRMLTFNPNKRITVEEALAHPYLEQYYDPTDEPVAEEPFTFAMELDDLPKERLKELIFQETARFQPGVLEAP

SEQ ID NO: 812482 - protein, 417 aa, Homo sapiens
MAAAAAQGGGGGEPRRTEGVGPGVPGEVEMVKGQPFDVGPRYTQLQYIGEGAYGMVSSAYDHVRKTRVAIKKISPFEHQTYCQRTLREIQILLRFRHENVIGIRDILRASTLEAMRDVYIVQDLMETDLYKLLKSQQLSNDHICYFLYQILRGLKYIHSANVLHRDLKPSNLLINTTCDLKICDFGLARIADPEHDHTGFLTEYVATRWYRAPEIMLNSKGYTKSIDIWSVGCILAEMLSNRPIFPGKHYLDQLNHILGILGSPSQEDLNCIINMKARNYLQSLPSKTKVAWAKLFPKSDSKALDLLDRMLTFNPNKRITVEEALAHPYLEQYYDPTDEPVARSLHFHGVDDYEGEESTSGTAVQADGGGARQKFSGRGRSSGSPIEEVAPSDAEGGVIAEGHTIETITFIEAVRRP

SEQ ID NO: 812483 - protein, 332 aa, Homo sapiens
ALAASPSRGGSAYDHVRKTRVAIKKISPFEHQTYCQRTLREIQILLRFRHENVIGIRDILRASTLEAMRDVYIVQDLMETDLYKLLKSQQLSNDHICYFLYQILRGLKYIHSANVLHRDLKPSNLLINTTCDLKICDFGLARIADPEHDHTGFLTEYVATRWYRAPEIMLNSKGYTKSIDIWSVGCILAEMLSNRPIFPGKHYLDQLNHILGILGSPSQEDLNCIINMKARNYLQSLPSKTKVAWAKLFPKSDSKALDLLDRMLTFNPNKRITVEEALAHPYLEQYYDPTDEPVAEEPFTFAMELDDLPKERLKELIFQETARFQPGVLEAP

SEQ ID NO: 812484 - protein, 331 aa, Homo sapiens
DTSVLRCLQINTCMITVSVLGCNNISPFEHQTYCQRTLREIQILLRFRHENVIGIRDILRASTLEAMRDVYIVQDLMETDLYKLLKSQQLSNDHICYFLYQILRGLKYIHSANVLHRDLKPSNLLINTTCDLKICDFGLARIADPEHDHTGFLTEYVATRWYRAPEIMLNSKGYTKSIDIWSVGCILAEMLSNRPIFPGKHYLDQLNHILGILGSPSQEDLNCIINMKARNYLQSLPSKTKVAWAKLFPKSDSKALDLLDRMLTFNPNKRITVEEALAHPYLEQYYDPTDEPVAEEPFTFAMELDDLPKERLKELIFQETARFQPGVLEAP

SEQ ID NO: 812485 - protein, 255 aa, Homo sapiens
EGNTKCGELKSQQLSNDHICYFLYQILRGLKYIHSANVLHRDLKPSNLLINTTCDLKICDFGLARIADPEHDHTGFLTEYVATRWYRAPEIMLNSKGYTKSIDIWSVGCILAEMLSNRPIFPGKHYLDQLNHILGILGSPSQEDLNCIINMKARNYLQSLPSKTKVAWAKLFPKSDSKALDLLDRMLTFNPNKRITVEEALAHPYLEQYYDPTDEPVAEEPFTFAMELDDLPKERLKELIFQETARFQPGVLEAP

SEQ ID NO: 812486 - protein, 394 aa, Homo sapiens
MAAAAAQGGGGGEPRRTEGVGPGVPGEVEMVKGQPFDVGPRYTQLQYIGEGAYGMVSSAYDHVRKTRVAIKKISPFEHQTYCQRTLREIQILLRFRHENVIGIRDILRASTLEAMRDVYIVQDLMETDLYKLLKSQQLSNDHICYFLYQILRGLKYIHSANVLHRDLKPSNLLINTTCDLKICDFGLAPDLPPEHEPTPGPFFPPWKRGRFIGWGLTGRPGVPGGPHEISAERPSGYTKSIDIWSVGCILAEMLSNRPIFPGKHYLDQLNHILGILGSPSQEDLNCIINMKARNYLQSLPSKTKVAWAKLFPKSDSKALDLLDRMLTFNPNKRITVEEALAHPYLEQYYDPTDEPVAEEPFTFAMELDDLPKERLKELIFQETARFQPGVLEAP

SEQ ID NO: 812487 - protein, 340 aa, Homo sapiens
MAAAAAQGGGGGEPRRTEGVGPGVPGEVEMVKGQPFDVGPRYTQLQYIGEGAYGMVSSAYDHVRKTRVAIKKISPFEHQTYCQRTLREIQILLRFRHENVIGIRDILRASTLEAMRDVYIVQDLMETDLYKLLKSQQLSNDHICYFLYQILRGLKYIHSANVLHRDLKPSNLLINTTCDLKGYTKSIDIWSVGCILAEMLSNRPIFPGKHYLDQLNHILGILGSPSQEDLNCIINMKARNYLQSLPSKTKVAWAKLFPKSDSKALDLLDRMLTFNPNKRITVEEALAHPYLEQYYDPTDEPVAEEPFTFAMELDDLPKERLKELIFQETARFQPGVLEAP

SEQ ID NO: 812488 - protein, 313 aa, Homo sapiens
TGYYGNIREQPLIWIGPGVVTFELSHEGQMGVGQMERKGMVLGSGREDVNGQKDQYVQRHIAGEKGMGMFRKVQGEGIAPEAEQFHLAKWNCSANVLHRDLKPSNLLINTTCDLKICDFGLARIADPEHDHTGFLTEYVATRWYRAPEIMLNSKGYTKSIDIWSVGCILAEMLSNRPIFPGKHYLDQLNHILGILGSPSQEDLNCIINMKARNYLQSLPSKTKVAWAKLFPKSDSKALDLLDRMLTFNPNKRITVEEALAHPYLEQYYDPTDEPVAEEPFTFAMELDDLPKERLKELIFQETARFQPGVLEAP

SEQ ID NO: 812489 - protein, 335 aa, Homo sapiens
MAAAAAQGGGGGEPRRTEGVGPGVPGEVEMVKGQPFDVGPRYTQLQYIGEGAYGMVSSAYDHVRKTRVAIKKISPFEHQTYCQRTLREIQILLRFRHENVIGIRDILRASTLEAMRDVYIVQDLMETDLYKLLKSQQLSNDHICYFLYQILRGLKYIHSANVLHRDLKPSNLLINTTCDLKICDFGLARIADPEHDHTGFLTEYVATRWYRAPEIMLNSKGYTKSIDIWSVGCILAEMLSNRPIFPGKHYLDQLNHILALDLLDRMLTFNPNKRITVEEALAHPYLEQYYDPTDEPVAEEPFTFAMELDDLPKERLKELIFQETARFQPGVLEAP

SEQ ID NO: 812490 - protein, 173 aa, Homo sapiens
CGDLEDPLRNVISQGYTKSIDIWSVGCILAEMLSNRPIFPGKHYLDQLNHILGILGSPSQEDLNCIINMKARNYLQSLPSKTKVAWAKLFPKSDSKALDLLDRMLTFNPNKRITVEEALAHPYLEQYYDPTDEPVAEEPFTFAMELDDLPKERLKELIFQETARFQPGVLEAP

SEQ ID NO: 812491 - protein, 88 aa, Homo sapiens
FPVTPDSCPSIALDLLDRMLTFNPNKRITVEEALAHPYLEQYYDPTDEPVAEEPFTFAMELDDLPKERLKELIFQETARFQPGVLEAP

SEQ ID NO: 812492 - protein, 259 aa, Homo sapiens
MAAAAAQGGGGGEPRRTEGVGPGVPGEVEMVKGQPFDVGPRYTQLQYIGEGAYGMVSSAYDHVRKTRVAIKKISPFEHQTYCQRTLREIQILLRFRHENVIGIRDILRASTLEAMRDVYIVQDLMETDLYKLLKSQQLSNDHICYFLYQILRGLKYIHSANVLHRDLKPSNLLINTTCDLKICDFGLARIADPEHDHTGFLTEYVATRWYRAPEIMLNSKGYTKSIDIWSVGCILAEMLIFNDLVFSDQRMTRLLKNTL

SEQ ID NO: 812493 - protein, 263 aa, Homo sapiens
FLGAAGAPEGSGSNSSSSSSGGGVEMAAAAAQGGGGGEPRRTEGVGPGVPGEVEMVKGQPFDVGPRYTQLQYIGEGAYGMVRPQQQPLSGPLSSAYDHVRKTRVAIKKISPFEHQTYCQRTLREIQILLRFRHENVIGIRDILRASTLEAMRDVYIVQDLMETDLYKLLKSQQLSNDHICYFLYQILRGLKYIHSANVLHRDLKPSNLLINTTCDLKICDFGLARIADPEHDHTGFLTEYVATRWYRAPEIMLNSKVGGAAHS

SEQ ID NO: 812494 - protein, 111 aa, Homo sapiens [sequence omitted]

SEQ ID NO: 812495 - protein, 280 aa, Homo sapiens
SELEPLVTCPKKSRHFIAFASLFFILVSITTFCLETHEAFNIVKNKTEPVINGTSVVLQYEIETDPALTYVEGVCVVWFTFEFLVRIVFSPNKLEFIKNLLNIIDFVAILPFYLEVGLSGLSSKAAKDVLGFLRVVRFVRILRIFKLTRHFVGLRVLGHTLRASTNEFLLLIIFLALGVLIFATMIYYAERVGAQPNDPSASEHTQFKNIPIGFWWAVVTMTTLGYGDMYPQTWSGMLVGALCALAGVLTIAMPVPVIVNNFGMYYSLAMAKQKLPRKRK

SEQ ID NO: 812496 - protein, 494 aa, Homo sapiens
MGKIENNERVILNVGGTRHETYRSTLKTLPGTRLALLASSEPPGDCLTTAGDKLQPSPPPLSPPPRAPPLSPGPGGCFEGGAGNCSSRGGRASDHPGGGREFFFDRHPGVFAYVLNYYRTGKLHCPADVCGPLFEEELAFWGIDETDVEPCCWMTYRQHRDAEEALDIFETPDLIGGDPGDDEDLAAKRLGIEDAAGLGGPDGKSGRWRRLQPRMWALFEDPYSSRAARFIAFASLFFILVSITTFCLETHEAFNIVKNKTEPVINGTSVVLQYEIETDPALTYVEGVCVVWFTFEFLVRIVFSPNKLEFIKNLLNIIDFVAILPFYLEVGLSGLSSKAAKDVLGFLRVVRFVRILRIFKLTRHFVGLRVLGHTLRASTNEFLLLIIFLALGVLIFATMIYYAERVGAQPNDPSASEHTQFKNIPIGFWWAVVTMTTLGYGDMYPQTWSGMLVGALCALAGVLTIAMPVPVIVNNFGMYYSLAMAKQKLPRKRK

SEQ ID NO: 812497 - protein, 297 aa, Homo sapiens
MGKIENNERVILNVGGTRHETYRSTLKTLPGTRLALLASSEPPGDCLTTAGDKLQPSPPPLSPPPRAPPLSPGPGGCFEGGAGNCSSRGGRASDHPGGGREFFFDRHPGVFAYVLNYYRTGKLHCPADVCGPLFEEELAFWGIDETDVEPCCWMTYRQHRDAEEALDIFETPDLIGGDPGDDEDLAAKRLGIEDAAGLGGPDGKSGRWRRLQPRMWALFEDPYSSRAARFIAFASLFFILVSITTFCLETHEAFNIVKNKTEPVINGTSVVLQYEIETDPALTYVEGVCVVWFTFEF

SEQ ID NO: 812498 - protein, 554 aa, Homo sapiens
RPAAPRHPLADSAAATAWADSAPCAGAELDLAAAPIASGSLTHRVRPLARQCSPRRLPSPVPPVPALRTPMAELRPSGAPGPTAPPAPGPTAPPAFASLFPPGLHAIYGECRRLYPDQPNPLQVTAIVKYWLGGPDPLDYVSMYRNVGSPSANIPEHWHYISFGLSDLYGDNRVHEFTGTDGPSGFGFELTFRLKRETGESAPPTWPAELMQGLARYVFQSENTFCSGDHVSWHSPLDNSESRIQHMLLTEDPQMQPVQTPFGVVTFLQIVGVCTEELHSAQQWNGQGILELLRTVPIAGGPWLITDMRRGETIFEIDPHLQERVDKGIETDGSNLSGVSAKCAWDDLSRPPEDDEDSRSICIGTQPRRLSGKDTEQIRETLRRGLEINSKPVLPPINPQRQNGLAHDRAPSRKDSLESDSSTAIIPHELIRTRQLESVHLKFNQESGALIPLCLRGRLLHGRHFTYKSITGDMAITFVSTGVEGAFATEEHPYAAHGPWLQILLTEEFVEKMLEDLEDLTSPEEFKLPKEYSWPEKKLKVSILPDVVFDSPLH

SEQ ID NO: 812499 - protein, 551 aa, Homo sapiens
RPAAPRHPLADSAAATAWADSAPCAGAELDLAAAPIASGSLTHRVRPLARQCSPRRLPSPVPPVPALRTPMAELRPSGAPGPTAPPAPGPTAPPAFASLFPPGLHAIYGECRRLYPDQPNPLQVTAIVKYWLGGPDPLDYVSMYRNVGSPSANIPEHWHYISFGLSDLYGDNRVHEFTGTDGPSGFGFELTFRLKRETGESAPPTWPAELMQGLARYVFQSENTFCSGDHVSWHSPLDNSESRIQHMLLTEDPQMQPVQTPFGVVTFLQIVGVCTEELHSAQQWNGQGILELLRTVPIAGGPWLITDMRRGETIFEIDPHLQERVDKGIETDGSNLSGVSAKCAWDDLSRPPEDDEDSRSICIGTQPRRLSGKDTEQIRETLRRGLEINSKPVLPPINPQRQNGLAHDRAPSRKDSLESDSSTAIIPHELIRTRQLESVHLKFNQESGALIPLCLRGRLLHGRHFTYKSITGDMAITFVSTGVEGAFATEEHPYAAHGPWLQVRRPFFFSLLPFIDFLAHPSSSPLAALDGTPSWGAGHECLMDSGPGACV

SEQ ID NO: 812500 - protein, 503 aa, Homo sapiens
RPAAPRHPLADSAAATAWADSAPCAGAELDLAAAPIASGSLTHRVRPLARQCSPRRLPSPVPPVPALRTPMAELRPSGAPGPTAPPAPGPTAPPAFASLFPPGLHAIYGECRRLYPDQPNPLQVTAIVKYWLGGPDPLDYVSMYRNVGSPSANIPEHWHYISFGLSDLYGDNRVHEFTGTDGPSGFGFELTFRLKRETGESAPPTWPAELMQGLARYVFQSENTFCSGDHVSWHSPLDNSESRIQHMLLTEDPQMQPVQTPFGVVTFLQIVGVCTEELHSAQQWNGQGILELLRTVPIAGGPWLITDMRRGETIFEIDPHLQERVDKGIETDGSNLSGVSAKCAWDDLSRPPEDDEDSRSICIGTQPRRLSGKDTEQIRETLRRGLEINSKPVLPPINPQRQNGLAHDRAPSRKDSLESDSSTAIIPHELIRTRQLESVHLKFNQESGALIPLCLRGRLLHGRHFTYKSITGDMAITFVSTGVEGAFATEEHPYAAHGPWLQL

SEQ ID NO: 812501 - protein, 129 aa, Homo sapiens
RPAAPRHPLADSAAATAWADSAPCAGAELDLAAAPIASGSLTHRVRPLARQCSPRRLPSPVPPVPALRTPMAELRPSGAPGQRWVRVTLGRRRQGYSSSGRPRSVIVTDVKRERRKAAHKQCTYEDTRR

SEQ ID NO: 812502 - protein, 554 aa, Homo sapiens; identical to SEQ ID NO: 812498

SEQ ID NO: 812503 - protein, 538 aa, Homo sapiens
RPAAPRHPLADSAAATAWADSAPCAGAELDLAAAPIASGSLTHRVRPLARQCSPRRLPSPVPPVPALRTPMAELRPSGAPGPTAPPAPGPTAPPAFASLFPPGLHAIYGECRRLYPDQPNPLQVTAIVKYWLGGPDPLDYVSMYRNVGSPSANIPEHWHYISFGLSDLYGDNRVHEFTGTDGPSGFGFELTFRLKRETGESAPPTWPAELMQGLARYVFQSENTFCSGDHVSWHSPLDNSESRIQHMLLTEDPQMQPVQTPFGVVTFLQIVGVCTEELHSAQQWNGQGILELLRTVPIAGGPWLITDMRRGETIFEIDPHLQERVDKGIETDGSNLSGVSAKCAWDDLSRPPEDDEDNTEQIRETLRRGLEINSKPVLPPINPQRQNGLAHDRAPSRKDSLESDSSTAIIPHELIRTRQLESVHLKFNQESGALIPLCLRGRLLHGRHFTYKSITGDMAITFVSTGVEGAFATEEHPYAAHGPWLQILLTEEFVEKMLEDLEDLTSPEEFKLPKEYSWPEKKLKVSILPDVVFDSPLH

SEQ ID NO: 812504 - protein, 308 aa, Homo sapiens [sequence omitted]

SEQ ID NO: 812505 - protein, 554 aa, Homo sapiens; identical to SEQ ID NO: 812498

SEQ ID NO: 812506 - protein, 554 aa, Homo sapiens; identical to SEQ ID NO: 812498

SEQ ID NO: 812507 - protein, 417 aa, Homo sapiens
MSRHLPWICDQRCSSPSSPGRWPPAARMWLPRFSSKTVTVLLLAQTTCLLLFIISRPGPSSPAGGEDRVHVLVLSSWRSGSSFLGQLFSQHPDVFYLMEPAWHVWTTLSQGSAATLHMAVRDLMRSIFLCDMDVFDAYMPQSRNLSAFFNWATSRALCSPPACSAFPRGTISKQDVCKTLCTRQPFSLAREACRSYSHVVLKEVRFFNLQVLYPLLSDPALNLRIVHLVRDPRAVLRSREAAGPILARDNGIVLGTNGKWVEADPHLRLIREVCRSHVRIAEAATLKPPPFLRGRYRLVRFEDLAREPLAEIRALYAFTGLTLTPQLEAWIHNITHGSGIGKPIEAFHTSSRNARNVSQAWRHALPFTKILRVQEVCAGALQLLGYRPVYSADQQRDLTLDLVLPRGPDHFSWASPD

SEQ ID NO: 812508 - protein, 411 aa, Homo sapiens
MGMRARVPKVAHSTRRPPAARMWLPRFSSKTVTVLLLAQTTCLLLFIISRPGPSSPAGGEDRVHVLVLSSWRSGSSFLGQLFSQHPDVFYLMEPAWHVWTTLSQGSAATLHMAVRDLMRSIFLCDMDVFDAYMPQSRNLSAFFNWATSRALCSPPACSAFPRGTISKQDVCKTLCTRQPFSLAREACRSYSHVVLKEVRFFNLQVLYPLLSDPALNLRIVHLVRDPRAVLRSREAAGPILARDNGIVLGTNGKWVEADPHLRLIREVCRSHVRIAEAATLKPPPFLRGRYRLVRFEDLAREPLAEIRALYAFTGLTLTPQLEAWIHNITHGSGIGKPIEAFHTSSRNARNVSQAWRHALPFTKILRVQEVCAGALQLLGYRPVYSADQQRDLTLDLVLPRGPDHFSWASPD

SEQ ID NO: 812509 - protein, 113 aa, Homo sapiens
PLPGGRTSRHPSQWGVGKRRGGVEEREEVGERGDPVVFRGGEGSSSQPSPLLLALIRQTHVPRRRKQLSFTLTRLKPSHLIGTLGRSTDLLASSPLSVFPPSLVLFPPPPSLL

SEQ ID NO: 812510 - protein, 113 aa, Homo sapiens; identical to SEQ ID NO: 812509

SEQ ID NO: 812511 - protein, 202 aa, Homo sapiens
MSCKVFVPQPHPCLLPSGNPPWESSVGGSRCLLQSSPALGDAGGPCRPEGLFAAHLPAEPNLRARCSVQPGIWHPSSFHVLCMCVVCPFLPLFEFTENPHVSPTGSPQTTSEGLTCCHSLLLPQSRVMRMDGVQGFRWGLRRCPCWPCPSWLSRPGFTVQLHLYAGRGADSSGTPWFWIPFLGSLWRQPGFSGAASQQLSQG

SEQ ID NO: 812512 - protein, 145 aa, Homo sapiens
LVEAAPLILCRVKSLFPSPTPASSHRETPHGSHQWAGVGACSSPALPWEMLEDPVALKACLLHICLQSQTSGPGAVSSLVSGIPVASMFCVCVWCAPSSHCLNSLKSHKGGLLLEIWPPLAPPRSPHVSPTGSPQTTSEGLTCCH

SEQ ID NO: 812513 - protein, 445 aa, Homo sapiens
TRPPAPMTNMSWSFLTRLLEEIHNHSTFVGKVWLTVLVVFRIVLTAVGGEAIYSDEQAKFTCNTRQPGCDNVCYDAFAPLSHVRFWVFQIVVISTPSVMYLGYAVHRLARASEQERRRALRRRPGPRRAPRAHLPPPHAGWPEPADLGEEEPMLGLGEEEEEEETGAAEGAGEEAEEAGAEEACTKAVGADGKAAGTPGPTGQHDGRRRIQREGLMRVYVAQLVARAAFEVAFLVGQYLLYGFEVRPFFPCSRQPCPHVVDCFVSRPTEKTVFLLVMYVVSCLCLLLNLCEMAHLGLGSAQDAVRGRRGPPASAPAPAPRPPPCAFPAAAAGLACPPDYSLVVRAAERARAHDQNLANLALQALRDGAAAGDRDRDSSPCVGLPAASRGPPRAGAPASRTGSATSAGTVGEQGRPGTHERPGAKPRAGSEKGSASSRDGKTTVWI

SEQ ID NO: 812514 - protein, 120 aa, Homo sapiens
SGVVRPIGTNMAEASFGSSSPVGSLSSEDHDFDPTAEMLVHDYDDERTLEEEEMMDEGKNFSSEIEDLEKEGTMPLEDLLAFYGYEPTIPAVANSSANSSPSELADELPDMTLDKVSVSI

SEQ ID NO: 812515 - protein, 208 aa, Homo sapiens
SGVVRPIGTNMAEASFGSSSPVGSLSSEDHDFDPTAEMLVHDYDDERTLEEEEMMDEGKNFSSEIEDLEKEGTMPLEDLLAFYGYEPTIPAVANSSANSSPSELADELPDMTLDKEEIAKDLLSGDDEETQSSADDLTPSVTSHETSDFFPRPLRSNTACDGDKESEVEDVETDSGNSPEDLRKEIMIGLQYQAEIPPYLGEYDGNEK

SEQ ID NO: 812516 - protein, 105 aa, Homo sapiens
RATRREDDRRGPAVTTYAHENMPLAKDLLHPSPEEEKRKHKKKRLVQSPNSYFMDVKCPGCYKITTVFSHAQTVVLCVGCSTVLCQPTGGKARLTEGCSFRRKQH

SEQ ID NO: 812517 - protein, 105 aa, Homo sapiens; identical to SEQ ID NO: 812516

SEQ ID NO: 812518 - protein, 102 aa, Homo sapiens
AGFPLSPFPAVTTYAHENMPLAKDLLHPSPEEEKRKHKKKRLVQSPNSYFMDVKCPGCYKITTVFSHAQTVVLCVGCSTVLCQPTGGKARLTEGCSFRRKQH

SEQ ID NO: 812519 - protein, 102 aa, Homo sapiens; identical to SEQ ID NO: 812518

SEQ ID NO: 812520 - protein, 102 aa, Homo sapiens; identical to SEQ ID NO: 812518

SEQ ID NO: 812521 - protein, 102 aa, Homo sapiens; identical to SEQ ID NO: 812518

SEQ ID NO: 812522 - protein, 99 aa, Homo sapiens
AGFPLSPFPAVTTYAHENMPDINSRDRSGPRATRIDGSGEEIRWRPSCADTRGGEGRALPARKGSPSSLSRRGEEETQEETPGAEPQFLLHGCEMPRML

SEQ ID NO: 812523 - protein, 102 aa, Homo sapiens; identical to SEQ ID NO: 812518

SEQ ID NO: 812524 - protein, 102 aa, Homo sapiens; identical to SEQ ID NO: 812518

SEQ ID NO: 812525 - protein, 69 aa, Homo sapiens
AGFPLSPFPAVTTYAHENMPLAKDLLHPSPEEEKRKHKKKRLVQSPNSYFMDVKCPGCYKITTVFSHAL

SEQ ID NO: 812526 - protein, 69 aa, Homo sapiens; identical to SEQ ID NO: 812525

SEQ ID NO: 812527 - protein, 93 aa, Homo sapiens
YAATTLLITTAQAKGVVNTAVSAAVQAVRGRGRGTLTRGAFVGATAAPGYIAPGYGTPYGYSTAAPAYGLPKRMVLLPVMKFPTYPVPHYSFF

SEQ ID NO: 812528 - protein, 93 aa, Homo sapiens; identical to SEQ ID NO: 812527

SEQ ID NO: 812529 - protein, 672 aa, Homo sapiens
MRSIRSFANDDRHVMVKHSTIYPSPEELEAVQNMVSTVECALKHVSDWLDETNKGTKTEGETEVKKDEAGENYSKDQGGRTLCGVMRIGLVAKGLLIKDDMDLELVLMCKDKPTETLLNTVKDNLPIQIQKLTEEKYQVEQCVNEASIIIRNTKEPTLTLKVILTSPLIRDELEKKDGENVSMKDPPDLLDRQKCLNALASLRHAKWFQARANGLKSCVIVLRILRDLCNRVPTWAPLKGWPLELICEKSIGTCNRPLGAGEALRRVMECLASGILLPGGPGLHDPCERDPTDALSYMTIQQKEDITHSAQHALRLSAFGQIYKVLEMDPLPSSKPFQKYSWSVTDKEGAGSSALKRPFEDGLGDDKDPNKKMKRNLRKILDSKAIDLMNALMRLNQIRPGLQYKLLSQSGPVHAPVFTMSVDVDGTTYEASGPSKKTAKLHVAVKVLQAMGYPTGFDADIECMSSDEKSDNESKNETVSSNSSNNTGNSTTETSSTLEVRTQGPILTASGKNPVMELNEKRRGLKYELISETGGSHDKRFVMEVEVDGQKFRGAGPNKKVAKASAALAALEKLFSGPNAANNKKKKIIPQAKGVVNTAVSAAVQAVRGRGRGTLTRGAFVGATAAPGYIAPGYGTPYGYSTAAPAYGLPKRMVLLPVMKFPTYPVPHYSFF

SEQ ID NO: 812530 - protein, 658 aa, Homo sapiens
MVKHSTIYPSPEELEAVQNMVSTVECALKHVSDWLDETNKGTKTEGETEVKKDEAGENYSKDQGGRTLCGVMRIGLVAKGLLIKDDMDLELVLMCKDKPTETLLNTVKDNLPIQIQKLTEEKYQVEQCVNEASIIIRNTKEPTLTLKVILTSPLIRDELEKKDGENVSMKDPPDLLDRQKCLNALASLRHAKWFQARANGLKSCVIVLRILRDLCNRVPTWAPLKGWPLELICEKSIGTCNRPLGAGEALRRVMECLASGILLPGGPGLHDPCERDPTDALSYMTIQQKEDITHSAQHALRLSAFGQIYKVLEMDPLPSSKPFQKYSWSVTDKEGAGSSALKRPFEDGLGDDKDPNKKMKRNLRKILDSKAIDLMNALMRLNQIRPGLQYKLLSQSGPVHAPVFTMSVDVDGTTYEASGPSKKTAKLHVAVKVLQAMGYPTGFDADIECMSSDEKSDNESKNETVSSNSSNNTGNSTTETSSTLEVRTQGPILTASGKNPVMELNEKRRGLKYELISETGGSHDKRFVMEVEVDGQKFRGAGPNKKVAKASAALAALEKLFSGPNAANNKKKKIIPQAKGVVNTAVSAAVQAVRGRGRGTLTRGAFVGATAAPGYIAPGYGTPYGYSTAAPAYGLPKRMVLLPVMKFPTYPVPHYSFF

SEQ ID NO: 812531 - protein, 672 aa, Homo sapiens; identical to SEQ ID NO: 812529

SEQ ID NO: 812532 - protein, 672 aa, Homo sapiens; identical to SEQ ID NO: 812529

SEQ ID NO: 812533 - protein, 658 aa, Homo sapiens; identical to SEQ ID NO: 812530

SEQ ID NO: 812534 - protein, 619 aa, Homo sapiens
MRSIRSFANDDRHVMVKHSTIYPSPEELEAVQNMVSTVECALKHVSDWLDETNKGTKTEGETEVKKDEAGENYSKDQGGRTLCGVMRIGLVAKGLLIKDDMDLELVLMCKDKPTETLLNTVKDNLPIQIQKLTEEKYQVEQCVNEASIIIRNTKEPTLTLKVILTSPLIRDELEKKDGENVSMKDPPDLLDRQKCLNALASLRHAKWFQARANGLKSCVIVLRILRDLCNRVPTWAPLKGWPLELICEKSIGTCNRPLGAGEALRRVMECLASGILLPGGPGLHDPCERDPTDALSYMTIQQKEDITHSAQHALRLSAFGQIYKVLEMDPLPSSKPFQKYSWSVTDKEGAGSSALKRPFEDGLGDDKDPNKKMKRNLRKILDSKAIDLMNALMRLNQIRPGLQYKLLSQSGPVHAPVFTMSVDVDGTTYEASGPSKKTAKLHVAVKVRTQGPILTASGKNPVMELNEKRRGLKYELISETGGSHDKRFVMEVEVDGQKFRGAGPNKKVAKASAALAALEKLFSGPNAANNKKKKIIPQAKGVVNTAVSAAVQAVRGRGRGTLTRGAFVGATAAPGYIAPGYGTPYGYSTAAPAYGLPKRMVLLPVMKFPTYPVPHYSFF

SEQ ID NO: 812535 - protein, 657 aa, Homo sapiens
MRSIRSFANDDRHVMVKHSTIYPSPEELEAVQNMVSTVECALKHVSDWLDETNKGTKTEGETEVKKDEAGENYSKDQGGRTLCGVMRIGLVAKGLLIKDDMDLELVLMCKDKPTETLLNTVKDNLPIQIQKLTEEKYQVEQCVNEASIIIRNTKEPTLTLKVILTSPLIRDELEKKDGENVSMKDPPDLLDRQKCLNALASLRHAKWFQARANGLKSCVIVLRILRDLCNRVPTWAPLKGWPLELICEKSIGTCNRPLGAGEALRRVMECLASGILLPGGPGLHDPCERDPTDALSYMTIQQKEDITHSAQHALRLSAFGQIYKVLEMDPLPSSKPFQKYSWSVTDKEGAGSSALKRPFEDGLGDDKDPNKKMKRNLRKILDSKAIDLMNALMRLNQIRPGLQYKLLSQSGPVHAPVFTMSVDVDGTTYEASGPSKKTAKLHVAVKVLQAMGYPTGFDADIECMSSDEKSDNESKNETVSSNSSNNTGNSTTETSSTLEVRTQGPILTASGKNPVMELNEKRRGLKYELISETGGSHDKRFVMEVEVDGQKFRGAGPNKKVAKASAALAALEKLFSGPNAANNKKKKIIPQAKGVVNTAVSAAVQAVRGRGRGTLTRGAFVGATAAPGYIAPGLPKRMVLLPVMKFPTYPVPHYSFF

SEQ ID NO: 812536 - protein, 648 aa, Homo sapiens
MRSIRSFANDDRHVMVKHSTIYPSPEELEAVQNMVSTVECALKHVSDWLDETNKGTKTEGETEVKKDEAGENYSKDQGGRTLCGVMRIGLVAKGLLIKDDMDLELVLMCKDKPTETLLNTVKDNLPIQIQKLTEEKYQVEQCVNEASIIIRNTKEPTLTLKVILTSPLIRDELEKKDGENVSMKDPPDLLDRQKCLNALASLRHAKWFQARANGLKSCVIVLRILRDLCNRVPTWAPLKGWPLELICEKSIGTCNRPLGAGEALRRVMECLASGILLPGGPGLHDPCERDPTDALSYMTIQQKEDITHSAQHALRLSAFGQIYKVLEMDPLPSSKPFQKYSWSVTDKEGAGSSALKRPFEDGLGDDKDPNKKMKRNLRKILDSKAIDLMNALMRLNQIRPGLQYKLLSQSGPVHAPVFTMSVDVDGTTYEASGPSKKTAKLHVAVKVLQAMGYPTGFDADIECMSSDEKSDNESKNETVSSNSSNNTGNSTTETSSTLEVRTQGPILTASGKNPVMELNEKRRGLKYELISETGGSHDKRFVMEVEVDGQKFRGAGPNKKVAKASAALAALEKLFSGPNAANNKKKKIIPQAKGVVNTAVSAAVQAVRGRGRGTLTRGAFVGATAAPGYIAPGYGTPYGYSTAAPAYG

SEQ ID NO: 812537 - protein, 648 aa, Homo sapiens; identical to SEQ ID NO: 812536

SEQ ID NO: 812538 - protein, 93 aa, Homo sapiens; identical to SEQ ID NO: 812527

SEQ ID NO: 812539 - protein, 592 aa, Homo sapiens
MRSIRSFANDDRHVMVKHSTIYPSPEELEAVQNMVSTVECALKHVSDWLDETNKGTKTEGETEVKKDEAGENYSKDQGGRTLCGVMRIGLVAKGLLIKDDMDLELVLMCKDKPTETLLNTVKDNLPIQIQKLTEEKYQVEQCVNEASIIIRNTKEPTLTLKVILTSPLIRDELEKKDGENVSMKDPPDLLDRQKCLNALASLRHAKWFQARANGLKSCVIVLRILRDLCNRVPTWAPLKGWPLELICEKSIGTCNRPLGAGEALRRVMECLASGILLPGGPGLHDPCERDPTDALSYMTIQQKEDITHSAQHALRLSAFGQIYKVLEMDPLPSSKPFQKYSWSVTDKEGAGSSALKRPFEDGLGDDKDPNKKMKRNLRKILDSKAIDLMNALMRLNQIRPGLQYKLLSQSGPVHAPVFTMSVDVDGTTYEASGPSKKTAKLHVAVKVLQAMGYPTGFDADIECMSSDEKSDNESKNETVSSNSSNNTGNSTTETSSTLEVRTQGPILTASGKNPVMELNEKRRGLKYELISETGGSHDKRFVMEVEVDGQKFRGAGPNKKVAKASAALAALEKLFSGPNAANNKKKKIIPQV

SEQ ID NO: 812540 - protein, 359 aa, Homo sapiens
MCLQPLQEQKQWALDGAEYRTIQANCTGTGIGYNIIWVPMASCDFSIRTYTYADTPDDFQLHNFSLPEEDTKLKIPLIHRALQLAQRPVSLLASPWTSPTWLKTKGAGNGKGPLKGQPRDIYHQTWARYIVKFLDAYAEHKLQFWAVTAENEPSAGLLSGYPFQCLGFTPEHQRDFIARDLGPTLANGTHHNVRLLMLDDQRLLLPHWAKVVLTDPEAAKGLCGFQVLGAECAARLLGSRDAVQPQHHHKPPVPCGRLDRLEPIIVDITKHTFYKQPMFYHLGHFSKFIPEGSQRVGLVASQKNDPDAVALMHPDGSPVVVVLNRSSKDVPLTIKDPAVGFLETISPGYSIHTYLWRRQ

SEQ ID NO: 812541 - protein, 357 aa, Homo sapiens
MASCDFSIRTYTYADTPDDFQLHNFSLPEEDTKLKIPLIHRALQLAQRPVSLLASPWTSPTWLKTKGAGNGKGPLKGQPRDIYHQTWARYIVKFLDAYAEHKLQFWAVTAENEPSAGLLSGYPFQCLGFTPEHQRDFIARDLGPTLANGTHHNVRLLMLDDQRLLLPHWAKVVLTDPEAAKYVHGIAVHWYLDFLAPAKATLRETHHLFPNTMLFASEACVGSKFWEQSVRLGSWDRGMQYSHSIITNLLYHVVGWNRLEPIIVDITKHTFYKQPMFYHLGHFSKFIPEGSQRVGLVASQKNDPDAVALMHPDGSPVVVVLNRSSKDVPLTIKDPAVGFLETISPGYSIHTYLWRRQ

SEQ ID NO: 812542 - protein, 470 aa, Homo sapiens
MEFSSPSREECPKPSGRVSIMAGSLTGLLLLQAVSWASDECLQPLQEQKQWALDGAEYRTIQANCTGTGIGYNIIWVPMASCDFSIRTYTYADTPDDFQLHNFSLPEEDTKLKIPLIHRALQLAQRPVSLLASPWTSPTWLKTKGAGNGKGPLKGQPRDIYHQTWARYIVKFLDAYAEHKLQFWAVTAENEPSAGLLSGYPFQCLGFTPEHQRDFIARDLGPTLANGTHHNVRLLMLDDQRLLLPHWAKVVLTDPEAAKYVHGIAVHWYLDFLAPAKATLRETHHLFPNTMLFASEACVGSKFWEQSVRLGSWDRGMQYSHSIITNLLYHVVGWNRLEPIIVDITKHTFYKQPMFYHLGHFSKFIPEGSQRVGLVASQKNDPDAVALMHPDGSPVVVVLNRSSKDVPLTIKDPAVGFLETISPGYSIHTYLCVASDGADTQGGTGLSLGIKGTESAHTLSVTKEGTTGPA

SEQ ID NO: 812543 - protein, 470 aa, Homo sapiens; identical to SEQ ID NO: 812542

SEQ ID NO: 812544 - protein, 357 aa, Homo sapiens; identical to SEQ ID NO: 812541

SEQ ID NO: 812545 - protein, 432 aa, Homo sapiens
MRCLQPLQEQKQWALDGAEYRTIQANCTGTGIGYNIIWVPMASCDFSIRTYTYADTPDDFQLHNFSLPEEDTKLKIPLIHRALQLAQRPVSLLASPWTSPTWLKTKGAGNGKGPLKGQPRDIYHQTWARYIVKFLDAYAEHKLQFWAVTAENEPSAGLLSGYPFQCLGFTPEHQRDFIARDLGPTLANGTHHNVRLLMLDDQRLLLPHWAKVVLTDPEAAKYVHGIAVHWYLDFLAPAKATLRETHHLFPNTMLFASEACVGSKFWEQSVRLGSWDRGMQYSHSIITNLLYHVVGWNRLEPIIVDITKHTFYKQPMFYHLGHFSKFIPEGSQRVGLVASQKNDPDAVALMHPDGSPVVVVLNRSSKDVPLTIKDPAVGFLETISPGYSIHTYLCVASDGADTQGGTGLSLGIKGTESAHTLSVTKEGTTGPA

SEQ ID NO: 812546 - protein, 334 aa, Homo sapiens
MEFSSPSREECPKPSGRVSIMAGSLTGLLLLQAVSWASDECLQPLQEQKQWALDGAEYRTIQANCTGTGIGYNIIWVPMASCDFSIRTYTYADTPDDFQLHNFSLPEEDTKLKIPLIHRALQLAQRPVSLLASPWTSPTWLKTKGAGNGKGPLKGQPRDIYHQTWARYIVKFLDAYAEHKLQFWAVTAENEPSAGLLSGYPFQCLGFTPEHQRDFIARDLGPTLANGTHHNVRLLMLDDQRLLLPHWAKVVLTDPEAAKYVHGIAVHWYLDFLAPAKATLRETHHLFPNTMLFASEACVGSKFWEQSVRLGSWDRGMQYSHSINHSKPPQSPFL

SEQ ID NO: 812547 - protein, 217 aa, Homo sapiens
MCLQPLQEQKQWALDGAEYRTIQANCTGTGIGYNIIWVPMASCDFSIRTYTYADTPDDFQLHNFSLPEEDTKLKIPLIHRALQLAQRPVSLLASPWTSPTWLKTKGAGNGKGPLKGQPRDIYHQTWARYIVKFLDAYAEHKLQFWAVTAENEPSAGLLSGYPFQCLGFTPEHQRDFIARDLGPTPCQRYSPQCPPTHVEAPRKRSVSPSVPPAPMLM

SEQ ID NO: 812548 - protein, 200 aa, Homo sapiens
MCLQPLQEQKQWALDGAEYRTIQANCTGTGIGYNIIWVPMASCDFSIRTYTYADTPDDFQLHNFSLPEEDTKLKIPLIHRALQLAQRPVSLLASPWTSPTWLKTKGAGNGKGPLKGQPRDIYHQTWARYIVKFLDAYAEHKLQFWAVTAENEPSAGLLSGYPFQCLGFTPEHQAEALKQQRVCPGTQMIPMAPARKNGSS

SEQ ID NO: 812549 - protein, 132 aa, Homo sapiens
MCLQPLQEQKQWALDGAEYRTIQANCTGTGIGYNIIWVPMASCDFSIRTYTYADTPDDFQLHNFSLPEEDTKLKIPLIHRALQLAQRPVSLLASPWTSPTWLKTKGAGNGKGPLKGQPRDIYHQGQRELTAT

SEQ ID NO: 812550 - protein, 32 aa, Homo sapiens
MASCDFSIRTYTYADTPDDFQLHNFSLPEEDT

SEQ ID NO: 812551 - protein, 225 aa, Homo sapiens
METIHFLMKVKAVQYVHRVLAHELLCPQGGPSCEYYLVLAQTHILKKNFAKAEEYLQQAAQMDYLNPNVWGLKGHLYFLSGNHSEAKACYERTISFVVDASEMHFIFLRLGLIYLEEKEYEKAKKTYMQACKRSPSCLTWLGLGIACYRLEELTEAEDALSEANALNNYNAEVWAYLALVCLKVGRQLEAEQAYKYMIKLKLKDEALLAEIHTLQETVGFGNPSF

SEQ ID NO: 812552 - protein, 338 aa, Homo sapiens
AVLLENYEQAEIFFEDATCLEPTNVVAWTLLGLYYEIQNNDIRMEMAFHEASKQLQATDASGTRPGAALSILDKFLEESSKLQSDSQEPILTTQTWDPSISQKPSNTFIKEIPTKKEASKCQDSSALLHPGLHYGVSQTTTIFMETIHFLMKVKAVQYVHRVLAHELLCPQGGPSCEYYLVLAQTHILKKNFAKAEEYLQQAAQMDYLNPNVWGLKGHLYFLSGNHSEAKACYERTISFVVDASEMHFIFLRLGLIYLEEKELEELTEAEDALSEANALNNYNAEVWAYLALVCLKVGRQLEAEQAYKYMIKLKLKDEALLAEIHTLQETVGFGNPSF

SEQ ID NO: 812553 - protein, 225 aa, Homo sapiens; identical to SEQ ID NO: 812551

SEQ ID NO: 812554 - protein, 107 aa, Homo sapiens
METIHFLMKVKAVQYVHRVLAHELLCPQGGPSCEYYLVLAQTHILKKNFAKAEEYLQQAAQMDYLNPNVWGLKGHLYFLSGNHSEAKACYERTISFVVDAQPRRDPL

SEQ ID NO: 812555 - protein, 71 aa, Homo sapiens
AVLLENYEQAEIFFEDATCLEPTNVVAWTLLGLYYEIQNNDIRMEMAFHEASKQLQARMLQAQDQELHYLF

SEQ ID NO: 812556 - protein, 574 aa, Homo sapiens
MPPNINWKEIMKVDPDDLPRQEELADNLLISLSKVEVNELKSEKQENVIHLFRITQSLMKMKAQEVELALEEVEKAGEEQAKFENQLKTKVMKLENELEMAQQSAGGRDTRFLRNEICQLEKQLEQKDRELEDMEKELEKEKKVNEQLALRNEEAENENSKLRRENKRLKKKNEQLCQDIIDYQKQIDSQKETLLSRRGEDSDYRSQLSKKNYELIQYLDEIQTLTEANEKIEVQNQEMRKNLEESVQEMEKMTDEYNRMKAIVHQTDNVIDQLKKENDHYQLQVQELTDLLKSKNEEDDPIMVAVNAKVEEWKLILSSKDDEIIEYQQMLHNLREKLKNAQLDADKSNVMALQQGIQERDSQIKMLTEQVEQYTKEMEKNTCIIEDLKNELQRNKGASTLSQQTHMKIQSTLDILKEKTKEAERTAELAEADAREKDKELVEALKRLKDYESGVYGLEDAVVEIKNCKNQIKIRDREIEILTKEINKLELKISDFLDENEALRERVGLEPKTMIDLTEFRNSKHLKQQQYRAENQILLKEIESLEEERLDLKKKNSSNGSRKRKKKCNFRINH

SEQ ID NO: 812557 - protein, 218 aa, Homo sapiens
MARKKVRPRLIAELARRVRALREQLNRPRDSQLYAVDYETLTRPFSGRRLPVRAWADVRRESRLLQLLGRLPLFGLGRLVTRKSWLWQHDEPCYWRLTRVRPDYTAQNLDHGKAWGILTFKGKTESEAREIEHVMYHDWRLVPKHEEEAFTAFTPAPEDSLASVPYPPLLRAMIIAERQKNGDTSTEEPMLNVQRIRMEPWDYPAKQEDKGRAKGTPV

SEQ ID NO: 812558 - protein, 218 aa, Homo sapiens; identical to SEQ ID NO: 812557

SEQ ID NO: 812559 - protein, 178 aa, Homo sapiens
MHCRAFPTLTSVAISLQFKASLSPQTSYSGPCNAKLGRLVTRKSWLWQHDEPCYWRLTRVRPDYTAQNLDHGKAWGILTFKGKTESEAREIEHVMYHDWRLVPKHEEEAFTAFTPAPEDSLASVPYPPLLRAMIIAERQKNGDTSTEEPMLNVQRIRMEPWDYPAKQEDKGRAKGTPV

SEQ ID NO: 812560 - protein, 208 aa, Homo sapiens
MARYEAVVCNSLRTRHGAEEGASAADRGAGPPRARPAGATEQAARLPALRGGLRDLDAAVLWTPALGRLVTRKSWLWQHDEPCYWRLTRVRPDYTAQNLDHGKAWGILTFKGKTESEAREIEHVMYHDWRLVPKHEEEAFTAFTPAPEDSLASVPYPPLLRAMIIAERQKNGDTSTEEPMLNVQRIRMEPWDYPAKQEDKGRAKGTPV

SEQ ID NO: 812561 - protein, 270 aa, Homo sapiens
MARKKVRPRLIAELARRVRALREQLNRPRDSQLYAVDYETLTRPFSGRRLPVRAWADVRRESRLLQLLGRLPLFGLGRLVTRKSWLWQHDEPCYWRLTRVRPDYTAQVGACTPSAPRPCSRLVSPPPLLPAEFAWLRLPPPDLGGRELCELTPFLLALQNLDHGKAWGILTFKGKTESEAREIEHVMYHDWRLVPKHEEEAFTAFTPAPEDSLASVPYPPLLRAMIIAERQKNGDTSTEEPMLNVQRIRMEPWDYPAKQEDKGRAKGTPV

SEQ ID NO: 812562 - protein, 218 aa, Homo sapiens; identical to SEQ ID NO: 812557

SEQ ID NO: 812563 - protein, 218 aa, Homo sapiens; identical to SEQ ID NO: 812557

SEQ ID NO: 812564 - protein, 225 aa, Homo sapiens
MARKKVRPRLIAELARRVRALREQLNRPRDSQLYAVDYETLTRPFSGRRLPVRAWADVRRESRLLQLLGRLPLFGLGRLVTRKSWLWQHDEPCYWRLTRVRPDYTAQNLDHGKAWGILTFKDASFSSSGKTESEAREIEHVMYHDWRLVPKHEEEAFTAFTPAPEDSLASVPYPPLLRAMIIAERQKNGDTSTEEPMLNVQRIRMEPWDYPAKQEDKGRAKGTPV

SEQ ID NO: 812565 - protein, 248 aa, Homo sapiens
MARKKVRPRLIAELARRVRALREQLNRPRDSQLYAVDYETLTRPFSGRRLPVRAWADVRRESRLLQLLGRLPLFGLGRLVTRKSWLWQHDEPCYWRLTRVRPDYTAQNLDHGKAWGILTFKGKARESGCPAVRCRPPTAQQVCADASFSSSGKTESEAREIEHVMYHDWRLVPKHEEEAFTAFTPAPEDSLASVPYPPLLRAMIIAERQKNGDTSTEEPMLNVQRIRMEPWDYPAKQEDKGRAKGTPV

SEQ ID NO: 812566 - protein, 240 aa, Homo sapiens
MARKKVRPRLIAELARRVRALREQLNRPRDSQLYAVDYETLTRPFSGRRLPVRAWADVRRESRLLQLLGRLPLFGLGRLVTRKSWLWQHDEPCYWRLTRVRPDYTAQNLDHGKAWGILTFKGKTESEAREIEHVMYHDWRLVPKHEEEAFTAFTPAPEDSLASVPYPPLLRAMIIAERQKNGDTSTEEPMLNVQRIRMEPWDYPAKQEDKGRAKGTPLPPHPTPRAHAGESGKRSLPFPH

SEQ ID NO: 812567 - protein, 357 aa, Homo sapiens
GRAGEARDGGGRRRVPLWRWRDGARRLGSCGRGFEPANFSSRPGRAPARRPGRVTRRAEAMVHQVLYRALVSTKWLAESIRTGKLGPGLRVLDASWYSPGTREARKEYLERHVPGASFFDIEECRDTASPYEMMLPSEAGFAEYVGRLGISNHTHVVVYDGEHLGSFYAPRVWWMFRVFGHRTVSVLNGGFRNWLKEGHPVTSEPSRPEPAVFKATLDRSLLKTYEQVLENLESKRFQLVDSRSQGRFLGTEPEPDAVGLDSGHIRGAVNMPFMDFLTEDGFEKGPEELRALFQTKKVDLSQPLIATCRKGVTACHVALAAYLCGKPDVAVYDGSWSEWFRRAPPESRVSQGKSEKA

SEQ ID NO: 812568 - protein, 83 aa, Homo sapiens
AYYYYTAARRRQKGEDIKQTKKEKSITNYHCQHTKRKKHACHVALAAYLCGKPDVAVYDGSWSEWFRRAPPESRVSQGKSEKA

SEQ ID NO: 812569 - protein, 297 aa, Homo sapiens
MVHQVLYRALVSTKWLAESIRTGKLGPGLRVLDASWYSPGTREARKEYLERHVPGASFFDIEECRDTASPYEMMLPSEAGFAEYVGRLGISNHTHVVVYDGEHLGSFYAPRVWWMFRVFGHRTVSVLNGGFRNWLKEGHPVTSEPSRPEPAVFKATLDRSLLKTYEQVLENLESKRFQLVDSRSQGRFLGTEPEPDAVGLDSGHIRGAVNMPFMDFLTEDGFEKGPEELRALFQTKKVDLSQPLIATCRKGVTACHVALAAYLCGKPDVAVYDGSWSEWFRRAPPESRVSQGKSEKA

SEQ ID NO: 812570 - protein, 251 aa, Homo sapiens
MSDIGDWFRSIPAITRYWFAATVAVPLVGKLGLISPAYLFLWPEAFLYRFQIWRPITATFYFPVGPGTGFLYLVNLYFLYQYSTRLETGAFDGRPADYLFMLLFNWICIVITGLAMDMQLLMIPLIMSVLYVWAQLNRDMIVSFWFGTRFKACYLPWVILGFNYIIGGSVINELIGNLVGHLYFFLMFRYPMDLGGRNFLSTPQFLYRWLPSRRGGVSGFGVPPASMRRAADQNGGGGRHNWGQGFRLGDQ

SEQ ID NO: 812571 - protein, 617 aa, Homo sapiens
MVKLYLFKMEEVSIGRYNCFSKWNADTFVSPFSIPFRVVISSLYTLNFVFKRGFWPGVVAHVGNPSILGGRRVDHEVRRSRPSWLHGETLAPLKIQKLAGHGSGRLLSQLLGRLRQENCLNPGGGGCSELRSCYCTPAWCQSETPSQKKTKKQKPELLSVLGRGMKVIEYDVNRLQSLTAVPSQAGCMSITSSAGRRLWNQADYVGILSLSKRFTQCWLNFLVYKTGVIVMPTSWGYCEDADEFISRQHLVKAIITEYNSHSNCSSIRSSIKPVLFRVSAVDKSPVMTYSCCQEGFKRRYQIMLSAFKQNFKHYGSAKWNRFKHILSLLIKESKMGNELENTIESVGLGLSSLSCSVNSEFINFKVGNHLTVWGPSSPTICEKGRMYLEGRFCINFKTYPYFQHRKPSSPVSFDGLSWEPFRNAVQGSNMQAVDLAFESECILYPLIQFEPYLDIPRCYQSFFGCWACGCNIFVSILFCMDYFYKQRKKRSECEFSWNLNTFKKHEKLNAVCGQVMGLSTEKTKLNKTSLAAFNMTSAMGTAGEGGVLGGQIICGSDFVLFSPFVSPSFCTRYRWLPSRRGGVSGFGVPPASMRRAADQNGGGGRHNWGQGFRLGDQ

SEQ ID NO: 812572 - protein, 251 aa, Homo sapiens; identical to SEQ ID NO: 812570

SEQ ID NO: 812573 - protein, 251 aa, Homo sapiens; identical to SEQ ID NO: 812570

SEQ ID NO: 812574 - protein, 251 aa, Homo sapiens; identical to SEQ ID NO: 812570

SEQ ID NO: 812575 - protein, 251 aa, Homo sapiens; identical to SEQ ID NO: 812570

SEQ ID NO: 812576 - protein, 172 aa, Homo sapiens
MTFGLFLFPGAFDGRPADYLFMLLFNWICIVITGLAMDMQLLMIPLIMSVLYVWAQLNRDMIVSFWFGTRFKACYLPWVILGFNYIIGGSVINELIGNLVGHLYFFLMFRYPMDLGGRNFLSTPQFLYRWLPSRRGGVSGFGVPPASMRRAADQNGGGGRHNWGQGFRLGDQ

SEQ ID NO: 812577 - protein, 251 aa, Homo sapiens; identical to SEQ ID NO: 812570

SEQ ID NO: 812578 - protein, 206 aa, Homo sapiens
MSDIGDWFRSIPAITRYWFAATVAVPLVGKLGLISPAYLFLWPEAFLYRFQIWRPITATFYFPVGPGTGFLYLVNLYFLYQYSTRLETGAFDGRPADYLFMLLFNWICIVITGLAMDMQLLMIPLIMSVLYVWAQLNRDMIVSFWFGTRFKACYLPWVILGFNYIIGGSVINELIGNLVGHLYFFLPVLGALNNCVLANTVGPDPH

SEQ ID NO: 812579 - protein, 251 aa, Homo sapiens; identical to SEQ ID NO: 812570

SEQ ID NO: 812580 - protein, 134 aa, Homo sapiens
MSDIGDWFRSIPAITRYWFAATVAVPLVGKLGLISPAYLFLWPEAFLYRFQIWRPITATFYFPVGPGTGFLYLVNLYFLYQYSTRLETVGPGLSTWRPVKGRPRAAAPLKPHFLPVLGALNNCVLANTVGPDPH

SEQ ID NO: 812581 - protein, 120 aa, Homo sapiens
MSDIGDWFRSIPAITRYWFAATVAVPLVGKLGLISPAYLFLWPEAFLYRFQIWRPITATFYFPVGPGTGFLYLVNLYFLYHTRQSFLNPEEKYKCSTSFTILIQVLTAVKNKYQLCKLQN

SEQ ID NO: 812582 - protein, 251 aa, Homo sapiens; identical to SEQ ID NO: 812570

SEQ ID NO: 812583 - protein, 1129 aa, Homo sapiens
MASACGAPGPGGALGSQAPSWYHRDLSRAAAEELLARAGRDGSFLVRDSESVAGAFALCVLYQKHVHTYRILPDGEDFLAVQTSQGVPVRRFQTLGELIGLYAQPNQGLVCALLLPVEGEREPDPPDDRDASDGEDEKPPLPPRSGSTSISAPTGPSSPLPAPETPTAPAAESAPNGLSTVSHDYLKGSYGLDLEAVRGGASHLPHLTRTLATSCRRLHSEVDKVLSGLEILSKVFDQQSSPMVTRLLQQQNLPQTGEQELESLVLKLSVLKDFLSGIQKKALKALQDMSSTAPPAPQPSTRKAKTIPVQAFEVKLDVTLGDLTKIGKSQKFTLSVDVEGGRLVLLRRQRDSQEDWTTFTHDRIRQLIKSQRVQNKLGVVFEKEKDRTQRKDFIFVSARKREAFCQLLQLMKNKHSKQDEPDMISVFIGTWNMGSVPPPKNVTSWFTSKGLGKTLDEVTVTIPHDIYVFGTQENSVGDREWLDLLRGGLKELTDLDYRPIAMQSLWNIKVAVLVKPEHENRISHVSTSSVKTGIANTLGNKGAVGVSFMFNGTSFGFVNCHLTSGNEKTARRNQNYLDILRLLSLGDRQLNAFDISLRFTHLFWFGDLNYRLDMDIQEILNYISRKEFEPLLRVDQLNLEREKHKVFLRFSEEEISFPPTYRYERGSRDTYAWHKQKPTGVRTNVPSWCDRILWKSYPETHIICNSYGCTDDIVTSDHSPVFGTFEVGVTSQFISKKGLSKTSDQAYIEFESIEAIVKTASRTKFFIEFYSTCLEEYKKSFENDAQSSDNINFLKVQWSSRQLPTLKPILADIEYLQDQHLLLTVKSMDGYESYGECVVALKSMIGSTAQQFLTFLSHRGEETGNIRGSMKVRVPTERLGTRERLYEWISIDKDEAGAKSKAPSVSRGSQEPRSGSRKPAFTEASCPLSRLFEEPEKPPPTGRPPAPPRAAPREEPLTPRLKPEGAPEPEGVAAPHPRTASITLPTTSLKGSRTSCCPRSHPRLPGPLSHLPPRTKWPLQCLLHSLGTTGTLVWERGVLQMRSLEAHCPLQTFHLHHCRTQPSSCPPAWILYQGQWSGAVVGLRPVAHHLPRPIQGLHCPQAPHQPALSWGKWPVGMTGPARCCRWPRR

SEQ ID NO: 812584 - protein, 1069 aa, Homo sapiens
MYQKHVHTYRILPDGEDFLAVQTSQGVPVRRFQTLGELIGLYAQPNQGLVCALLLPVEGEREPDPPDDRDASDGEDEKPPLPPRSGSTSISAPTGPSSPLPAPETPTAPAAESAPNGLSTVSHDYLKGSYGLDLEAVRGGASHLPHLTRTLATSCRRLHSEVDKVLSGLEILSKVFDQQSSPMVTRLLQQQNLPQTGEQELESLVLKLSVLKDFLSGIQKKALKALQDMSSTAPPAPQPSTRKAKTIPVQAFEVKLDVTLGDLTKIGKSQKFTLSVDVEGGRLVLLRRQRDSQEDWTTFTHDRIRQLIKSQRVQNKLGVVFEKEKDRTQRKDFIFVSARKREAFCQLLQLMKNKHSKQDEPDMISVFIGTWNMGSVPPPKNVTSWFTSKGLGKTLDEVTVTIPHDIYVFGTQENSVGDREWLDLLRGGLKELTDLDYRPIAMQSLWNIKVAVLVKPEHENRISHVSTSSVKTGIANTLGNKGAVGVSFMFNGTSFGFVNCHLTSGNEKTARRNQNYLDILRLLSLGDRQLNAFDISLRFTHLFWFGDLNYRLDMDIQEILNYISRKEFEPLLRVDQLNLEREKHKVFLRFSEEEISFPPTYRYERGSRDTYAWHKQKPTGVRTNVPSWCDRILWKSYPETHIICNSYGCTDDIVTSDHSPVFGTFEVGVTSQFISKKGLSKTSDQAYIEFESIEAIVKTASRTKFFIEFYSTCLEEYKKSFENDAQSSDNINFLKVQWSSRQLPTLKPILADIEYLQDQHLLLTVKSMDGYESYGECVVALKSMIGSTAQQFLTFLSHRGEETGNIRGSMKVRVPTERLGTRERLYEWISIDKDEAGAKSKAPSVSRGSQEPRSGSRKPAFTEASCPLSRLFEEPEKPPPTGRPPAPPRAAPREEPLTPRLKPEGAPEPEGVAAPHPRTASITLPTTSLKGSRTSCCPRSHPRLPGPLSHLPPRTKWPLQCLLHSLGTTGTLVWERGVLQMRSLEAHCPLQTFHLHHCRTQPSSCPPAWILYQGQWSGAVVGLRPVAHHLPRPIQGLHCPQAPHQPALSWGKWPVGMTGPARCCRWPRR

SEQ ID NO: 812585 - protein, 104 aa, Homo sapiens [sequence omitted]

SEQ ID NO: 812586 - protein, 104 aa, Homo sapiens [sequence omitted]

SEQ ID NO: 812587 - protein, 198 aa, Homo sapiens
EVTLEDSGILDWKREAFCQLLQLMKNKHSKQDEPDMISVFIGTWNMGSVPPPKNVTSWFTSKGLGKTLDEVTVTIPHDIYVFGTQENSVGDREWLDLLRGGLKELTDLDYRPIAMQSLWNIKVAVLVKPEHENRISHVSTSSVKTGIANTLGNKGAVGVSFMFNGTSFGFVNCHLTSGNEKTARGPNYSTSPVRSRSI

SEQ ID NO: 812588 - protein, 168 aa, Homo sapiens
ANWQGIPVDGGLPGCLPAPEWLLFPQKREAFCQLLQLMKNKHSKQDEPDMISVFIGTWNMGSVPPPKNVTSWFTSKGLGKTLDEVTVTIPHDIYVFGTQENSVGDREWLDLLRGGLKELTDLDYRPVRGGHLVQDPVLTHHLQTSLLDFMGNPGSTASLAFSLVPEHI

SEQ ID NO: 812589 - protein, 904 aa, Homo sapiens
SKITVFWKELIDPRLIIESPSNTQVQNLPQTGEQELESLVLKLSVLKDFLSGIQKKALKALQDMSSTAPPAPQPSTRKAKTIPVQAFEVKLDVTLGDLTKIGKSQKFTLSVDVEGGRLVLLRRQRDSQEDWTTFTHDRIRQLIKSQRVQNKLGVVFEKEKDRTQRKDFIFVSARKREAFCQLLQLMKNKHSKQDEPDMISVFIGTWNMGSVPPPKNVTSWFTSKGLGKTLDEVTVTIPHDIYVFGTQENSVGDREWLDLLRGGLKELTDLDYRPIAMQSLWNIKVAVLVKPEHENRISHVSTSSVKTGIANTLGNKGAVGVSFMFNGTSFGFVNCHLTSGNEKTARRNQNYLDILRLLSLGDRQLNAFDISLRFTHLFWFGDLNYRLDMDIQEILNYISRKEFEPLLRVDQLNLEREKHKVFLRFSEEEISFPPTYRYERGSRDTYAWHKQKPTGVRTNVPSWCDRILWKSYPETHIICNSYGCTDDIVTSDHSPVFGTFEVGVTSQFISKKGLSKTSDQAYIEFESIEAIVKTASRTKFFIEFYSTCLEEYKKSFENDAQSSDNINFLKVQWSSRQLPTLKPILADIEYLQDQHLLLTVKSMDGYESYGECVVALKSMIGSTAQQFLTFLSHRGEETGNIRGSMKVRVPTERLGTRERLYEWISIDKDEAGAKSKAPSVSRGSQEPRSGSRKPAFTEASCPLSRLFEEPEKPPPTGRPPAPPRAAPREEPLTPRLKPEGAPEPEGVAAPHPRTASITLPTTSLKGSRTSCCPRSHPRLPGPLSHLPPRTKWPLQCLLHSLGTTGTLVWERGVLQMRSLEAHCPLQTFHLHHCRTQPSSCPPAWILYQGQWSGAVVGLRPVAHHLPRPIQGLHCPQAPHQPALSWGKWPVGMTGPARCCRWPRR

SEQ ID NO: 812590 - protein, 742 aa, Homo sapiens
EVTLEDSGILDWKREAFCQLLQLMKNKHSKQDEPDMISVFIGTWNMGSVPPPKNVTSWFTSKGLGKTLDEVTVTIPHDIYVFGTQENSVGDREWLDLLRGGLKELTDLDYRPIAMQSLWNIKVAVLVKPEHENRISHVSTSSVKTGIANTLGNKGAVGVSFMFNGTSFGFVNCHLTSGNEKTARRNQNYLDILRLLSLGDRQLNAFDISLRFTHLFWFGDLNYRLDMDIQEILNYISRKEFEPLLRVDQLNLEREKHKVFLRFSEEEISFPPTYRYERGSRDTYAWHKQKPTGVRTNVPSWCDRILWKSYPETHIICNSYGCTDDIVTSDHSPVFGTFEVGVTSQFISKKGLSKTSDQAYIEFESIEAIVKTASRTKFFIEFYSTCLEEYKKSFENDAQSSDNINFLKVQWSSRQLPTLKPILADIEYLQDQHLLLTVKSMDGYESYGECVVALKSMIGSTAQQFLTFLSHRGEETGNIRGSMKVRVPTERLGTRERLYEWISIDKDEAGAKSKAPSVSRGSQEPRSGSRKPAFTEASCPLSRLFEEPEKPPPTGRPPAPPRAAPREEPLTPRLKPEGAPEPEGVAAPHPRTASITLPTTSLKGSRTSCCPRSHPRLPGPLSHLPPRTKWPLQCLLHSLGTTGTLVWERGVLQMRSLEAHCPLQTFHLHHCRTQPSSCPPAWILYQGQWSGAVVGLRPVAHHLPRPIQGLHCPQAPHQPALSWGKWPVGMTGPARCCRWPRR

SEQ ID NO: 812591 - protein, 1129 aa, Homo sapiens; identical to SEQ ID NO: 812583

SEQ ID NO: 812592 - protein, 1129 aa, Homo sapiens; identical to SEQ ID NO: 812583

SEQ ID NO: 812593 - protein, 1129 aa, Homo sapiens; identical to SEQ ID NO: 812583

SEQ ID NO: 812594 - protein, 1129 aa, Homo sapiens; identical to SEQ ID NO: 812583

SEQ ID NO: 812595 - protein, 529 aa, Homo sapiens
IASFLTSLMCNLIWGLQEILNYISRKEFEPLLRVDQLNLEREKHKVFLRFSEEEISFPPTYRYERGSRDTYAWHKQKPTGVRTNVPSWCDRILWKSYPETHIICNSYGCTDDIVTSDHSPVFGTFEVGVTSQFISKKGLSKTSDQAYIEFESIEAIVKTASRTKFFIEFYSTCLEEYKKSFENDAQSSDNINFLKVQWSSRQLPTLKPILADIEYLQDQHLLLTVKSMDGYESYGECVVALKSMIGSTAQQFLTFLSHRGEETGNIRGSMKVRVPTERLGTRERLYEWISIDKDEAGAKSKAPSVSRGSQEPRSGSRKPAFTEASCPLSRLFEEPEKPPPTGRPPAPPRAAPREEPLTPRLKPEGAPEPEGVAAPHPRTASITLPTTSLKGSRTSCCPRSHPRLPGPLSHLPPRTKWPLQCLLHSLGTTGTLVWERGVLQMRSLEAHCPLQTFHLHHCRTQPSSCPPAWILYQGQWSGAVVGLRPVAHHLPRPIQGLHCPQAPHQPALSWGKWPVGMTGPARCCRWPRR

SEQ ID NO: 812596 - protein, 133 aa, Homo sapiens [sequence omitted]

SEQ ID NO: 812597 - protein, 510 aa, Homo sapiens
MKNLVRLAVFTMASMLSNSMKAWSEVFESPFLEMNWEVTPTYRYERGSRDTYAWHKQKPTGVRTNVPSWCDRILWKSYPETHIICNSYGCTDDIVTSDHSPVFGTFEVGVTSQFISKKGLSKTSDQAYIEFESIEAIVKTASRTKFFIEFYSTCLEEYKKSFENDAQSSDNINFLKVQWSSRQLPTLKPILADIEYLQDQHLLLTVKSMDGYESYGECVVALKSMIGSTAQQFLTFLSHRGEETGNIRGSMKVRVPTERLGTRERLYEWISIDKDEAGAKSKAPSVSRGSQEPRSGSRKPAFTEASCPLSRLFEEPEKPPPTGRPPAPPRAAPREEPLTPRLKPEGAPEPEGVAAPHPRTASITLPTTSLKGSRTSCCPRSHPRLPGPLSHLPPRTKWPLQCLLHSLGTTGTLVWERGVLQMRSLEAHCPLQTFHLHHCRTQPSSCPPAWILYQGQWSGAVVGLRPVAHHLPRPIQGLHCPQAPHQPALSWGKWPVGMTGPARCCRWPRR

SEQ ID NO: 812598 - protein, 1129 aa, Homo sapiens; identical to SEQ ID NO: 812583

SEQ ID NO: 812599 - protein, 428 aa, Homo sapiens
SYPLSPGCTDDIVTSDHSPVFGTFEVGVTSQFISKKGLSKTSDQAYIEFESIEAIVKTASRTKFFIEFYSTCLEEYKKSFENDAQSSDNINFLKVQWSSRQLPTLKPILADIEYLQDQHLLLTVKSMDGYESYGECVVALKSMIGSTAQQFLTFLSHRGEETGNIRGSMKVRVPTERLGTRERLYEWISIDKDEAGAKSKAPSVSRGSQEPRSGSRKPAFTEASCPLSRLFEEPEKPPPTGRPPAPPRAAPREEPLTPRLKPEGAPEPEGVAAPHPRTASITLPTTSLKGSRTSCCPRSHPRLPGPLSHLPPRTKWPLQCLLHSLGTTGTLVWERGVLQMRSLEAHCPLQTFHLHHCRTQPSSCPPAWILYQGQWSGAVVGLRPVAHHLPRPIQGLHCPQAPHQPALSWGKWPVGMTGPARCCRWPRR

SEQ ID NO: 812600 - protein, 406 aa, Homo sapiens
DSRIPLCSLFISKKGLSKTSDQAYIEFESIEAIVKTASRTKFFIEFYSTCLEEYKKSFENDAQSSDNINFLKVQWSSRQLPTLKPILADIEYLQDQHLLLTVKSMDGYESYGECVVALKSMIGSTAQQFLTFLSHRGEETGNIRGSMKVRVPTERLGTRERLYEWISIDKDEAGAKSKAPSVSRGSQEPRSGSRKPAFTEASCPLSRLFEEPEKPPPTGRPPAPPRAAPREEPLTPRLKPEGAPEPEGVAAPHPRTASITLPTTSLKGSRTSCCPRSHPRLPGPLSHLPPRTKWPLQCLLHSLGTTGTLVWERGVLQMRSLEAHCPLQTFHLHHCRTQPSSCPPAWILYQGQWSGAVVGLRPVAHHLPRPIQGLHCPQAPHQPALSWGKWPVGMTGPARCCRWPRR

SEQ ID NO: 812601 - protein, 1129 aa, Homo sapiens; identical to SEQ ID NO: 812583

SEQ ID NO: 812602 - protein, 1129 aa, Homo sapiens; identical to SEQ ID NO: 812583

SEQ ID NO: 812603 - protein, 1129 aa, Homo sapiens; identical to SEQ ID NO: 812583

SEQ ID NO: 812604 - protein, 1129 aa, Homo sapiens; identical to SEQ ID NO: 812583

SEQ ID NO: 812605 - protein, 1129 aa, Homo sapiens; identical to SEQ ID NO: 812583

SEQ ID NO: 812606 - protein, 1129 aa, Homo sapiens; identical to SEQ ID NO: 812583

SEQ ID NO: 812607 - protein, 282 aa, Homo sapiens
APFKDVVEQYYVLEGVPHQLLPPEPPSPARAPVPSATKNKVAITVPAPQLGHHRHPRVGEGSSSDEESGGTLPPPDFPPPPLPDSAIFLPPSLDPLPGPVVRGRGGAEARGPPPPKAHPRPPLPPGPSPASTFLGEVASGDDRSCSVLQMAKTLSEVDYAPAGPARSALLPGPLELQPPRGLPSDYGRPLSFPPPRIRESIQEDLAEEAPCLQGGRASGLGEAGMSAWLRAIGLERYEEGLVHNGWDDLEFLSDITEEDLEEAGVQDPAHKRLLLDTLQLSK

SEQ ID NO: 812608 - protein, 1129 aa, Homo sapiens; identical to SEQ ID NO: 812583

SEQ ID NO: 812609 - protein, 245 aa, Homo sapiens
MGKVAITVPAPQLGHHRHPRVGEGSSSDEESGGTLPPPDFPPPPLPDSAIFLPPSLDPLPGPVVRGRGGAEARGPPPPKAHPRPPLPPGPSPASTFLGEVASGDDRSCSVLQMAKTLSEVDYAPAGPARSALLPGPLELQPPRGLPSDYGRPLSFPPPRIRESIQEDLAEEAPCLQGGRASGLGEAGMSAWLRAIGLERYEEGLVHNGWDDLEFLSDITEEDLEEAGVQDPAHKRLLLDTLQLSK

SEQ ID NO: 812610 - protein, 1025 aa, Homo sapiens
MASACGAPGPGGALGSQAPSWYHRDLSRAAAEELLARAGRDGSFLVRDSESVAGAFALCVLYQKHVHTYRILPDGEDFLAVQTSQGVPVRRFQTLGELIGLYAQPNQGLVCALLLPVEGEREPDPPDDRDASDGEDEKPPLPPRSGSTSISAPTGPSSPLPAPETPTAPAAESAPNGLSTVSHDYLKGSYGLDLEAVRGGASHLPHLTRTLATSCRRLHSEVDKVLSGLEILSKVFDQQSSPMVTRLLQQQNLPQTGEQELESLVLKLSVLKDFLSGIQKKALKALQDMSSTAPPAPQPSTRKAKTIPVQAFEVKLDVTLGDLTKIGKSQKFTLSVDVEGGRLVLLRRQRDSQEDWTTFTHDRIRQLIKSQRVQNKLGVVFEKEKDRTQRKDFIFVSARKREAFCQLLQLMKNKHSKQDEPDMISVFIGTWNMGSVPPPKNVTSWFTSKGLGKTLDEVTVTIPHDIYVFGTQENSVGDREWLDLLRGGLKELTDLDYRPIAMQSLWNIKVAVLVKPEHENRISHVSTSSVKTGIANTLGNKGAVGVSFMFNGTSFGFVNCHLTSGNEKTARRNQNYLDILRLLSLGDRQLNAFDISLRFTHLFWFGDLNYRLDMDIQEILNYISRKEFEPLLRVDQLNLEREKHKVFLRFSEEEISFPPTYRYERGSRDTYAWHKQKPTGVRTNVPSWCDRILWKSYPETHIICNSYGCTDDIVTSDHSPVFGTFEVGVTSQFISKKGLSKTSDQAYIEFESIEAIVKTASRTKFFIEFYSTCLEEYKKSFENDAQSSDNINFLKVQWSSRQLPTLKPILADIEYLQDQHLLLTVKSMDGYESYGECVVALKSMIGSTAQQFLTFLSHRGEETGNIRGSMKVRVPTERLGTRERLYEWISIDKDEAGAKSKAPSVSRGSQEPRSGSRKPAFTEASCPLSRLFEEPEKPPPTGRPPAPPRAAPREEPLTPRLKPEGAPEPEGVAAPHPRTASITLPTLVLSCFTGPRLPAPGVPVGVHLGTSGPPLSPVSAAFHRA

SEQ ID NO: 812611 - protein, 913 aa, Homo sapiens
MASACGAPGPGGALGSQAPSWYHRDLSRAAAEELLARAGRDGSFLVRDSESVAGAFALCVLYQKHVHTYRILPDGEDFLAVQTSQGVPVRRFQTLGELIGLYAQPNQGLVCALLLPVEGEREPDPPDDRDASDGEDEKPPLPPRSGSTSISAPTGPSSPLPAPETPTAPAAESAPNGLSTVSHDYLKGSYGLDLEAVRGGASHLPHLTRTLATSCRRLHSEVDKVLSGLEILSKVFDQQSSPMVTRLLQQQNLPQTGEQELESLVLKLSVLKDFLSGIQKKALKALQDMSSTAPPAPQPSTRKAKTIPVQAFEVKLDVTLGDLTKIGKSQKFTLSVDVEGGRLVLLRRQRDSQEDWTTFTHDRIRQLIKSQRVQNKLGVVFEKEKDRTQRKDFIFVSARKREAFCQLLQLMKNKHSKQDEPDMISVFIGTWNMGSVPPPKNVTSWFTSKGLGKTLDEVTVTIPHDIYVFGTQENSVGDREWLDLLRGGLKELTDLDYRPIAMQSLWNIKVAVLVKPEHENRISHVSTSSVKTGIANTLGNKGAVGVSFMFNGTSFGFVNCHLTSGNEKTARRNQNYLDILRLLSLGDRQLNAFDISLRFTHLFWFGDLNYRLDMDIQEILNYISRKEFEPLLRVDQLNLEREKHKVFLRFSEEEISFPPTYRYERGSRDTYAWHKQKPTGVRTNVPSWCDRILWKSYPETHIICNSYGCTDDIVTSDHSPVFGTFEVGVTSQFISKKGLSKTSDQAYIEFESIEAIVKTASRTKFFIEFYSTCLEEYKKSFENDAQSSDNINFLKVQWSSRQLPTLKPILADIEYLQDQHLLLTVKSMDGYESYGECVVALKSMIGSTAQQFLTFLSHRGEETGNIRGSMKVRVPTERLGTRERLYEWISIDKDEAGAKSKAPSVSRGSQEPR

SEQ ID NO: 812612 - protein, 910 aa, Homo sapiens
MASACGAPGPGGALGSQAPSWYHRDLSRAAAEELLARAGRDGSFLVRDSESVAGAFALCVLYQKHVHTYRILPDGEDFLAVQTSQGVPVRRFQTLGELIGLYAQPNQGLVCALLLPVEGEREPDPPDDRDASDGEDEKPPLPPRSGSTSISAPTGPSSPLPAPETPTAPAAESAPNGLSTVSHDYLKGSYGLDLEAVRGGASHLPHLTRTLATSCRRLHSEVDKVLSGLEILSKVFDQQSSPMVTRLLQQQNLPQTGEQELESLVLKLSVLKDFLSGIQKKALKALQDMSSTAPPAPQPSTRKAKTIPVQAFEVKLDVTLGDLTKIGKSQKFTLSVDVEGGRLVLLRRQRDSQEDWTTFTHDRIRQLIKSQRVQNKLGVVFEKEKDRTQRKDFIFVSARKREAFCQLLQLMKNKHSKQDEPDMISVFIGTWNMGSVPPPKNVTSWFTSKGLGKTLDEVTVTIPHDIYVFGTQENSVGDREWLDLLRGGLKELTDLDYRPIAMQSLWNIKVAVLVKPEHENRISHVSTSSVKTGIANTLGNKGAVGVSFMFNGTSFGFVNCHLTSGNEKTARRNQNYLDILRLLSLGDRQLNAFDISLRFTHLFWFGDLNYRLDMDIQEILNYISRKEFEPLLRVDQLNLEREKHKVFLRFSEEEISFPPTYRYERGSRDTYAWHKQKPTGVRTNVPSWCDRILWKSYPETHIICNSYGCTDDIVTSDHSPVFGTFEVGVTSQFISKKGLSKTSDQAYIEFESIEAIVKTASRTKFFIEFYSTCLEEYKKSFENDAQSSDNINFLKVQWSSRQLPTLKPILADIEYLQDQHLLLTVKSMDGYESYVIAIHGRKSKRAGREHRGGQRRVQHVGWYPRPGSDRDMAGDTGQRGPQLPPHQRIHLVAGTGAAPERFSGYAELEA

SEQ ID NO: 812613 - protein, 818 aa, Homo sapiens
MASACGAPGPGGALGSQAPSWYHRDLSRAAAEELLARAGRDGSFLVRDSESVAGAFALCVLYQKHVHTYRILPDGEDFLAVQTSQGVPVRRFQTLGELIGLYAQPNQGLVCALLLPVEGEREPDPPDDRDASDGEDEKPPLPPRSGSTSISAPTGPSSPLPAPETPTAPAAESAPNGLSTVSHDYLKGSYGLDLEAVRGGASHLPHLTRTLATSCRRLHSEVDKVLSGLEILSKVFDQQSSPMVTRLLQQQNLPQTGEQELESLVLKLSVLKDFLSGIQKKALKALQDMSSTAPPAPQPSTRKAKTIPVQAFEVKLDVTLGDLTKIGKSQKFTLSVDVEGGRLVLLRRQRDSQEDWTTFTHDRIRQLIKSQRVQNKLGVVFEKEKDRTQRKDFIFVSARKREAFCQLLQLMKNKHSKQDEPDMISVFIGTWNMGSVPPPKNVTSWFTSKGLGKTLDEVTVTIPHDIYVFGTQENSVGDREWLDLLRGGLKELTDLDYRPIAMQSLWNIKVAVLVKPEHENRISHVSTSSVKTGIANTLGNKGAVGVSFMFNGTSFGFVNCHLTSGNEKTARRNQNYLDILRLLSLGDRQLNAFDISLRFTHLFWFGDLNYRLDMDIQEILNYISRKEFEPLLRVDQLNLEREKHKVFLRFSEEEISFPPTYRYERGSRDTYAWHKQKPTGVRTNVPSWCDRILWKSYPETHIICNSYGCTDDIVTSDHSPVFGTFEVGVTSQFISKKGLSKTSDQAYIEFESIEAIVKTASRTKFFIEFYSTCLEEYKKSFENDAQSSDNINFLKVQWSSRQLPTPGTGSCKQPPGQS

SEQ ID NO: 812614 - protein, 283 aa, Homo sapiens
KNRLRSRLPVNRQRVKTASRTKFFIEFYSTCLEEYKKSFENDAQSSDNINFLKVQWSSRQLPTLKPILADIEYLQDQHLLLTVKSMDGYESYGECVVALKSMIGSTAQQFLTFLSHRGEETGNIRGSMKVRVPTERLGTRERLYEWISIDKDEAGAKSKAPSVSRGSQEPRSGSRKPAFTEASCPLSRLFEEPEKPPPTGRPPAPPRAAPREEPLTPRLKPEGAPEPEGVAAPHPRTASITLPTLVLSCFTGPRLPAPGVPVGVHLGTSGPPLSPVSAAFHRA

SEQ ID NO: 812615 - protein, 737 aa, Homo sapiens
MASACGAPGPGGALGSQAPSWYHRDLSRAAAEELLARAGRDGSFLVRDSESVAGAFALCVLYQKHVHTYRILPDGEDFLAVQTSQGVPVRRFQTLGELIGLYAQPNQGLVCALLLPVEGEREPDPPDDRDASDGEDEKPPLPPRSGSTSISAPTGPSSPLPAPETPTAPAAESAPNGLSTVSHDYLKGSYGLDLEAVRGGASHLPHLTRTLATSCRRLHSEVDKVLSGLEILSKVFDQQSSPMVTRLLQQQNLPQTGEQELESLVLKLSVLKDFLSGIQKKALKALQDMSSTAPPAPQPSTRKAKTIPVQAFEVKLDVTLGDLTKIGKSQKFTLSVDVEGGRLVLLRRQRDSQEDWTTFTHDRIRQLIKSQRVQNKLGVVFEKEKDRTQRKDFIFVSARKREAFCQLLQLMKNKHSKQDEPDMISVFIGTWNMGSVPPPKNVTSWFTSKGLGKTLDEVTVTIPHDIYVFGTQENSVGDREWLDLLRGGLKELTDLDYRPIAMQSLWNIKVAVLVKPEHENRISHVSTSSVKTGIANTLGNKGAVGVSFMFNGTSFGFVNCHLTSGNEKTARRNQNYLDILRLLSLGDRQLNAFDISLRFTHLFWFGDLNYRLDMDIQEILNYISRKEFEPLLRVDQLNLEREKHKVFLRFSEEEISFPPTYRYERGSRDTYAWHKQKPTGVRTNVPSWCDRILWKSYPETHIICNSYGCTDDIVTSDHSPVFERALSSVGSLSTLGR

SEQ ID NO: 812616 - protein, 173 aa, Homo sapiens
MASACGAPGPGGALGSQAPSWYHRDLSRAAAEELLARAGRDGSFLVRDSESVAGAFALCVLYQKHVHTYRILPDGEDFLAVQTSQGVPVRRFQTLGELIGLYAQPNQGLVCALLLPVEGEREPDPPDDRDASDGEDEKPPLPPRSGSTSISAPTGPSSPLPAPETPTAPAAER

SEQ ID NO: 812617 - protein, 188 aa, Homo sapiens
VLLPFSSGLSKTSDQAYIEFESIEAIVKTASRTKFFIEFYSTCLEEYKKSFENDAQSSDNINFLKVQWSSRQLPTLKPILADIEYLQDQHLLLTVKSMDGYESYVFCVGLGRESTLILLGLVGVGQDLSHKVPVCLVLTVSWSVLPCSGDARRQGGGGRFLAGLSPGQGLASSLLGSRKGCGVMSSIN

SEQ ID NO: 812618 - protein, 175 aa, Homo sapiens
MASACGAPGPGGALGSQAPSWYHRDLSRAAAEELLARAGRDGSFLVRDSESVAGAFALCVLYQKHVHTYRILPDGEDFLAVQTSQGVPVRRFQTLGELIGLYAQPNQGLVCALLLPVEGEREPDPPDDRDASGTSQCAGPLPAPVPWLYLPLPIPPSQPHLSCNPLSLGHDAGAL

SEQ ID NO: 812619 - protein, 73 aa, Homo sapiens
GSGDHALSTQIAMQSLWNIKVAVLVKPEHENRISHVSTSSVKTGIANTLGKWGWQVPKSGSVSLSMASASSQA

SEQ ID NO: 812620 - protein, 754 aa, Homo sapiens
MLVAGLLLWASLLTGAWPSFPTQDHLPATPRVRLSFKELKATGTAHFFNFLLNTTDYRILLKDEDHDRMYVGSKDYVLSLDLHDINREPLIIHWAASPQRIEECVLSGKDVNGECGNFVRLIQPWNRTHLYVCGTGAYNPMCTYVNRGRRAQDYIFYLEPERLESGKGKCPYDPKLDTASALINEELYAGVYIDFMGTDAAIFRTLGKQTAMRTDQYNSRWLNDPSFIHAELIPDSAERNDDKLYFFFRERSAEAPQSPAVYARIGRICLNDDGGHCCLVNKWSTFLKARLVCSVPGEDGIETHFDELQDVFVQQTQDVRNPVIYAVFTSSGSVFRGSAVCVYSMADIRMVFNGPFAHKEGPNYQWMPFSGKMPYPRPGTCPGGTFTPSMKSTKDYPDEVINFMRSHPLMYQAVYPLQRRPLVVRTGAPYRLTTIAVDQVDAADGRYEVLFLGTDRGTVQKVIVLPKDDQEMEELMLEEVEVFKDPAPVKTMTISSKRQQLYVASAVGVTHLSLHRCQAYGAACADCCLARDPYCAWDGQACSRYTASSKRRSRRQDVRHGNPIRQCRGFNSNANKNAVESVQYGVAGSAAFLECQPRSPQATVKWLFQRDPGDRRREIRAEDRFLRTEQGLLLRALQLSDRGLYSCTATENNFKHVVTRVQLHVLGRDAVHAALFPPLSMSAPPPPGAGPPTPPYQELAQLLAQPEVGLIHQYCQGYWRHVPPSPREAPGAPRSPEPQDQKKPRNRRHHPPDT

SEQ ID NO: 812621 - protein, 785 aa, Homo sapiens
MLVAGLLLWASLLTGAWPSFPTQDHLPATPRVRLSFKELKATGTAHFFNFLLNTTDYRILLKDEDHDRMYVGSKDYVLSLDLHDINREPLIIHWAASPQRIEECVLSGKDVNGECGNFVRLIQPWNRTHLYVCGTGAYNPMCTYVNRGRRAQATPWTQTQAVRGRGSRATDGALRPMPTAPRQDYIFYLEPERLESGKGKCPYDPKLDTASALINEELYAGVYIDFMGTDAAIFRTLGKQTAMRTDQYNSRWLNDPSFIHAELIPDSAERNDDKLYFFFRERSAEAPQSPAVYARIGRICLNDDGGHCCLVNKWSTFLKARLVCSVPGEDGIETHFDELQDVFVQQTQDVRNPVIYAVFTSSGSVFRGSAVCVYSMADIRMVFNGPFAHKEGPNYQWMPFSGKMPYPRPGTCPGGTFTPSMKSTKDYPDEVINFMRSHPLMYQAVYPLQRRPLVVRTGAPYRLTTIAVDQVDAADGRYEVLFLGTDRGTVQKVIVLPKDDQEMEELMLEEVEVFKDPAPVKTMTISSKRQQLYVASAVGVTHLSLHRCQAYGAACADCCLARDPYCAWDGQACSRYTASSKRRSRRQDVRHGNPIRQCRGFNSNANKNAVESVQYGVAGSAAFLECQPRSPQATVKWLFQRDPGDRRREIRAEDRFLRTEQGLLLRALQLSDRGLYSCTATENNFKHVVTRVQLHVLGRDAVHAALFPPLSMSAPPPPGAGPPTPPYQELAQLLAQPEVGLIHQYCQGYWRHVPPSPREAPGAPRSPEPQDQKKPRNRRHHPPDT

SEQ ID NO: 812622 - protein, 280 aa, Homo sapiens
MIGVSWIGVLRISTRQDMTISSKRQQLYVASAVGVTHLSLHRCQAYGAACADCCLARDPYCAWDGQACSRYTASSKRRSRRQDVRHGNPIRQCRGFNSNANKNAVESVQYGVAGSAAFLECQPRSPQATVKWLFQRDPGDRRREIRAEDRFLRTEQGLLLRALQLSDRGLYSCTATENNFKHVVTRVQLHVLGRDAVHAALFPPLSMSAPPPPGAGPPTPPYQELAQLLAQPEVGLIHQYCQGYWRHVPPSPREAPGAPRSPEPQDQKKPRNRRHHPPDT

SEQ ID NO: 812623 - protein, 94 aa, Homo sapiens
RPRRRSRLRRSGERSRAGPWPRGAASADRPNGSRSVPPPPPGRPGPAAAEEVSREWSLLPGPQPLLPSPPGQGRATPLYLLSFPCATLTQRLGA

SEQ ID NO: 812624 - protein, 96 aa, Homo sapiens
MLVAGLLLWASLLTGAWPSFPTQDHLPATPRVRLSFKELKATGTAHFFNFLLNTTDYRILLKDEDHDRMYVGSKDYVLSLDLHDINREPLIVRAGP

SEQ ID NO: 812625 - protein, 290 aa, Homo sapiens
MLVAGLLLWASLLTGAWPSFPTQDHLPATPRVRLSFKELKATGTAHFFNFLLNTTDYRILLKASCLCLPWASLALVPFNIKDIYIYIYIYKISIFYTHPAPAKTVFIGGLNIACLSGSILQNLDPCWSETAENRACLTRPSQLVGPGQDHTVPRLSWKSTCWTGLRQDLQDKGREQALLGWGTDCPPFLMCVVSLCCGIDMDARTTLETGVASRAHREGKKGPSQDASPCLGWGHSATTSPFLGIYSLFIGDRRRGILPGWDSPFSPFSPPRLARAGPPHSTSLAFPVPL

SEQ ID NO: 812626 - protein, 75 aa, Homo sapiens
MYTRIDVLWGAHVFTCVPGLCGVRGWQPEPAPPAPATPSSNPFSSSSQATPWTQTQAVRGRGSRATDGALRPMPT

SEQ ID NO: 812627 - protein, 601 aa, Homo sapiens
LPPATASATDAEGTAPRPPPLAAAIAASDFRTSVVLNHLAEKWFPGQRERARAAGRLGELLHQGRYREALAAACEALRAEPSDLIVKIYRAESYAGLQEFKAAIEDLNAVLFQLPDWPEVYFRKGKVLCDAGFLGDALQLFLQCLALDEDFAPAKLQVQKILCDLLLPENLKEGLKESSWSSLPCTKNRPFDFHSVMEESQSLNEPSPKQSEEIPEVTSEPVKGSLNRAQSAQSINSTEMPAREDCLKRVSSEPVLSVQEKGVLLKRKLSLLEQDVIVNEDGRNKLKKQGAYGDIPEELIDVSDFECSLCMRLFFEPVTTPCGHSFCKNCLERCLDHAPYCPLCKESLKEYLADRRYCVTQLLEELIVKYLPDELSERKKIYDEETAELSHLTKNVPIFVCTMAYPTVPCPLHVFEPRYRLMIRRSIQTGTKQFGMCVSDTQNSFADYGCMLQIRNVHFLPDGRSVVDTVGGKRFRVLKRGMKDGYCTADIEYLEDVKVENEDEIKNLRELHDLVYSQACSWFQNLRDRFRSQILQHFGSMPEREENLQAAPNGPAWCWWLLAVLPVDPRYQLSVLSMKSLKERLTKIQHILTYFSRDQSK

SEQ ID NO: 812628 - protein, 612 aa, Homo sapiens
LPPATASATDAEGTAPRPPPLAAAIAASDFRTSVVLNHLAEKWFPGQRERARAAGRLGELLHQGRYREALAAACEALRAEPSDLIVKIYRAESYAGLQEFKAAIEDLNAVLFQLPDWPEVYFRKGKVLCDAGFLGDALQLFLQCLALDEDFAPAKLQVQKILCDLLLPENLKEGLKESSWSSLPCTKNRPFDFHSVMEESQSLNEPSPKQSEEIPEVTSEPVKGSLNRAQSAQSINSTEMPAREDCLKRVSSEPVLSVQEKGVLLKRKLSLLEQDVIVNEDGRNKLKKQGETPNEVCMFSLAYGDIPEELIDVSDFECSLCMRLFFEPVTTPCGHSFCKNCLERCLDHAPYCPLCKESLKEYLADRRYCVTQLLEELIVKYLPDELSERKKIYDEETAELSHLTKNVPIFVCTMAYPTVPCPLHVFEPRYRLMIRRSIQTGTKQFGMCVSDTQNSFADYGCMLQIRNVHFLPDGRSVVDTVGGKRFRVLKRGMKDGYCTADIEYLEDVKVENEDEIKNLRELHDLVYSQACSWFQNLRDRFRSQILQHFGSMPEREENLQAAPNGPAWCWWLLAVLPVDPRYQLSVLSMKSLKERLTKIQHILTYFSRDQSK

SEQ ID NO: 812629 - protein, 555 aa, Homo sapiens
GPARARSTGTSGELLHQGRYREALAAACEALRAEPSDLIVKIYRAESYAGLQEFKAAIEDLNAVLFQLPDWPEVYFRKGKVLCDAGFLGDALQLFLQCLALDEDFAPAKLQVQKILCDLLLPENLKEGLKESSWSSLPCTKNRPFDFHSVMEESQSLNEPSPKQSEEIPEVTSEPVKGSLNRAQSAQSINSTEMPAREDCLKRVSSEPVLSVQEKGVLLKRKLSLLEQDVIVNEDGRNKLKKQGAYGDIPEELIDVSDFECSLCMRLFFEPVTTPCGHSFCKNCLERCLDHAPYCPLCKESLKEYLADRRYCVTQLLEELIVKYLPDELSERKKIYDEETAELSHLTKNVPIFVCTMAYPTVPCPLHVFEPRYRLMIRRSIQTGTKQFGMCVSDTQNSFADYGCMLQIRNVHFLPDGRSVVDTVGGKRFRVLKRGMKDGYCTADIEYLEDVKVENEDEIKNLRELHDLVYSQACSWFQNLRDRFRSQILQHFGSMPEREENLQAAPNGPAWCWWLLAVLPVDPRYQLSVLSMKSLKERLTKIQHILTYFSRDQSK

SEQ ID NO: 812630 - protein, 199 aa, Homo sapiens
MAYPTVPCPLHVFEPRYRLMIRRSIQTGTKQFGMCVSDTQNSFADYGCMLQIRNVHFLPDGRSVVDTVGGKRFRVLKRGMKDGYCTADIEYLEDVKVENEDEIKNLRELHDLVYSQACSWFQNLRDRFRSQILQHFGSMPEREENLQAAPNGPAWCWWLLAVLPVDPRYQLSVLSMKSLKERLTKIQHILTYFSRDQSK

SEQ ID NO: 812631 - protein, 601 aa, Homo sapiens; identical to SEQ ID NO: 812627

SEQ ID NO: 812632 - protein, 601 aa, Homo sapiens; identical to SEQ ID NO: 812627

SEQ ID NO: 812633 - protein, 601 aa, Homo sapiens; identical to SEQ ID NO: 812627

SEQ ID NO: 812634 - protein, 570 aa, Homo sapiens
MPGETEEPRPPEQQDQEGGEAAKAAPEEPQQRPPEAVAAAPAGTTSSRVLRGGRDRGRAAAAAAAAAVSRRRKAEYPRRRRSSPSARPPDVPGQQPQAAKSPSPVQGKKSPRLLCIEKVTTDKDPKEEKEEEDDSALPQEVSIAASRPSRGWRSSRTSVSRHRDTENTRSSRSKTGSLQLICKSEPNTDQLDYDVGEEHQSPGGISSEEEEEEEEEMLISEEEIPFKDDPRDETYKPHLERETPKPRRKSGKVKEEKEKKEIKVEVEVEVKEEENEIREDEEPPRKRGRRRKDDKSPRLPKRRKKPPIQYVRCEMEGCGTVLAHPRYLQHHIKYQHLLKKKYVCPHPSCGRLFRLQKQLLRHAKHHTDQRDYICEYCARAFKSSHNLAVHRMIHTGEKPLQCEICGFTCRQKASLNWHMKKHDADSFYQFSCNICGKKFEKKDSVVAHKAKSHPEVLIAEALAANAGALITSTDILGTNPESLTQPSDGQGLPLLPEPLGNSTSGECLLLEAEGMSKSYCSGTERVSLMADGKIFVGSGSSGGTEGLVMNSDILGATTEVLIEDSDSAGP

SEQ ID NO: 812635 - protein, 721 aa, Homo sapiens
MPGETEEPRPPEQQDQEGGEAAKAAPEEPQQRPPEAVAAAPAGTTSSRVLRGGRDRGRAAAAAAAAAVSRRRKAEYPRRRRSSPSARPPDVPGQQPQAAKSPSPVQGKKSPRLLCIEKVTTDKDPKEEKEEEDDSALPQEVSIAASRPSRGWRSSRTSVSRHRDTENTRSSRSKTGSLQLICKSEPNTDQLDYDVGEEHQSPGGISSEEEEEEEEEMLISEEEIPFKDDPRDETYKPHLERETPKPRRKSGKVKEEKEKKEIKVEVEVEVKEEENEIREDEEPPRKRGRRRKDDKSPRLPKRRKKPPIQYVRCEMEGCGTVLAHPRYLQHHIKYQHLLKKKYVCPHPSCGRLFRLQKQLLRHAKHHTDQRDYICEYCARAFKSSHNLAVHRMIHTGEKPLQCEICGFTCRQKASLNWHMKKHDADSFYQFSCNICGKKFEKKDSVVAHKAKSHPEVLIAEALAANAGALITSTDILGTNPESLTQPSDGQGLPLLPEPLGNSTSGECLLLEAEGMSKSYCSGTERSIHLLTPHRRDLCSRSIWLARKIRSDLTALTESYVKHQGLNKNINLDSADGMPVASTDQWSELTEAERLQENLQAYRTFHVLLARLLEDQQVHFTPTEGDFHQAIHTLLLQVAAFAYQIEELMILLEYKIPRNEADGMPINVGDGGLFEKKLWGLKVLQELSQWTVRSIHDLRFISSHQTGIPARGSHYIANNKKM

SEQ ID NO: 812636 - protein, 570 aa, Homo sapiens; identical to SEQ ID NO: 812634

SEQ ID NO: 812637 - protein, 570 aa, Homo sapiens; identical to SEQ ID NO: 812634

SEQ ID NO: 812638 - protein, 570 aa, Homo sapiens; identical to SEQ ID NO: 812634

SEQ ID NO: 812639 - protein, 255 aa, Homo sapiens
MPGETEEPRPPEQQDQEGGEAAKAAPEEPQQRPPEAVAAAPAGTTSSRVLRGGRDRGRAAAAAAAAAVSRRRKAEYPRRRRSSPSARPPDVPGQQPQAAKSPSPVQGKKSPRLLCIEKVTTDKDPKEEKEEEDDSALPQEVSIAASRPSRGWRSSRTSVSRHRDTENTRSSRSKTGSLQLICKSEPNTDQLDYDVGEEHQSPGGISSEEEEEEEEEMLISEEEIPFKDDPRDETYKPHLERHVSDFTADMLMKYK

SEQ ID NO: 812640 - protein, 570 aa, Homo sapiens; identical to SEQ ID NO: 812634

SEQ ID NO: 812641 - protein, 570 aa, Homo sapiens; identical to SEQ ID NO: 812634

SEQ ID NO: 812642 - protein, 466 aa, Homo sapiens [sequence omitted]

SEQ ID NO: 812643 - protein, 354 aa, Homo sapiens
MLISEEEIPFKDDPRDETYKPHLERETPKPRRKSGKVKEEKEKKEIKVEVEVEVKEEENEIREDEEPPRKRGRRRKDDKSPRLPKRRKKPPIQYVRCEMEGCGTVLAHPRYLQHHIKYQHLLKKKYVCPHPSCGRLFRLQKQLLRHAKHHTDQRDYICEYCARAFKSSHNLAVHRMIHTGEKPLQCEICGFTCRQKASLNWHMKKHDADSFYQFSCNICGKKFEKKDSVVAHKAKSHPEVLIAEALAANAGALITSTDILGTNPESLTQPSDGQGLPLLPEPLGNSTSGECLLLEAEGMSKSYCSGTERVSLMADGKIFVGSGSSGGTEGLVMNSDILGATTEVLIEDSDSAGP

SEQ ID NO: 812644 - protein, 570 aa, Homo sapiens; identical to SEQ ID NO: 812634

SEQ ID NO: 812645 - protein, 256 aa, Homo sapiens [sequence omitted]

SEQ ID NO: 812646 - protein, 570 aa, Homo sapiens; identical to SEQ ID NO: 812634

SEQ ID NO: 812647 - protein, 380 aa, Homo sapiens
MPGETEEPRPPEQQDQEGGEAAKAAPEEPQQRPPEAVAAAPAGTTSSRVLRGGRDRGRAAAAAAAAAVSRRRKAEYPRRRRSSPSARPPDVPGQQPQAAKSPSPVQGKKSPRLLCIEKVTTDKDPKEEKEEEDDSALPQEVSIAASRPSRGWRSSRTSVSRHRDTENTRSSRSKTGSLQLICKSEPNTDQLDYDVGEEHQSPGGISSEEEEEEEEEMLISEEEIPFKDDPRDETYKPHLERETPKPRRKSGKVKEEKEKKEIKVEVEVEVKEEENEIREDEEPPRKRGRRRKDDKSPRLPKRRKKPPIQYVRCEMEGCGTVLAHPRYLQHHIKYQHLLKKKYVCPHPSCGRLFRLQKQLLRHAKHHTVYSHIQTRTPPCR

SEQ ID NO: 812648 - protein, 286 aa, Homo sapiens
MPGETEEPRPPEQQDQEGGEAAKAAPEEPQQRPPEAVAAAPAGTTSSRVLRGGRDRGRAAAAAAAAAVSRRRKAEYPRRRRSSPSARPPDVPGQQPQAAKSPSPVQGKKSPRLLCIEKVTTDKDPKEEKEEEDDSALPQEVSIAASRPSRGWRSSRTSVSRHRDTENTRSSRSKTGSLQLICKSEPNTDQLDYDVGEEHQSPGGISSEEEEEEEEEMLISEEEIPFKDDPRDETYKPHLERETPKPRRKSGKVKEEKEKKEIKVEVEVEVKEEENEIREDEEPPRK

SEQ ID NO: 812649 - protein, 255 aa, Homo sapiens; identical to SEQ ID NO: 812639

SEQ ID NO: 812650 - protein, 214 aa, Homo sapiens
EAWYQRRGPITAVGPTAMAEPVQEELSVLAAIFCRPHEWEVLSRSETDGTVFRIHTKAEGFMDADIPLELVFHLPVNYPSCLPGISINSEQLTRAQCVTVKEKLLEQAESLLSEPMVHELVLWIQQNLRHILSQPETGSGSEKCTFSTSTTMDDGLWITLLHLDHMRAKTKYVKIVEKWASDLRLTGRLMFMGKIILILLQGDRNNLKVPVSGI

SEQ ID NO: 812651 - protein, 286 aa, Homo sapiens
EAWYQRRGPITAVGPTAMAEPVQEELSVLAAIFCRPHEWEVLSRSETDGTVFRIHTKAEGFMDADIPLELVFHLPVNYPSCLPGISINSEQLTRAQCVTVKEKLLEQAESLLSEPMVHELVLWIQQNLRHILSQPETGSGSEKCTFSTSTTMDDGLWITLLHLDHMRAKTKYVKIVEKWASDLRLTGRLMFMGKIILILLQGDRNNLKVPEYLILQKTSKVDVDSSGKKCKEKMISVLFETKVQTEHKRFLAFEVKEYSALDELQKEFETAGLKKLFSEFVLALVK

SEQ ID NO: 812652 - protein, 214 aa, Homo sapiens; identical to SEQ ID NO: 812650

SEQ ID NO: 812653 - protein, 227 aa, Homo sapiens
RAVLLLAGGGGGCGSGRGSAEAVGPTAMAEPVQEELSVLAAIFCRPHEWEVLSRSETDGTVFRIHTKAEGFMDADIPLELVFHLPVNYPSCLPGISINSEQLTRAQCVTVKEKLLEQAESLLSEPMVHELVLWIQQNLRHILSQPETGSGSEKCTFSTSTTMDDGLWITLLHLDHMRAKTKYVKIVEKWASDLRLTGRLMFMGVLDSSENLQSRCGLKWKEMQREND

SEQ ID NO: 812654 - protein, 429 aa, Homo sapiens
MEINTKLLISVTCISFFTFQLLFYFVSYWFSAKVSPGFNSLSFKKKIEWNSRVVSTCHSLVVGIFGLYIFLFDEATKADPLWGGPSLANVNIAIASGYLISDLSIIILYWKVIGDKFFIMHHCASLYAYYLVLKNGVLAYIGNFRLLAELSSPFVNQRPKAVVTGNMDLFSSLTLHLSTLSLQSPANNKTDGTVFRIHTKAEGFMDADIPLELVFHLPVNYPSCLPGISINSEQLTRAQCVTVKEKLLEQAESLLSEPMVHELVLWIQQNLRHILSQPETGSGSEKCTFSTSTTMDDGLWITLLHLDHMRAKTKYVKIVEKWASDLRLTGRLMFMGKIILILLQGDRNNLKVPEYLILQKTSKVDVDSSGKKCKEKMISVLFETKVQTEHKRFLAFEVKEYSALDELQKEFETAGLKKLFSEFVLALVK

SEQ ID NO: 812655 - protein, 225 aa, Homo sapiens
MDADIPLELVFHLPVNYPSCLPGISINSEQLTRAQCVTVKEKLLEQAESLLSEPMVHELVLWIQQNLRHILSQPETGSGSEKCTFSTSTTMDDGLWITLLHLDHMRAKTKYVKIVEKWASDLRLTGRLMFMGKIILILLQGDRNNLKVPEYLILQKTSKVDVDSSGKKCKEKMISVLFETKVQTEHKRFLAFEVKEYSALDELQKEFETAGLKKLFSEFVLALVK

SEQ ID NO: 812656 - protein, 355 aa, Homo sapiens
MEINTKLLISVTCISFFTFQLLFYFVSYWFSAKVSPGFNSLSFKKKIEWNSRVVSTCHSLVVGIFGLYIFLFDEATKADPLWGGPSLANVNIAIASGYLISDLSIIILYWKVIGDKFFIMHHCASLYAYYLVLKNGVLAYIGNFRLLAELSSPFVNQRPKAVVTGNMDLFSSLTLHLSTLSLQSPANNKTDGTVFRIHTKAEGFMDADIPLELVFHLPVNYPSCLPGISINSEQLTRAQCVTVKEKLLEQAESLLSEPMVHELVLWIQQNLRHILSQPETGSGSEKCTFSTSTTMDDGLWITLLHLDHMRAKTKYVKIVEKWASDLRLTGRLMFMGKIILILLQGDRNNLKVPKS

SEQ ID NO: 812657 - protein, 384 aa, Homo sapiens
GSMVSTQRAHYGGGAHSHGGACAGGALGPGRDFLQAPRVGGAEPLRPENNTETKLKTDHMRATDSTYVNNRGQAGLPDLKADRHRLHVHWELPDFFTQTPPTAEHVDLNVEKTTAPRTTDLALLLRPHTRYPTEHNKVSRHSRTVTSRYFSRSELNSTNTTDPPEHPARTPRNAFFLPHILVPCLPVHTDTRKRPANSFPATPSRQRPTPPAPRRICALSAGDAALHLAPLAHTPHHALPLPRPPLHHGPSLPKPPRGHPKPSYSSLMRNITHPLASEPPRSIILHASAPGPRGPSATATQCTHPPHSNPPTHAPPTRLRPPCSPPPPPIPTQPPAPRTQCSAPRRIPPPVIHTHPPPPPPTTTPAHPHTQPRPAPPPPPPPPP

SEQ ID NO: 812658 - protein, 429 aa, Homo sapiens; identical to SEQ ID NO: 812654

SEQ ID NO: 812659 - protein, 360 aa, Homo sapiens
MEINTKLLISVTCISFFTFQLLFYFVSYWFSAKVSPGFNSLSFKKKIEWNSRVVSTCHSLVVGIFGLYIFLFDEATKADPLWGGPSLANVNIAIASGYLISDLSIIILYWKVIGDKFFIMHHCASLYAYYLVLKNGVLAYIGNFRLLAELSSPFVNQRPKAVVTGNMDLFSSLTLHLSTLSLQSPANNKTDGTVFRIHTKAEGFMDADIPLELVFHLPVNYPSCLPGISINSEQLTRAQCVTVKEKLLEQAESLLSEPMVHELVLWIQQNLRHILSQPETGSGSEKCTFSTSTTMDDGLWITLLHLDHMRAKTKYVKIVEKWASDLRLTGRLMFMGVLDSSENLQSRCGLKWKEMQREND

SEQ ID NO: 812660 - protein, 429 aa, Homo sapiens; identical to SEQ ID NO: 812654

SEQ ID NO: 812661 - protein, 254 aa, Homo sapiens
MFLSCGSLHQRGPETDGTVFRIHTKAEGFMDADIPLELVFHLPVNYPSCLPGISINSEQLTRAQCVTVKEKLLEQAESLLSEPMVHELVLWIQQNLRHILSQPETGSGSEKCTFSTSTTMDDGLWITLLHLDHMRAKTKYVKIVEKWASDLRLTGRLMFMGKIILILLQGDRNNLKVPEYLILQKTSKVDVDSSGKKCKEKMISVLFETKVQTEHKRFLAFEVKEYSALDELQKEFETAGLKKLFSEFVLALVK

SEQ ID NO: 812662 - protein, 263 aa, Homo sapiens
MEINTKLLISVTCISFFTFQLLFYFVSYWFSAKVSPGFNSLSFKKKIEWNSRVVSTCHSLVVGIFGLYIFLFDEATKADPLWGGPSLANVNIAIASGYLISDLSIIILYWKVIGDKFFIMHHCASLYAYYLVLKNGVLAYIGNFRLLAELSSPFVNQRWFFEALKYPKFSKAIVINGILMTVVFFIVRIASMLPHYGFMYSVYGTEPYIRLGVLIQLSWVISCVVLDVMNVMWMIKISKGCIKVISHIRQEKAKNSLQNGKLD

SEQ ID NO: 812663 - protein, 135 aa, Homo sapiens
EDVFGQLECTGPRATAMQPLEVGLVPAPAGEPRLTRWLRRGSGILAHLVALGFTIFLTALSRPGTKTGPLMEDRSEGGRARWVMPEIPKCCDYRREPPCLARSCFENLTVGDSGILPKPAGRCAKACSELIIIIS

SEQ ID NO: 812664 - protein, 754 aa, Homo sapiens
MWKLLPAAGPAGGEPYRLLTGVEYVVGRKNCAILIENDQSISRNHAVLTANFSVTNLSQTDEIPVLTLKDNSKYGTFVNEEKMQNGFSRTLKSGDGITFGVFGSKFRIEYEPLVACSSCLDVSGKTALNQAILQLGGFTVNNWTEECTHLVMVSVKVTIKTICALICGRPIVKPEYFTEFLKAVESKKQPPQIESFYPPLDEPSIGSKNVDLSGRQERKQIFKGKTFIFLNAKQHKKLSSAVVFGGGEARLITEENEEEHNFFLAPGTCVVDTGITNSQTLIPDCQKKWIQSIMDMLQRQGLRPIPEAEIGLAVIFMTTKNYCDPQGHPSTGLKTTTPGPSLSQGVSVDEKLMPSAPVNTTTYVADTESEQADTWDLSERPKEIKVSKMEQKFRMLSQDAPTVKESCKTSSNNNSMVSNTLAKMRIPNYQLSPTKLPSINKSKDRASQQQQTNSIRNYFQPSTKKRERDEENQEMSSCKSARIETSCSLLEQTQPATPSLWKNKEQHLSENEPVDTNSDNNLFTDTDLKSIVKNSASKSHAAEKLRSNKKREMDDVAIEDEVLEQLFKDTKPELEIDVKVQKQEEDVNVRKRPRMDIETNDTFSDEAVPESSKISQENEIGKKRELKEDSLWSAKEISNNDKLQDDSEMLPKKLLLTEFRSLVIKNSTSRNPSGINDDYGQLKNFKKFKKVTYPGAGKLPHIIGGSDLIAHHARKNTELEEWLRQEMEVQNQHAKEESLADDLFRYNPYLKRRR

SEQ ID NO: 812665 - protein, 672 aa, Homo sapiens
MQNGFSRTLKSGDGITFGVFGSKFRIEYEPLVACSSCLDVSGKTALNQAILQLGGFTVNNWTEECTHLVMVSVKVTIKTICALICGRPIVKPEYFTEFLKAVESKKQPPQIESFYPPLDEPSIGSKNVDLSGRQERKQIFKGKTFIFLNAKQHKKLSSAVVFGGGEARLITEENEEEHNFFLAPGTCVVDTGITNSQTLIPDCQKKWIQSIMDMLQRQGLRPIPEAEIGLAVIFMTTKNYCDPQGHPSTGLKTTTPGPSLSQGVSVDEKLMPSAPVNTTTYVADTESEQADTWDLSERPKEIKVSKMEQKFRMLSQDAPTVKESCKTSSNNNSMVSNTLAKMRIPNYQLSPTKLPSINKSKDRASQQQQTNSIRNYFQPSTKKRERDEENQEMSSCKSARIETSCSLLEQTQPATPSLWKNKEQHLSENEPVDTNSDNNLFTDTDLKSIVKNSASKSHAAEKLRSNKKREMDDVAIEDEVLEQLFKDTKPELEIDVKVQKQEEDVNVRKRPRMDIETNDTFSDEAVPESSKISQENEIGKKRELKEDSLWSAKEISNNDKLQDDSEMLPKKLLLTEFRSLVIKNSTSRNPSGINDDYGQLKNFKKFKKVTYPGAGKLPHIIGGSDLIAHHARKNTELEEWLRQEMEVQNQHAKEESLADDLFRYNPYLKRRR

SEQ ID NO: 812666 - protein, 603 aa, Homo sapiens
MVSVKVTIKTICALICGRPIVKPEYFTEFLKAVESKKQPPQIESFYPPLDEPSIGSKNVDLSGRQERKQIFKGKTFIFLNAKQHKKLSSAVVFGGGEARLITEENEEEHNFFLAPGTCVVDTGITNSQTLIPDCQKKWIQSIMDMLQRQGLRPIPEAEIGLAVIFMTTKNYCDPQGHPSTGLKTTTPGPSLSQGVSVDEKLMPSAPVNTTTYVADTESEQADTWDLSERPKEIKVSKMEQKFRMLSQDAPTVKESCKTSSNNNSMVSNTLAKMRIPNYQLSPTKLPSINKSKDRASQQQQTNSIRNYFQPSTKKRERDEENQEMSSCKSARIETSCSLLEQTQPATPSLWKNKEQHLSENEPVDTNSDNNLFTDTDLKSIVKNSASKSHAAEKLRSNKKREMDDVAIEDEVLEQLFKDTKPELEIDVKVQKQEEDVNVRKRPRMDIETNDTFSDEAVPESSKISQENEIGKKRELKEDSLWSAKEISNNDKLQDDSEMLPKKLLLTEFRSLVIKNSTSRNPSGINDDYGQLKNFKKFKKVTYPGAGKLPHIIGGSDLIAHHARKNTELEEWLRQEMEVQNQHAKEESLADDLFRYNPYLKRRR

SEQ ID NO: 812667 - protein, 736 aa, Homo sapiens
MWKLLPAAGPAGGEPYRLLTGVEYVVGRKNCAILIENDQSISRNHAVLTANFSVTNLSQTDEIPVLTLKDNSKYGTFVNEEKMQNGFSRTLKSGDGITFGVFGSKFRIEYEPLVACSSCLDVSGKTALNQAILQLGGFTVNNWTEECTHLVMVSVKVTIKTICALICGRPIVKPEYFTEFLKAVESKKQPPQIESFYPPLDEPSIGSKNVDLSGRQERKQIFKGVFGGGEARLITEENEEEHNFFLAPGTCVVDTGITNSQTLIPDCQKKWIQSIMDMLQRQGLRPIPEAEIGLAVIFMTTKNYCDPQGHPSTGLKTTTPGPSLSQGVSVDEKLMPSAPVNTTTYVADTESEQADTWDLSERPKEIKVSKMEQKFRMLSQDAPTVKESCKTSSNNNSMVSNTLAKMRIPNYQLSPTKLPSINKSKDRASQQQQTNSIRNYFQPSTKKRERDEENQEMSSCKSARIETSCSLLEQTQPATPSLWKNKEQHLSENEPVDTNSDNNLFTDTDLKSIVKNSASKSHAAEKLRSNKKREMDDVAIEDEVLEQLFKDTKPELEIDVKVQKQEEDVNVRKRPRMDIETNDTFSDEAVPESSKISQENEIGKKRELKEDSLWSAKEISNNDKLQDDSEMLPKKLLLTEFRSLVIKNSTSRNPSGINDDYGQLKNFKKFKKVTYPGAGKLPHIIGGSDLIAHHARKNTELEEWLRQEMEVQNQHAKEESLADDLFRYNPYLKRRR

SEQ ID NO: 812668 - protein, 399 aa, Homo sapiens
MWKLLPAAGPAGGEPYRLLTGVEYVVGRKNCAILIENDQSISRNHAVLTANFSVTNLSQTDEIPVLTLKDNSKYGTFVNEEKMQNGFSRTLKSGDGITFGVFGSKFRIEYEPLVACSSCLDVSGKTALNQAILQLGGFTVNNWTEECTHLVMVSVKVTIKTICALICGRPIVKPEYFTEFLKAVESKKQPPQIESFYPPLDEPSIGSKNVDLSGRQERKQIFKGKTFIFLNAKQHKKLSSAVVFGGGEARLITEENEEEHNFFLAPGTCVVDTGITNSQTLIPDCQKKWIQSIMDMLQRQGLRPIPEAEIGLAVIFMTTKNYCDPQGHPSTGLKTTTPGPSLSQGVSVDEKLMPSAPVNTTTYVADTESEQADTWDLSERPKEIKVSKMEQKHQLNCQV

SEQ ID NO: 812669 - protein, 702 aa, Homo sapiens
MWKLLPAAGPAGGEPYRLLTGVEYVVGRKNCAILIENDQSISRNHAVLTANFSVTNLSQTDEIPVLTLKDNSKYGTFVNEEKMQNGFSRTLKSGDGITFGVFGSKFRIEYEPLVACSSCLDVSGKTALNQAILQLGGFTVNNWTEECTHLVMVSVKVTIKTICALICGRPIVKPEYFTEFLKAVESKKQPPQIESFYPPLDEPSIGSKNVDLSGRQERKQIFKGKTFIFLNAKQHKKLSSAVVFGGGEARLITEENEEEHNFFLAPGTCVVDTGITNSQTLIPDCQKKWIQSIMDMLQRQGLRPIPEAEIGLAVIFMTTKNYCDPQGHPSTGLKTTTPGPSLSQGVSVDEKLMPSAPVNTTTYVADTESEQADTWDLSERPKEIKVSKMEQKFRMLSQDAPTVKESCKTSSNNNSMVSNTLAKMRIPNYQLSPTKLPSINKSKDRASQQQQTNSIRNYFQPSTKKRERDEENQEMSSCKSARIETSCSLLEQTQPATPSLWKNKEQHLSENEPVDTNSDNNLFTDTDLKSIVKNSASKSHAAEKLRSNKKREMDDVAIEDEVLEQLFKDTKPELEIDVKVQKQEEDVNVRKRPRMDIETNDTFSDEAVPESSKISQENEIGKKRELKEDSLWSAKEISVTYPGAGKLPHIIGGSDLIAHHARKNTELEEWLRQEMEVQNQHAKEESLADDLFRYNPYLKRRR

SEQ ID NO: 812670 - protein, 151 aa, Homo sapiens
SQLNAYASQGFSPTSSSHLGRSASFHFTPRHRTIANNDKLQDDSEMLPKKLLLTEFRSLVIKNSTSRNPSGINDDYGQLKNFKKFKKVTYPGAGKLPHIIGGSDLIAHHARKNTELEEWLRQEMEVQNQHAKEESLADDLFRYNPYLKRRR

SEQ ID NO: 812671 - protein, 754 aa, Homo sapiens; identical to SEQ ID NO: 812664

SEQ ID NO: 812672 - protein, 374 aa, Homo sapiens
MWKLLPAAGPAGGEPYRLLTGVEYVVGRKNCAILIENDQSISRNHAVLTANFSVTNLSQTDEIPVLTLKDNSKYGTFVNEEKMQNGFSRTLKSGDGITFGVFGSKFRIEYEPLVACSSCLDVSGKTALNQAILQLGGFTVNNWTEECTHLVMVSVKVTIKTICALICGRPIVKPEYFTEFLKAVESKKQPPQIESFYPPLDEPSIGSKNVDLSGRQERKQIFKGKTFIFLNAKQHKKLSSAVVFGGGEARLITEENEEEHNFFLAPGTCVVDTGITNSQTLIPDCQKKWIQSIMDMLQRQGLRPIPEAEIGLAVIFMTTKNYCDPQGHPSTGLKTTTPGPSLSQGVSVDEKLMPSAPVNTTTYVADTESEQADT

SEQ ID NO: 812673 - protein, 221 aa, Homo sapiens
SWAPSLGDSAPPDFLRATGDRAEPSVYWAAVTLRFQMKMFESADSTATRSGQDLWAEICSCLPNPEQEDGANNAFSDSFVDSCPEGEGQREVADFAVQPAVKPWAPLQDSEVYLASLEKKLRRIKGLNQEVTSKDMLRTLAQAKKECWDRFLQEKLASEFFVDGLDSDESTLEHFKRWLQPDKVAVSTEEVQYLIPPESQVEKPVAEDEPAAGDKPAAAEQ

SEQ ID NO: 812674 - protein, 170 aa, Homo sapiens
SWAPSLGDSAPPDFLRATGDRAEPSVYWAAVTLRFQMKMFESADSTATRSGQDLWAEICSCLPNPEQEDGANNAFSDSFVDSCPEGEGQREVADFAVQPAVKPWAPLQDSEVYLASLEKKLRRIKGLNQEVTSKDMLRTLAQAKKECWDRFLQEKLASEFFVDGLDSDER

SEQ ID NO: 812675 - protein, 135 aa, Homo sapiens
SWAPSLGDSAPPDFLRATGDRAEPSVYWAAVTLRFQMKMFESADSTATRSGQDLWAEICSCLPNPEQEDGANNAFSDSFVDSCPEGEGQREVADFAVQPAVKPWAPLQDSEVYLASLARRAGDAADPRPGAARRR

SEQ ID NO: 812676 - protein, 154 aa, Homo sapiens
SWAPSLGDSAPPDFLRATGDRAEPSVYWAAVTLRFQMKMFESADSTATRSGQDLWAEICSCLPNPEQEDGANNAFSDSFVDSCPEGEGQREVADFAVQPAVKPWAPLQDSEVYLASLAILFEKYFLTSDVAGAGRRGGPETLQTRDPEQLGGGE

SEQ ID NO: 812677 - protein, 221 aa, Homo sapiens; identical to SEQ ID NO: 812673

SEQ ID NO: 812678 - protein, 221 aa, Homo sapiens; identical to SEQ ID NO: 812673

SEQ ID NO: 812679 - protein, 183 aa, Homo sapiens
MFESADSTATRSGQDLWAEICSCLPNPEQEDGANNAFSDSFVDSCPEGEGQREVADFAVQPAVKPWAPLQDSEVYLASLEKKLRRIKGLNQEVTSKDMLRTLAQAKKECWDRFLQEKLASEFFVDGLDSDESTLEHFKRWLQPDKVAVSTEEVQYLIPPESQVEKPVAEDEPAAGDKPAAAEQ

SEQ ID NO: 812680 - protein, 221 aa, Homo sapiens; identical to SEQ ID NO: 812673

SEQ ID NO: 812681 - protein, 183 aa, Homo sapiens; identical to SEQ ID NO: 812679

SEQ ID NO: 812682 - protein, 170 aa, Homo sapiens; identical to SEQ ID NO: 812674

SEQ ID NO: 812683 - protein, 183 aa, Homo sapiens
SWAPSLGDSAPPDFLRATGDRAEPSVYWAAVTLRFQMKMFESADSTATRSGQDLWAEICSCLPNPEQEDGANNAFSDSFVDSCPEGEGQREVADFAVQPAVKPWAPLQDSEVYLASLEKKLRRIKGLNQEVTSKDMLRTLAQAKKECWDRFLQEKLASEFFVDGLDSDERFELHWSTDRQSFF

SEQ ID NO: 812684 - protein, 116 aa, Homo sapiens
NHFSSAAISYQPYSIIRQLKPNNIYIKSRKQGKVIWDWQTGVDKMIHILGFVGYVLFLLHIPLLFFKQYLKNVKTIFSVWTSLLTAGQEQPHHDRNAGICSPTARNTKSIPESTSR

SEQ ID NO: 812685 - protein, 105 aa, Homo sapiens
MSGEVSWMQAVCAGTRAPATDEVAGVHRSLLRSSRGFQGRLTRFLGRRFMTAEFLLEDPSSGSLIPQESSWKTRACEGSAAAPRQPDSQPRTAGVDMHGSLDAIS

SEQ ID NO: 812686 - protein, 105 aa, Homo sapiens; identical to SEQ ID NO: 812685

SEQ ID NO: 812687 - protein, 242 aa, Homo sapiens
LSTWNQVVLLQGPPGTGKTFLCKALAHKLTIKLSSRYWYGQLIEINSPNLFSKRFSEIDKLITKTFQKIQDLIDYKDALAFSLIDEIESLTATHNESHSGAIGMVNAVLTQINQIKRHFNVVIPATSNITVKIDMAFVDRSDIKQYISLRSAAAIFKIYVFCLEELVKCQVIYPPQQLLTLQKLEMIGFIENNVSKLSFLLSDISKKIEGLHGQFLRKLLFLVHTLCVQATPGFLSGRGQAG

SEQ ID NO: 812688 - protein, 105 aa, Homo sapiens
MAPKAKKEAPAPPKAEAKAKALKAKKAVLKGVHSHKKKKIRTSPPPSGGPKTLRLRRQPQISLGRALPRRNKLDPPMPIIKFPLTTESAHEEDRRQQHTCVHCGC

SEQ ID NO: 812689 - protein, 105 aa, Homo sapiens; identical to SEQ ID NO: 812688

SEQ ID NO: 812690 - protein, 105 aa, Homo sapiens; identical to SEQ ID NO: 812688

SEQ ID NO: 812691 - protein, 105 aa, Homo sapiens; identical to SEQ ID NO: 812688

SEQ ID NO: 812692 - protein, 106 aa, Homo sapiens
ISERAAKKEAPAPPKAEAKAKALKAKKAVLKGVHSHKKKKIRTSPPPSGGPKTLRLRRQPQISLGRALPRRNKLDPPMPIIKFPLTTESAHEEDRRQQHTCVHCGC

SEQ ID NO: 812693 - protein, 107 aa, Homo sapiens
MARYEAGGEGAPAPPKAEAKAKALKAKKAVLKGVHSHKKKKIRTSPPPSGGPKTLRLRRQPQISLGRALPRRNKLDPPMPIIKFPLTTESAHEEDRRQQHTCVHCGC

SEQ ID NO: 812694 - protein, 105 aa, Homo sapiens; identical to SEQ ID NO: 812688

SEQ ID NO: 812695 - protein, 105 aa, Homo sapiens; identical to SEQ ID NO: 812688

SEQ ID NO: 812696 - protein, 105 aa, Homo sapiens; identical to SEQ ID NO: 812688

SEQ ID NO: 812697 - protein, 105 aa, Homo sapiens; identical to SEQ ID NO: 812688

SEQ ID NO: 812698 - protein, 105 aa, Homo sapiens; identical to SEQ ID NO: 812688

SEQ ID NO: 812699 - protein, 105 aa, Homo sapiens; identical to SEQ ID NO: 812688

SEQ ID NO: 812700 - protein, 105 aa, Homo sapiens; identical to SEQ ID NO: 812688

SEQ ID NO: 812701 - protein, 105 aa, Homo sapiens; identical to SEQ ID NO: 812688

SEQ ID NO: 812702 - protein, 106 aa, Homo sapiens
HWLELMSRASPAPPKAEAKAKALKAKKAVLKGVHSHKKKKIRTSPPPSGGPKTLRLRRQPQISLGRALPRRNKLDPPMPIIKFPLTTESAHEEDRRQQHTCVHCGC

SEQ ID NO: 812703 - protein, 105 aa, Homo sapiens; identical to SEQ ID NO: 812688

SEQ ID NO: 812704 - protein, 105 aa, Homo sapiens; identical to SEQ ID NO: 812688

SEQ ID NO: 812705 - protein, 105 aa, Homo sapiens; identical to SEQ ID NO: 812688

SEQ ID NO: 812706 - protein, 105 aa, Homo sapiens; identical to SEQ ID NO: 812688

SEQ ID NO: 812707 - protein, 115 aa, Homo sapiens
MAARRQKGSQMAPKAKKEAPAPPKAEAKAKALKAKKAVLKGVHSHKKKKIRTSPPPSGGPKTLRLRRQPQISLGRALPRRNKLDPPMPIIKFPLTTESAHEEDRRQQHTCVHCGC

SEQ ID NO: 812708 - protein, 105 aa, Homo sapiens; identical to SEQ ID NO: 812688

SEQ ID NO: 812709 - protein, 82 aa, Homo sapiens
ERERERERETLRLRRVGDVPSAAGRWVKTLRLRRQPQISLGRALPRRNKLDPPMPIIKFPLTTESAHEEDRRQQHTCVHCGC

SEQ ID NO: 812710 - protein, 106 aa, Homo sapiens; identical to SEQ ID NO: 812692

SEQ ID NO: 812711 - protein, 105 aa, Homo sapiens; identical to SEQ ID NO: 812688

SEQ ID NO: 812712 - protein, 105 aa, Homo sapiens; identical to SEQ ID NO: 812688

SEQ ID NO: 812713 - protein, 105 aa, Homo sapiens; identical to SEQ ID NO: 812688

SEQ ID NO: 812714 - protein, 77 aa, Homo sapiens
PVAAQPHQKKKIRTSPPPSGGPKTLRLRRQPQISLGRALPRRNKLDPPMPIIKFPLTTESAHEEDRRQQHTCVHCGC

SEQ ID NO: 812715 - protein, 105 aa, Homo sapiens; identical to SEQ ID NO: 812688

SEQ ID NO: 812716 - protein, 105 aa, Homo sapiens; identical to SEQ ID NO: 812688

SEQ ID NO: 812717 - protein, 105 aa, Homo sapiens; identical to SEQ ID NO: 812688

SEQ ID NO: 812718 - protein, 105 aa, Homo sapiens; identical to SEQ ID NO: 812688

SEQ ID NO: 812719 - protein, 105 aa, Homo sapiens; identical to SEQ ID NO: 812688

SEQ ID NO: 812720 - protein, 105 aa, Homo sapiens; identical to SEQ ID NO: 812688

SEQ ID NO: 812721 - protein, 466 aa, Homo sapiens
MELRKLYGPLCGYYLGRRMFIVISEPDMIKQVLVENFSNFTNRMASGLEFKSVADSVLFLRDKRWEEVRGALMSAFSPEKLNEMVPLISQACDLLLAHLKRYAESGDAFDIQRCYCNYTTDVVASVAFGTPVDSWQAPEDPFVKHCKRFFEFCIPRPILVLLLSFPSIMVPLARILPNKNRDELNGFFNKLIRNVIALRDQQAAEERRRDFLQMVLDARHSASPMGVQDFDIVRDVFSSTGCKPNPSRQHQPSPMARPLTVDEIVGQAFIFLIAGYEIITNTLSFATYLLATNPDCQEKLLREVDVFKEKHMAPEFCSLEEGLPYLDMVIAETLRMYPPAFRFTREAAQDCEVLGQRIPAGAVLEMAVGALHHDPEHWPSPETFNPERFTAEARQQHRPFTYLPFGAGPRSCLGVRLGLLEVKLTLLHVLHKFRFQACPETQVPLQLESKSALGPKNGVYIKIVSR

SEQ ID NO: 812722 - protein, 99 aa, Homo sapiens
SERAGLDPAGARLRAQRSRAGLQRGPQNFVCVCARARVCAQVRGFARVLAGREPTRKRAPRWQSGSPISQPVGARGGSQNISCLLLTLCCPQHTRTLDG

SEQ ID NO: 812723 - protein, 69 aa, Homo sapiens
SERAGLDPAGARLRAQRSRAGLQRGPQNFVCAGGEGTDPKESPTLAKWLAHLTAGWRSRRRHILPGLPG

SEQ ID NO: 812724 - protein, 533 aa, Homo sapiens
MEALGFLKLEVNGPMVTVALSVALLALLKWYSTSAFSRLEKLGLRHPKPSPFIGNLTFFRQGFWESQMELRKLYGPLCGYYLGRRMFIVISEPDMIKQVLVENFSNFTNRMASGLEFKSVADSVLFLRDKRWEEVRGALMSAFSPEKLNEMVPLISQACDLLLAHLKRYAESGDAFDIQRCYCNYTTDVVASVAFGTPVDSWQAPEDPFVKHCKRFFEFCIPRPILVLLLSFPSIMVPLARILPNKNRDELNGFFNKLIRNVIALRDQQAAEERRRDFLQMVLDARHSASPMGVQDFDIVRDVFSSTGCKPNPSRQHQPSPMARPLTVDEIVGQAFIFLIAGYEIITNTLSFATYLLATNPDCQEKLLREVDVFKEKHMAPEFCSLEEGLPYLDMVIAETLRMYPPAFRFTREAAQDCEVLGQRIPAGAVLEMAVGALHHDPEHWPSPETFNPERFTAEARQQHRPFTYLPFGAGPRSCLGVRLGLLEVKLTLLHVLHKFRFQACPETQVPLQLESKSALGPKNGVYIKIVSR

SEQ ID NO: 812725 - protein, 533 aa, Homo sapiens; identical to SEQ ID NO: 812724

SEQ ID NO: 812726 - protein, 533 aa, Homo sapiens; identical to SEQ ID NO: 812724

SEQ ID NO: 812727 - protein, 533 aa, Homo sapiens; identical to SEQ ID NO: 812724

SEQ ID NO: 812728 - protein, 459 aa, Homo sapiens
MEALGFLKLEVNGPMVTVALSVALLALLKWYSTSAFSRLEKLGLRHPKPSPFIGNLTFFRQGFWESQMELRKLYGPLCGYYLGRRMFIVISEPDMIKQVLVENFSNFTNRMASGLEFKSVADSVLFLRDKRWEEVRGALMSAFSPEKLNEMVPLISQACDLLLAHLKRYAESGDAFDIQRCYCNYTTDVVASVAFGTPVDSWQAPEDPFVKHCKRFFEFCIPRPILVLLLSFPSIMVPLARILPNKNRDELNGFFNKLIRNVIALRDQQAAEERRRDFLQMVLDARHSASPMGVQDFDIVRDVFSSTGCKPNPSRQHQPSPMARPLTVDEIVGQAFIFLIAGYEIITNTLSFATYLLATNPDCQEKLLREVDVFKEKHMAPEFCSLEEGLPYLDMVIAETLRMYPPAFRFTREAAQDCEVLGQRIPAGAVLEMAVGALHHDPEHWPSPETFNPERYRCS

SEQ ID NO: 812729 - protein, 459 aa, Homo sapiens; identical to SEQ ID NO: 812728

SEQ ID NO: 812730 - protein, 459 aa, Homo sapiens; identical to SEQ ID NO: 812728

SEQ ID NO: 812731 - protein, 533 aa, Homo sapiens; identical to SEQ ID NO: 812724

SEQ ID NO: 812732 - protein, 391 aa, Homo sapiens [sequence omitted]

SEQ ID NO: 812733 - protein, 514 aa, Homo sapiens
MVLHISILKTGEVRPQTSQAFSFHWKLDIFPPGFLGKPNGAQKAVWTSVWVRRKLNVSIMYYLGRRMFIVISEPDMIKQVLVENFSNFTNRMASGLEFKSVADSVLFLRDKRWEEVRGALMSAFSPEKLNEMVPLISQACDLLLAHLKRYAESGDAFDIQRCYCNYTTDVVASVAFGTPVDSWQAPEDPFVKHCKRFFEFCIPRPILVLLLSFPSIMVPLARILPNKNRDELNGFFNKLIRNVIALRDQQAAEERRRDFLQMVLDARHSASPMGVQDFDIVRDVFSSTGCKPNPSRQHQPSPMARPLTVDEIVGQAFIFLIAGYEIITNTLSFATYLLATNPDCQEKLLREVDVFKEKHMAPEFCSLEEGLPYLDMVIAETLRMYPPAFRFTREAAQDCEVLGQRIPAGAVLEMAVGALHHDPEHWPSPETFNPERFTAEARQQHRPFTYLPFGAGPRSCLGVRLGLLEVKLTLLHVLHKFRFQACPETQVPLQLESKSALGPKNGVYIKIVSR

SEQ ID NO: 812734 - protein, 195 aa, Homo sapiens
SPPPPAAAAAAAGLGVNKSRRLRTRARGGRRPPGAPPTPRPAHPGGPGPARPGEALGSLCSPWAAPRVGPLPPAPAMVRISKPKTFQAYLDDCHRRYSCAHCRAHLANHDDLISKSFQGSQGRAYLFNSVVNVGCGPAEERVLLTGLHAVADIHCENCKTTLGWKYEQAFESSQKYKEGKYIIELNHMIKDNGWD

SEQ ID NO: 812735 - protein, 137 aa, Homo sapiens
MCVAQVLTAHLLPPRQALGSLCSPWAAPRVGPLPPAPAMVRISKPKTFQAYLDDCHRRYSCAHCRAHLANHDDLISKSFQGSQGRAYLFNSVVNVGCGPAEERVLLTGLHAVADIHCENCKTTLGWKYVSHPPLTPG

SEQ ID NO: 812736 - protein, 100 aa, Homo sapiens
MRGLSGARAADKRGSLYSSPPEHASQRHPLPRSAPGLDPPTPPLRGPQAGMRAGLGRAGRSRISGPAGAGGGGGAVGACAGRRVTRPLICMRSAHWPRRP

SEQ ID NO: 812737 - protein, 119 aa, Homo sapiens
MVRISKPKTFQAYLDDCHRRYSCAHCRAHLANHDDLISKSFQGSQGRAYLFNSVVNVGCGPAEERVLLTGLHAVADIHCENCKTTLGWKYEQAFESSQKYKEGKYIIELNHMIKDNGWD

SEQ ID NO: 812738 - protein, 119 aa, Homo sapiens; identical to SEQ ID NO: 812737

SEQ ID NO: 812739 - protein, 126 aa, Homo sapiens
FGTSHDDLISNPSRAVRGVPTSSTQCEYLASLLAFPDLCCDLLTPGILLRLPEFPGAGRKLVNVGCGPAEERVLLTGLHAVADIHCENCKTTLGWKYEQAFESSQKYKEGKYIIELNHMIKDNGWD

SEQ ID NO: 812740 - protein, 161 aa, Homo sapiens
MCVAQVLTAHLLPPRQALGSLCSPWAAPRVGPLPPAPAMVRISKPKTFQAYLDDCHRRYSCAHCRAHLANHDDLISKSFQGSQGRAYLFNSVLSIWPPFLLSLTSVVTCDPWHPAETPRVPRCRQEIVSIISWMLRTDTVLEGVGPVMAGPSLGLPHVPTG

SEQ ID NO: 812741 - protein, 195 aa, Homo sapiens; identical to SEQ ID NO: 812734

SEQ ID NO: 812742 - protein, 195 aa, Homo sapiens; identical to SEQ ID NO: 812734

SEQ ID NO: 812743 - protein, 95 aa, Homo sapiens
QAGTVRSRMIDLISNSFQGSQGRAYLFNSVVNVGCGPAEERVLLTGLHAVADIHCENCKTTLGWKYEQAFESSQKYKEGKYIIELNHMIKDNGWD

SEQ ID NO: 812744 - protein, 157 aa, Homo sapiens
MCVAQVLTAHLLPPRQALGSLCSPWAAPRVGPLPPAPAMVRISKPKTFQAYLDDCHRRYSCAHCRAHLANHDDLISKSFQGSQGRAYLFNSVVNVGCGPAEERVLLTGLHAVADIHCENCKTTLGWKYEQAFESSQKYKEGKYIIELNHMIKDNGWD

SEQ ID NO: 812745 - protein, 131 aa, Homo sapiens
MVAGISTCTNDCFNSHMIVTRVSSTEKVCTHDVPNVVASTLTNHDGCSSQSPSRISLDVCYLFNSVVNVGCGPAEERVLLTGLHAVADIHCENCKTTLGWKYEQAFESSQKYKEGKYIIELNHMIKDNGWD

SEQ ID NO: 812746 - protein, 128 aa, Homo sapiens
MCVAQVLTAHLLPPRQALGSLCSPWAAPRVGPLPPAPAMVRISKPKTFQAYLDDCHRRYSCAHCRAHLANHDDLISKSFQGSQGRAYLFNSVVNVGCGPAEERVLLTGLHAVADIHCENCKTTLGWKY

SEQ ID NO: 812747 - protein, 195 aa, Homo sapiens; identical to SEQ ID NO: 812734

SEQ ID NO: 812748 - protein, 74 aa, Homo sapiens
SLSSSFPSVLQAIRKTICDWEGGREPPNDPCLRGEKDPKGGFDIKVPRRAVGPSSTQLYWCGPCLNHHQNLPVP

SEQ ID NO: 812749 - protein, 1300 aa, Homo sapiens
QRGRGGAERGAAERGRASCAPARGPAVASGPSPGPAAEPVQNTETAAMTTHVTLEDALSNVDLLEELPLPDQQPCIEPPPSSIMYQANFDTNFEDRNAFVTGIARYIEQATVHSSMNEMLEEGHEYAVMLYTWRSCSRAIPQVKCNEQPNRVEIYEKTVEVLEPEVTKLMKFMYFQRKAIERFCSEVKRLCHAERRKDFVSEAYLLTLGKFINMFAVLDELKNMKCSVKNDHSAYKRAAQFLRKMADPQSIQESQNLSMFLANHNRITQCLHQQLEVIPGYEELLADIVNICVDYYENKMYLTPSEKHMLLKVMGFGLYLMDGNVSNIYKLDAKKRINLSKIDKFFKQLQVVPLFGDMQIELARYIKTSAHYEENKSKWTCTQSSISPQYNICEQMVQIRDDHIRFISELARYSNSEVVTGSGLDSQKSDEEYRELFDLALRGLQLLSKWSAHVMEVYSWKLVHPTDKFCNKDCPGTAEEYERATRYNYTSEEKFAFVEVIAMIKGLQVLMGRMESVFNQAIRNTIYAALQDFAQVTLREPLRQAVRKKKNVLISVLQAIRKTICDWEGGREPPNDPCLRGEKDPKGGFDIKVPRRAVGPSSTQLYMVRTMLESLIADKSGSKKTLRSSLDGPIVLAIEDFHKQSFFFTHLLNISEALQQCCDLSQLWFREFFLELTMGRRIQFPIEMSMPWILTDHILETKEPSMMEYVLYPLDLYNDSAYYALTKFKKQFLYDEIEAEVNLCFDQFVYKLADQIFAYYKAMAGSVLLDKRFRAECKNYGVIIPYPPSNRYETLLKQRHVQLLGRSIDLNRLITQRISAAMYKSLDQAISRFESEDLTSIVELEWLLEINRLTHRLLCKHMTLDSFDAMFREANHNVSAPYGRITLHVFWELNFDFLPNYCYNGSTNRFVRTAIPFTQEPQRDKPANVQPYYLYGSKPLNIAYSHIYSSYRNFVGPPHFKTICRLLGYQGIAVVMEELLKIVKSLLQGTILQYVKTLIEVMPKICRLPRHEYGSPGILEFFHHQLKDIIEYAELKTDVFQSLREVGNAILFCLLIEQALSQEEVCDLLHAAPFQNILPRVYIKEGERLEVRMKRLEAKYAPLHLVPLIERLGTPQQIAIAREGDLLTKERLCCGLSMFEVILTRIRSYLQDPIWRGPPPTNGVMHVDECVEFHRLWSAMQFVYCIPVGTNEFTAEQCFGDGLNWAGCSIIVLLGQQRRFDLFDFCYHLLKVQRQDGKDEIIKNVPLKKMADRIRKYQILNNEVFAILNKYMKSVETDSSTVEHVRCFQPPIHQSLATTC

SEQ ID NO: 812750 - protein, 1300 aa, Homo sapiens; identical to SEQ ID NO: 812749

SEQ ID NO: 812751 - protein, 1253 aa, Homo sapiens
MTTHVTLEDALSNVDLLEELPLPDQQPCIEPPPSSIMYQANFDTNFEDRNAFVTGIARYIEQATVHSSMNEMLEEGHEYAVMLYTWRSCSRAIPQVKCNEQPNRVEIYEKTVEVLEPEVTKLMKFMYFQRKAIERFCSEVKRLCHAERRKDFVSEAYLLTLGKFINMFAVLDELKNMKCSVKNDHSAYKRAAQFLRKMADPQSIQESQNLSMFLANHNRITQCLHQQLEVIPGYEELLADIVNICVDYYENKMYLTPSEKHMLLKVMGFGLYLMDGNVSNIYKLDAKKRINLSKIDKFFKQLQVVPLFGDMQIELARYIKTSAHYEENKSKWTCTQSSISPQYNICEQMVQIRDDHIRFISELARYSNSEVVTGSGLDSQKSDEEYRELFDLALRGLQLLSKWSAHVMEVYSWKLVHPTDKFCNKDCPGTAEEYERATRYNYTSEEKFAFVEVIAMIKGLQVLMGRMESVFNQAIRNTIYAALQDFAQVTLREPLRQAVRKKKNVLISVLQAIRKTICDWEGGREPPNDPCLRGEKDPKGGFDIKVPRRAVGPSSTQLYMVRTMLESLIADKSGSKKTLRSSLDGPIVLAIEDFHKQSFFFTHLLNISEALQQCCDLSQLWFREFFLELTMGRRIQFPIEMSMPWILTDHILETKEPSMMEYVLYPLDLYNDSAYYALTKFKKQFLYDEIEAEVNLCFDQFVYKLADQIFAYYKAMAGSVLLDKRFRAECKNYGVIIPYPPSNRYETLLKQRHVQLLGRSIDLNRLITQRISAAMYKSLDQAISRFESEDLTSIVELEWLLEINRLTHRLLCKHMTLDSFDAMFREANHNVSAPYGRITLHVFWELNFDFLPNYCYNGSTNRFVRTAIPFTQEPQRDKPANVQPYYLYGSKPLNIAYSHIYSSYRNFVGPPHFKTICRLLGYQGIAVVMEELLKIVKSLLQGTILQYVKTLIEVMPKICRLPRHEYGSPGILEFFHHQLKDIIEYAELKTDVFQSLREVGNAILFCLLIEQALSQEEVCDLLHAAPFQNILPRVYIKEGERLEVRMKRLEAKYAPLHLVPLIERLGTPQQIAIAREGDLLTKERLCCGLSMFEVILTRIRSYLQDPIWRGPPPTNGVMHVDECVEFHRLWSAMQFVYCIPVGTNEFTAEQCFGDGLNWAGCSIIVLLGQQRRFDLFDFCYHLLKVQRQDGKDEIIKNVPLKKMADRIRKYQILNNEVFAILNKYMKSVETDSSTVEHVRCFQPPIHQSLATTC

SEQ ID NO: 812752 - protein, 1253 aa, Homo sapiens; identical to SEQ ID NO: 812751

SEQ ID NO: 812753 - protein, 1325 aa, Homo sapiens
QRGRGGAERGAAERGRASCAPARGPAVASGPSPGPAAEPVQNTETAAMTTHVTLEDALSNVDLLEELPLPDQQPCIEPPPSSIMYQANFDTNFEDRNAFVTGIARYIEQATVHSSMNEMLEEGHEYAVMLYTWRSCSRAIPQVKCNEQPNRVEIYEKTVEVLEPEVTKLMKFMYFQRKAIERFCSEVKRLCHAERRKDFVSEAYLLTLGKFINMFAVLDELKNMKCSVKNDHSAYKRAAQFLRKMADPQSIQESQNLSMFLANHNRITQCLHQQLEVIPGYEELLADIVNICVDYYENKMYLTPSEKHMLLKVMGFGLYLMDGNVSNIYKLDAKKRINLSKIDKFFKQLQVVPLFGDMQIELARYIKTSAHYEENKSKWTCTQSSISPQYNICEQMVQIRDDHIRFISELARYSNSEVVTGSGLDSQKSDEEYRELFDLALRGLQLLSKWSAHVMEVYSWKLVHPTDKFCNKDCPGTAEEYERATRYNYTSEEKFAFVEVIAMIKGLQVLMGRMESVFNQAIRNTIYAALQDFAQVTLREPLRQAVRKKKNVLISVLQAIRKTICDWEGGREPPNDPCLRGEKDPKGGFDIKVPRRAVGPSSTQACQWSPRALFHPTGGTQGRRGCRSLLYMVRTMLESLIADKSGSKKTLRSSLDGPIVLAIEDFHKQSFFFTHLLNISEALQQCCDLSQLWFREFFLELTMGRRIQFPIEMSMPWILTDHILETKEPSMMEYVLYPLDLYNDSAYYALTKFKKQFLYDEIEAEVNLCFDQFVYKLADQIFAYYKAMAGSVLLDKRFRAECKNYGVIIPYPPSNRYETLLKQRHVQLLGRSIDLNRLITQRISAAMYKSLDQAISRFESEDLTSIVELEWLLEINRLTHRLLCKHMTLDSFDAMFREANHNVSAPYGRITLHVFWELNFDFLPNYCYNGSTNRFVRTAIPFTQEPQRDKPANVQPYYLYGSKPLNIAYSHIYSSYRNFVGPPHFKTICRLLGYQGIAVVMEELLKIVKSLLQGTILQYVKTLIEVMPKICRLPRHEYGSPGILEFFHHQLKDIIEYAELKTDVFQSLREVGNAILFCLLIEQALSQEEVCDLLHAAPFQNILPRVYIKEGERLEVRMKRLEAKYAPLHLVPLIERLGTPQQIAIAREGDLLTKERLCCGLSMFEVILTRIRSYLQDPIWRGPPPTNGVMHVDECVEFHRLWSAMQFVYCIPVGTNEFTAEQCFGDGLNWAGCSIIVLLGQQRRFDLFDFCYHLLKVQRQDGKDEIIKNVPLKKMADRIRKYQILNNEVFAILNKYMKSVETDSSTVEHVRCFQPPIHQSLATTC

SEQ ID NO: 812754 - protein, 1278 aa, Homo sapiens
MTTHVTLEDALSNVDLLEELPLPDQQPCIEPPPSSIMYQANFDTNFEDRNAFVTGIARYIEQATVHSSMNEMLEEGHEYAVMLYTWRSCSRAIPQVKCNEQPNRVEIYEKTVEVLEPEVTKLMKFMYFQRKAIERFCSEVKRLCHAERRKDFVSEAYLLTLGKFINMFAVLDELKNMKCSVKNDHSAYKRAAQFLRKMADPQSIQESQNLSMFLANHNRITQCLHQQLEVIPGYEELLADIVNICVDYYENKMYLTPSEKHMLLKVMGFGLYLMDGNVSNIYKLDAKKRINLSKIDKFFKQLQVVPLFGDMQIELARYIKTSAHYEENKSKWTCTQSSISPQYNICEQMVQIRDDHIRFISELARYSNSEVVTGSGLDSQKSDEEYRELFDLALRGLQLLSKWSAHVMEVYSWKLVHPTDKFCNKDCPGTAEEYERATRYNYTSEEKFAFVEVIAMIKGLQVLMGRMESVFNQAIRNTIYAALQDFAQVTLREPLRQAVRKKKNVLISVLQAIRKTICDWEGGREPPNDPCLRGEKDPKGGFDIKVPRRAVGPSSTQACQWSPRALFHPTGGTQGRRGCRSLLYMVRTMLESLIADKSGSKKTLRSSLDGPIVLAIEDFHKQSFFFTHLLNISEALQQCCDLSQLWFREFFLELTMGRRIQFPIEMSMPWILTDHILETKEPSMMEYVLYPLDLYNDSAYYALTKFKKQFLYDEIEAEVNLCFDQFVYKLADQIFAYYKAMAGSVLLDKRFRAECKNYGVIIPYPPSNRYETLLKQRHVQLLGRSIDLNRLITQRISAAMYKSLDQAISRFESEDLTSIVELEWLLEINRLTHRLLCKHMTLDSFDAMFREANHNVSAPYGRITLHVFWELNFDFLPNYCYNGSTNRFVRTAIPFTQEPQRDKPANVQPYYLYGSKPLNIAYSHIYSSYRNFVGPPHFKTICRLLGYQGIAVVMEELLKIVKSLLQGTILQYVKTLIEVMPKICRLPRHEYGSPGILEFFHHQLKDIIEYAELKTDVFQSLREVGNAILFCLLIEQALSQEEVCDLLHAAPFQNILPRVYIKEGERLEVRMKRLEAKYAPLHLVPLIERLGTPQQIAIAREGDLLTKERLCCGLSMFEVILTRIRSYLQDPIWRGPPPTNGVMHVDECVEFHRLWSAMQFVYCIPVGTNEFTAEQCFGDGLNWAGCSIIVLLGQQRRFDLFDFCYHLLKVQRQDGKDEIIKNVPLKKMADRIRKYQILNNEVFAILNKYMKSVETDSSTVEHVRCFQPPIHQSLATTC

SEQ ID NO: 812755 - protein, 1318 aa, Homo sapiens
QRGRGGAERGAAERGRASCAPARGPAVASGPSPGPAAEPVQNTETAAMTTHVTLEDALSNVDLLEELPLPDQQPCIEPPPSSIMYQANFDTNFEDRNAFVTGIARYIEQATVHSSMNEMLEEGHEYAVMLYTWRSCSRAIPQVKCNEQPNRVEIYEKTVEVLEPEVTKLMKFMYFQRKAIERFCSEVKRLCHAERRKDFVSEAYLLTLGKFINMFAVLDELKNMKCSVKNDHSAYKRAAQFLRKMADPQSIQESQNLSMFLANHNRITQCLHQQLEVIPGYEELLADIVNICVDYYENKMYLTPSEKHMLLKVMGFGLYLMDGNVSNIYKLDAKKRINLSKIDKFFKQLQVVPLFGDMQIELARYIKTSAHYEENKSKWTCTQSSISPQYNICEQMVQIRDDHIRFISELARYSNSEVVTGSGLDSQKSDEEYRELFDLALRGLQLLSKWSAHVMEVYSWKLVHPTDKFCNKDCPGTAEEYERATRYNYTSEEKFAFVEVIAMIKGLQVLMGRMESVFNQAIRNTIYAALQDFAQVTLREPLRQAVRKKKNVLISVLQAIRKTICDWEGGREPPNDPCLRGEKDPKGGFDIKVPRRAVGPSSTQLYMVRTMLESLIADKSGSKKTLRSSLDGPIVLAIEDFHKQSFFFTHLLNISEALQQCCDLSQLWFREFFLELTMGRRIQFPIEMSMPWILTDHILETKEPSMMEYVLYPLDLYNDSAYYALTKFKKQFLYDEIEAEVNLCFDQFVYKLADQIFAYYKAMAGSVLLDKRFRAECKNYGVIIPYPPSNRYETLLKQRHVQLLGRSIDLNRLITQRISAAMYKSLDQAISRFESEDLTSIVELEWLLEINRVTHRLLCKHMTLDSFDAMLTHRLLCKHMTLDSFDAMFREANHNVSAPYGRITLHVFWELNFDFLPNYCYNGSTNRFVRTAIPFTQEPQRDKPANVQPYYLYGSKPLNIAYSHIYSSYRNFVGPPHFKTICRLLGYQGIAVVMEELLKIVKSLLQGTILQYVKTLIEVMPKICRLPRHEYGSPGILEFFHHQLKDIIEYAELKTDVFQSLREVGNAILFCLLIEQALSQEEVCDLLHAAPFQNILPRVYIKEGERLEVRMKRLEAKYAPLHLVPLIERLGTPQQIAIAREGDLLTKERLCCGLSMFEVILTRIRSYLQDPIWRGPPPTNGVMHVDECVEFHRLWSAMQFVYCIPVGTNEFTAEQCFGDGLNWAGCSIIVLLGQQRRFDLFDFCYHLLKVQRQDGKDEIIKNVPLKKMADRIRKYQILNNEVFAILNKYMKSVETDSSTVEHVRCFQPPIHQSLATTC

SEQ ID NO: 812756 - protein, 1029 aa, Homo sapiens
QRGRGGAERGAAERGRASCAPARGPAVASGPSPGPAAEPVQNTETAAMTTHVTLEDALSNVDLLEELPLPDQQPCIEPPPSSIMYQANFDTNFEDRNAFVTGIARYIEQATVHSSMNEMLEEGHEYAVMLYTWRSCSRAIPQVKCNEQPNRVEIYEKTVEVLEPEVTKLMKFMYFQRKAIERFCSEVKRLCHAERRKDFVSEAYLLTLGKFINMFAVLDELKNMKCSVKNDHSAYKRAAQFLRKMADPQSIQESQNLSMFLANHNRITQCLHQQLEVIPGYEELLADIVNICVDYYENKMYLTPSEKHMLLKVMGFGLYLMDGNVSNIYKLDAKKRINLSKIDKFFKQLQVVPLFGDMQIELARYIKTSAHYEENKSKWTCTQSSISPQYNICEQMVQIRDDHIRFISELARYSNSEVVTGSGLDSQKSDEEYRELFDLALRGLQLLSKWSAHVMEVYSWKLVHPTDKFCNKDCPGTAEEYERATRYNYTSEEKFAFVEVIAMIKGLQVLMGRMESVFNQAIRNTIYAALQDFAQVTLREPLRQAVRKKKNVLISVLQAIRKTICDWEGGREPPNDPCLRGEKDPKGGFDIKVPRRAVGPSSTQLYMVRTMLESLIADKSGSKKTLRSSLDGPIVLAIEDFHKQSFFFTHLLNISEALQQCCDLSQLWFREFFLELTMGRRIQFPIEMSMPWILTDHILETKEPSMMEYVLYPLDLYNDSAYYALTKFKKQFLYDEIEAEVNLCFDQFVYKLADQIFAYYKAMAGSVLLDKRFRAECKNYGVIIPYPPSNRYETLLKQRHVQLLGRSIDLNRLITQRISAAMYKSLDQAISRFESEDLTSIVELEWLLEINRLTHRLLCKHMTLDSFDAMFREANHNVSAPYGRITLHVFWELNFDFLPNYCYNGSTNRFVRTAIPFTQEPQRDKPANVQPYYLYGSKPLNIAYSHIYSSYRNFVGPPHFKTICRLLGYQGIAVVMEELLKIVKSLLQGTILQYVKTLIEVMPKICPAPPGPSDRAAGDPSANRHCSRG

SEQ ID NO: 812757 - protein, 538 aa, Homo sapiens
MAGSVLLDKRFRAECKNYGVIIPYPPSNRYETLLKQRHVQLLGRSIDLNRLITQRISAAMYKSLDQAISRFESEDLTSIVELEWLLEINRLTHRLLCKHMTLDSFDAMFREANHNVSAPYGRITLHVFWELNFDFLPNYCYNGSTNRFVRTAIPFTQEPQRDKPANVQPYYLYGSKPLNIAYSHIYSSYRNFVGPPHFKTICRLLGYQGIAVVMEELLKIVKSLLQGTILQYVKTLIEVMPKICRLPRHEYGSPGILEFFHHQLKDIIEYAELKTDVFQSLREVGNAILFCLLIEQALSQEEVCDLLHAAPFQNILPRVYIKEGERLEVRMKRLEAKYAPLHLVPLIERLGTPQQIAIAREGDLLTKERLCCGLSMFEVILTRIRSYLQDPIWRGPPPTNGVMHVDECVEFHRLWSAMQFVYCIPVGTNEFTAEQCFGDGLNWAGCSIIVLLGQQRRFDLFDFCYHLLKVQRQDGKDEIIKNVPLKKMADRIRKYQILNNEVFAILNKYMKSVETDSSTVEHVRCFQPPIHQSLATTC

SEQ ID NO: 812758 - protein, 1246 aa, Homo sapiens
QRGRGGAERGAAERGRASCAPARGPAVASGPSPGPAAEPVQNTETAAMTTHVTLEDALSNVDLLEELPLPDQQPCIEPPPSSIMYQANFDTNFEDRNAFVTGIARYIEQATVHSSMNEMLEEGHEYAVMLYTWRSCSRAIPQVKCNEQPNRVEIYEKTVEVLEPEVTKLMKFMYFQRKAIERFCSEVKRLCHAERRKDFVSEAYLLTLGKFINMFAVLDELKNMKCSVKNDHSAYKRAAQFLRKMADPQSIQESQNLSMFLANHNRITQCLHQQLEVIPGYEELLADIVNICVDYYENKMYLTPSEKHMLLKVMGFGLYLMDGNVSNIYKLDAKKRINLSKIDKFFKQLQVVPLFGDMQIELARYIKTSAHYEENKSKWTCTQSSISPQYNICEQMVQIRDDHIRFISELARYSNSEVVTGSGLDSQKSDEEYRELFDLALRGLQLLSKWSAHVMEVYSWKLVHPTDKFCNKDCPGTAEEYERATRYNYTSEEKFAFVEVIAMIKGLQVLMGRMESVFNQAIRNTIYAALQDFAQVTLREPLRQAVRKKKNVLISVLQAIRKTICDWEGGREPPNDPCLRGEKDPKGGFDIKVPRRAVGPSSTQLYMVRTMLESLIADKSGSKKTLRSSLDGPIVLAIEDFHKQSFFFTHLLNISEALQQCCDLSQLWFREFFLELTMGRRIQFPIEMSMPWILTDHILETKEPSMMEYVLYPLDLYNDSAYYALTKFKKQFLYDEIEAEVNLCFDQFVYKLADQIFAYYKAMAGSVLLDKRFRAECKNYGVIIPYPPSNRYETLLKQRHVQLLGRSIDLNRLITQRISAAMYKSLDQAISRFESEDLTSIVELEWLLEINRLTHRLLCKHMTLDSFDAMFREANHNVSAPYGRITLHVFWELNFDFLPNYCYNGSTNRFVRTAIPFTQEPQRDKPANVQPYYLYGSKPLNIAYSHIYSSYRNFVGPPHFKTICRLLGYQGIAVVMEELLKIVKSLLQGTILQYVKTLIEVMPKICRLPRHEYGSPGILEFFHHQLKDIIEYAELKTDVFQSLREVGNAILFCLLIEQALSQEEVCDLLHAAPFQNILPRVYIKEGERLEVRMKRLEAKYAPLHLVPLIERLGTPQQIAIAREGDLLTKERLCCGLSMFEVILTRIRSYLQDPIWRGPPPTNGVMHVDECVEFHRLWSAMQFVYCIPVGTNEFTAEQCFGDGLNWAGCSIIVLLGQQRRFDLFDFCYHLLKVQRQDGKDEIIKNVP

SEQ ID NO: 812759 - protein, 1196 aa, Homo sapiens
QRGRGGAERGAAERGRASCAPARGPAVASGPSPGPAAEPVQNTETAAMTTHVTLEDALSNVDLLEELPLPDQQPCIEPPPSSIMYQANFDTNFEDRNAFVTGIARYIEQATVHSSMNEMLEEGHEYAVMLYTWRSCSRAIPQVKCNEQPNRVEIYEKTVEVLEPEVTKLMKFMYFQRKAIERFCSEVKRLCHAERRKDFVSEAYLLTLGKFINMFAVLDELKNMKCSVKNDHSAYKRAAQFLRKMADPQSIQESQNLSMFLANHNRITQCLHQQLEVIPGYEELLADIVNICVDYYENKMYLTPSEKHMLLKVMGFGLYLMDGNVSNIYKLDAKKRINLSKIDKFFKQLQVVPLFGDMQIELARYIKTSAHYEENKSKWTCTQSSISPQYNICEQMVQIRDDHIRFISELARYSNSEVVTGSGLDSQKSDEEYRELFDLALRGLQLLSKWSAHVMEVYSWKLVHPTDKFCNKDCPGTAEEYERATRYNYTSEEKFAFVEVIAMIKGLQVLMGRMESVFNQAIRNTIYAALQDFAQVTLREPLRQAVRKKKNVLISVLQAIRKTICDWEGGREPPNDPCLRGEKDPKGGFDIKVPRRAVGPSSTQLYMVRTMLESLIADKSGSKKTLRSSLDGPIVLAIEDFHKQSFFFTHLLNISEALQQCCDLSQLWFREFFLELTMGRRIQFPIEMSMPWILTDHILETKEPSMMEYVLYPLDLYNDSAYYALTKFKKQFLYDEIEAEVNLCFDQFVYKLADQIFAYYKAMAGSVLLDKRFRAECKNYGVIIPYPPSNRYETLLKQRHVQLLGRSIDLNRLITQRISAAMYKSLDQAISRFESEDLTSIVELEWLLEINRLTHRLLCKHMTLDSFDAMFREANHNVSAPYGRITLHVFWELNFDFLPNYCYNGSTNRFVRTAIPFTQEPQRDKPANVQPYYLYGSKPLNIAYSHIYSSYRNFVGPPHFKTICRLLGYQGIAVVMEELLKIVKSLLQGTILQYVKTLIEVMPKICRLPRHEYGSPGILEFFHHQLKDIIEYAELKTDVFQSLREVGNAILFCLLIEQALSQEEVCDLLHAAPFQNILPRVYIKEGERLEVRMKRLEAKYAPLHLVPLIERLGTPQQIAIAREGDLLTKERLCCGLSMFEVILTRIRSYLQDPIWRGPPPTNGVMHVDECVEFHRLWSAMQFVYCIPVGTNEFTAE

SEQ ID NO: 812760 - protein, 382 aa, Homo sapiens
PRVGLVLDRERRPFYLYGSKPLNIAYSHIYSSYRNFVGPPHFKTICRLLGYQGIAVVMEELLKIVKSLLQGTILQYVKTLIEVMPKICRLPRHEYGSPGILEFFHHQLKDIIEYAELKTDVFQSLREVGNAILFCLLIEQALSQEEVCDLLHAAPFQNILPRVYIKEGERLEVRMKRLEAKYAPLHLVPLIERLGTPQQIAIAREGDLLTKERLCCGLSMFEVILTRIRSYLQDPIWRGPPPTNGVMHVDECVEFHRLWSAMQFVYCIPVGTNEFTAEQCFGDGLNWAGCSIIVLLGQQRRFDLFDFCYHLLKVQRQDGKDEIIKNVPLKKMADRIRKYQILNNEVFAILNKYMKSVETDSSTVEHVRCFQPPIHQSLATTC

SEQ ID NO: 812761 - protein, 356 aa, Homo sapiens
RYKGQWITGNPQEGTLKMEWAGPGDCRGEKENRLMAQAKISKKYRPPCLLCPHTVLKHVPASAPDRGLGGLGSQPNMASDTFLNFPEPQFLLKSGAADPVPEAVVSLRFGHSVKWGQVLWNLNISPLTAPPRQEGGKQPGSKDCLPEVGGALYAYKAPLHLVPLIERLGTPQQIAIAREGDLLTKERLCCGLSMFEVILTRIRSYLQDPIWRGPPPTNGVMHVDECVEFHRLWSAMQFVYCIPVGTNEFTAEQCFGDGLNWAGCSIIVLLGQQRRFDLFDFCYHLLKVQRQDGKDEIIKNVPLKKMADRIRKYQILNNEVFAILNKYMKSVETDSSTVEHVRCFQPPIHQSLATTC

SEQ ID NO: 812762 - protein, 136 aa, Homo sapiens
MHVDECVEFHRLWSAMQFVYCIPVGTNEFTAEQCFGDGLNWAGCSIIVLLGQQRRFDLFDFCYHLLKVQRQDGKDEIIKNVPLKKMADRIRKYQILNNEVFAILNKYMKSVETDSSTVEHVRCFQPPIHQSLATTC

SEQ ID NO: 812763 - protein, 120 aa, Homo sapiens
KKKSKQGSLCFFFSPPSTILRTPSFTLFSIIVLLGQQRRFDLFDFCYHLLKVQRQDGKDEIIKNVPLKKMADRIRKYQILNNEVFAILNKYMKSVETDSSTVEHVRCFQPPIHQSLATTC

SEQ ID NO: 812764 - protein, 316 aa, Homo sapiens
QRGRGGAERGAAERGRASCAPARGPAVASGPSPGPAAEPVQNTETAAMTTHVTLEDALSNVDLLEELPLPDQQPCIEPPPSSIMYQANFDTNFEDRNAFVTGIARYIEQATVHSSMNEMLEEGHEYAVMLYTWRSCSRAIPQVKCNEQPNRVEIYEKTVEVLEPEVTKLMKFMYFQRKAIERFCSEVKRLCHAERRKDFVSEAYLLTLGKFINMFAVLDELKNMKCSVKNDHSAYKRAAQFLRKMADPQSIQESQNLSMFLANHNRITQCLHQQLEVIPGYEELLADIVNICVDYYENKMYLTPSEKHMLLKVKLP

SEQ ID NO: 812765 - protein, 96 aa, Homo sapiens
SKRRCVAQQDNELEQPALFDFCYHLLKVQRQDGKDEIIKNVPLKKMADRIRKYQILNNEVFAILNKYMKSVETDSSTVEHVRCFQPPIHQSLATTC

SEQ ID NO: 812766 - protein, 279 aa, Homo sapiens
QRGRGGAERGAAERGRASCAPARGPAVASGPSPGPAAEPVQNTETAAMTTHVTLEDALSNVDLLEELPLPDQQPCIEPPPSSIMYQANFDTNFEDRNAFVTGIARYIEQATVHSSMNEMLEEGHEYAVMLYTWRSCSRAIPQVKCNEQPNRVEIYEKTVEVLEPEVTKLMKFMYFQRKAIERFCSEVKRLCHAERRKDFVSEAYLLTLGKFINMFAVLDELKNMKCSVKNDHSAYKRAAQFLRKMADPQSIQESQNLSMFLANHNRITQVRADSLLGLA

SEQ ID NO: 812767 - protein, 256 aa, Homo sapiens
QRGRGGAERGAAERGRASCAPARGPAVASGPSPGPAAEPVQNTETAAMTTHVTLEDALSNVDLLEELPLPDQQPCIEPPPSSIMYQANFDTNFEDRNAFVTGIARYIEQATVHSSMNEMLEEGHEYAVMLYTWRSCSRAIPQVKCNEQPNRVEIYEKTVEVLEPEVTKLMKFMYFQRKAIERFCSEVKRLCHAERRKDFVSEAYLLTLGKFINMFAVLDELKNMKCSVKNDHSAYKRAAQLLRKMADPRCVGANLE

SEQ ID NO: 812768 - protein, 77 aa, Homo sapiens
IAFSPDELWLASAGYSRMVKVWDCNTGKCLETLKQGVLDVAHTCAFTPDGKILVSGAADQTRRQISRTSKSPRDPQT

SEQ ID NO: 812769 - protein, 1016 aa, Homo sapiens
MLDNRQQLLRKRHIGNDIVTIVFQEPGALPFTPKSIRSHFQHVFVIVKVHNPCTENVCYSVGVSRSKDVPPFGPPIPKGVTFPKSAVFRDFLLAKVINAENAAHKSEKFRAMATRTRQEYLKDLAENFVTTATVDTSVKFSFITLGAKKKEKVKPRKDAHLFSIGAIMWHVIARDFGQSADIECLLGISNEFIMLIEKDSKNVVFNCSCRDVIGWTSGLVSIKVFYERGECVLLSSVDNCAEDIREIVQRLVIVTRGCETVEMTLRRNGLGQLGFHVNFEGIVADVEPFGFAWKAGLRQGSRLVEICKVAVATLTHEQMIDLLRTSVTVKVVIIQPHDDGSPRRGCSELCRIPMVEYKLDSEGTPCEYKTPFRRNTTWHRVPTPALQPLSRASPIPGTPDRLPCQQLLQQAQAAIPRSTSFDRKLPDGTRSSPSNQSSSSDPGPGGSGPWRPQVGYDGCQSPLLLEHQGSGPLECDGAREREDTMEASRHPETKWHGPPSKVLGSYKERALQKDGSCKDSPNKLSHIGDKSCSSHSSSNTLSSNTSSNSDDKHFGSGDLMDPELLGLTYIKGASTDSGIDTAPCMPATILGPVHLAGSRSLIHSRAEQWADAADVSGPDDEPAKLYSVHGYASTISAGSAAEGSMGDLSEISSHSSGSHHSGSPSAHCSKSSGSLDSSKVYIVSHSSGQQVPGSMSKPYHRQGAVNKYVIGWKKSEGSPPPEEPEVTECPGMYSEMDVMSTATQHQTVVGDAVAETQHVLSKEDFLKLMLPDSPLVEEGRRKFSFYGNLSPRRSLYRTLSDESICSNRRGSSFGSSRSSVLDQALPNDILFSTTPPYHSTLPPRAHPAPSMGSLRNEFWFSDGSLSDKSKCADPGLMPLPDTATGLDWTHLVDAARAFEDQRVASFCTLTDMQHGQDLEGAQELPLCVDPGSGKEFMDTTGERSPSPLTGKVNQLELILRQLQTDLRKEKQDKAVLQAEVQHLRQDNMRLQEESQTATAQLRKFTEWFFTTIDKKS

SEQ ID NO: 812770 - protein, 1016 aa, Homo sapiens; identical to SEQ ID NO: 812769

SEQ ID NO: 812771 - protein, 1016 aa, Homo sapiens; identical to SEQ ID NO: 812769

SEQ ID NO: 812772 - protein, 731 aa, Homo sapiens
MLDNRQQLLRKRHIGNDIVTIVFQEPGALPFTPKSIRSHFQHVFVIVKVHNPCTENVCYSVGVSRSKDVPPFGPPIPKGVTFPKSAVFRDFLLAKVINAENAAHKSEKFRAMATRTRQEYLKDLAENFVTTATVDTSVKFSFITLGAKKKEKVKPRKDAHLFSIGAIMWHVIARDFGQSADIECLLGISNEFIMLIEKDSKNVVFNCSCRDVIGWTSGLVSIKVFYERGECVLLSSVDNCAEDIREIVQRLVIVTRGCETVEMTLRRNGLGQLGFHVNFEGIVADVEPFGFAWKAGLRQGSRLVEICKVAVATLTHEQMIDLLRTSVTVKVVIIQPHDDGSPRRGCSELCRIPMVEYKLDSEGTPCEYKTPFRRNTTWHRVPTPALQPLSRASPIPGTPDRLPCQQLLQQAQAAIPRSTSFDRKLPDGTRSSPSNQSSSSDPGPGGSGPWRPQVGYDGCQSPLLLEHQGSGPLECDGAREREDTMEASRHPETKWHGPPSKVLGSYKERALQKDGSCKDSPNKLSHIGDKSCSSHSSSNTLSSNTSSNSDDKHFGSGDLMDPELLGLTYIKGASTDSGIDTAPCMPATILGPVHLAGSRSLIHSRAEQWADAADVSGPDDEPAKLYSVHGYASTISAGSAAEGSMGDLSEISSHSSGSHHSGSPSAHCSKSSGSLDSSKVYIVSHSSGQQVPGSMSKPYHRQGAVNKYVIGWKKSEGSPPPEEPEVTECPG

SEQ ID NO: 812773 - protein, 67 aa, Homo sapiens
GGMNVSISLHDSVYFYSDQEKQDKAVLQAEVQHLRQDNMRLQEESQTATAQLRKFTEWFFTTIDKKS

SEQ ID NO: 812774 - protein, 991 aa, Homo sapiens
MLDNRQQLLRKRHIGNDIVTIVFQEPGALPFTPKSIRSHFQHVFVIVKVHNPCTENVCYSVGVSRSKDVPPFGPPIPKGVTFPKSAVFRDFLLAKVINAENAAHKSEKFRAMATRTRQEYLKDLAENFVTTATVDTSVKFSFITLGAKKKEKVKPRKDAHLFSIGAIMWHVIARDFGQSADIECLLGISNEFIMLIEKDSKNVVFNCSCRDVIGWTSGLVSIKVFYERGECVLLSSVDNCAEDIREIVQRLVIVTRGCETVEMTLRRNGLGQLGFHVNFEGIVADVEPFGFAWKAGLRQGSRLVEICKVAVATLTHEQMIDLLRTSVTVKVVIIQPHDDGSPRRGCSELCRIPMVEYKLDSEGTPCEYKTPFRRNTTWHRVPTPALQPLSRASPIPGTPDRLPCQQLLQQAQAAIPRSTSFDRKLPDGTRSSPSNQSSSSDPGPGGSGPWRPQVGYDGCQSPLLLEHQGSGPLECDGAREREDTMEASRHPETKWHGPPSKVLGSYKERALQKDGSCKDSPNKLSHIGDKSCSSHSSSNTLSSNTSSNSDDKHFGSGDLMDPELLGLTYIKGASTDSGIDTAPCMPATILGPVHLAGSRSLIHSRAEQWADAADVSGPDDEPAKLYSVHGYASTISAGSAAEGSMGDLSEISSHSSGSHHSGSPSAHCSKSSGSLDSSKVYIVSHSSGQQVPGSMSKPYHRQGAVNKYVIGWKKSEGSPPPEEPEVTECPGMYSEMDVMSTATQHQTVVGDAVAETQHVLSKEDFLKLMLPDSPLVEEGRRKFSFYGNLSPRRSLYRTLSDESICSNRRGSSFGSSRSSVLDQALPNDILFSTTPPYHSTLPPRAHPAPSMGSLRNEFWFSDGSLSDKSKCADPGLMPLPDTATGLDWTHLVDAARAFEDQRVASFCTLTDMQHGQDLEGAQELPLCVDPGSGKEFMDTTGERSPSPLTGKVNQLELILRQLQTDLRKVINWKSIIRTVSLIKSAPYNYYR

SEQ ID NO: 812775 - protein, 1016 aa, Homo sapiens; identical to SEQ ID NO: 812769

SEQ ID NO: 812776 - protein, 84 aa, Homo sapiens
GLEGPHTMLDNRQQLLRKRHIGNDIVTIVFQEPGALPFTPKSIRSHFQHVFVIVKVHNPCTENVCYSVGVSRSKDVPQAPGRRW

SEQ ID NO: 812777 - protein, 158 aa, Homo sapiens
ACSVVVQWPSQPCAPKHLEHIALQNFYLPASLPLAMACRCLSFLLMGTFLSVSQTVLAQLDALLVFPGQVAQLSCTLSPQHVTIRDYGVSWYQQRAGSAPRYLLYYRSEEDHHRPADIPDRFSAAKDEAHNACVLTISPVQPEDDADYYCSVGYGFSP

SEQ ID NO: 812778 - protein, 142 aa, Homo sapiens
ACSVVVQWPSQPCAPKHLEHIALQNFYLPASLPLAMACRCLSFLLMGTFLSGQVAQLSCTLSPQHVTIRDYGVSWYQQRAGSAPRYLLYYRSEEDHHRPADIPDRFSAAKDEAHNACVLTISPVQPEDDADYYCSVGYGFSP

SEQ ID NO: 812779 - protein, 36 aa, Homo sapiens
MYQHFIINYSFLVLCLSCFRTFSQVKSFLVLKLLVS

SEQ ID NO: 812780 - protein, 36 aa, Homo sapiens; identical to SEQ ID NO: 812779

SEQ ID NO: 812781 - protein, 1162 aa, Homo sapiens
MYLSICCCFLLWAPALTLKNLNYSVPEEQGAGTVIGNIGRDARLQPGLPPAERGGGGRSKSGSYRVLENSAPHLLDVDADSGLLYTKQRIDRESLCRHNAKCQLSLEVFANDKEICMIKVEIQDINDNAPSFSSDQIEMDISENAAPGTRFPLTSAHDPDAGENGLRTYLLTRDDHGLFGLDVKSRGDGTKFPELVIQKALDREQQNHHTLVLTALDGGEPPRSATVQINVKVIDSNDNSPVFEAPSYLVELPENAPLGTVVIDLNATDADEGPNGEVLYSFSSYVPDRVRELFSIDPKTGLIRVKGNLDYEENGMLEIDVQARDLGPNPIPAHCKVTVKLIDRNDNAPSIGFVSVRQGALSEAAPPGTVIALVRVTDRDSGKNGQLQCRVLGGGGTGGGGGLGGPGGSVPFKLEENYDNFYTVVTDRPLDRETQDEYNVTIVARDGGSPPLNSTKSFAIKILDENDNPPRFTKGLYVLQVHENNIPGEYLGSVLAQDPDLGQNGTVSYSILPSHIGDVSIYTYVSVNPTNGAIYALRSFNFEQTKAFEFKVLAKDSGAPAHLESNATVRVTVLDVNDNAPVIVLPTLQNDTAELQVPRNAGLGYLVSTVRALDSDFGESGRLTYEIVDGNDDHLFEIDPSSGEIRTLHPFWEDVTPVVELVVKVTDHGKPTLSAVAKLIIRSVSGSLPEGVPRVNGEQHHWDMSLPLIVTLSTISIILLAAMITIAVKCKRENKEIRTYNCRIAEYSHPQLGGGKGKKKKINKNDIMLVQSEVEERNAMNVMNVVSSPSLATSPMYFDYQTRLPLSSPRSEVMYLKPASNNLTVPQGHAGCHTSFTGQGTNASETPATRMSIIQTDNFPAEPNYMGSRQQFVQSISVAPRLRTQKEPAMRDSGHGDSDQADSDQDTNKGSCCDMSVREALKMKTTSTKSQPLEQEPEECVNCTDECRVLGHSDRCWMPQFPAANQAENADYRTNLFVPTVEANVETETYETVNPTGKKTFCTFGKDKREHTILIANVKPYLKAKRALSPLLQEVPSASSSPTKACIEPCTSTKGSLDGCEAKPGALAEASSQYLPTDSQYLSPSKQPRDPPFMASDQMARVFADVHSRASRDSSEMGAVLEQLDHPNRDLGRESVDAEEVVREIDKLLQDCRGNDPVAVRK

SEQ ID NO: 812782 - protein, 122 aa, Homo sapiens
DDPVAVRKLINFSHNFLCTTDSLPRSLAEASSQYLPTDSQYLSPSKQPRDPPFMASDQMARVFADVHSRASRDSSEMGAVLEQLDHPNRDLGRESVDAEEVVREIDKLLQDCRGNDPVAVRK

SEQ ID NO: 812783 - protein, 1162 aa, Homo sapiens; identical to SEQ ID NO: 812781

SEQ ID NO: 812784 - protein, 1162 aa, Homo sapiens; identical to SEQ ID NO: 812781

SEQ ID NO: 812785 - protein, 475 aa, Homo sapiens
MGMWASLDALWEMPAEKRIFGAVLLFSWTVYLWETFLAQRQRRIYKTTTHVPPELGQIMDSETFEKSRLYQLDKSTFSFWSGLYSETEGTLILLFGGIPYLWRLSGRFCGYAGFGPEYEITQSLVFLLLATLFSALTGLPWSLYNTFVIEEKHGFNQQTLGFFMKDAIKKFVVTQCILLPVSSLLLYIIKIGGDYFFIYAWLFTLVVSLVLVTIYADYIAPLFDKFTPLPEGKLKEEIEVMAKSIDFPLTKVYVVEGSKRSSHSNAYFYGFFKNKRIVLFDTLLEEYSVLNKDIQEDSGMEPRNEEEGNSEEIKAKVKNKKQGCKNEEVLAVLGHELGHWKLGHTVKNIIISQMNSFLCFFLFAVLIGRKELFAAFGFYDSQPTLIGLLIIFQFIFSPYNEVLSFCLTVLSRRFEFQADAFAKKLGKAKDLYSALIKLNKDNLGFPVSDWLFSMWHYSHPPLLERLQALKTMKQH

SEQ ID NO: 812786 - protein, 176 aa, Homo sapiens [sequence omitted]

SEQ ID NO: 812787 - protein, 281 aa, Homo sapiens
MGMWASLDALWEMPAEKRIFGAVLLFSWTVYLWETFLAQRQRRIYKTTTHVPPELGQIMDSETFEKSRLYQLDKSTFSFWSGLYSETEGTLILLFGGIPYLWRLSGRFCGYAGFGPEYEITQSLVFLLLATLFSALTGLPWSLYNTFVIEEKHGFNQQTLGFFMKDAIKKFVVTQCILLPVSSLLLYIIKIGGDYFFIYAWLFTLVVSLVLVTIYADYIAPLFDKFTPLPEGKLKEEIEVMAKSIDFPLTKVYVVEGSKRSSHSNAYFYGFFKNKRIVYAA

SEQ ID NO: 812788 - protein, 475 aa, Homo sapiens; identical to SEQ ID NO: 812785

SEQ ID NO: 812789 - protein, 475 aa, Homo sapiens; identical to SEQ ID NO: 812785

SEQ ID NO: 812790 - protein, 475 aa, Homo sapiens; identical to SEQ ID NO: 812785

SEQ ID NO: 812791 - protein, 773 aa, Homo sapiens
MSRRKQGKPQHLSKREFSPEPLEAILTDDEPDHGPLGAPEGDHDLLTCGQCQMNFPLGDILIFIEHKRKQCNGSLCLEKAVDKPPSPSPIEMKKASNPVEVGIQVTPEDDDCLSTSSRGICPKQEHIADKLLHWRGLSSPRSAHGALIPTPGMSAEYAPQGICKDEPSSYTCTTCKQPFTSAWFLLQHAQNTHGLRIYLESEHGSPLTPRVGIPSGLGAECPSQPPLHGIHIADNNPFNLLRIPGSVSREASGLAEGRFPPTPPLFSPPPRHHLDPHRIERLGAEEMALATHHPSAFDRVLRLNPMAMEPPAMDFSRRLRELAGNTSSPPLSPGRPSPMQRLLQPFQPGSKPPFLATPPLPPLQSAPPPSQPPVKSKSCEFCGKTFKFQSNLVVHRRSHTGEKPYKCNLCDHACTQASKLKRHMKTHMHKSSPMTVKSDDGLSTASSPEPGTSDLVGSASSALKSVVAKFKSENDPNLIPENGDEEEEEDDEEEEEEEEEEEEELTESERVDYGFGLSLEAARHHENSSRGAVVGVGDESRALPDVMQGMVLSSMQHFSEAFHQVLGEKHKRGHLAEAEGHRDTCDEDSVAGESDRIDDGTVNGRGCSPGESASGGLSKKLLLGSPSSLSPFSKRIKLEKEFDLPPAAMPNTENVYSQWLAGYAASRQLKDPFLSFGDSRQSPFASSSEHSSENGSLRFSTPPGELDGGISGRSGTGSGGSTPHISGPGPGRPSSKEGRRSDTCSSHTPIRRSTQRAQDVWQFSDGSSRALKF

SEQ ID NO: 812792 - protein, 243 aa, Homo sapiens
MSRRKQGKPQHLSKREFSPEPLEAILTDDEPDHGPLGAPEGDHDLLTCGQCQMNFPLGDILIFIEHKRKQCNGSLCLEKAVDKPPSPSPIEMKKASNPVEVGIQVTPEDDDCLSTSSRGICPKQEHIADKLLHWRGLSSPRSAHGALIPTPGMSAEYAPQGICKDEPSSYTCTTCKQPFTSAWFLLQHAQNTHGLRIYLESEHGSPLTPRVLHTPPFGVVPRELKMCGSFRMEAREPLSSEKI

SEQ ID NO: 812793 - protein, 801 aa, Homo sapiens
MSRRKQGKPQHLSKREFSPEPLEAILTDDEPDHGPLGAPEGDHDLLTCGQCQMNFPLGDILIFIEHKRKQCNGSLCLEKAVDKPPSPSPIEMKKASNPVEVGIQVTPEDDDCLSTSSRGICPKQEHIAGKDEPSSYTCTTCKQPFTSAWFLLQHAQNTHGLRIYLESEHGSPLTPRVGIPSGLGAECPSQPPLHGIHIADNNPFNLLRIPGSVSREASGLAEGRFPPTPPLFSPPPRHHLDPHRIERLGAEEMALATHHPSAFDRVLRLNPMAMEPPAMDFSRRLRELAGNTSSPPLSPGRPSPMQRLLQPFQPGSKPPFLATPPLPPLQSAPPPSQPPVKSKSCEFCGKTFKFQSNLVVHRRSHTGEKPYKCNLCDHACTQASKLKRHMKTHMHKSSPMTVKSDDGLSTASSPEPGTSDLVGSASSALKSVVAKFKSENDPNLIPENGDEEEEEDDEEEEEEEEEEEEELTESERVDYGFGLSLEAARHHENSSRGAVVGVGDESRALPDVMQGMVLSSMQHFSEAFHQVLGEKHKRGHLAEAEGHRDTCDEDSVAGESDRIDDGTVNGRGCSPGESASGGLSKKLLLGSPSSLSPFSKRIKLEKEFDLPPAAMPNTENVYSQWLAGYAASRQLKDPFLSFGDSRQSPFASSSEHSSENGSLRFSTPPGELDGGISGRSGTGSGGSTPHISGPGPGRPSSKEGRRSDTCEYCGKVFKNCSNLTVHRRSHTGERPYKCELCNYACAQSSKLTRHMKTHGQVGKDVYKCEICKMPFSVYSTLEKHMKKWHSDRVLNNDIKTE

SEQ ID NO: 812794 - protein, 683 aa, Homo sapiens
MSAEYAPQGICKDEPSSYTCTTCKQPFTSAWFLLQHAQNTHGLRIYLESEHGSPLTPRVGIPSGLGAECPSQPPLHGIHIADNNPFNLLRIPGSVSREASGLAEGRFPPTPPLFSPPPRHHLDPHRIERLGAEEMALATHHPSAFDRVLRLNPMAMEPPAMDFSRRLRELAGNTSSPPLSPGRPSPMQRLLQPFQPGSKPPFLATPPLPPLQSAPPPSQPPVKSKSCEFCGKTFKFQSNLVVHRRSHTGEKPYKCNLCDHACTQASKLKRHMKTHMHKSSPMTVKSDDGLSTASSPEPGTSDLVGSASSALKSVVAKFKSENDPNLIPENGDEEEEEDDEEEEEEEEEEEEELTESERVDYGFGLSLEAARHHENSSRGAVVGVGDESRALPDVMQGMVLSSMQHFSEAFHQVLGEKHKRGHLAEAEGHRDTCDEDSVAGESDRIDDGTVNGRGCSPGESASGGLSKKLLLGSPSSLSPFSKRIKLEKEFDLPPAAMPNTENVYSQWLAGYAASRQLKDPFLSFGDSRQSPFASSSEHSSENGSLRFSTPPGELDGGISGRSGTGSGGSTPHISGPGPGRPSSKEGRRSDTCEYCGKVFKNCSNLTVHRRSHTGERPYKCELCNYACAQSSKLTRHMKTHGQVGKDVYKCEICKMPFSVYSTLEKHMKKWHSDRVLNNDIKTE

SEQ ID NO: 812795 - protein, 730 aa, Homo sapiens
RPPPQPPQAQAPQPPPPPQLGGAGGGSSRHEKSLGLLTTKFVSLLQEAKDGVLDLKAGKDEPSSYTCTTCKQPFTSAWFLLQHAQNTHGLRIYLESEHGSPLTPRVGIPSGLGAECPSQPPLHGIHIADNNPFNLLRIPGSVSREASGLAEGRFPPTPPLFSPPPRHHLDPHRIERLGAEEMALATHHPSAFDRVLRLNPMAMEPPAMDFSRRLRELAGNTSSPPLSPGRPSPMQRLLQPFQPGSKPPFLATPPLPPLQSAPPPSQPPVKSKSCEFCGKTFKFQSNLVVHRRSHTGEKPYKCNLCDHACTQASKLKRHMKTHMHKSSPMTVKSDDGLSTASSPEPGTSDLVGSASSALKSVVAKFKSENDPNLIPENGDEEEEEDDEEEEEEEEEEEEELTESERVDYGFGLSLEAARHHENSSRGAVVGVGDESRALPDVMQGMVLSSMQHFSEAFHQVLGEKHKRGHLAEAEGHRDTCDEDSVAGESDRIDDGTVNGRGCSPGESASGGLSKKLLLGSPSSLSPFSKRIKLEKEFDLPPAAMPNTENVYSQWLAGYAASRQLKDPFLSFGDSRQSPFASSSEHSSENGSLRFSTPPGELDGGISGRSGTGSGGSTPHISGPGPGRPSSKEGRRSDTCEYCGKVFKNCSNLTVHRRSHTGERPYKCELCNYACAQSSKLTRHMKTHGQVGKDVYKCEICKMPFSVYSTLEKHMKKWHSDRVLNNDIKTE

SEQ ID NO: 812796 - protein, 243 aa, Homo sapiens; identical to SEQ ID NO: 812792

SEQ ID NO: 812797 - protein, 142 aa, Homo sapiens
MSRRKQGKPQHLSKREFSPEPLEAILTDDEPDHGPLGAPEGDHDLLTCGQCQMNFPLGDILIFIEHKRKQCNGSLCLEKAVDKPPSPSPIEMKKASNPVEVGIQVTPEDDDCLSTSSRGICPKQEHIAAQTELEDVFVYLMV

SEQ ID NO: 812798 - protein, 835 aa, Homo sapiens
MSRRKQGKPQHLSKREFSPEPLEAILTDDEPDHGPLGAPEGDHDLLTCGQCQMNFPLGDILIFIEHKRKQCNGSLCLEKAVDKPPSPSPIEMKKASNPVEVGIQVTPEDDDCLSTSSRGICPKQEHIADKLLHWRGLSSPRSAHGALIPTPGMSAEYAPQGICKDEPSSYTCTTCKQPFTSAWFLLQHAQNTHGLRIYLESEHGSPLTPRVGIPSGLGAECPSQPPLHGIHIADNNPFNLLRIPGSVSREASGLAEGRFPPTPPLFSPPPRHHLDPHRIERLGAEEMALATHHPSAFDRVLRLNPMAMEPPAMDFSRRLRELAGNTSSPPLSPGRPSPMQRLLQPFQPGSKPPFLATPPLPPLQSAPPPSQPPVKSKSCEFCGKTFKFQSNLVVHRRSHTGEKPYKCNLCDHACTQASKLKRHMKTHMHKSSPMTVKSDDGLSTASSPEPGTSDLVGSASSALKSVVAKFKSENDPNLIPENGDEEEEEDDEEEEEEEEEEEEELTESERVDYGFGLSLEAARHHENSSRGAVVGVGDESRALPDVMQGMVLSSMQHFSEAFHQVLGEKHKRGHLAEAEGHRDTCDEDSVAGESDRIDDGTVNGRGCSPGESASGGLSKKLLLGSPSSLSPFSKRIKLEKEFDLPPAAMPNTENVYSQWLAGYAASRQLKDPFLSFGDSRQSPFASSSEHSSENGSLRFSTPPGELDGGISGRSGTGSGGSTPHISGPGPGRPSSKEGRRSDTCEYCGKVFKNCSNLTVHRRSHTGERPYKCELCNYACAQSSKLTRHMKTHGQVGKDVYKCEICKMPFSVYSTLEKHMKKWHSDRVLNNDIKTE

SEQ ID NO: 812799 - protein, 773 aa, Homo sapiens; identical to SEQ ID NO: 812791

SEQ ID NO: 812800 - protein, 797 aa, Homo sapiens
MSKGTDEDIFSGVSFFLTRLSRCEPSRRPPAPQPTMSRRKQGKPQHLSKREFSPEPLEAILTDDEPDHGPLGAPEGDHDLLTCGQCQMNFPLGDILIFIEHKRKQCNGSLCLEKAVDKPPSPSPIEMKKASNPVEVGIQVTPEDDDCLSTSSRGICPKQEHIADKLLHWRGLSSPRSAHGALIPTPGMSAEYAPQGICKDEPSSYTCTTCKQPFTSAWFLLQHAQNTHGLRIYLESEHGSPLTPRVGIPSGLGAECPSQPPLHGIHIADNNPFNLLRIPGSVSREASGLAEGRFPPTPPLFSPPPRHHLDPHRIERLGAEEMALATHHPSAFDRVLRLNPMAMEPPAMDFSRRLRELAGNTSSPPLSPGRPSPMQRLLQPFQPGSKPPFLATPPLPPLQSAPPPSQPPVKSKSCEFCGKTFKFQSNLVVHRRSHTGEKPYKCNLCDHACTQASKLKRHMKTHMHKSSPMTVKSDDGLSTASSPEPGTSDLVGSASSALKSVVAKFKSENDPNLIPENGDEEEEEDDEEEEEEEEEEEEELTESERVDYGFGLSLEAVVGVGDESRALPDVMQGMVLSSMQHFSEAFHQVLGEKHKRGHLAEAEGHRDTCDEDSVAGESDRIDDGTVNGRGCSPGESASGGLSKKLLLGSPSSLSPFSKRIKLEKEFDLPPAAMPNTENVYSQWLAGYAASRQLKDPFLSFGDSRQSPFASSSEHSSENGSLRFSTPPGELDGGISGRSGTGSGGSTPHISGPGPGRPSSKEGRRSDTCSSHTPIRRSTQRAQDVWQFSDGSSRALKF

SEQ ID NO: 812801 - protein, 835 aa, Homo sapiens; identical to SEQ ID NO: 812798

SEQ ID NO: 812802 - protein, 830 aa, Homo sapiens
QTRRRRCEVTARPAEPLEAILTDDEPDHGPLGAPEGDHDLLTCGQCQMNFPLGDILIFIEHKRKQCNGSLCLEKAVDKPPSPSPIEMKKASNPVEVGIQVTPEDDDCLSTSSRGICPKQEHIADKLLHWRGLSSPRSAHGALIPTPGMSAEYAPQGICKDEPSSYTCTTCKQPFTSAWFLLQHAQNTHGLRIYLESEHGSPLTPRVGIPSGLGAECPSQPPLHGIHIADNNPFNLLRIPGSVSREASGLAEGRFPPTPPLFSPPPRHHLDPHRIERLGAEEMALATHHPSAFDRVLRLNPMAMEPPAMDFSRRLRELAGNTSSPPLSPGRPSPMQRLLQPFQPGSKPPFLATPPLPPLQSAPPPSQPPVKSKSCEFCGKTFKFQSNLVVHRRSHTGEKPYKCNLCDHACTQASKLKRHMKTHMHKSSPMTVKSDDGLSTASSPEPGTSDLVGSASSALKSVVAKFKSENDPNLIPENGDEEEEEDDEEEEEEEEEEEEELTESERVDYGFGLSLEAARHHENSSRGAVVGVGDESRALPDVMQGMVLSSMQHFSEAFHQVLGEKHKRGHLAEAEGHRDTCDEDSVAGESDRIDDGTVNGRGCSPGESASGGLSKKLLLGSPSSLSPFSKRIKLEKEFDLPPAAMPNTENVYSQWLAGYAASRQLKDPFLSFGDSRQSPFASSSEHSSENGSLRFSTPPGELDGGISGRSGTGSGGSTPHISGPGPGRPSSKEGRRSDTCEYCGKVFKNCSNLTVHRRSHTGERPYKCELCNYACAQSSKLTRHMKTHGQVGKDVYKCEICKMPFSVYSTLEKHMKKWHSDRVLNNDIKTE

SEQ ID NO: 812803 - protein, 142 aa, Homo sapiens; identical to SEQ ID NO: 812797

SEQ ID NO: 812804 - protein, 102 aa, Homo sapiens
MADDVDQQQTTNTVEEPLDLIRLSLDERIYVKMRNDRELRGRLHAYDQHLNMILGDVEETVTTIEIDEETYEEIYKSTKRNIPMLFVRGDGVVLVAPPLRVG

SEQ ID NO: 812805 - protein, 171 aa, Homo sapiens
KERTNRSSTLACFAAVDDCHKFTCQHNVHHGVRRRQPITMVIWCIDLEVEEKCALIEQVAHQTIVLTYIGWTDVDQQQTTNTVEEPLDLIRLSLDERIYVKMRNDRELRGRLHAYDQHLNMILGDVEETVTTIEIDEETYEEIYKSTKRNIPMLFVRGDGVVLVAPPLRVG

SEQ ID NO: 812806 - protein, 102 aa, Homo sapiens; identical to SEQ ID NO: 812804

SEQ ID NO: 812807 - protein, 102 aa, Homo sapiens; identical to SEQ ID NO: 812804

SEQ ID NO: 812808 - protein, 102 aa, Homo sapiens; identical to SEQ ID NO: 812804

SEQ ID NO: 812809 - protein, 102 aa, Homo sapiens; identical to SEQ ID NO: 812804

SEQ ID NO: 812810 - protein, 102 aa, Homo sapiens; identical to SEQ ID NO: 812804

SEQ ID NO: 812811 - protein, 102 aa, Homo sapiens; identical to SEQ ID NO: 812804

SEQ ID NO: 812812 - protein, 102 aa, Homo sapiens; identical to SEQ ID NO: 812804

SEQ ID NO: 812813 - protein, 201 aa, Homo sapiens
MSTEAQRVDDSPSTSGGSSDGDQRESVQQEPEREQVQPKKKEGKISSKTAAKLSTSAKRIQKELAEITLDPPPNCSAGPKGDNIYEWRSTILGPPGSVYEGGVFFLDITFSPDYPFKPPKVTFRTRIYHCNINSQGVICLDILKDNWSPALTISKVLLSICSLLTDCNPADPLVGSIATQYMTNRAEHDRMARQWTKRYAT

SEQ ID NO: 812814 - protein, 132 aa, Homo sapiens
ICMSYFSAGPKGDNIYEWRSTILGPPGSVYEGGVFFLDITFSPDYPFKPPKVTFRTRIYHCNINSQGVICLDILKDNWSPALTISKVLLSICSLLTDCNPADPLVGSIATQYMTNRAEHDRMARQWTKRYAT

SEQ ID NO: 812815 - protein, 280 aa, Homo sapiens
AAPHGRRGARALAVSPGRARRHAHSRVRARTAGRRRLPEVVASLSRTQGQPQRQPRAAASGAGAGTAGGGGSGGAEGSKMSTEAQRVDDSPSTSGGSSDGDQRESVQQEPEREQVQPKKKEGKISSKTAAKLSTSAKRIQKELAEITLDPPPNCSAGPKGDNIYEWRSTILGPPGSVYEGGVFFLDITFSPDYPFKPPKVTFRTRIYHCNINSQGVICLDILKDNWSPALTISKVLLSICSLLTDCNPADPLVGSIATQYMTNRAEHDRMARQWTKRYAT

SEQ ID NO: 812816 - protein, 110 aa, Homo sapiens
FAGLTLLTTIATRSKMSTEAQRVDDSPSTSGGSSDGDQRESVQQEPEREQVLIFLFLLNLEPFCDGMLSIFPSQFFLPPFLSPTLSFISHFIPLLISVNLKDLGFFPTSS

SEQ ID NO: 812817 - protein, 225 aa, Homo sapiens
MSTEAQRVDDSPSTSGGSSDGDQRESVQQEPEREQVQPKKKEGKISSKTAAKLSTSAKRIQKELAEITLDPPPNCSTNITLKGNAHSILNWIFGFWMPTSAGPKGDNIYEWRSTILGPPGSVYEGGVFFLDITFSPDYPFKPPKVTFRTRIYHCNINSQGVICLDILKDNWSPALTISKVLLSICSLLTDCNPADPLVGSIATQYMTNRAEHDRMARQWTKRYAT

SEQ ID NO: 812818 - protein, 304 aa, Homo sapiens
AAPHGRRGARALAVSPGRARRHAHSRVRARTAGRRRLPEVVASLSRTQGQPQRQPRAAASGAGAGTAGGGGSGGAEGSKMSTEAQRVDDSPSTSGGSSDGDQRESVQQEPEREQVQPKKKEGKISSKTAAKLSTSAKRIQKELAEITLDPPPNCSTNITLKGNAHSILNWIFGFWMPTSAGPKGDNIYEWRSTILGPPGSVYEGGVFFLDITFSPDYPFKPPKVTFRTRIYHCNINSQGVICLDILKDNWSPALTISKVLLSICSLLTDCNPADPLVGSIATQYMTNRAEHDRMARQWTKRYAT

SEQ ID NO: 812819 - protein, 306 aa, Homo sapiens
MACTEANLTCVSELPVGWTQEYILWSMERSLQQIFRYLESARSRLVEQDLPESQDMISSSTTSVLVAQKTVLCCCDYKKAKHSTDHSISFSSSCNDSSLSHLPVFSEGTTWEFRSHSLPISHKKQSSVFRNQGRTLPLFQLSEPQKSKIFQNLADLSPLQPQSSFINSISEPLNICKQKRKKNDERMSKSHLTSDHEPNSVSKERPRLPRWATFKLSPSVRRELEGHMSQKVFALRQQTAPLPLRKSWAMLNYITEVQGGVAESEKPQTQLSMPIHQNTEQNINNKSSDLPSFQLHVNAGVGSGSN

SEQ ID NO: 812820 - protein, 304 aa, Homo sapiens
RNFFFFSNSPSGQKYFAFEMATFFVFLFQCKLKHFSLFLRSRLVEQDLPESQDMISSSTTSVLVAQKTVLCCCDYKKAKHSTDHSISFSSSCNDSSLSHLPVFSEGTTWEFRSHSLPISHKKQSSVFRNQGRTLPLFQLSEPQKSKIFQNLADLSPLQPQSSFINSISEPLNICKQKRKKNDERMSKSHLTSDHEPNSVSKERPRLPRWATFKLSPSVRRELEGHMSQKVFALRQQTAPLPLRKSWAMLNYITEVQGGVAESEKPQTQLSMPIHQNTEQNINNKSSDLPSFQLHVNAGVGSGSN

SEQ ID NO: 812821 - protein, 89 aa, Homo sapiens
HFCIEMGFCQITQSGLELLASGDLSASASQSAAITGMSHRDGQPLAALASSLLRLSTRSPVLGEASPGLTERQGSTARGFDCITLFHWF

SEQ ID NO: 812822 - protein, 124 aa, Homo sapiens
MVLCWLLLLVMALPPGTTGVKDCVFCELTDSMQCPGTYMHCGDDEDCFTGHGVAPGTGPVINKGCLRATSCGLEEPVSYRGVTYSLTTNCCTGRLCNRAPSSQTVGATTSLALGLGMLLPPRLL

SEQ ID NO: 812823 - protein, 172 aa, Homo sapiens
MCSTKGMWHVAPGRVHPARGQLFSCLGLTLTTGLWGVLQPKCPPCPPHISVRGGHAQANVLSQPAAGAALPRRAWEVLGMPQRFSSCLALAWPSASRINLRSVEQPRETQIWLRTAYGQEGCKSSQAKPPWALAPAAAWLWTQLEPGRKSATPHRRPLRLGKHLRKKLLQKR

SEQ ID NO: 812824 - protein, 406 aa, Homo sapiens
SACVCECDSGCGCGRGRGRRARRSPAAGGPARAPAPRARRGRVAQPSLETTPPLPVAVAMSVAGLKKQFHKASQLFSEKISGAEGTKLDDEFLDMERKIDVTNKVVAEILSKTTEYLQPNPAYRAKLGMLNTVSKIRGQVKTTGYPQTEGLLGDCMLKYGKELGEDSTFGNALIEVGESMKLMAEVKDSLDINVKQTFIDPLQLLQDKDLKEIGHHLKKLEGRRLDYDYKKKRVGKIPDEEVRQAVEKFEESKELAERSMFNFLENDVEQVSQLAVFIEAALDYHRQSTEILQELQSKLQMRISAASSVPRREYKPRPVKRSSSELNGVSTTSVVKTTGSNIPMDQPCCRGLYDFEPENQGELGFKEGDIITLTNQIDENWYEGMIHGESGFFPINYVEVIVPLPQ

SEQ ID NO: 812825 - protein, 388 aa, Homo sapiens
AGVCASVTAAVAVAVAVGGGPGGAQPRGDRPGLPLPERAVAMSVAGLKKQFHKASQLFSEKISGAEGTKLDDEFLDMERKIDVTNKVVAEILSKTTEYLQPNPAYRAKLGMLNTVSKIRGQVKTTGYPQTEGLLGDCMLKYGKELGEDSTFGNALIEVGESMKLMAEVKDSLDINVKQTFIDPLQLLQDKDLKEIGHHLKKLEGRRLDYDYKKKRVGKIPDEEVRQAVEKFEESKELAERSMFNFLENDVEQVSQLAVFIEAALDYHRQSTEILQELQSKLQMRISAASSVPRREYKPRPVKRSSSELNGVSTTSVVKTTGSNIPMDQPCCRGLYDFEPENQGELGFKEGDIITLTNQIDENWYEGMIHGESGFFPINYVEVIVPLPQ

SEQ ID NO: 812826 - protein, 399 aa, Homo sapiens
SACVCECDSGCGCGRGRGRRARRSPAAGGPARAPAPRARRGRVAQPSLETTPPLPVAVAMSVAGLKKQFHKASQLFSEKISGAEGTKLDDEFLDMERKIDVTNKVVAEILSKTTEYLQPNPAYRAKLGMLNTVSKIRGQVKTTGYPQTEGLLGDCMLKYGKELGEDSTFGNALIEVGESMKLMAEVKDSLDINVKQTFIDPLQLLQDKDLKEIGHHLKKLEGRRLDYDYKKKRVGKIPDEEVRQAVEKFEESKELAERSMFNFLENDVEQVSQLAVFIEAALDYHRQSTEILQELQSKLQMRISAASSVPRREYKPRPVKRSSSELNGVSTTSVVKTTGSNIPMDQPCCRGLYDFEPENQGELGFKEGDGTFRKIKRETKIKMCRKKIVNIYKLKDQQH

SEQ ID NO: 812827 - protein, 355 aa, Homo sapiens
MDGIFAGIICNQANRCLTWTSQQLFSEKISGAEGTKLDDEFLDMERKIDVTNKVVAEILSKTTEYLQPNPAYRAKLGMLNTVSKIRGQVKTTGYPQTEGLLGDCMLKYGKELGEDSTFGNALIEVGESMKLMAEVKDSLDINVKQTFIDPLQLLQDKDLKEIGHHLKKLEGRRLDYDYKKKRVGKIPDEEVRQAVEKFEESKELAERSMFNFLENDVEQVSQLAVFIEAALDYHRQSTEILQELQSKLQMRISAASSVPRREYKPRPVKRSSSELNGVSTTSVVKTTGSNIPMDQPCCRGLYDFEPENQGELGFKEGDIITLTNQIDENWYEGMIHGESGFFPINYVEVIVPLPQ

SEQ ID NO: 812828 - protein, 302 aa, Homo sapiens
SACVCECDSGCGCGRGRGRRARRSPAAGGPARAPAPRARRGRVAQPSLETTPPLPVAVAMSVAGLKKQFHKASQLFSEKISGAEGTKLDDEFLDMERKIDVTNKVVAEILSKTTEYLQPNPAYRAKLGMLNTVSKIRGQVKTTGYPQTEGLLGDCMLKYGKELGEDSTFGNALIEVGESMKLMAEVKDSLDINVKQTFIDPLQLLQDKDLKEIGHHLKKLEGRRLDYDYKKKRVGKIPDEEVRQAVEKFEESKELAERSMFNFLENDVEQVSQLAVFIEAALDYHRQSTEILQELQSKLQMR

SEQ ID NO: 812829 - protein, 106 aa, Homo sapiens [sequence omitted]

SEQ ID NO: 812830 - protein, 101 aa, Homo sapiens
GQPRVRGFSRLFKDTEIHSSHLGAPTQLCPAIPGSNIPMDQPCCRGLYDFEPENQGELGFKEGDIITLTNQIDENWYEGMIHGESGFFPINYVEVIVPLPQ

SEQ ID NO: 812831 - protein, 270 aa, Homo sapiens
GLPSILPVEMAAAVAGMLRGGLLPQAGRLPTLQTVRYGSKAVTRHRRVMHFQRQKLMAVTEYIPPKPAIHPSCLPSPPSPPQEEIGLIRLLRREIAAVFQDNRMIAVCQNVALSAEDKLLMRHQLRKHKILMKVFPNQVLKPFLEDSKYQNLLPLFVGHNMLLVSEEPKVKEMVRILRTVPFLPLLGGCIDDTILSRQGFINYSKLPSLPLVQGELVGGLTCLTAQTHSLLQHQPLQLTTLLDQYIREQREKDSVMSANGKPDPDTVPDS

SEQ ID NO: 812832 - protein, 270 aa, Homo sapiens; identical to SEQ ID NO: 812831

SEQ ID NO: 812833 - protein, 270 aa, Homo sapiens; identical to SEQ ID NO: 812831

SEQ ID NO: 812834 - protein, 270 aa, Homo sapiens; identical to SEQ ID NO: 812831

SEQ ID NO: 812835 - protein, 302 aa, Homo sapiens
ASVHSSGGDGCGRGGDAARGSPAPGGLECSGMISAHCNLHLPGSSDSPASASQVAGITGRLPTLQTVRYGSKAVTRHRRVMHFQRQKLMAVTEYIPPKPAIHPSCLPSPPSPPQEEIGLIRLLRREIAAVFQDNRMIAVCQNVALSAEDKLLMRHQLRKHKILMKVFPNQVLKPFLEDSKYQNLLPLFVGHNMLLVSEEPKVKEMVRILRTVPFLPLLGGCIDDTILSRQGFINYSKLPSLPLVQGELVGGLTCLTAQTHSLLQHQPLQLTTLLDQYIREQREKDSVMSANGKPDPDTVPDS

SEQ ID NO: 812836 - protein, 222 aa, Homo sapiens
MHFQRQKLMAVTEYIPPKPAIHPSCLPSPPSPPQEEIGLIRLLRREIAAVFQDNRMIAVCQNVALSAEDKLLMRHQLRKHKILMKVFPNQVLKPFLEDSKYQNLLPLFVGHNMLLVSEEPKVKEMVRILRTVPFLPLLGGCIDDTILSRQGFINYSKLPSLPLVQGELVGGLTCLTAQTHSLLQHQPLQLTTLLDQYIREQREKDSVMSANGKPDPDTVPDS

SEQ ID NO: 812837 - protein, 222 aa, Homo sapiens; identical to SEQ ID NO: 812836

SEQ ID NO: 812838 - protein, 270 aa, Homo sapiens
GLPSILPVEMAAAVAGMLRGGLLPQAGRLPTLQTVRYGSKAVTRHRRVMHFQRQKLMAVTEYIPPKPAIHPSCLPSPPSPPQEEIGLIRLLRREIAAVFQDNRMIAVCQNVALSAEDKLLMRHQLRKHKILMKVFPNQVLKPFLEDSKYQNLLPLFVGHNILLLTQHPNLNHILPILTTLTFLPLPPSIHHILTTHPFNYSNLPTLPLLNPHLLPPLTSLTPHTHSLLHHHPLHLTTLFHHYITHHPHLISPNPNPHPHTLHSYSITPPH

SEQ ID NO: 812839 - protein, 270 aa, Homo sapiens; identical to SEQ ID NO: 812831

SEQ ID NO: 812840 - protein, 254 aa, Homo sapiens [sequence omitted]

SEQ ID NO: 812841 - protein, 271 aa, Homo sapiens
MISAHCNLHLPGSSDSPASASQVAGITGRLPTLQTVRYGSKAVTRHRRVMHFQRQKLMAVTEYIPPKPAIHPSCLPSPPSPPQEEIGLIRLLRREIAAVFQDNRMIAVCQNVALSAEDKLLMRHQLRKHKILMKVFPNQVLKPFLEDSKYQNLLPLFVGHNMLLVSEEPKVKEMVRILRTVPFLPLLGGCIDDTILSRQGFINYSKLPSLPLVQGELVGGLTCLTAQTHSLLQHQPLQLTTLLDQYIREQREKDSVMSANGKPDPDTVPDS

SEQ ID NO: 812842 - protein, 271 aa, Homo sapiens; identical to SEQ ID NO: 812841

SEQ ID NO: 812843 - protein, 76 aa, Homo sapiens
MSDFENSREFGANDNMGASSITQETSLGGKEEFVATTESTTETKEPKKAKRVRRKKEAPLHDKEMQHEGMQLDFRK

SEQ ID NO: 812844 - protein, 824 aa, Homo sapiens
RVSVLAAASSALPVAPREAGVTNWPAGCVPEVRSTGEKEVAKTLHRRSRPEWCGARDPPAMLLFVLTCLLAVFPAISTKSPIFGPEEVNSVEGNSVSITCYYPPTSVNRHTRKYWCRQGARGGCITLISSEGYVSSKYAGRANLTNFPENGTFVVNIAQLSQDDSGRYKCGLGINSRGLSFDVSLEVSQGPGLLNDTKVYTVDLGRTVTINCPFKTENAQKRKSLYKQIGLYPVLVIDSSGYVNPNYTGRIRLDIQGTGQLLFSVVINQLRLSDAGQYLCQAGDDSNSNKKNADLQVLKPEPELVYEDLRGSVTFHCALGPEVANVAKFLCRQSSGENCDVVVNTLGKRAPAFEGRILLNPQDKDGSFSVVITGLRKEDAGRYLCGAHSDGQLQEGSPIQAWQLFVNEESTIPRSPTVVKGVAGGSVAVLCPYNRKESKSIKYWCLWEGAQNGRCPLLVDSEGWVKAQYEGRLSLLEEPGNGTFTVILNQLTSRDAGFYWCLTNGDTLWRTTVEIKIIEGEPNLKVPGNVTAVLGETLKVPCHFPCKFSSYEKYWCKWNNTGCQALPSQDEGPSKAFVNCDENSRLVSLTLNLVTRADEGWYWCGVKQGHFYGETAAVYVAVEERKAAGSRDVSLAKADAAPDEKVLDSGFREIENKAIQDPRLFAEEKAVADTRDQADGSRASVDSGSSEEQGGSSRALVSTLVPLGLVLAVGAVAVGVARARHRKNVDRVSIRSYRTDISMSDFENSREFGANDNMGASSITQETSLGGKEEFVATTESTTETKEPKKAKRSSKEEAEMAYKDFLLQSSTVAAEAQDGPQEA

SEQ ID NO: 812845 - protein, 824 aa, Homo sapiens; identical to SEQ ID NO: 812844

SEQ ID NO: 812846 - protein, 824 aa, Homo sapiens; identical to SEQ ID NO: 812844

SEQ ID NO: 812847 - protein, 824 aa, Homo sapiens; identical to SEQ ID NO: 812844

SEQ ID NO: 812848 - protein, 824 aa, Homo sapiens; identical to SEQ ID NO: 812844

SEQ ID NO: 812849 - protein, 824 aa, Homo sapiens; identical to SEQ ID NO: 812844

SEQ ID NO: 812850 - protein, 824 aa, Homo sapiens; identical to SEQ ID NO: 812844

SEQ ID NO: 812851 - protein, 798 aa, Homo sapiens
VWPIGLCRESLGQPCTALHRRSRPEWCGARDPPAMLLFVLTCLLAVFPAISTKSPIFGPEEVNSVEGNSVSITCYYPPTSVNRHTRKYWCRQGARGGCITLISSEGYVSSKYAGRANLTNFPENGTFVVNIAQLSQDDSGRYKCGLGINSRGLSFDVSLEVSQGPGLLNDTKVYTVDLGRTVTINCPFKTENAQKRKSLYKQIGLYPVLVIDSSGYVNPNYTGRIRLDIQGTGQLLFSVVINQLRLSDAGQYLCQAGDDSNSNKKNADLQVLKPEPELVYEDLRGSVTFHCALGPEVANVAKFLCRQSSGENCDVVVNTLGKRAPAFEGRILLNPQDKDGSFSVVITGLRKEDAGRYLCGAHSDGQLQEGSPIQAWQLFVNEESTIPRSPTVVKGVAGGSVAVLCPYNRKESKSIKYWCLWEGAQNGRCPLLVDSEGWVKAQYEGRLSLLEEPGNGTFTVILNQLTSRDAGFYWCLTNGDTLWRTTVEIKIIEGEPNLKVPGNVTAVLGETLKVPCHFPCKFSSYEKYWCKWNNTGCQALPSQDEGPSKAFVNCDENSRLVSLTLNLVTRADEGWYWCGVKQGHFYGETAAVYVAVEERKAAGSRDVSLAKADAAPDEKVLDSGFREIENKAIQDPRLFAEEKAVADTRDQADGSRASVDSGSSEEQGGSSRALVSTLVPLGLVLAVGAVAVGVARARHRKNVDRVSIRSYRTDISMSDFENSREFGANDNMGASSITQETSLGGKEEFVATTESTTETKEPKKAKRSSKEEAEMAYKDFLLQSSTVAAEAQDGPQEA

SEQ ID NO: 812852 - protein, 824 aa, Homo sapiens; identical to SEQ ID NO: 812844

SEQ ID NO: 812853 - protein, 824 aa, Homo sapiens; identical to SEQ ID NO: 812844

SEQ ID NO: 812854 - protein, 701 aa, Homo sapiens
VWPIGLCRESLGQPCTALHRRSRPEWCGARDPPAMLLFVLTCLLAVFPAISTKSPIFGPEEVNSVEGPGLLNDTKVYTVDLGRTVTINCPFKTENAQKRKSLYKQIGLYPVLVIDSSGYVNPNYTGRIRLDIQGTGQLLFSVVINQLRLSDAGQYLCQAGDDSNSNKKNADLQVLKPEPELVYEDLRGSVTFHCALGPEVANVAKFLCRQSSGENCDVVVNTLGKRAPAFEGRILLNPQDKDGSFSVVITGLRKEDAGRYLCGAHSDGQLQEGSPIQAWQLFVNEESTIPRSPTVVKGVAGGSVAVLCPYNRKESKSIKYWCLWEGAQNGRCPLLVDSEGWVKAQYEGRLSLLEEPGNGTFTVILNQLTSRDAGFYWCLTNGDTLWRTTVEIKIIEGEPNLKVPGNVTAVLGETLKVPCHFPCKFSSYEKYWCKWNNTGCQALPSQDEGPSKAFVNCDENSRLVSLTLNLVTRADEGWYWCGVKQGHFYGETAAVYVAVEERKAAGSRDVSLAKADAAPDEKVLDSGFREIENKAIQDPRLFAEEKAVADTRDQADGSRASVDSGSSEEQGGSSRALVSTLVPLGLVLAVGAVAVGVARARHRKNVDRVSIRSYRTDISMSDFENSREFGANDNMGASSITQETSLGGKEEFVATTESTTETKEPKKAKRSSKEEAEMAYKDFLLQSSTVAAEAQDGPQEA

SEQ ID NO: 812855 - protein, 654 aa, Homo sapiens
MRRWLRISCHWLPTTVHLSGPGLLNDTKVYTVDLGRTVTINCPFKTENAQKRKSLYKQIGLYPVLVIDSSGYVNPNYTGRIRLDIQGTGQLLFSVVINQLRLSDAGQYLCQAGDDSNSNKKNADLQVLKPEPELVYEDLRGSVTFHCALGPEVANVAKFLCRQSSGENCDVVVNTLGKRAPAFEGRILLNPQDKDGSFSVVITGLRKEDAGRYLCGAHSDGQLQEGSPIQAWQLFVNEESTIPRSPTVVKGVAGGSVAVLCPYNRKESKSIKYWCLWEGAQNGRCPLLVDSEGWVKAQYEGRLSLLEEPGNGTFTVILNQLTSRDAGFYWCLTNGDTLWRTTVEIKIIEGEPNLKVPGNVTAVLGETLKVPCHFPCKFSSYEKYWCKWNNTGCQALPSQDEGPSKAFVNCDENSRLVSLTLNLVTRADEGWYWCGVKQGHFYGETAAVYVAVEERKAAGSRDVSLAKADAAPDEKVLDSGFREIENKAIQDPRLFAEEKAVADTRDQADGSRASVDSGSSEEQGGSSRALVSTLVPLGLVLAVGAVAVGVARARHRKNVDRVSIRSYRTDISMSDFENSREFGANDNMGASSITQETSLGGKEEFVATTESTTETKEPKKAKRSSKEEAEMAYKDFLLQSSTVAAEAQDGPQEA

SEQ ID NO: 812856 - protein, 455 aa, Homo sapiens
MRVNFISPSWLRPREEGFSGHARLFLRGHPPIPSLSVLPESTIPRSPTVVKGVAGGSVAVLCPYNRKESKSIKYWCLWEGAQNGRCPLLVDSEGWVKAQYEGRLSLLEEPGNGTFTVILNQLTSRDAGFYWCLTNGDTLWRTTVEIKIIEGEPNLKVPGNVTAVLGETLKVPCHFPCKFSSYEKYWCKWNNTGCQALPSQDEGPSKAFVNCDENSRLVSLTLNLVTRADEGWYWCGVKQGHFYGETAAVYVAVEERKAAGSRDVSLAKADAAPDEKVLDSGFREIENKAIQDPRLFAEEKAVADTRDQADGSRASVDSGSSEEQGGSSRALVSTLVPLGLVLAVGAVAVGVARARHRKNVDRVSIRSYRTDISMSDFENSREFGANDNMGASSITQETSLGGKEEFVATTESTTETKEPKKAKRSSKEEAEMAYKDFLLQSSTVAAEAQDGPQEA

SEQ ID NO: 812857 - protein, 237 aa, Homo sapiens
YSRGSYRLLLCVDLLFWLTFCLRRPSAPAAVYVAVEERKAAGSRDVSLAKADAAPDEKVLDSGFREIENKAIQDPRLFAEEKAVADTRDQADGSRASVDSGSSEEQGGSSRALVSTLVPLGLVLAVGAVAVGVARARHRKNVDRVSIRSYRTDISMSDFENSREFGANDNMGASSITQETSLGGKEEFVATTESTTETKEPKKAKRSSKEEAEMAYKDFLLQSSTVAAEAQDGPQEA

SEQ ID NO: 812858 - protein, 134 aa, Homo sapiens
CFANTVLSGGTNMYPGIADRMQKEIPTVLRGVLVPSSVTSKPGLIVPIGDEGGMRRSHLQLLSVERTSGTEKNRGPHGSLEGRGTRVGELIAERRDVQRPSAPLSWDVNRIFPSTPSLPPVLPLFFFPSIKRCI

SEQ ID NO: 812859 - protein, 824 aa, Homo sapiens; identical to SEQ ID NO: 812844

SEQ ID NO: 812860 - protein, 824 aa, Homo sapiens; identical to SEQ ID NO: 812844

SEQ ID NO: 812861 - protein, 791 aa, Homo sapiens
RVSVLAAASSALPVAPREAGVTNWPAGCVPEVRSTGEKEVAKTLHRRSRPEWCGARDPPAMLLFVLTCLLAVFPAISTKSPIFGPEEVNSVEGNSVSITCYYPPTSVNRHTRKYWCRQGARGGCITLISSEGYVSSKYAGRANLTNFPENGTFVVNIAQLSQDDSGRYKCGLGINSRGLSFDVSLEVSQGPGLLNDTKVYTVDLGRTVTINCPFKTENAQKRKSLYKQIGLYPVLVIDSSGYVNPNYTGRIRLDIQGTGQLLFSVVINQLRLSDAGQYLCQAGDDSNSNKKNADLQVLKPEPELVYEDLRGSVTFHCALGPEVANVAKFLCRQSSGENCDVVVNTLGKRAPAFEGRILLNPQDKDGSFSVVITGLRKEDAGRYLCGAHSDGQLQEGSPIQAWQLFVNEESTIPRSPTVVKGVAGGSVAVLCPYNRKESKSIKYWCLWEGAQNGRCPLLVDSEGWVKAQYEGRLSLLEEPGNGTFTVILNQLTSRDAGFYWCLTNGDTLWRTTVEIKIIEGEPNLKVPGNVTAVLGETLKVPCHFPCKFSSYEKYWCKWNNTGCQALPSQDEGPSKAFVNCDENSRLVSLTLNLVTRADEGWYWCGVKQGHFYGETAAVYVAVEERKAAGSRDVSLAKADAAPDEKVLDSGFREIENKAIQDPRLFAEEKAVADTRDQADGSRASVDSGSSEEQGGSSRALVSTLVPLGLVLAVGAVAVGVARARHRKNVDRVSIRSYRTDISMSDFENSREFGANDNMGASSITQETSLGGKEEFVATTESTTVTVEGDPL

SEQ ID NO: 812862 - protein, 522 aa, Homo sapiens
RVSVLAAASSALPVAPREAGVTNWPAGCVPEVRSTGEKEVAKTLHRRSRPEWCGARDPPAMLLFVLTCLLAVFPAISTKSPIFGPEEVNSVEGNSVSITCYYPPTSVNRHTRKYWCRQGARGGCITLISSEGYVSSKYAGRANLTNFPENGTFVVNIAQLSQDDSGRYKCGLGINSRGLSFDVSLEVSQGPGLLNDTKVYTVDLGRTVTINCPFKTENAQKRKSLYKQIGLYPVLVIDSSGYVNPNYTGRIRLDIQGTGQLLFSVVINQLRLSDAGQYLCQAGDDSNSNKKNADLQVLKPEPELVYEDLRGSVTFHCALGPEVANVAKFLCRQSSGENCDVVVNTLGKRAPAFEGRILLNPQDKDGSFSVVITGLRKEDAGRYLCGAHSDGQLQEGSPIQAWQLFVNEESTIPRSPTVVKGVAGGSVAVLCPYNRKESKSIKYWCLWEGAQNGRCPLLVDSEGWVKAQYEGRLSLLEEPGNGTFTVILNQLTSRDAGFYWCLTNGDTLWRTTVEIKIIEGRS

SEQ ID NO: 812863 - protein, 501 aa, Homo sapiens
RVSVLAAASSALPVAPREAGVTNWPAGCVPEVRSTGEKEVAKTLHRRSRPEWCGARDPPAMLLFVLTCLLAVFPAISTKSPIFGPEEVNSVEGNSVSITCYYPPTSVNRHTRKYWCRQGARGGCITLISSEGYVSSKYAGRANLTNFPENGTFVVNIAQLSQDDSGRYKCGLGINSRGLSFDVSLEVSQGPGLLNDTKVYTVDLGRTVTINCPFKTENAQKRKSLYKQIGLYPVLVIDSSGYVNPNYTGRIRLDIQGTGQLLFSVVINQLRLSDAGQYLCQAGDDSNSNKKNADLQVLKPEPELVYEDLRGSVTFHCALGPEVANVAKFLCRQSSGENCDVVVNTLGKRAPAFEGRILLNPQDKDGSFSVVITGLRKEDAGRYLCGAHSDGQLQEGSPIQAWQLFVNEESTIPRSPTVVKGVAGGSVAVLCPYNRKESKSIKYWCLWEGAQNGRCPLLVDSEGWVKAQYEGRLSLLEELCGRGTVRAASDGQYEKLCSRPS

SEQ ID NO: 812864 - protein, 335 aa, Homo sapiens
RVSVLAAASSALPVAPREAGVTNWPAGCVPEVRSTGEKEVAKTLHRRSRPEWCGARDPPAMLLFVLTCLLAVFPAISTKSPIFGPEEVNSVEGNSVSITCYYPPTSVNRHTRKYWCRQGARGGCITLISSEGYVSSKYAGRANLTNFPENGTFVVNIAQLSQDDSGRYKCGLGINSRGLSFDVSLEVSQGPGLLNDTKVYTVDLGRTVTINCPFKTENAQKRKSLYKQIGLYPVLVIDSSGYVNQQLPTAAQVQLTQHCPLAVPQPYPLLKNLQPSTAAQAPLTQHSSLTAPQAQASLKHLHASTAAGLTTHDTVHRQLTQDLEFRKNRPRSRPP

SEQ ID NO: 812865 - protein, 109 aa, Homo sapiens
IQQDLCQLLEIQSQIDVTETLRSTSLGRQGALHLLVIIVFQHCTGEVGLSGAALGTHQQCCSSCSPACWRSSQVCLPGPNSPSSTPSACPTPGFTSLGTLKSDSSPGMS

SEQ ID NO: 812866 - protein, 1014 aa, Homo sapiens
MAESSDKLYRVEYAKSGRASCKKCSESIPKDSLRMAIMVQSPMFDGKVPHWYHFSCFWKVGHSIRHPDVEVDGFSELRWDDQQKVKKTAEAGGVTGKGQDGIGSKAEKTLGDFAAEYAKSNRSTCKGCMEKIEKGQVRLSKKMVDPEKPQLGMIDRWYHPGCFVKNREELGFRPEYSASQLKGFSLLATEDKEALKKQLPGVKSEGKRKGDEVDGVDEVAKKKSKKEKDKDSKLEKALKAQNDLIWNIKDELKKVCSTNDLKELLIFNKQQVPSGESAILDRVADGMVFGALLPCEECSGQLVFKSDAYYCTGDVTAWTKCMVKTQTPNRKEWVTPKEFREISYLKKLKVKKQDRIFPPETSASVAATPPPSTASAPAAVNSSASADKPLSNMKILTLGKLSRNKDEVKAMIEKLGGKLTGTANKASLCISTKKEVEKMNKKMEEVKEANIRVVSEDFLQDVSASTKSLQELFLAHILSPWGAEVKAEPVEVVAPRGKSGAALSKKSKGQVKEEGINKSEKRMKLTLKGGAAVDPDSGLEHSAHVLEKGGKVFSATLGLVDIVKGTNSYYKLQLLEDDKENRYWIFRSWGRVGTVIGSNKLEQMPSKEDAIEHFMKLYEEKTGNAWHSKNFTKYPKKFYPLEIDYGQDEEAVKKLTVNPGTKSKLPKPVQDLIKMIFDVESMKKAMVEYEIDLQKMPLGKLSKRQIQAAYSILSEVQQAVSQGSSDSQILDLSNRFYTLIPHDFGMKKPPLLNNADSVQAKVEMLDNLLDIEVAYSLLRGGSDDSSKDPIDVNYEKLKTDIKVVDRDSEEAEIIRKYVKNTHATTHNAYDLEVIDIFKIEREGECQRYKPFKQLHNRRLLWHGSRTTNFAGILSQGLRIAPPEAPVTGYMFGKGIYFADMVSKSANYCHTSQGDPIGLILLGEVALGNMYELKHASHISKLPKGKHSVKGLGKTTPDPSANISLDGVDVPLGTGISSGVNDTSLLYNEYIVYDIAQVNLKYLLKLKFNFKTSLW

SEQ ID NO: 812867 - protein, 1014 aa, Homo sapiens; identical to SEQ ID NO: 812866

SEQ ID NO: 812868 - protein, 1014 aa, Homo sapiens; identical to SEQ ID NO: 812866

SEQ ID NO: 812869 - protein, 1054 aa, Homo sapiens
RFSPRRAVAFFALPSASLVSHQARAHFFSLLGSGLAAQGRMAESSDKLYRVEYAKSGRASCKKCSESIPKDSLRMAIMVQSPMFDGKVPHWYHFSCFWKVGHSIRHPDVEVDGFSELRWDDQQKVKKTAEAGGVTGKGQDGIGSKAEKTLGDFAAEYAKSNRSTCKGCMEKIEKGQVRLSKKMVDPEKPQLGMIDRWYHPGCFVKNREELGFRPEYSASQLKGFSLLATEDKEALKKQLPGVKSEGKRKGDEVDGVDEVAKKKSKKEKDKDSKLEKALKAQNDLIWNIKDELKKVCSTNDLKELLIFNKQQVPSGESAILDRVADGMVFGALLPCEECSGQLVFKSDAYYCTGDVTAWTKCMVKTQTPNRKEWVTPKEFREISYLKKLKVKKQDRIFPPETSASVAATPPPSTASAPAAVNSSASADKPLSNMKILTLGKLSRNKDEVKAMIEKLGGKLTGTANKASLCISTKKEVEKMNKKMEEVKEANIRVVSEDFLQDVSASTKSLQELFLAHILSPWGAEVKAEPVEVVAPRGKSGAALSKKSKGQVKEEGINKSEKRMKLTLKGGAAVDPDSGLEHSAHVLEKGGKVFSATLGLVDIVKGTNSYYKLQLLEDDKENRYWIFRSWGRVGTVIGSNKLEQMPSKEDAIEHFMKLYEEKTGNAWHSKNFTKYPKKFYPLEIDYGQDEEAVKKLTVNPGTKSKLPKPVQDLIKMIFDVESMKKAMVEYEIDLQKMPLGKLSKRQIQAAYSILSEVQQAVSQGSSDSQILDLSNRFYTLIPHDFGMKKPPLLNNADSVQAKVEMLDNLLDIEVAYSLLRGGSDDSSKDPIDVNYEKLKTDIKVVDRDSEEAEIIRKYVKNTHATTHNAYDLEVIDIFKIEREGECQRYKPFKQLHNRRLLWHGSRTTNFAGILSQGLRIAPPEAPVTGYMFGKGIYFADMVSKSANYCHTSQGDPIGLILLGEVALGNMYELKHASHISKLPKGKHSVKGLGKTTPDPSANISLDGVDVPLGTGISSGVNDTSLLYNEYIVYDIAQVNLKYLLKLKFNFKTSLW

SEQ ID NO: 812870 - protein, 1000 aa, Homo sapiens
MAESSDKLYRVEYAKSGRASCKKCSESIPKDSLRMAIMVQSPMFDGKVPHWYHFSCFWKVGHSIRHPDVEVDGFSELRWDDQQKVKKTAEAGGVTGKGQDGIGSKAEKTLGDFAAEYAKSNRSTCKGCMEKIEKGQVRLSKKMVDPEKPQLGMIDRWYHPGCFVKNREELGFRPEYSASQLKGFSLLATEDKEALKKQLPGVKSEGKRKGDEVDGVDEVAKKKSKKEKDKDSKLEKALKAQNDLIWNIKDELKKVCSTNDLKELLIFNKQQVPSGESAILDRVADGMVFGALLPCEECSGQLVFKSDAYYCTGDVTAWTKCMVKTQTPNRKEWVTPKEFREISYLKKLKVKKQDRIFPPETSASVAATPPPSTASAPAAVNSSASADKPLSNMKILTLGKLSRNKDEVKAMIEKLGGKLTGTANKASLCISTKKEVEKMNKKMEEVKEANIRVVSEDFLQDVSASTKSLQELFLAHILSPWGAEVKAEPVEVVAPRGKSGAALSKKSKGQVKEEGINKSEKRMKLTLKGGAAVDPDSGLEHSAHVLEKGGKVFSATLGLVDIVKGTNSYYKLQLLEDDKENRYWIFRSWGRVGTVIGSNKLEQMPSKEDAIEHFMKLYEEKTGNAWHSKNFTKYPKKFYPLEIDYGQDEEAVKKLTVNPGTKSKLPKPVQDLIKMIFDVESMKKAMVEYEIDLQKMPLGKLSKRQIQAAYSILSEVQQAVSQGSSDSQILDLSNRFYTLIPHDFGMKKPPLLNNADSVQAKVEMLDNLLDIEVAYSLLRGGSDDSSKDPIDVNYEKLKTDIKYVKNTHATTHNAYDLEVIDIFKIEREGECQRYKPFKQLHNRRLLWHGSRTTNFAGILSQGLRIAPPEAPVTGYMFGKGIYFADMVSKSANYCHTSQGDPIGLILLGEVALGNMYELKHASHISKLPKGKHSVKGLGKTTPDPSANISLDGVDVPLGTGISSGVNDTSLLYNEYIVYDIAQVNLKYLLKLKFNFKTSLW

SEQ ID NO: 812871 - protein, 1014 aa, Homo sapiens; identical to SEQ ID NO: 812866

SEQ ID NO: 812872 - protein, 886 aa, Homo sapiens [sequence omitted]

SEQ ID NO: 812873 - protein, 872 aa, Homo sapiens [sequence omitted]

SEQ ID NO: 812874 - protein, 728 aa, Homo sapiens [sequence omitted]

SEQ ID NO: 812875 - protein, 961 aa, Homo sapiens
MAESSDKLYRVEYAKSGRASCKKCSESIPKDSLRMAIMVQSPMFDGKVPHWYHFSCFWKVGHSIRHPDVEVDGFSELRWDDQQKVKKTAEAGGVTGKGQDGIGSKAEKTLGDFAAEYAKSNRSTCKGCMEKIEKGQVRLSKKMVDPEKPQLGMIDRWYHPGCFVKNREELGFRPEYSASQLKGFSLLATEDKEALKKQLPGVKSEGKRKGDEVDGVDEVAKKKSKKEKDKDSKLEKALKAQNDLIWNIKDELKKVCSTNDLKELLIFNKQQVPSGESAILDRVADGMVFGALLPCEECSGQLVFKSDAYYCTGDVTAWTKCMVKTQTPNRKEWVTPKEFREISYLKKLKVKKQDRIFPPETSASVAATPPPSTASAPAAVNSSASADKPLSNMKILTLGKLSRNKDEVKAMIEKLGGKLTGTANKASLCISTKKEVEKMNKKMEEVKEANIRVVSEDFLQDVSASTKSLQELFLAHILSPWGAEVKAEPVEVVAPRGKSGAALSKKSKGQVKEEGINKSEKRMKLTLKGGAAVDPDSGLEHSAHVLEKGGKVFSATLGLVDIVKGTNSYYKLQLLEDDKENRYWIFRSWGRVGTVIGSNKLEQMPSKEDAIEHFMKLYEEKTGNAWHSKNFTKYPKKFYPLEIDYGQDEEAVKKLTVNPGTKSKLPKPVQDLIKMIFDVESMKKAMVEYEIDLQKMPLGKLSKRQIQAAYSILSEVQQAVSQGSSDSQILDLSNRFYTLIPHDFGMKKPPLLNNADSVQAKVEMLDNLLDIEVAYSLLRGGSDDSSKDPIDVNYEKLKTDIKVVDRDSEEAEIIRKYVKNTHATTHNAYDLEVIDIFKIEREGECQRYKPFKQLHNRRLLWHGSRTTNFAGILSQGLRIAPPEAPVTGYMFGKGIYFADMVSKSANYCHTSQGDPIGLILLGEVALGNMYELKHASHISKLPKGKHSVKGSSWDRDFIWCE

SEQ ID NO: 812876 - protein, 1047 aa, Homo sapiens [sequence omitted]

SEQ ID NO: 812877 - protein, 1014 aa, Homo sapiens; identical to SEQ ID NO: 812866

SEQ ID NO: 812878 - protein, 319 aa, Homo sapiens
MPLGKLSKRQIQAAYSILSEVQQAVSQGSSDSQILDLSNRFYTLIPHDFGMKKPPLLNNADSVQAKVEMLDNLLDIEVAYSLLRGGSDDSSKDPIDVNYEKLKTDIKVVDRDSEEAEIIRKYVKNTHATTHNAYDLEVIDIFKIEREGECQRYKPFKQLHNRRLLWHGSRTTNFAGILSQGLRIAPPEAPVTGYMFGKGIYFADMVSKSANYCHTSQGDPIGLILLGEVALGNMYELKHASHISKLPKGKHSVKGLGKTTPDPSANISLDGVDVPLGTGISSGVNDTSLLYNEYIVYDIAQVNLKYLLKLKFNFKTSLW

SEQ ID NO: 812879 - protein, 954 aa, Homo sapiens
MAESSDKLYRVEYAKSGRASCKKCSESIPKDSLRMAIMVQSPMFDGKVPHWYHFSCFWKVGHSIRHPDVEVDGFSELRWDDQQKVKKTAEAGGVTGKGQDGIGSKAEKTLGDFAAEYAKSNRSTCKGCMEKIEKGQVRLSKKMVDPEKPQLGMIDRWYHPGCFVKNREELGFRPEYSASQLKGFSLLATEDKEALKKQLPGVKSEGKRKGDEVDGVDEVAKKKSKKEKDKDSKLEKALKAQNDLIWNIKDELKKVCSTNDLKELLIFNKQQVPSGESAILDRVADGMVFGALLPCEECSGQLVFKSDAYYCTGDVTAWTKCMVKTQTPNRKEWVTPKEFREISYLKKLKVKKQDRIFPPETSASVAATPPPSTASAPAAVNSSASADKPLSNMKILTLGKLSRNKDEVKAMIEKLGGKLTGTANKASLCISTKKEVEKMNKKMEEVKEANIRVVSEDFLQDVSASTKSLQELFLAHILSPWGAEVKAEPVEVVAPRGKSGAALSKKSKGQVKEEGINKSEKRMKLTLKGGAAVDPDSGLEHSAHVLEKGGKVFSATLGLVDIVKGTNSYYKLQLLEDDKENRYWIFRSWGRVGTVIGSNKLEQMPSKEDAIEHFMKLYEEKTGNAWHSKNFTKYPKKFYPLEIDYGQDEEAVKKLTVNPGTKSKLPKPVQDLIKMIFDVESMKKAMVEYEIDLQKMPLGKLSKRQIQAAYSILSEVQQAVSQGSSDSQILDLSNRFYTLIPHDFGMKKPPLLNNADSVQAKVEMLDNLLDIEVAYSLLRGGSDDSSKDPIDVNYEKLKTDIKVVDRDSEEAEIIRKYVKNTHATTHNAYDLEVIDIFKIEREGECQRYKPFKQLHNRRLLWHGSRTTNFAGILSQGLRIAPPEAPVTGYMFGKGIYFADMVSKSANYCHTSQGDPIGLILLGEVALGNMYDLKQLQYQKLQAERVKWAIPDLST

SEQ ID NO: 812880 - protein, 358 aa, Homo sapiens
MIFDVERVTNARLVNFDIDLLQDALLVMISAWLITRHKIIDSRRVAVPYVQADTPRIGRFVDRSVSWLTQNRRFSNSHVISPSQIIARRTEKPPLLNNADSVQAKVEMLDNLLDIEVAYSLLRGGSDDSSKDPIDVNYEKLKTDIKVVDRDSEEAEIIRKYVKNTHATTHNAYDLEVIDIFKIEREGECQRYKPFKQLHNRRLLWHGSRTTNFAGILSQGLRIAPPEAPVTGYMFGKGIYFADMVSKSANYCHTSQGDPIGLILLGEVALGNMYELKHASHISKLPKGKHSVKGLGKTTPDPSANISLDGVDVPLGTGISSGVNDTSLLYNEYIVYDIAQVNLKYLLKLKFNFKTSLW

SEQ ID NO: 812881 - protein, 983 aa, Homo sapiens
MAESSDKLYRVEYAKSGRASCKKCSESIPKDSLRMAIMVQSPMFDGKVPHWYHFSCFWKVGHSIRHPDVEVDGFSELRWDDQQKVKKTAEAGGVTGKGQDGIGSKAEKTLGDFAAEYAKSNRSTCKGCMEKIEKGQVRLSKKMVDPEKPQLGMIDRWYHPGCFVKNREELGFRPEYSASQLKGFSLLATEDKEALKKQLPGVKSEGKRKGDEVDGVDEVAKKKSKKEKDKDSKLEKALKAQNDLIWNIKDELKKVCSTNDLKELLIFNKQQVPSGESAILDRVADGMVFGALLPCEECSGQLVFKSDAYYCTGDVTAWTKCMVKTQTPNRKEWVTPKEFREISYLKKLKVKKQDRIFPPETSASVAATPPPSTASAPAAVNSSASADKPLSNMKILTLGKLSRNKDEVKAMIEKLGGKLTGTANKASLCISTKKEVEKMNKKMEEVKEANIRVVSEDFLQDVSASTKSLQELFLAHILSPWGAEVKAEPVEVVAPRGKSGAALSKKSKGQVKEEGINKSEKRMKLTLKGGAAVDPDSGLEHSAHVLEKGGKVFSATLGLVDIVKGTNSYYKLQLLEDDKENRYWIFRSWGRVGTVIGSNKLEQMPSKEDAIEHFMKLYEEKTGNAWHSKNFTKYPKKFYPLEIDYGQDEEAVKKLTVNPGTKSKLPKPVQDLIKMIFDVESMKKAMVEYEIDLQKMPLGKLSKRQIQAAYSILSEVQQAVSQGSSDSQILDLSNRFYTLIPHDFGMKKPPLLNNADSVQAKVEMLDNLLDIEVAYSLLRGGSDDSSKDPIDVNYEKLKTDIKVVDRDSEEAEIIRKYVKNTHATTHNAYDLEVIDIFKIEREGECQRYKPFKQLHNRRLLWHGSRTTNFAGDFAAEYAKSNRSTCKGCMEKIEKGQVRLSKKMVDPEKPQLGMIDRWYHPGCFVKNREELGFRPEYSASQLKGFSLLATEDKEALKKQLPGVKSEGKRKGDEVDGVDEVAKKK

SEQ ID NO: 812882 - protein, 125 aa, Homo sapiens [sequence omitted]

SEQ ID NO: 812883 - protein, 154 aa, Homo sapiens
QLQRLQARSPVGKNGPPQLGEGEAAPAPVVSVALRYSVDMVSKSANYCHTSQGDPIGLILLGEVALGNMYELKHASHISKLPKGKHSVKGLGKTTPDPSANISLDGVDVPLGTGISSGVNDTSLLYNEYIVYDIAQVNLKYLLKLKFNFKTSLW

SEQ ID NO: 812884 - protein, 423 aa, Homo sapiens
MAESSDKLYRVEYAKSGRASCKKCSESIPKDSLRMAIMVQSPMFDGKVPHWYHFSCFWKVGHSIRHPDVEVDGFSELRWDDQQKVKKTAEAGGVTGKGQDGIGSKAEKTLGDFAAEYAKSNRSTCKGCMEKIEKGQVRLSKKMVDPEKPQLGMIDRWYHPGCFVKNREELGFRPEYSASQLKGFSLLATEDKEALKKQLPGVKSEGKRKGDEVDGVDEVAKKKSKKEKDKDSKLEKALKAQNDLIWNIKDELKKVCSTNDLKELLIFNKQQVPSGESAILDRVADGMVFGALLPCEECSGQLVFKSDAYYCTGDVTAWTKCMVKTQTPNRKEWVTPKEFREISYLKKLKVKKQDRIFPPETSASVAATPPPSTASAPAAVNSSASADKPLSNMKILTLGKLSRNKDEVKAMILTRGILVPSSS

SEQ ID NO: 812885 - protein, 128 aa, Homo sapiens [sequence omitted]

SEQ ID NO: 812886 - protein, 80 aa, Homo sapiens
HHFVHYDLTQVMVEKLLRDHFVHSDLPPLRPPGYDLKKCMVARRVHAHAECPYTPRITPGGSGMNSPEALLHQLTWPLSC

SEQ ID NO: 812887 - protein, 155 aa, Homo sapiens
MAESSDKLYRVEYAKSGRASCKKCSESIPKDSLRMAIMVQSPMFDGKVPHWYHFSCFWKVGHSIRHPDVEVDGFSELRWDDQQKVKKTAEAGGVTGVYILGQHGHSAPTLKLPGGPRLREQSRPPPACPLPHVQIKRMVPMLFQQHLLDSASSVA

SEQ ID NO: 812888 - protein, 186 aa, Homo sapiens
MVKLAAKCILAGDPAVGKTALAQIFRSDGAHFQKSYTLTTGMDLVVKTVPVPDTGDSVELFIFDSAGKELFSEMLDKLWESPNVLCLVYDVTNEESFNNCSKWLEKARSQAPGISLPGVLVGNKTDLAGRRAVDSAEARAWALGQGLECFETSVKEMENFEAPFHCLAKQFHQLYREKVEVFRALA

SEQ ID NO: 812889 - protein, 245 aa, Homo sapiens
MTFWKPEHSPACLAFCSARWEVSLFLVFLHSGLQEVRLHTESAGWCENPSYCLSKTLEFAPFPFIFSRAWEKRQSMCEDVGACISPLRQVQCELRVIPVTRSLWFFHVETFLAFLIVELFIFDSAGKELFSEMLDKLWESPNVLCLVYDVTNEESFNNCSKWLEKARSQAPGISLPGVLVGNKTDLAGRRAVDSAEARAWALGQGLECFETSVKEMENFEAPFHCLAKQFHQLYREKVEVFRALA

SEQ ID NO: 812890 - protein, 41 aa, Homo sapiens
MVKLAAKCILAVPVDKRLSRAEVCSGCCEVCRSVSWTCALP

SEQ ID NO: 812891 - protein, 186 aa, Homo sapiens; identical to SEQ ID NO: 812888

SEQ ID NO: 812892 - protein, 112 aa, Homo sapiens
MISDQTKGFLSLVTLSKYLENSSIFIYFRSTPWCLLRLTCIEFLPFYVAISQDCIVECFRIHFEIPVRALCRPQSFSIPFLTLLSTEAVFYPDTGLPRTLCSAQLAGPGRMY

SEQ ID NO: 812893 - protein, 127 aa, Homo sapiens
RSFGDVREARSQLGADSQTRPAPRRRSGLAQAQAGKMAAAGAGRLRRVASALLLRSPRLPARELSAPARLYHKKVGTKEGTRGMPTQRRPGLEGRPRGSAQLGLGAVPSHVFALTRFPLLRSEAHCN

SEQ ID NO: 812894 - protein, 80 aa, Homo sapiens
RSVLPFPSLPAIASSSLATEWVKGKTVEEALTIKNTDIAKELCLPPVKLHCSMLAEDAIKAALADYKLKQEPKKGEAEKK

SEQ ID NO: 812895 - protein, 203 aa, Homo sapiens
RSFGDVREARSQLGADSQTRPAPRRRSGLAQAQAGKMAAAGAGRLRRVASALLLRSPRLPARELSAPARLYHKKVVDHYENPRNVGSLDKTSKNVGTGLVGAPACGDVMKLQIQVDEKGKIVDARFKTFGCGSAIASSSLATEWVKGKTVEEALTIKNTDIAKELCLPPVKLHCSMLAEDAIKAALADYKLKQEPKKGEAEKK

SEQ ID NO: 812896 - protein, 127 aa, Homo sapiens; identical to SEQ ID NO: 812893

SEQ ID NO: 812897 - protein, 127 aa, Homo sapiens; identical to SEQ ID NO: 812893

SEQ ID NO: 812898 - protein, 127 aa, Homo sapiens; identical to SEQ ID NO: 812893

SEQ ID NO: 812899 - protein, 142 aa, Homo sapiens
MVLIDMSVDLSTQVVDHYENPRNVGSLDKTSKNVGTGLVGAPACGDVMKLQIQVDEKGKIVDARFKTFGCGSAIASSSLATEWVKGKTVEEALTIKNTDIAKELCLPPVKLHCSMLAEDAIKAALADYKLKQEPKKGEAEKK

SEQ ID NO: 812900 - protein, 127 aa, Homo sapiens; identical to SEQ ID NO: 812893

SEQ ID NO: 812901 - protein, 203 aa, Homo sapiens; identical to SEQ ID NO: 812895

SEQ ID NO: 812902 - protein, 127 aa, Homo sapiens; identical to SEQ ID NO: 812893

SEQ ID NO: 812903 - protein, 190 aa, Homo sapiens
RSFGDVREARSQLGADSQTRPAPRRRSGLAQAQAGKMAAAGAGRLRRVASALLLRSPRLPARELSAPARLYHKKVVDHYENPRNVGSLDKTSKNVGTGLVGAPACGDVMKLQIQVDEKGKIVDARFKTFGCGSAIASSSLATEWVKGKTVEEALTIKNTDIAKELCLPPVKLHCSKSVLFPAEEKTQLSP

SEQ ID NO: 812904 - protein, 127 aa, Homo sapiens; identical to SEQ ID NO: 812893

SEQ ID NO: 812905 - protein, 190 aa, Homo sapiens; identical to SEQ ID NO: 812903

SEQ ID NO: 812906 - protein, 127 aa, Homo sapiens; identical to SEQ ID NO: 812893

SEQ ID NO: 812907 - protein, 218 aa, Homo sapiens
RSFGDVREARSQLGADSQTRPAPRRRSGLAQAQAGKMAAAGAGRLRRVASALLLRSPRLPARELSAPARLYHKKVVDHYENPRNVGSLDKTSKNVGTGLVGAPACGDVMKLQIQVDEKGKIVDARFKTFGCGSAIASSSLATEWVKGKTVEEALTIKNTDIAKELCLPPVKLHCSMLAEDAIKAALADYKLKQEPKKHQLFPTCCAVTLDVQKPLPLH

SEQ ID NO: 812908 - protein, 190 aa, Homo sapiens
RSFGDVREARSQLGADSQTRPAPRRRSGLAQAQAGKMAAAGAGRLRRVASALLLRSPRLPARELSAPARLYHKKVVDHYENPRNVGSLDKTSKNVGTGLVGAPACGDVMKLQIQVDEKGKIVDARFKTFGCGSAIASSSLATEWVKGKTVEEALTIKNTDIAKELCLPPVKLHCSSKSLLSIPVSWDIWQ

SEQ ID NO: 812909 - protein, 82 aa, Homo sapiens
RSFGDVREARSQLGADSQTRPAPRRRSGLAQAQAGKMAAAGAGRLRRVASALLLRSPRLPARELSAPARLYHKKVSQICEVL

SEQ ID NO: 812910 - protein, 203 aa, Homo sapiens; identical to SEQ ID NO: 812895

SEQ ID NO: 812911 - protein, 415 aa, Homo sapiens [sequence omitted]

SEQ ID NO: 812912 - protein, 410 aa, Homo sapiens
MPNPKNSKGGRKNKRANSSGDEQENGAGALAAAGAAGAAFRFCSCRCGQGHLKKDTDWYQVKRMQDEKKKKSGSEKNTGRPPGEAAEEAKKCRPPNKPQKGPSHDLPRRHSMDRQNSQEKAVGAAAYGARSPGGSPGQSPPTGYSILSPAHFSGPRSSRYLGEFLKNAIHLEPHKKAMAGGHVFRNAHFDYSPAGLAVHRGGHFDTPVQFLRRLDLSELLTHIPRHKLNTFHVRMEDDAQVGQGEDLRKFILAALSASHRNVVNCALCHRALPVFEQFPLVDGTLFLSPSRHDEIEYDVPCHLQGRLMHLYAVCVDCLEGVHKIICIKCKSRWDGSWHQLGTMYTYDILAASPCCQARLNCKHCGKPVIDVRIGMQYFSEYSNVQQCPHCGNLDYHFVKPFSSFKVLEAY

SEQ ID NO: 812913 - protein, 415 aa, Homo sapiens [sequence omitted]

SEQ ID NO: 812914 - protein, 315 aa, Homo sapiens
PFPSGSGASRLRPGPAAPARLRASGGRVPAPGSRRGRGGQDGAARAVRLDGSRGNRRLAPSVLSRSRLHAGPGTAVPLGSAFADAGHLPGRERARCPTPKTAKAAAKTSAPTAAATSRKMEPGPWQRRARRERRPGGPWRRRPVAGRRRRARRAPEARRAPEARGLAPRTLRPPRGLRPRAMPKTVRRGWRGERQLPPRRGRRGGGALGGAGGAWTMRESGSAHPAPPPRRGCPFAVPTPGGGDRSAAPARCPRGGQPAPHTLRGSRLRQRCPRAQPAARAGTAPPCVPGRREEGREERAAQVEKNDPIENLGTG

SEQ ID NO: 812915 - protein, 105 aa, Homo sapiens
MPNPKNSKGGRKNKRANSSGDEQENGAGALAAAGAAGAAAGGALAAAAGCGAAAAGAPGAGGAAGAGGAGTGAANAAAAAGAAAAGDAKNGKPKGGRKGGKSRPS

SEQ ID NO: 812916 - protein, 1000 aa, Homo sapiens
MAERKPNGGSGGASTSSSGTNLLFSSSATEFSFNVPFIPVTQASASPASLLLPGEDSTDVGEEDSFLGQTSIHTSAPQTFSYFSQVSSSSDPFGNIGQSPLTTAATSVGQSGFPKPLTALPFTTGSQDVSNAFSPSISKAQPGAPPSSLMGINSYLPSQPSSLPPSYFGNQPQGIPQPGYNPYRHTPGSSRANPYIAPPQLQQCQTPGPPAHPPPSGPPVQMYQMPPGSLPPVPSSVQSPAQQQVPARPGAPSVQVPSPFLLQNQYEPVQPHWFYCKEVEYKQLWMPFSVFDSLNLEEIYNSVQPDPESVVLGTDGGRYDVYLYDRIRKAAYWEEEPAEVRRCTWFYKGDTDSRFIPYTEEFSEKLEAEYKKAVTTNQWHRRLEFPSGETIVMHNPKVIVQFQPSSVPDEWGTTQDGQTRPRVVKRGIDDNLDEIPDGEMPQVDHLVFVVHGIGPVCDLRFRSIIECVDDFRVVSLKLLRTHFKKSLDDGKVSRVEFLPVHWHSSLGGDATGVDRNIKKITLPSIGRFRHFTNETLLDILFYNSPTYCQTIVEKVGMEINHLHALFMSRNPDFKGGVSVAGHSLGSLILFDILSNQKDLNLSKCPGPLAVANGVVKQLHFQEKQMPEEPKLTLDESYDLVVENEEVLTLQETLEALSLSEYFSTFEKEKIDMESLLMCTVDDLKEMGIPLGPRKKIANFVEHKAAKLKKAASEKKAVAATSTKGQEQSAQKTKDMASLPSESNEPKRKLPVGACVSSVCVNYESFEVGAGQVSVAYNSLDFEPEIFFALGSPIAMFLTIRGVDRIDENYSLPTCKGFFNIYHPLDPVAYRLEPMIVPDLDLKAVLIPHHKGRKRLHLELKESLSRMGSDLKQGFISSLKSAWQTLNEFARAHTSSTQLQEELEKVANQIKEEEEKQVVEAEKVVESPDFSKDEDYLGKVGMLNGGRRIDYVLQEKPIESFNEYLFALQSHLCYWESEDTALLLLKEIYRTMNISPEQPQH

SEQ ID NO: 812917 - protein, 109 aa, Homo sapiens
GQERDRFPVSGVVPGTRRRVSDGGPQPWPRENLTVAAAAPPLPHRALTYFSPPRPRSSASMCPSSQSPRPPLLRPPCSYREFFISKKQVFKEKKKKLFFCNAEIASLKN

SEQ ID NO: 812918 - protein, 1000 aa, Homo sapiens; identical to SEQ ID NO: 812916

SEQ ID NO: 812919 - protein, 1000 aa, Homo sapiens; identical to SEQ ID NO: 812916

SEQ ID NO: 812920 - protein, 788 aa, Homo sapiens
MAERKPNGGSGGASTSSSGTNLLFSSSATEFSFNVPFIPVTQASASPASLLLPGEDSTDVGEEDSFLGQTSIHTSAPQTFSYFSQVSSSSDPFGNIGQSPLTTAATSVGQSGFPKPLTALPFTTGSQDVSNAFSPSISKAQPGAPPSSLMGINSYLPSQPSSLPPSYFGNQPQGIPQPGYNPYRHTPGSSRANPYIAPPQLQQCQTPGPPAHPPPSGPPVQMYQMREMPQVDHLVFVVHGIGPVCDLRFRSIIECVDDFRVVSLKLLRTHFKKSLDDGKVSRVEFLPVHWHSSLGGDATGVDRNIKKITLPSIGRFRHFTNETLLDILFYNSPTYCQTIVEKVGMEINHLHALFMSRNPDFKGGVSVAGHSLGSLILFDILSNQKDLNLSKCPGPLAVANGVVKQLHFQEKQMPEEPKLTLDESYDLVVENEEVLTLQETLEALSLSEYFSTFEKEKIDMESLLMCTVDDLKEMGIPLGPRKKIANFVEHKAAKLKKAASEKKAVAATSTKGQEQSAQKTKDMASLPSESNEPKRKLPVGACVSSVCVNYESFEVGAGQVSVAYNSLDFEPEIFFALGSPIAMFLTIRGVDRIDENYSLPTCKGFFNIYHPLDPVAYRLEPMIVPDLDLKAVLIPHHKGRKRLHLELKESLSRMGSDLKQGFISSLKSAWQTLNEFARAHTSSTQLQEELEKVANQIKEEEEKQVVEAEKVVESPDFSKDEDYLGKVGMLNGGRRIDYVLQEKPIESFNEYLFALQSHLCYWESEDTALLLLKEIYRTMNISPEQPQH

SEQ ID NO: 812921 - protein, 970 aa, Homo sapiens
MAERKPNGGSGGASTSSSGTNLLFSSSATEFSFNVPFIPVTQASASPASLLLPGEDSTDVGEEDSFLGQTSIHTSAPQTFSYFSQVSSSSDPFGNIGQSPLTTAATSVGQSGFPKPLTALPFTTGSQDVSNAFSPSISKAQPGAPPSSLMGINSYLPSQPSSLPPSYFGNQPQGIPQPGYNPYRHTPGSSRANPYIAPPQLQQCQTPGPPAHPPPSGPPVQMYQMPPGSLPPVPSSVQSPAQQQVPARPGAPSVQVPSPFLLQNQYEPVQPHWFYCKEVEYKQLWMPFSVFDSLNLEEIYNSVQPDPESVVLGTDGGRYDVYLYDRIRKAAYWEEEPAEVRRCTWFYKGDTDSRFIPYTEEFSEKLEVIVQFQPSSVPDEWGTTQDGQTRPRVVKRGIDDNLDEIPDGEMPQVDHLVFVVHGIGPVCDLRFRSIIECVDDFRVVSLKLLRTHFKKSLDDGKVSRVEFLPVHWHSSLGGDATGVDRNIKKITLPSIGRFRHFTNETLLDILFYNSPTYCQTIVEKVGMEINHLHALFMSRNPDFKGGVSVAGHSLGSLILFDILSNQKDLNLSKCPGPLAVANGVVKQLHFQEKQMPEEPKLTLDESYDLVVENEEVLTLQETLEALSLSEYFSTFEKEKIDMESLLMCTVDDLKEMGIPLGPRKKIANFVEHKAAKLKKAASEKKAVAATSTKGQEQSAQKTKDMASLPSESNEPKRKLPVGACVSSVCVNYESFEVGAGQVSVAYNSLDFEPEIFFALGSPIAMFLTIRGVDRIDENYSLPTCKGFFNIYHPLDPVAYRLEPMIVPDLDLKAVLIPHHKGRKRLHLELKESLSRMGSDLKQGFISSLKSAWQTLNEFARAHTSSTQLQEELEKVANQIKEEEEKQVVEAEKVVESPDFSKDEDYLGKVGMLNGGRRIDYVLQEKPIESFNEYLFALQSHLCYWESEDTALLLLKEIYRTMNISPEQPQH

SEQ ID NO: 812922 - protein, 982 aa, Homo sapiens
MAERKPNGGSGGASTSSSGTNLLFSSSATEFSFNVPFIPVTQASASPASLLLPGEDSTDVGEEDSFLGQTSIHTSAPQTFSYFSQVSSSSDPFGNIGQSPLTTAATSVGQSGFPKPLTALPFTTGSQDVSNAFSPSISKAQPGAPPSSLMGINSYLPSQPSSLPPSYFGNQPQGIPQPGYNPYRHTPGSSRANPYIAPPQLQQCQTPGPPAHPPPSGPPVQMYQMPPGSLPPVPSSVQSPAQQQVPARPGAPSVQVPSPFLLQNQYEPVQPHWFYCKEVEYKQLWMPFSVFDSLNLEEIYNSVQPDPESVVLGTDGGRYDVYLYDRIRKAAYWEEEPAEVRRCTWFYKGDTDSRFIPYTEEFSEKLEAEYKKAVTTNQWHRRLEFPSGETIVMHNPKVIVQFQPSSVPDEWGTTQDGQTRPRVVKRGIDDNLDEIPDGEMPQVDHLVFVVHGIGPVCDLRFRSIIECVDDFRVVSLKLLRTHFKKSLDDGKVSRVEFLPVHWHSSLGGDATGVDRNIKKITLPSIGRFRHFTNETLLDILFYNSPTYCQTIVEKVGMEINHLHALFMSRNPDFKGGVSVAGHSLGSLILFDILSNQKDLNLSKCPGPLAVANGVVKQLHFQEKQMPEEPKLTLDESYDLVVENEEVLTLQETLEALSLSEYFSTFEKEKIDMESLLMCTVDDLKEMGIPLGPRKKIANFVEHKAAKLKKAASEKKAVAATSTKSNEPKRKLPVGACVSSVCVNYESFEVGAGQVSVAYNSLDFEPEIFFALGSPIAMFLTIRGVDRIDENYSLPTCKGFFNIYHPLDPVAYRLEPMIVPDLDLKAVLIPHHKGRKRLHLELKESLSRMGSDLKQGFISSLKSAWQTLNEFARAHTSSTQLQEELEKVANQIKEEEEKQVVEAEKVVESPDFSKDEDYLGKVGMLNGGRRIDYVLQEKPIESFNEYLFALQSHLCYWESEDTALLLLKEIYRTMNISPEQPQH

SEQ ID NO: 812923 - protein, 561 aa, Homo sapiens [sequence omitted]

SEQ ID NO: 812924 - protein, 1000 aa, Homo sapiens; identical to SEQ ID NO: 812916

SEQ ID NO: 812925 - protein, 806 aa, Homo sapiens
MAERKPNGGSGGASTSSSGTNLLFSSSATEFSFNVPFIPVTQASASPASLLLPGEDSTDVGEEDSFLGQTSIHTSAPQTFSYFSQVSSSSDPFGNIGQSPLTTAATSVGQSGFPKPLTALPFTTGSQDVSNAFSPSISKAQPGAPPSSLMGINSYLPSQPSSLPPSYFGNQPQGIPQPGYNPYRHTPGSSRANPYIAPPQLQQCQTPGPPAHPPPSGPPVQMYQMPPGSLPPVPSSVQSPAQQQVPARPGAPSVQVPSPFLLQNQYEPVQPHWFYCKEVEYKQLWMPFSVFDSLNLEEIYNSVQPDPESVVLGTDGGRYDVYLYDRIRKAAYWEEEPAEVRRCTWFYKGDTDSRFIPYTEEFSEKLEAEYKKAVTTNQWHRRLEFPSGETIVMHNPKVIVQFQPSSVPDEWGTTQDGQTRPRVVKRGIDDNLDEIPDGEMPQVDHLVFVVHGIGPVCDLRFRSIIECVDDFRVVSLKLLRTHFKKSLDDGKVSRVEFLPVHWHSSLGGDATGVDRNIKKITLPSIGRFRHFTNETLLDILFYNSPTYCQTIVEKVGMEINHLHALFMSRNPDFKGGVSVAGHSLGSLILFDILSNQKDLNLSKCPGPLAVANGVVKQLHFQEKQMPEEPKLTLDESYDLVVENEEVLTLQETLEALSLSEYFSTFEKEKIDMESLLMCTVDDLKEMGIPLGPRKKIANFVEHKAAKLKKAASEKKAVAATSTKSNEPKRKLPVGACVSSVCVNYESFEVGAGQVSVAYNSLDFEPEIFFALGSPIAMFLTIRGVDRIDENYSLPTCKGFFNIYHPN

SEQ ID NO: 812926 - protein, 861 aa, Homo sapiens
MAERKPNGGSGGASTSSSGTNLLFSSSATEFSFNVPFIPVTQASASPASLLLPGEDSTDVGEEDSFLGQTSIHTSAPQTFSYFSQVSSSSDPFGNIGQSPLTTAATSVGQSGFPKPLTALPFTTGSQDVSNAFSPSISKAQPGAPPSSLMGINSYLPSQPSSLPPSYFGNQPQGIPQPGYNPYRHTPGSSRANPYIAPPQLQQCQTPGPPAHPPPSGPPVQMYQMPPGSLPPVPSSVQSPAQQQVPARPGAPSVQVPSPFLLQNQYEPVQPHWFYCKEVEYKQLWMPFSVFDSLNLEEIYNSVQPDPESVVLGTDGGRYDVYLYDRIRKAAYWEEEPAEVRRCTWFYKGDTDSRFIPYTEEFSEKLEAEYKKAVTTNQWHRRLEFPSGETIVMHNPKVIVQFQPSSVPDEWGTTQDGQTRPRVVKRGIDDNLDEIPDGEMPQVDHLVFVVHGIGPVCDLRFRSIIECVDDFRVVSLKLLRTHFKKSLDDGKVSRVEFLPVHWHSSLGGDATGVDRNIKKITLPSIGRFRHFTNETLLDILFYNSPTYCQTIVEKVGMEINHLHALFMSRNPDFKGGVSVAGHSLGSLILFDILSNQKDLNLSKCPGPLAVANGVVKQLHFQEKQMPEEPKLTLDESYDLVVENEEVLTLQETLEALSLSEYFSTFEKEKIDMESLLMCTVDDLKEMGIPLGPRKKIANFVEHKAAKLKKAASEKKAVAATSTKGQEQSAQKTKDMASLPSESNEPKRKLPVGACVSSVCVNYESFEVGAGQVSVAYNSLDFEPEIFFALGSPIAMFLTIRGVDRIDENYSLPTCKGFFNIYHPLDPVAYRLEPMIVPDLDLKAVLIPHHKGRKRLHLAGFY

SEQ ID NO: 812927 - protein, 1000 aa, Homo sapiens; identical to SEQ ID NO: 812916

SEQ ID NO: 812928 - protein, 387 aa, Homo sapiens
MAERKPNGGSGGASTSSSGTNLLFSSSATEFSFNVPFIPVTQASASPASLLLPGEDSTDVGEEDSFLGQTSIHTSAPQTFSYFSQVSSSSDPFGNIGQSPLTTAATSVGQSGFPKPLTALPFTTGSQDVSNAFSPSISKAQPGAPPSSLMGINSYLPSQPSSLPPSYFGNQPQGIPQPGYNPYRHTPGSSRANPYIAPPQLQQCQTPGPPAHPPPSGPPVQMYQMPPGSLPPVPSSVQSPAQQQVPARPGAPSVQVPSPFLLQNQYEPVQPHWFYCKEVEYKQLWMPFSVFDSLNLEEIYNSVQPDPESVVLGTDGGRYDVYLYDRIRKAAYWEEEPAEVRRCTWFYKGDTDSRFIPYTEEFSEKLEVRVLYFFMSFFKKCRSYIHW

SEQ ID NO: 812929 - protein, 493 aa, Homo sapiens
MWPQDPSRKEVLRFAVSCRILTLMLQALFNAIIPDHHAEAFSPPRLAPSGFVDQLVEGLLGGLSHWDAEHFLFIAEHGYLYEHNFAFFPGFPLALLVGTELLRPLRGLLSLRSCLLISVASLNFLFFMLAAVALHDLGCLVLHCPHQSFYAALLFCLSPANVFLAAGYSEALFALLTFSAMGQLERGRVWTSVLLFAFATGVRSNGLVSVGFLMHSQCQGFFSSLTMLNPLRQLFKLMASLFLSVFTLGLPFALFQYYAYTQFCLPGSARPIPEPLVQLAVDKGYRIAEGNEPPWCFWDVPLIYSYIQDVYWNVGFLKYYELKQVPNFLLAAPVAILVAWATWTYVTTHPWLCLTLGLQRSKNNKTLEKPDLGFLSPQVFVYVVHAAVLLLFGGLCMHVQVLTRFLGSSTPIMYWFPAHLLQDQEPLLRSLKTVPWKPLAEDSPPGQKVPRNPIMGLLYHWKTCSPVTRYILGYFLTYWLLGLLLHCNFLPWT

SEQ ID NO: 812930 - protein, 493 aa, Homo sapiens; identical to SEQ ID NO: 812929

SEQ ID NO: 812931 - protein, 33 aa, Homo sapiens
MQKPSLLLAPQLGAIGEVSGAALGVTFVWACTV

SEQ ID NO: 812932 - protein, 493 aa, Homo sapiens; identical to SEQ ID NO: 812929

SEQ ID NO: 812933 - protein, 493 aa, Homo sapiens; identical to SEQ ID NO: 812929

SEQ ID NO: 812934 - protein, 493 aa, Homo sapiens; identical to SEQ ID NO: 812929

SEQ ID NO: 812935 - protein, 469 aa, Homo sapiens
MKALFNAIIPDHHAEAFSPPRLAPSGFVDQLVEGLLGGLSHWDAEHFLFIAEHGYLYEHNFAFFPGFPLALLVGTELLRPLRGLLSLRSCLLISVASLNFLFFMLAAVALHDLGCLVLHCPHQSFYAALLFCLSPANVFLAAGYSEALFALLTFSAMGQLERGRVWTSVLLFAFATGVRSNGLVSVGFLMHSQCQGFFSSLTMLNPLRQLFKLMASLFLSVFTLGLPFALFQYYAYTQFCLPGSARPIPEPLVQLAVDKGYRIAEGNEPPWCFWDVPLIYSYIQDVYWNVGFLKYYELKQVPNFLLAAPVAILVAWATWTYVTTHPWLCLTLGLQRSKNNKTLEKPDLGFLSPQVFVYVVHAAVLLLFGGLCMHVQVLTRFLGSSTPIMYWFPAHLLQDQEPLLRSLKTVPWKPLAEDSPPGQKVPRNPIMGLLYHWKTCSPVTRYILGYFLTYWLLGLLLHCNFLPWT

SEQ ID NO: 812936 - protein, 434 aa, Homo sapiens [sequence omitted]

SEQ ID NO: 812937 - protein, 105 aa, Homo sapiens [sequence omitted]

SEQ ID NO: 812938 - protein, 487 aa, Homo sapiens
MLEHLVLLLPPTTSKTQTLDYLSPIPFWPTFPSTSSPAQHFGPRLPSPDPTLFCSLLTSWPPRFSHLTQLHPRHQRILQQQQHSQTPREPHFLLTTLLRKCQWWVSLKGCSSWLKVPQPRSLGLSSQTPDANLMTRKEKDWVIKVQMVQLQSAKPRLDDYYYQEYYQKLEKKQADEELLGRRNRVESLKLVTPYIPKAEAYESVVRIEGSLGQVAVSTCFSPRRAIDAVPHGTQEQDIEAASSQRLRVLYRIEKMFLQLLEIEEGWKYRPPPPCFSEQQSNQVEKLFQTLKTQEQNNLEEAADGFLQVLSVRKGKALVARLLPFLPQDQAVTILLAITHHLPLLVRRDVADQALQMLFKPLGKCISHLTLHELLQGLQGLTLLPPGSSERPVTVVLQNQFGISLLYALLSHGEQLVSLHSSLEEPNSDHTAWTDMVVLIAWEIAQMPTASLAEPLAFPSNLLPLFCHHVDKQLVQQLEARMEFAWIY

SEQ ID NO: 812939 - protein, 484 aa, Homo sapiens
MLGMSLASLHFLWQTLDYLSPIPFWPTFPSTSSPAQHFGPRLPSPDPTLFCSLLTSWPPRFSHLTQLHPRHQRILQQQQHSQTPREPHFLLTTLLRKCQWWVSLKGCSSWLKVPQPRSLGLSSQTPDANLMTRKEKDWVIKVQMVQLQSAKPRLDDYYYQEYYQKLEKKQADEELLGRRNRVESLKLVTPYIPKAEAYESVVRIEGSLGQVAVSTCFSPRRAIDAVPHGTQEQDIEAASSQRLRVLYRIEKMFLQLLEIEEGWKYRPPPPCFSEQQSNQVEKLFQTLKTQEQNNLEEAADGFLQVLSVRKGKALVARLLPFLPQDQAVTILLAITHHLPLLVRRDVADQALQMLFKPLGKCISHLTLHELLQGLQGLTLLPPGSSERPVTVVLQNQFGISLLYALLSHGEQLVSLHSSLEEPNSDHTAWTDMVVLIAWEIAQMPTASLAEPLAFPSNLLPLFCHHVDKQLVQQLEARMEFAWIY

SEQ ID NO: 812940 - protein, 221 aa, Homo sapiens
MFGFHKPKMYRSIEGCCICRAKSSSSRFTDSKRYEKDFQSCFGLHETRSGDICNACVLLVKRWKKLPAGSKKNWNHVVDARAGPSLKTTLKPKKVKTLSGNRIKSNQISKLQKEFKRHNSDAHSTTSSASPAQSPCYSNQSDDGSDTEMASGSNRTPVFSFLDLTYWKRQKICCGIIYKGRFGEVLIDTHLFKPCCSNKKAAAEKPEEQGPEPLPISTQEW

SEQ ID NO: 812941 - protein, 221 aa, Homo sapiens; identical to SEQ ID NO: 812940

SEQ ID NO: 812942 - protein, 100 aa, Homo sapiens
DKAESTPSRPAVATAELQETIFLDKAVEEEGALEGDWPGVHSAPRGHYCAWNGCFWKILMLTVPPQVPPQLNLLVTVTSQMTAQIQRWLLVLTEHQFFPF

SEQ ID NO: 812943 - protein, 73 aa, Homo sapiens
GKAESTPSRPAVATAELQETIFLDKAVEEEGALEGDWPGVHSAPRGHYCAWNGCFWKAQLPEWTMTPTKDPCL

SEQ ID NO: 812944 - protein, 175 aa, Homo sapiens
MFGFHKPKMYRSIEGCCICRAKSSSSRFTDSKRYEKDFQSCFGLHETRSGDICNACVLLVKRWKKLPAGSLKPKKVKTLSGNRIKSNQISKLQKEFKRHNSDAHSTTSSASPAQSPCYSNQSDDGSDTEMASGSNRTPVFSFLDLTYWKRGDDICWGIHTAMGRPLTHSGLVDIL

SEQ ID NO: 812945 - protein, 221 aa, Homo sapiens; identical to SEQ ID NO: 812940

SEQ ID NO: 812946 - protein, 335 aa, Homo sapiens
ELRQGKAMRRNKPRQRGVREARPAGGAGPGWRGARCSGAGEGGGGERRGSPPAALALAPASGPRRNFPPDARCLIYQQIHQGAFLLAGSASLSAVTGVPEGEARFTEDYCPEEKMFGFHKPKMYRSIEGCCICRAKSSSSRFTDSKRYEKDFQSCFGLHETRSGDICNACVLLVKRWKKLPAGSKKNWNHVVDARAGPSLKTTLKPKKVKTLSGNRIKSNQISKLQKEFKRHNSDAHSTTSSASPAQSPCYSNQSDDGSDTEMASGSNRTPVFSFLDLTYWKRQKICCGIIYKGRFGEVLIDTHLFKPCCSNKKAAAEKPEEQGPEPLPISTQEW

SEQ ID NO: 812947 - protein, 221 aa, Homo sapiens; identical to SEQ ID NO: 812940

SEQ ID NO: 812948 - protein, 202 aa, Homo sapiens
MFGFHKPKMYRSIEGCCICRAKSSSSRFTDSKRYEKDFQSCFGLHETRSGDICNACVLLVKRWKKLPAGSLKPKKVKTLSGNRIKSNQISKLQKEFKRHNSDAHSTTSSASPAQSPCYSNQSDDGSDTEMASGSNRTPVFSFLDLTYWKRQKICCGIIYKGRFGEVLIDTHLFKPCCSNKKAAAEKPEEQGPEPLPISTQEW

SEQ ID NO: 812949 - protein, 221 aa, Homo sapiens; identical to SEQ ID NO: 812940

SEQ ID NO: 812950 - protein, 285 aa, Homo sapiens
ELRQGKAMRRNKPRQRGVREARPAGGAGPGWRGARCSGAGEGGGGERRGSPPAALALAPASGPRRNFPPDARCLIYQQIHQGAFLLAGSASLSAVTGVPEGEARFTEDYCPEEKMFGFHKPKMYRSIEGCCICRAKSSSSRFTDSKRYEKDFQSCFGLHETRSGDICNACVLLVKRWKKLPAGSKKNWNHVVDARAGPSLKTTLKPKKVKTLSGNRIKSNQISKLQKEFKRHNSDAHSTTSSASPAQSPCYSNQSDDGSDTEMASGSNRTPVFSFLDLTYWKSPH

SEQ ID NO: 812951 - protein, 191 aa, Homo sapiens
MAMHNKAAPPQIPDTRRELAELVKRKQELAETLANLERQIYAFEGSYLEDTQMYGNIIRGWDRYLTNQKNSNSKNDRRNRKFKEAERLFSKSSVTSAAAVSALAGVQDQLIEKREPGSGTESDTSPDFHNQENEPSQEDPEDLDGSVQGVKPQKAASSTSSGSHHSSHKKRKNKNRHRIDLKLNKKPRADY

SEQ ID NO: 812952 - protein, 181 aa, Homo sapiens
MAMHNKAAPPQIPDTRRELAELVKRKQELAETLANLERQIYAFEGSYLEDTQMYGNIIRGWDRYLTNQKNSNSKNDRRNRKFKEAERLFSKSSVTSAAAVSALAGVQDQLIEKREPGSGTESDTSPDFHNQENEPSQEDPEDLDGSVQGVKPQKAASSTSSGSHHSSHKKRKNKNRHRGSN

SEQ ID NO: 812953 - protein, 191 aa, Homo sapiens; identical to SEQ ID NO: 812951

SEQ ID NO: 812954 - protein, 201 aa, Homo sapiens
MAMHNKAAPPQIPDTRRELAELVKRKQELAETLANLERQIYAFEGSYLEDTQMYGNIIRGWDRYLTNQKNSNSKNDRRNRKFKEAERLFSKSSVTSAAAVSALAGVQDQLIEKREPGSGTESDTSPDFHNQENEPSQEDPEDLDGSVQGVKPQKAASSTSSGSHHSSHKKRKNKNRHSPSGMFDYDFEIDLKLNKKPRADY

SEQ ID NO: 812955 - protein, 181 aa, Homo sapiens
MAMHNKAAPPQIPDTRRELAELVKRKQELAETLANLERQIYAFEGSYLEDTQMYGNIIRGWDRYLTNQKNSNSKNDRRNRKFKEAERLFSKSSVTSAAAVSALAGVQDQLIEKREPGSGTESDTSPDFHNQENEPSQEDPEDLDGSVQGVKPQKAASSTSSGSHHSSHKKRKNKNRHRYVY

SEQ ID NO: 812956 - protein, 191 aa, Homo sapiens
MAMHNKAAPPQIPDTRRELAELVKRKQELAETLANLERQIYAFEGSYLEDTQMYGNIIRGWDRYLTNQKNSNSKNDRRNRKFKEAERLFSKSSVTSAAAVSALAGVQDQLIEKREPGSGTESDTSPDFHNQENEPSQEDPEDLDGSVQGVKPQKAASSTSSGSHHSSHKKRKNKNRHRTIRRHISAEASRL

SEQ ID NO: 812957 - protein, 181 aa, Homo sapiens; identical to SEQ ID NO: 812955

SEQ ID NO: 812958 - protein, 149 aa, Homo sapiens
MYGNIIRGWDRYLTNQKNSNSKNDRRNRKFKEAERLFSKSSVTSAAAVSALAGVQDQLIEKREPGSGTESDTSPDFHNQENEPSQEDPEDLDGSVQGVKPQKAASSTSSGSHHSSHKKRKNKNRHSPSGMFDYDFEIDLKLNKKPRADY

SEQ ID NO: 812959 - protein, 198 aa, Homo sapiens
MAMHNKAAPPQIPDTRRELAELVKRKQELAETLANLERQIYAFEGSYLEDTQMYGNIIRGWDRYLTNQKNSNSKNDRRNRKFKEAERLFSKSSVTSAAAVSALAGVQDQLIEKREPGSGTESDTSPDFHNQENEPSQEDPEDLDGSVQGVKPQKAASSTSSGSHHSSHKKRKNKNRHRVSGRDPTPAAPMTIAVKGIA

SEQ ID NO: 812960 - protein, 211 aa, Homo sapiens
RAEFGTSGTRQFSQEKAMFSSSAKIVKPNGEKPDEFESGISQALLELEMNSDLKAQLRELNITAAKEIEVGGGRKAIIIFVPVPQLKSFQKIQVRLVRELEKKFSGKHVVFIAQRRILPKPTRKSRTKNKQKRPRSRTLTAVHDAILEDLVFPSEIVGKRIRVKLDGSRLIKVHLDKAQQNNVEHKVETFSGVYKKLTGKDVNFEFPEFQL

SEQ ID NO: 812961 - protein, 217 aa, Homo sapiens
ELEPLCCRNSARGRSFEFSQEKAMFSSSAKIVKPNGEKPDEFESGISQALLELEMNSDLKAQLRELNITAAKEIEVGGGRKAIIIFVPVPQLKSFQKIQVRLVRELEKKFSGKHVVFIAQRRILPKPTRKSRTKNKQKRPRSRTLTAVHDAILEDLVFPSEIVGKRIRVKLDGSRLIKVHLDKAQQNNVEHKVETFSGVYKKLTGKDVNFEFPEFQL

SEQ ID NO: 812962 - protein, 194 aa, Homo sapiens [sequence omitted]

SEQ ID NO: 812963 - protein, 211 aa, Homo sapiens; identical to SEQ ID NO: 812960

SEQ ID NO: 812964 - protein, 119 aa, Homo sapiens
GLGACVAPARPGGCASLLHLTNATFLPSRLAGPFQGNSQDVVTCRVQVFLVPGTSRLRGGACQGVGKRIRVKLDGSRLIKVHLDKAQQNNVEHKVETFSGVYKKLTGKDVNFEFPEFQL

SEQ ID NO: 812965 - protein, 87 aa, Homo sapiens
AAAYYYYTTINSRPRRQFDADSLAHNFLGKTNVGKRIRVKLDGSRLIKVHLDKAQQNNVEHKVETFSGVYKKLTGKDVNFEFPEFQL

SEQ ID NO: 812966 - protein, 45 aa, Homo sapiens
MFSSSAKIVKPNGEKPDEFESGISQVRGFPWGGWGEAPRPGGEAA

SEQ ID NO: 812967 - protein, 194 aa, Homo sapiens [sequence omitted]

SEQ ID NO: 812968 - protein, 236 aa, Homo sapiens
MASAGRAGPGRGVRAGGRASGACSPGRVTLTAVPSEFSQEKAMFSSSAKIVKPNGEKPDEFESGISQALLELEMNSDLKAQLRELNITAAKEIEVGGGRKAIIIFVPVPQLKSFQKIQVRLVRELEKKFSGKHVVFIAQRRILPKPTRKSRTKNKQKRPRSRTLTAVHDAILEDLVFPSEIVGKRIRVKLDGSRLIKVHLDKAQQNNVEHKVETFSGVYKKLTGKDVNFEFPEFQL

SEQ ID NO: 812969 - protein, 194 aa, Homo sapiens [sequence omitted]

SEQ ID NO: 812970 - protein, 194 aa, Homo sapiens [sequence omitted]

SEQ ID NO: 812971 - protein, 165 aa, Homo sapiens
MARNSDLKAQLRELNITAAKEIEVGGGRKAIIIFVPVPQLKSFQKIQVRLVRELEKKFSGKHVVFIAQRRILPKPTRKSRTKNKQKRPRSRTLTAVHDAILEDLVFPSEIVGKRIRVKLDGSRLIKVHLDKAQQNNVEHKVETFSGVYKKLTGKDVNFEFPEFQL

SEQ ID NO: 812972 - protein, 194 aa, Homo sapiens [sequence omitted]

SEQ ID NO: 812973 - protein, 194 aa, Homo sapiens [sequence omitted]

SEQ ID NO: 812974 - protein, 194 aa, Homo sapiens [sequence omitted]

SEQ ID NO: 812975 - protein, 194 aa, Homo sapiens [sequence omitted]

SEQ ID NO: 812976 - protein, 194 aa, Homo sapiens [sequence omitted]

SEQ ID NO: 812977 - protein, 72 aa, Homo sapiens
KTLVPRAASWDSLASYRFSVMFRFPPSSSAVSASCLRTPDFDVLSRDLGLFLSRRSASSPRRKPCSVRAPRS

SEQ ID NO: 812978 - protein, 124 aa, Homo sapiens
AAAYYYYYTARIQASNDVRGHVVFIAQRRILPKPTRKSRTKNKQKRPRSRTLTAVHDAILEDLVFPSEIVGKRIRVKLDGSRLIKVHLDKAQQNNVEHKVETFSGVYKKLTGKDVNFEFPEFQL

SEQ ID NO: 812979 - protein, 168 aa, Homo sapiens
MFSSSAKIVKPNGEKPDEFESGISQALLELEMNSDLKAQLRELNITAAKEIEVGGGRKAIIIFVPVPQLKSFQKIQVRLVRELEKKFSGKHVVFIAQRRILPKPTRKSRTKNNVGKRIRVKLDGSRLIKVHLDKAQQNNVEHKVETFSGVYKKLTGKDVNFEFPEFQL

SEQ ID NO: 812980 - protein, 132 aa, Homo sapiens
MFSSSAKIVKPNGEKPDEFESGISQALLELEMNSDLKAQLRELNITAAKEIEVGGGRKAIIIFVPVPQLKSFQKIQVRLVRELEKKFSGKHVVFIAQRRILPKPTVDYVANRGLVANRGLVANRGLVANRGL

SEQ ID NO: 812981 - protein, 112 aa, Homo sapiens
MFSSSAKIVKPNGEKPDEFESGISQALLELEMNSDLKAQLRELNITAAKEIEVGGGRKAIIIFVPVPQLKSFQKIQVRLVRELEKKFSGKHVVFIAQVSVLLLQHVSVCEFC

SEQ ID NO: 812982 - protein, 72 aa, Homo sapiens
AAAYYYYTPQIRGRVDSVGKRIRVKLDGSRLIKVHLDKAQQNNVEHKVETFSGVYKKLTGKDVNFEFPEFQL

SEQ ID NO: 812983 - protein, 315 aa, Homo sapiens
MVQQRGARAKRDGGPPPPGPGPAEEGAREPGWCKTPSGHIKRPMNAFMVWSQHERRKIMDQWPDMHNAEISKRLGRRWQLLQDSEKIPFVREAERLRLKHMADYPDYKYRPRKKSKGAPAKARPRPPGGSGGGSRLKPGPQLPGRGGRRAAGGPLGGGAAAPEDDDEDDDEELLEVRLVETPGRELWRMVPAGRAARGQAERAQGPSGEGAAAAAAASPTPSEDEEPEEEEEEAAAAEEGEEETVASGEESLGFLSRLPPGPAGLDCSALDRDPDLQPPSGTSHFEFPDYCTPEVTEMIAGDWRPSSIADLVFTY

SEQ ID NO: 812984 - protein, 315 aa, Homo sapiens; identical to SEQ ID NO: 812983

SEQ ID NO: 812985 - protein, 315 aa, Homo sapiens; identical to SEQ ID NO: 812983

SEQ ID NO: 812986 - protein, 315 aa, Homo sapiens; identical to SEQ ID NO: 812983

SEQ ID NO: 812987 - protein, 429 aa, Homo sapiens
MVQQRGARAKRDGGPPPPGPGPAEEGAREPGWCKTPSGHIKRPMNAFMVWSQHERRKIMDQWPDMHNAEISKRLGRRWQLLQDSEKIPFVREAERLRLKHMADYPDYKYRPRKKSKGAPAKARPRPPGGSGGGSRLKPGPQLPGRGGRRAAGGPLGGGAAAPEDDDEDDDEELLEVRLVETPGRELWRMVPAGRAARGQAERAQGPSGEGAAAAAAASPTPSEDEEPEEEEEEAAAAEEGEEETVASGEESLGFLSRLPPGPAGLDCSRGAHAPKPAVYIQESGIGAPRRPRLAPHLPRSLPPPGRAHPPSDPDMPLPRRHTPRQSNPHPFPDTQAPPHVAPSCTATSSQPPPIHLPSSPTDLHPSPLLHTPLLVAGGPAPSFAPESLLPRPARLLWVRGAMRPGGNARASCAPPFPGGRGAPLLSPER

SEQ ID NO: 812988 - protein, 315 aa, Homo sapiens; identical to SEQ ID NO: 812983

SEQ ID NO: 812989 - protein, 344 aa, Homo sapiens
MVQQRGARAKRDGGPPPPGPGPAEEGAREPGWCKTPSGHIKRPMNAFMVWSQHERRKIMDQWPDMHNAEISKRLGRRWQLLQDSEKIPFVREAERLRLKHMADYPDYKYRPRKKSKGAPAKARPRPPGGSGGGSRLKPGPQLPGRGGRRAAGGPLGGGAAAPEDDDEDDDEELLEVRLVETPGRELWRMVPAGRAARGQAERAQGPSGEGAAAAAAASPTPSEDEEPEEEEEEAAAAEEGEEETVASGEESLGFLSRLPPGPAGLDCSALDRDPDLQPPSGTSHFEFPTPPLPSLPVSHRRVFTLPGGSHTLIHTHKSQEQTVPESSGPLPRVSAGLCPTRSRR

SEQ ID NO: 812990 - protein, 373 aa, Homo sapiens
MVQQRGARAKRDGGPPPPGPGPAEEGAREPGWCKTPSGHIKRPMNAFMVWSQHERRKIMDQWPDMHNAEISKRLGRRWQLLQDSEKIPFVREAERLRLKHMADYPDYKYRPRKKSKGAPAKARPRPPGGSGGGSRLKPGPQLPGRGGRRAAGGPLGGGAAAPEDDDEDDDEELLEVRLVETPGRELWRMVPAGRAARGQAERAQGPSGEGAAAAAAASPTPSEDEEPEEEEEEAAAAEEGEEETVASGEESLGFLSRLPPGPAGLDCSALDRDPDLQPPSGTSHFEFPPPGWLTHSHSHTQISGTNGPRVLRTPAQGLCRSLPHAFPSLTKPPAASFKLGAPALGLSCALFFFFFFLRKTTTTKKDNEKKNVM

SEQ ID NO: 812991 - protein, 321 aa, Homo sapiens
NWRCGRHNLQRIQCRSENSKGVYCLQYDDEKIISGLRDNSIKIWDKTSLECLKVLTGHTGSVLCLQYDERVIVTGSSDSTVRVWDVNTGEVLNTLIHHNEAVLHLRFSNGLMVTCSKDRSIAVWDMASATDITLRRVLVGHRAAVNVVDFDDKYIVSASGDRTIKVWSTSTCEFVRTLNGHKRGIACLQYRDRLVVSGSSDNTIRLWDIECGACLRVLEGHEELVRCIRFDNKRIVSGAYDGKIKVWDLQAALDPRAPASTLCLRTLVEHSGRVFRLQFDEFQIISSSHDDTILIWDFLNVPPSAQNETRSPSRTYTYISR

SEQ ID NO: 812992 - protein, 71 aa, Homo sapiens
SVCSGGRTGLILGTGRHFHPVQGFLVLNYWLRGYQMPKGVRSQLSYEAGIGSRRWVDAKQPNSSSTDISHL

SEQ ID NO: 812993 - protein, 321 aa, Homo sapiens; identical to SEQ ID NO: 812991

SEQ ID NO: 812994 - protein, 444 aa, Homo sapiens
MSSTSPNLQKAIDLASKAAQEDKAGNYEEALQLYQHAVQYFLHVVKYEAQGDKAKQSIRAKCTEYLDRAEKLKEYLKNKEKKAQKPVKEGQPSPADEKGNDSDGEGESDDPEKKKLQNQLQGAIVIERPNVKWSDVAGLEGAKEALKEAVILPIKFPHLFTGKRTPWRGILLFGPPGTGKSYLAKAVATEANNSTFFSISSSDLVSKWLGESEKLVKNLFQLARENKPSIIFIDEIDSLCGSRSENESEAARRIKTEFLVQMQGVGVDNDGILVLGATNIPWVLDSAIRRRFEKRIYIPLPEPHARAAMFKLHLGTTQNSLTEADFRELGRKTDGYSGADISIIVRDALMQPVRKVQSATHFKKVRGPSRADPNHLVDDLLTPCSPGDPGAIEMTWMDVPGDKLLEPVVSMSDMLRSLSNTKPTVNEHDLLKLKKFTEDFGQEG

SEQ ID NO: 812995 - protein, 119 aa, Homo sapiens
MSSTSPNLQKAIDLASKAAQEDKAGNYEEALQLYQHAVQYFLHVVKYEAQGDKAKQSIRAKCTEYLDRAEKLKEYLKNKEKKAQKPVKEGQPSPADEKGMTVMGGESDDLATDHFRCHC

SEQ ID NO: 812996 - protein, 444 aa, Homo sapiens; identical to SEQ ID NO: 812994

SEQ ID NO: 812997 - protein, 444 aa, Homo sapiens; identical to SEQ ID NO: 812994

SEQ ID NO: 812998 - protein, 183 aa, Homo sapiens [sequence omitted]

SEQ ID NO: 812999 - protein, 136 aa, Homo sapiens [sequence omitted]

SEQ ID NO: 813000 - protein, 444 aa, Homo sapiens; identical to SEQ ID NO: 812994

SEQ ID NO: 813001 - protein, 514 aa, Homo sapiens
MALSELALVRWLQESRRSRKLILFIVFLALLLDNMLLTVVVPIIPSYLYSIKHEKNATEIQTARPVHTASISDSFQSIFSYYDNSTMVTGNATRDLTLHQTATQHMVTNASAVPSDCPSEDKDLLNENVQVGLLFASKATVQLITNPFIGLLTNRIGYPIPIFAGFCIMFVSTIMFAFSSSYAFLLIARSLQGIGSSCSSVAGMGMLASVYTDDEERGNVMGIALGGLAMGVLVGPPFGSVLYEFVGKTAPFLVLAALVLLDGAIQLFVLQPSRVQPESQKGTPLTTLLKDPYILIAAGSICFANMGIAMLEPALPIWMMETMCSRKWQLGVAFLPASISYLIGTNIFGILAHKMGRWLCALLGMIIVGVSILCIPFAKNIYGLIAPNFGVGFAIGMVDSSMMPIMGYLVDLRHVSVYGSVYAIADVAFCMGYAIGPSAGGAIAKAIGFPWLMTIIGIIDILFAPLCFFLRSPPAKEEKMAILMDHNCPIKTKMYTQNNIQSYPIGEDEESESD

SEQ ID NO: 813002 - protein, 514 aa, Homo sapiens; identical to SEQ ID NO: 813001

SEQ ID NO: 813003 - protein, 514 aa, Homo sapiens; identical to SEQ ID NO: 813001

SEQ ID NO: 813004 - protein, 514 aa, Homo sapiens; identical to SEQ ID NO: 813001

SEQ ID NO: 813005 - protein, 354 aa, Homo sapiens
MSAFDMSHDFFFCLTSEWEIQPRTKRSSLQQGFLKNQIFTGIQMQTRSYSGWKLCENCGEVFSEQFCLKTHMRAQNGGNTFEGNCYGKDSISVHKEASIGQELSKFNPCGKVFTLTPGLAVHLEILNGRQPYKCKECGKGFKYFASLDNHMGIHIGEKLCEFQECERAITTSSHLKQCVAVHTGKKSEKTKNCGKSFTNFSQLSAHAKTHKGEKSFECKECGRSFRNSSSFNVHIQIHTGIKPHKCTECGKAFTRSTHLTQHVRTHTGIKPYECKECGQAFTQYTGLAIHIRNHTGEKPYQCKECGKAFNRSSTLTQHRRIHTGEKPYECVECGKTFITSSHRSKHLKTHSGER

SEQ ID NO: 813006 - protein, 357 aa, Homo sapiens
MLENYMNLASVDFFFCLTSEWEIQPRTKRSSLQQGFLKNQIFTGIQMQTRSYSGWKLCENCGEVFSEQFCLKTHMRAQNGGNTFEGNCYGKDSISVHKEASIGQELSKFNPCGKVFTLTPGLAVHLEILNGRQPYKCKECGKGFKYFASLDNHMGIHIGEKLCEFQECERAITTSSHLKQCVAVHTGKKSEKTKNCGKSFTNFSQLSAHAKTHKGEKSFECKECGRSFRNSSSFNVHIQIHTGIKPHKCTECGKAFTRSTHLTQHVRTHTGIKPYECKECGQAFTQYTGLAIHIRNHTGEKPYQCKECGKAFNRSSTLTQHRRIHTGEKPYECVECGKTFITSSHRSKHLKTHSGER

SEQ ID NO: 813007 - protein, 357 aa, Homo sapiens; identical to SEQ ID NO: 813006

SEQ ID NO: 813008 - protein, 426 aa, Homo sapiens
MSAFDMSHGFFPREPICPFEEKTKIGTMVEDHRSNSYQDSVTFDDVAVEFTPEEWALLDTTQKYLYRDVMLENYMNLASVDFFFCLTSEWEIQPRTKRSSLQQGFLKNQIFTGIQMQTRSYSGWKLCENCGEVFSEQFCLKTHMRAQNGGNTFEGNCYGKDSISVHKEASIGQELSKFNPCGKVFTLTPGLAVHLEILNGRQPYKCKECGKGFKYFASLDNHMGIHIGEKLCEFQECERAITTSSHLKQCVAVHTGKKSEKTKNCGKSFTNFSQLSAHAKTHKGEKSFECKECGRSFRNSSSFNVHIQIHTGIKPHKCTECGKAFTRSTHLTQHVRTHTGIKPYECKECGQAFTQYTGLAIHIRNHTGEKPYQCKECGKAFNRSSTLTQHRRIHTGEKPYECVECGKTFITSSHRSKHLKTHSGER

SEQ ID NO: 813009 - protein, 357 aa, Homo sapiens; identical to SEQ ID NO: 813006

SEQ ID NO: 813010 - protein, 357 aa, Homo sapiens; identical to SEQ ID NO: 813006

SEQ ID NO: 813011 - protein, 357 aa, Homo sapiens; identical to SEQ ID NO: 813006

SEQ ID NO: 813012 - protein, 357 aa, Homo sapiens; identical to SEQ ID NO: 813006

SEQ ID NO: 813013 - protein, 357 aa, Homo sapiens; identical to SEQ ID NO: 813006

SEQ ID NO: 813014 - protein, 357 aa, Homo sapiens; identical to SEQ ID NO: 813006

SEQ ID NO: 813015 - protein, 128 aa, Homo sapiens
AAAQQRSHPAMSPGTPGPTMGRSQGSPMDPMVMKRPQLYGMGSNPHSQPQQSSPYPGGSYGPPGPQRYPIGIQGRTPGAMAGMQYPQQQVCAGPPTRCFFVIVLSLPFAVHLRLMLKRIRGHCTDFLL

SEQ ID NO: 813016 - protein, 106 aa, Homo sapiens
MAWAVTLILSLSRAVRTQEVPMALQAHSGIQLASRVGLPGPWPECSTLSSRTCSLPSSSSSETPWITVFEEVGEPVAEVPTHDLALLVEVATREAGERLLIHRELQ

SEQ ID NO: 813017 - protein, 90 aa, Homo sapiens
AAAQQRSHPAMSPGTPGPTMGRSQGSPMDPMVMKRPQLYGMGSNPHSQPQQSSPYPGGSYGPPGPQRYPIGIQGRTPGAMAGMQYPQQQF

SEQ ID NO: 813018 - protein, 1799 aa, Homo sapiens
AAAQQRSHPAMSPGTPGPTMGRSQGSPMDPMVMKRPQLYGMGSNPHSQPQQSSPYPGGSYGPPGPQRYPIGIQGRTPGAMAGMQYPQQQMPPQYGQQGVSGYCQQGQQPYYSQQPQPPHLPPQAQYLPSQSQQRYQPQQDMSQEGYGTRSQPPLAPGKPNHEDLNLIQQERPSSLPDLSGSIDDLPTGTEATLSSAVSASGSTSSQGDQSNPAQSPFSPHASPHLSSIPGGPSPSPVGSPVGSNQSRSGPISPASIPGSQMPPQPPGSQSESSSHPALSQSPMPQERGFMAGTQRNPQMAQYGPQQTGPSMSPHPSPGGQMHAGISSFQQSNSSGTYGPQMSQYGPQGNYSRPPAYSGVPSASYSGPGPGMGISANNQMHGQGPSQPCGAVPLGRMPSAGMQNRPFPGNMSSMTPSSPGMSQQGGPGMGPPMPTVNRKAQEAAAAVMQAAANSAQSRQGSFPGMNQSGLMASSSPYSQPMNNSSSLMNTQAPPYSMAPAMVNSSAASVGLADMMSPGESKLPLPLKADGKEEGTPQPESKSKDSYSSQGISQPPTPGNLPVPSPMSPSSASISSFHGDESDSISSPGWPKTPSSPKSSSSTTTGEKITKVYELGNEPERKLWVDRYLTFMEERGSPVSSLPAVGKKPLDLFRLYVCVKEIGGLAQVNKNKKWRELATNLNVGTSSSAASSLKKQYIQYLFAFECKIERGEEPPPEVFSTGDTKKQPKLQPPSPANSGSLQGPQTPQSTGSNSMAEVPGDLKPPTPASTPHGQMTPMQGGRSSTISVHDPFSDVSDSSFPKRNSMTPNAPYQQGMSMPDVMGRMPYEPNKDPFGGMRKVPGSSEPFMTQGQMPNSSMQDMYNQSPSGAMSNLGMGQRQQFPYGASYDRRHEPYGQQYPGQGPPSGQPPYGGHQPGLYPQQPNYKRHMDGMYGPPAKRHEGDMYNMQYSSQQQEMYNQYGGSYSGPDRRPIQGQYPYPYSRERMQGPGQIQTHGIPPQMMGGPLQSSSSEGPQQNMWAARNDMPYPYQNRQGPGGPTQAPPYPGMNRTDDMMVPDQRINHESQWPSHVSQRQPYMSSSASMQPITRPPQPSYQTPPSLPNHISRAPSPASFQRSLENRMSPSKSPFLPSMKMQKVMPTVPTSQVTGPPPQPPPIRREITFPPGSVEASQPVLKQRRKITSKDIVTPEAWRVMMSLKSGLLAESTWALDTINILLYDDSTVATFNLSQLSGFLELLVEYFRKCLIDIFGILMEYEVGDPSQKALDHNAARKDDSQSLADDSGKEEEDAECIDDDEEDEEDEEEDSEKTESDEKSSIALTAPDAAADPKEKPKQASKFDKLPIKIVKKNNLFVVDRSDKLGRVQEFNSGLLHWQLGGGDTTEHIQTHFESKMEIPPRRRPPPPLSSAGRKKEQEGKGDSEEQQEKSIIATIDDVLSARPGALPEDANPGPQTESSKFPFGIQQAKSHRNIKLLEDEPRSRDETPLCTIAHWQDSLAKRCICVSNIVRSLSFVPGNDAEMSKHPGLVLILGKLILLHHEHPERKRAPQTYEKEEDEDKGVACSKDEWWWDCLEVLRDNTLVTLANISGQLDLSAYTESICLPILDGLLHWMVCPSAEAQDPFPTVGPNSVLSPQRLVLETLCKLSIQDNNVDLILATPPFSRQEKFYATLVRYVGDRKNPVCREMSMALLSNLAQGDALAARAIAVQKGSIGNLISFLEDGVTMAQYQQSQHNLMHMQPPPLEPPSVDMMCRAAKALLAMARVDENRSEFLLHEGRLLDISISAVLNSLVASVICDVLFQIGQL

SEQ ID NO: 813019 - protein, 1812 aa, Homo sapiens
AAAQQRSHPAMSPGTPGPTMGRSQGSPMDPMVMKRPQLYGMGSNPHSQPQQSSPYPGGSYGPPGPQRYPIGIQGRTPGAMAGMQYPQQQDSGDATWKETFWLMPPQYGQQGVSGYCQQGQQPYYSQQPQPPHLPPQAQYLPSQSQQRYQPQQDMSQEGYGTRSQPPLAPGKPNHEDLNLIQQERPSSLPDLSGSIDDLPTGTEATLSSAVSASGSTSSQGDQSNPAQSPFSPHASPHLSSIPGGPSPSPVGSPVGSNQSRSGPISPASIPGSQMPPQPPGSQSESSSHPALSQSPMPQERGFMAGTQRNPQMAQYGPQQTGPSMSPHPSPGGQMHAGISSFQQSNSSGTYGPQMSQYGPQGNYSRPPAYSGVPSASYSGPGPGMGISANNQMHGQGPSQPCGAVPLGRMPSAGMQNRPFPGNMSSMTPSSPGMSQQGGPGMGPPMPTVNRKAQEAAAAVMQAAANSAQSRQGSFPGMNQSGLMASSSPYSQPMNNSSSLMNTQAPPYSMAPAMVNSSAASVGLADMMSPGESKLPLPLKADGKEEGTPQPESKSKDSYSSQGISQPPTPGNLPVPSPMSPSSASISSFHGDESDSISSPGWPKTPSSPKSSSSTTTGEKITKVYELGNEPERKLWVDRYLTFMEERGSPVSSLPAVGKKPLDLFRLYVCVKEIGGLAQVNKNKKWRELATNLNVGTSSSAASSLKKQYIQYLFAFECKIERGEEPPPEVFSTGDTKKQPKLQPPSPGYSGSLQGPQTPQSTGSNSMAEVPGDLKPPTPASTPHGQMTPMQGGRSSTISVHDPFSDVSDSSFPKRNSMTPNAPYQQGMSMPDVMGRMPYEPNKDPFGGMRKVPGSSEPFMTQGQMPNSSMQDMYNQSPSGAMSNLGMGQRQQFPYGASYDRRHEPYGQQYPGQGPPSGQPPYGGHQPGLYPQQPNYKRHMDGMYGPPAKRHEGDMYNMQYSSQQQEMYNQYGGSYSGPDRRPIQGQYPYPYSRERMQGPGQIQTHGIPPQMMGGPLQSSSSEGPQQNMWAARNDMPYPYQNRQGPGGPTQAPPYPGMNRTDDMMVPDQRINHESQWPSHVSQRQPYMSSSASMQPITRPPQPSYQTPPSLPNHISRAPSPASFQRSLENRMSPSKSPFLPSMKMQKVMPTVPTSQVTGPPPQPPPIRREITFPPGSVEASQPVLKQRRKITSKDIVTPEAWRVMMSLKSGLLAESTWALDTINILLYDDSTVATFNLSQLSGFLELLVEYFRKCLIDIFGILMEYEVGDPSQKALDHNAARKDDSQSLADDSGKEEEDAECIDDDEEDEEDEEEDSEKTESDEKSSIALTAPDAAADPKEKPKQASKFDKLPIKIVKKNNLFVVDRSDKLGRVQEFNSGLLHWQLGGGDTTEHIQTHFESKMEIPPRRRPPPPLSSAGRKKEQEGKGDSEEQQEKSIIATIDDVLSARPGALPEDANPGPQTESSKFPFGIQQAKSHRNIKLLEDEPRSRDETPLCTIAHWQDSLAKRCICVSNIVRSLSFVPGNDAEMSKHPGLVLILGKLILLHHEHPERKRAPQTYEKEEDEDKGVACSKDEWWWDCLEVLRDNTLVTLANISGQLDLSAYTESICLPILDGLLHWMVCPSAEAQDPFPTVGPNSVLSPQRLVLETLCKLSIQDNNVDLILATPPFSRQEKFYATLVRYVGDRKNPVCREMSMALLSNLAQGDALAARAIAVQKGSIGNLISFLEDGVTMAQYQQSQHNLMHMQPPPLEPPSVDMMCRAAKALLAMARVDENRSEFLLHEGRLLDISISAVLNSLVASVICDVLFQIGQL

SEQ ID NO: 813020 - protein, 1659 aa, Homo sapiens
MSQEGYGTRSQPPLAPGKPNHEDLNLIQQERPSSLPDLSGSIDDLPTGTEATLSSAVSASGSTSSQGDQSNPAQSPFSPHASPHLSSIPGGPSPSPVGSPVGSNQSRSGPISPASIPGSQMPPQPPGSQSESSSHPALSQSPMPQERGFMAGTQRNPQMAQYGPQQTGPSMSPHPSPGGQMHAGISSFQQSNSSGTYGPQMSQYGPQGNYSRPPAYSGVPSASYSGPGPGMGISANNQMHGQGPSQPCGAVPLGRMPSAGMQNRPFPGNMSSMTPSSPGMSQQGGPGMGPPMPTVNRKAQEAAAAVMQAAANSAQSRQGSFPGMNQSGLMASSSPYSQPMNNSSSLMNTQAPPYSMAPAMVNSSAASVGLADMMSPGESKLPLPLKADGKEEGTPQPESKSKDSYSSQGISQPPTPGNLPVPSPMSPSSASISSFHGDESDSISSPGWPKTPSSPKSSSSTTTGEKITKVYELGNEPERKLWVDRYLTFMEERGSPVSSLPAVGKKPLDLFRLYVCVKEIGGLAQVNKNKKWRELATNLNVGTSSSAASSLKKQYIQYLFAFECKIERGEEPPPEVFSTGDTKKQPKLQPPSPANSGSLQGPQTPQSTGSNSMAEVPGDLKPPTPASTPHGQMTPMQGGRSSTISVHDPFSDVSDSSFPKRNSMTPNAPYQQGMSMPDVMGRMPYEPNKDPFGGMRKVPGSSEPFMTQGQMPNSSMQDMYNQSPSGAMSNLGMGQRQQFPYGASYDRRHEPYGQQYPGQGPPSGQPPYGGHQPGLYPQQPNYKRHMDGMYGPPAKRHEGDMYNMQYSSQQQEMYNQYGGSYSGPDRRPIQGQYPYPYSRERMQGPGQIQTHGIPPQMMGGPLQSSSSEGPQQNMWAARNDMPYPYQNRQGPGGPTQAPPYPGMNRTDDMMVPDQRINHESQWPSHVSQRQPYMSSSASMQPITRPPQPSYQTPPSLPNHISRAPSPASFQRSLENRMSPSKSPFLPSMKMQKVMPTVPTSQVTGPPPQPPPIRREITFPPGSVEASQPVLKQRRKITSKDIVTPEAWRVMMSLKSGLLAESTWALDTINILLYDDSTVATFNLSQLSGFLELLVEYFRKCLIDIFGILMEYEVGDPSQKALDHNAARKDDSQSLADDSGKEEEDAECIDDDEEDEEDEEEDSEKTESDEKSSIALTAPDAAADPKEKPKQASKFDKLPIKIVKKNNLFVVDRSDKLGRVQEFNSGLLHWQLGGGDTTEHIQTHFESKMEIPPRRRPPPPLSSAGRKKEQEGKGDSEEQQEKSIIATIDDVLSARPGALPEDANPGPQTESSKFPFGIQQAKSHRNIKLLEDEPRSRDETPLCTIAHWQDSLAKRCICVSNIVRSLSFVPGNDAEMSKHPGLVLILGKLILLHHEHPERKRAPQTYEKEEDEDKGVACSKDEWWWDCLEVLRDNTLVTLANISGQLDLSAYTESICLPILDGLLHWMVCPSAEAQDPFPTVGPNSVLSPQRLVLETLCKLSIQDNNVDLILATPPFSRQEKFYATLVRYVGDRKNPVCREMSMALLSNLAQGDALAARAIAVQKGSIGNLISFLEDGVTMAQYQQSQHNLMHMQPPPLEPPSVDMMCRAAKALLAMARVDENRSEFLLHEGRLLDISISAVLNSLVASVICDVLFQIGQL

SEQ ID NO: 813021 - protein, 1842 aa, Homo sapiens
AAAQQRSHPAMSPGTPGPTMGRSQGSPMDPMVMKRPQLYGMGSNPHSQPQQSSPYPGGSYGPPGPQRYPIGIQGRTPGAMAGMQYPQQQMPPQYGQQGVSGYCQQGQQPYYSQQPQPPHLPPQAQYLPSQSQQRYQPQQDMSQEGYGTRSQPPLAPGKPNHEDLNLIQQERPSSLPDLSGSIDDLPTGTEATLSSAVSASGSTSSQGDQSNPAQSPFSPHASPHLSSIPGGPSPSPVGSPVGSNQSRSGPISPASIPGSQMPPQPPGSQSESSSHPALSQSPMPQERGFMAGTQRNPQMAQYGPQQTGPSMSPHPSPGGQMHAGISSFQQSNSSGTYGPQMSQYGPQGNYSRPPAYSGVPSASYSGPGPGMGISANNQMHGQGPSQPCGAVPLGRMPSAGMQNRPFPGNMSSMTPSSPGMSQQGGPGMGPPMPTVNRKAQEAAAAVMQAAANSAQSRPPYIRSPAYPSQSGAGGRPMFSSQHPNYGNSQAPMVHQPDQYGQGSFPGMNQSGLMASSSPYSQPMNNSSSLMNTQAPPYSMAPAMVNSSAASVGLADMMSPGESKLPLPLKADGKEEGTPQPESKSKDSYSSQGISQPPTPGNLPVPSPMSPSSASISSFHGDESDSISSPGWPKTPSSPKSSSSTTTGEKITKVYELGNEPERKLWVDRYLTFMEERGSPVSSLPAVGKKPLDLFRLYVCVKEIGGLAQVNKNKKWRELATNLNVGTSSSAASSLKKQYIQYLFAFECKIERGEEPPPEVFSTGDTKKQPKLQPPSPANSGSLQGPQTPQSTGSNSMAEVPGDLKPPTPASTPHGQMTPMQGGRSSTISVHDPFSDVSDSSFPKRNSMTPNAPYQQGMSMPDVMGRMPYEPNKDPFGGMRKVPGSSEPFMTQGQMPNSSMQDMYNQSPSGAMSNLGMGQRQQFPYGASYDRRHEPYGQQYPGQGPPSGQPPYGGHQPGLYPQQPNYKRHMDGMYGPPAKRHEGDMYNMQYSSQQQEMYNQYGGSYSGPDRRPIQGQYPYPYSRERMQGPGQIQTHGIPPQMMGGPLQSSSSEGPQQNMWAARNDMPYPYQNRQGPGGPTQAPPYPGMNRTDDMMVPDQRINHESQWPSHVSQRQPYMSSSASMQPITRPPQPSYQTPPSLPNHISRAPSPASFQRSLENRMSPSKSPFLPSMKMQKVMPTVPTSQVTGPPPQPPPIRREITFPPGSVEASQPVLKQRRKITSKDIVTPEAWRVMMSLKSGLLAESTWALDTINILLYDDSTVATFNLSQLSGFLELLVEYFRKCLIDIFGILMEYEVGDPSQKALDHNAARKDDSQSLADDSGKEEEDAECIDDDEEDEEDEEEDSEKTESDEKSSIALTAPDAAADPKEKPKQASKFDKLPIKIVKKNNLFVVDRSDKLGRVQEFNSGLLHWQLGGGDTTEHIQTHFESKMEIPPRRRPPPPLSSAGRKKEQEGKGDSEEQQEKSIIATIDDVLSARPGALPEDANPGPQTESSKFPFGIQQAKSHRNIKLLEDEPRSRDETPLCTIAHWQDSLAKRCICVSNIVRSLSFVPGNDAEMSKHPGLVLILGKLILLHHEHPERKRAPQTYEKEEDEDKGVACSKDEWWWDCLEVLRDNTLVTLANISGQLDLSAYTESICLPILDGLLHWMVCPSAEAQDPFPTVGPNSVLSPQRLVLETLCKLSIQDNNVDLILATPPFSRQEKFYATLVRYVGDRKNPVCREMSMALLSNLAQGDALAARAIAVQKGSIGNLISFLEDGVTMAQYQQSQHNLMHMQPPPLEPPSVDMMCRAAKALLAMARVDENRSEFLLHEGRLLDISISAVLNSLVASVICDVLFQIGQL

SEQ ID NO: 813022 - protein, 1842 aa, Homo sapiens; identical to SEQ ID NO: 813021

SEQ ID NO: 813023 - protein, 1842 aa, Homo sapiens; identical to SEQ ID NO: 813021

SEQ ID NO: 813024 - protein, 1842 aa, Homo sapiens; identical to SEQ ID NO: 813021

SEQ ID NO: 813025 - protein, 1437 aa, Homo sapiens
PPTPQAAAGCRVFNLPPWSVSPAPMCGGDRYTGLMLVHQNKSQEAVLLFHFRPPYIRSPAYPSQSGAGGRPMFSSQHPNYGNSQAPMVHQPDQYGQGSFPGMNQSGLMASSSPYSQPMNNSSSLMNTQAPPYSMAPAMVNSSAASVGLADMMSPGESKLPLPLKADGKEEGTPQPESKSKDSYSSQGISQPPTPGNLPVPSPMSPSSASISSFHGDESDSISSPGWPKTPSSPKSSSSTTTGEKITKVYELGNEPERKLWVDRYLTFMEERGSPVSSLPAVGKKPLDLFRLYVCVKEIGGLAQVNKNKKWRELATNLNVGTSSSAASSLKKQYIQYLFAFECKIERGEEPPPEVFSTGDTKKQPKLQPPSPANSGSLQGPQTPQSTGSNSMAEVPGDLKPPTPASTPHGQMTPMQGGRSSTISVHDPFSDVSDSSFPKRNSMTPNAPYQQGMSMPDVMGRMPYEPNKDPFGGMRKVPGSSEPFMTQGQMPNSSMQDMYNQSPSGAMSNLGMGQRQQFPYGASYDRRHEPYGQQYPGQGPPSGQPPYGGHQPGLYPQQPNYKRHMDGMYGPPAKRHEGDMYNMQYSSQQQEMYNQYGGSYSGPDRRPIQGQYPYPYSRERMQGPGQIQTHGIPPQMMGGPLQSSSSEGPQQNMWAARNDMPYPYQNRQGPGGPTQAPPYPGMNRTDDMMVPDQRINHESQWPSHVSQRQPYMSSSASMQPITRPPQPSYQTPPSLPNHISRAPSPASFQRSLENRMSPSKSPFLPSMKMQKVMPTVPTSQVTGPPPQPPPIRREITFPPGSVEASQPVLKQRRKITSKDIVTPEAWRVMMSLKSGLLAESTWALDTINILLYDDSTVATFNLSQLSGFLELLVEYFRKCLIDIFGILMEYEVGDPSQKALDHNAARKDDSQSLADDSGKEEEDAECIDDDEEDEEDEEEDSEKTESDEKSSIALTAPDAAADPKEKPKQASKFDKLPIKIVKKNNLFVVDRSDKLGRVQEFNSGLLHWQLGGGDTTEHIQTHFESKMEIPPRRRPPPPLSSAGRKKEQEGKGDSEEQQEKSIIATIDDVLSARPGALPEDANPGPQTESSKFPFGIQQAKSHRNIKLLEDEPRSRDETPLCTIAHWQDSLAKRCICVSNIVRSLSFVPGNDAEMSKHPGLVLILGKLILLHHEHPERKRAPQTYEKEEDEDKGVACSKDEWWWDCLEVLRDNTLVTLANISGQLDLSAYTESICLPILDGLLHWMVCPSAEAQDPFPTVGPNSVLSPQRLVLETLCKLSIQDNNVDLILATPPFSRQEKFYATLVRYVGDRKNPVCREMSMALLSNLAQGDALAARAIAVQKGSIGNLISFLEDGVTMAQYQQSQHNLMHMQPPPLEPPSVDMMCRAAKALLAMARVDENRSEFLLHEGRLLDISISAVLNSLVASVICDVLFQIGQL

SEQ ID NO: 813026 - protein, 1047 aa, Homo sapiens
MAEVPGDLKPPTPASTPHGQMTPMQGGRSSTISVHDPFSDVSDSSFPKRNSMTPNAPYQQGMSMPDVMGRMPYEPNKDPFGGMRKVPGSSEPFMTQGQMPNSSMQDMYNQSPSGAMSNLGMGQRQQFPYGASYDRRHEPYGQQYPGQGPPSGQPPYGGHQPGLYPQQPNYKRHMDGMYGPPAKRHEGDMYNMQYSSQQQEMYNQYGGSYSGPDRRPIQGQYPYPYSRERMQGPGQIQTHGIPPQMMGGPLQSSSSEGPQQNMWAARNDMPYPYQNRQGPGGPTQAPPYPGMNRTDDMMVPDQRINHESQWPSHVSQRQPYMSSSASMQPITRPPQPSYQTPPSLPNHISRAPSPASFQRSLENRMSPSKSPFLPSMKMQKVMPTVPTSQVTGPPPQPPPIRREITFPPGSVEASQPVLKQRRKITSKDIVTPEAWRVMMSLKSGLLAESTWALDTINILLYDDSTVATFNLSQLSGFLELLVEYFRKCLIDIFGILMEYEVGDPSQKALDHNAARKDDSQSLADDSGKEEEDAECIDDDEEDEEDEEEDSEKTESDEKSSIALTAPDAAADPKEKPKQASKFDKLPIKIVKKNNLFVVDRSDKLGRVQEFNSGLLHWQLGGGDTTEHIQTHFESKMEIPPRRRPPPPLSSAGRKKEQEGKGDSEEQQEKSIIATIDDVLSARPGALPEDANPGPQTESSKFPFGIQQAKSHRNIKLLEDEPRSRDETPLCTIAHWQDSLAKRCICVSNIVRSLSFVPGNDAEMSKHPGLVLILGKLILLHHEHPERKRAPQTYEKEEDEDKGVACSKDEWWWDCLEVLRDNTLVTLANISGQLDLSAYTESICLPILDGLLHWMVCPSAEAQDPFPTVGPNSVLSPQRLVLETLCKLSIQDNNVDLILATPPFSRQEKFYATLVRYVGDRKNPVCREMSMALLSNLAQGDALAARAIAVQKGSIGNLISFLEDGVTMAQYQQSQHNLMHMQPPPLEPPSVDMMCRAAKALLAMARVDENRSEFLLHEGRLLDISISAVLNSLVASVICDVLFQIGQL

SEQ ID NO: 813027 - protein, 1842 aa, Homo sapiens; identical to SEQ ID NO: 813021

SEQ ID NO: 813028 - protein, 954 aa, Homo sapiens [sequence omitted]

SEQ ID NO: 813029 - protein, 742 aa, Homo sapiens
AAAQQRSHPAMSPGTPGPTMGRSQGSPMDPMVMKRPQLYGMGSNPHSQPQQSSPYPGGSYGPPGPQRYPIGIQGRTPGAMAGMQYPQQQMPPQYGQQGVSGYCQQGQQPYYSQQPQPPHLPPQAQYLPSQSQQRYQPQQDMSQEGYGTRSQPPLAPGKPNHEDLNLIQQERPSSLPDLSGSIDDLPTGTEATLSSAVSASGSTSSQGDQSNPAQSPFSPHASPHLSSIPGGPSPSPVGSPVGSNQSRSGPISPASIPGSQMPPQPPGSQSESSSHPALSQSPMPQERGFMAGTQRNPQMAQYGPQQTGPSMSPHPSPGGQMHAGISSFQQSNSSGTYGPQMSQYGPQGNYSRPPAYSGVPSASYSGPGPGMGISANNQMHGQGPSQPCGAVPLGRMPSAGMQNRPFPGNMSSMTPSSPGMSQQGGPGMGPPMPTVNRKAQEAAAAVMQAAANSAQSRQGSFPGMNQSGLMASSSPYSQPMNNSSSLMNTQAPPYSMAPAMVNSSAASVGLADMMSPGESKLPLPLKADGKEEGTPQPESKSKDSYSSQGISQPPTPGNLPVPSPMSPSSASISSFHGDESDSISSPGWPKTPSSPKSSSSTTTGEKITKVYELGNEPERKLWVDRYLTFMEERGSPVSSLPAVGKKPLDLFRLYVCVKEIGGLAQVNKNKKWRELATNLNVGTSSSAASSLKKQYIQYLFAFECKIERGEEPPPEVFSTGDTKKQPKLQPPSPGSPDGAEGL

SEQ ID NO: 813030 - protein, 1542 aa, Homo sapiens
AAAQQRSHPAMSPGTPGPTMGRSQGSPMDPMVMKRPQLYGMGSNPHSQPQQSSPYPGGSYGPPGPQRYPIGIQGRTPGAMAGMQYPQQQMPPQYGQQGVSGYCQQGQQPYYSQQPQPPHLPPQAQYLPSQSQQRYQPQQDMSQEGYGTRSQPPLAPGKPNHEDLNLIQQERPSSLPDLSGSIDDLPTGTEATLSSAVSASGSTSSQGDQSNPAQSPFSPHASPHLSSIPGGPSPSPVGSPVGSNQSRSGPISPASIPGSQMPPQPPGSQSESSSHPALSQSPMPQERGFMAGTQRNPQMAQYGPQQTGPSMSPHPSPGGQMHAGISSFQQSNSSGTYGPQMSQYGPQGNYSRPPAYSGVPSASYSGPGPGMGISANNQMHGQGPSQPCGAVPLGRMPSAGMQNRPFPGNMSSMTPSSPGMSQQGGPGMGPPMPTVNRKAQEAAAAVMQAAANSAQSRPPYIRSPAYPSQSGAGGRPMFSSQHPNYGNSQAPMVHQPDQYGQGSFPGMNQSGLMASSSPYSQPMNNSSSLMNTQAPPYSMAPAMVNSSAASVGLADMMSPGESKLPLPLKADGKEEGTPQPESKSKDSYSSQGISQPPTPGNLPVPSPMSPSSASISSFHGDESDSISSPGWPKTPSSPKSSSSTTTGEKITKVYELGNEPERKLWVDRYLTFMEERGSPVSSLPAVGKKPLDLFRLYVCVKEIGGLAQVNKNKKWRELATNLNVGTSSSAASSLKKQYIQYLFAFECKIERGEEPPPEVFSTGDTKKQPKLQPPSPANSGSLQGPQTPQSTGSNSMAEVPGDLKPPTPASTPHGQMTPMQGGRSSTISVHDPFSDVSDSSFPKRNSMTPNAPYQQGMSMPDVMGRMPYEPNKDPFGGMRKVPGSSEPFMTQGQMPNSSMQDMYNQSPSGAMSNLGMGQRQQFPYGASYDRRHEPYGQQYPGQGPPSGQPPYGGHQPGLYPQQPNYKRHMDGMYGPPAKRHEGDMYNMQYSSQQQEMYNQYGGSYSGPDRRPIQGQYPYPYSRERMQGPGQIQTHGIPPQMMGGPLQSSSSEGPQQNMWAARNDMPYPYQNRQGPGGPTQAPPYPGMNRTDDMMVPDQRINHESQWPSHVSQRQPYMSSSASMQPITRPPQPSYQTPPSLPNHISRAPSPASFQRSLENRMSPSKSPFLPSMKMQKVMPTVPTSQVTGPPPQPPPIRREITFPPGSVEASQPVLKQRRKITSKDIVTPEAWRVMMSLKSGLLAESTWALDTINILLYDDSTVATFNLSQLSGFLELLVEYFRKCLIDIFGILMEYEVGDPSQKALDHNAARKDDSQSLADDSGKEEEDAECIDDDEEDEEDEEEDSEKTESDEKSSIALTAPDAAADPKEKPKQASKFDKLPIKIVKKNNLFVVDRSDKLGRVQEFNSGLLHWQLGGGDTTEHIQTHFESKMEIPPRRRPPPPLSSAGRKKEQEGKGDSEEQQEKSIIATIDDVLSARPGALPEDANPGPQTESSKFPFGIQQAKSHRNIKLLEDEPRSRDETPLCTIAHWQDSLAKRCICHL

SEQ ID NO: 813031 - protein, 634 aa, Homo sapiens
AAAQQRSHPAMSPGTPGPTMGRSQGSPMDPMVMKRPQLYGMGSNPHSQPQQSSPYPGGSYGPPGPQRYPIGIQGRTPGAMAGMQYPQQQMPPQYGQQGVSGYCQQGQQPYYSQQPQPPHLPPQAQYLPSQSQQRYQPQQDMSQEGYGTRSQPPLAPGKPNHEDLNLIQQERPSSLPDLSGSIDDLPTGTEATLSSAVSASGSTSSQGDQSNPAQSPFSPHASPHLSSIPGGPSPSPVGSPVGSNQSRSGPISPASIPGSQMPPQPPGSQSESSSHPALSQSPMPQERGFMAGTQRNPQMAQYGPQQTGPSMSPHPSPGGQMHAGISSFQQSNSSGTYGPQMSQYGPQGNYSRPPAYSGVPSASYSGPGPGMGISANNQMHGQGPSQPCGAVPLGRMPSAGMQNRPFPGNMSSMTPSSPGMSQQGGPGMGPPMPTVNRKAQEAAAAVMQAAANSAQSRPPYIRSPAYPSQSGAGGRPMFSSQHPNYGNSQAPMVHQPDQYGQGSFPGMNQSGLMASSSPYSQPMNNSSSLMNTQAPPYSMAPAMVNSSAASVGLADMMSPGESKLPLPLKADGKEEGTPQPESKSKKSSSSTTTGEKITKVYELGNEPERKLWVDRYSPKKERKNTKNKNKKKRG

SEQ ID NO: 813032 - protein, 787 aa, Homo sapiens
AAAQQRSHPAMSPGTPGPTMGRSQGSPMDPMVMKRPQLYGMGSNPHSQPQQSSPYPGGSYGPPGPQRYPIGIQGRTPGAMAGMQYPQQQMPPQYGQQGVSGYCQQGQQPYYSQQPQPPHLPPQAQYLPSQSQQRYQPQQDMSQEGYGTRSQPPLAPGKPNHEDLNLIQQERPSSLPDLSGSIDDLPTGTEATLSSAVSASGSTSSQGDQSNPAQSPFSPHASPHLSSIPGGPSPSPVGSPVGSNQSRSGPISPASIPGSQMPPQPPGSQSESSSHPALSQSPMPQERGFMAGTQRNPQMAQYGPQQTGPSMSPHPSPGGQMHAGISSFQQSNSSGTYGPQMSQYGPQGNYSRPPAYSGVPSASYSGPGPGMGISANNQMHGQGPSQPCGAVPLGRMPSAGMQNRPFPGNMSSMTPSSPGMSQQGGPGMGPPMPTVNRKAQEAAAAVMQAAANSAQSRPPYIRSPAYPSQSGAGGRPMFSSQHPNYGNSQAPMVHQPDQYGQGSFPGMNQSGLMASSSPYSQPMNNSSSLMNTQAPPYSMAPAMVNSSAASVGLADMMSPGESKLPLPLKADGKEEGTPQPESKSKDSYSSQGISQPPTPGNLPVPSPMSPSSASISSFHGDESDSISSPGWPKTPSSPKSSSSTTTGEKITKVYELGNEPERKLWVDRYLTFMEERGSPVSSLPAVGKKPLDLFRLYVCVKEIGGLAQVNKNKKWRELATNLNVGTSSSAASSLKKQYIQYLFAFECKIERGEEPPPEVFSTGDTKKQPKLQPPSPGSGTLQRPWGR

SEQ ID NO: 813033 - protein, 409 aa, Homo sapiens
AAAQQRSHPAMSPGTPGPTMGRSQGSPMDPMVMKRPQLYGMGSNPHSQPQQSSPYPGGSYGPPGPQRYPIGIQGRTPGAMAGMQYPQQQMPPQYGQQGVSGYCQQGQQPYYSQQPQPPHLPPQAQYLPSQSQQRYQPQQDMSQEGYGTRSQPPLAPGKPNHEDLNLIQQERPSSLPDLSGSIDDLPTGTEATLSSAVSASGSTSSQGDQSNPAQSPFSPHASPHLSSIPGGPSPSPVGSPVGSNQSRSGPISPASIPGSQMPPQPPGSQSESSSHPALSQSPMPQERGFMAGTQRNPQMAQYGPQQTGPSMSPHPSPGGQMHAGISSFQQSNSSGTYGPQMSQYGPQGSQMPPQPPGSQSESSSHPALSQSPMPQERGFMAGTQRNPQMAQYGPQQTGPSILTHLGPSL

SEQ ID NO: 813034 - protein, 186 aa, Homo sapiens
AAAQQRSHPAMSPGTPGPTMGRSQGSPMDPMVMKRPQLYGMGSNPHSQPQQSSPYPGGSYGPPGPQRYPIGIQGRTPGAMAGMQYPQQQMPPQYGQQGVSGYCQQGQQPYYSQQPQPPHLPPQAQYLPSQSQQRYQPQQDMSQEGYGTRSQPPLAPGKPNHEDLNLIQQERPSSLPVRHYCADLEM

SEQ ID NO: 813035 - protein, 716 aa, Homo sapiens
AAAQQRSHPAMSPGTPGPTMGRSQGSPMDPMVMKRPQLYGMGSNPHSQPQQSSPYPGGSYGPPGPQRYPIGIQGRTPGAMAGMQYPQQQMPPQYGQQGVSGYCQQGQQPYYSQQPQPPHLPPQAQYLPSQSQQRYQPQQDMSQEGYGTRSQPPLAPGKPNHEDLNLIQQERPSSLPDLSGSIDDLPTGTEATLSSAVSASGSTSSQGDQSNPAQSPFSPHASPHLSSIPGGPSPSPVGSPVGSNQSRSGPISPASIPGSQMPPQPPGSQSESSSHPALSQSPMPQERGFMAGTQRNPQMAQYGPQQTGPSMSPHPSPGGQMHAGISSFQQSNSSGTYGPQMSQYGPQGNYSRPPAYSGVPSASYSGPGPGMGISANNQMHGQGPSQPCGAVPLGRMPSAGMQNRPFPGNMSSMTPSSPGMSQQGGPGMGPPMPTVNRKAQEAAAAVMQAAANSAQSRQGSFPGMNQSGLMASSSPYSQPMNNSSSLMNTQAPPYSMAPAMVNSSAASVGLADMMSPGESKLPLPLKADGKEEGTPQPESKSKKSSSSTTTGEKITKVYELGNEPERKLWVDRYLTFMEERGSPVSSLPAVGKKPLDLFRLYVCVKEIGGLAQVNKNKKWRELATNLNVGTSSSAASSLKKQYIQYLFAFECKIERGEEPPPEVFSTGDTKKQPKLQPPSPGKWRRCSHWPRKAQAPGLGGSGKVVSQSGQQGTWDF

SEQ ID NO: 813036 - protein, 186 aa, Homo sapiens; identical to SEQ ID NO: 813034

SEQ ID NO: 813037 - protein, 108 aa, Homo sapiens [sequence omitted]

SEQ ID NO: 813038 - protein, 139 aa, Homo sapiens
METDCNPMELSSMSGFEEGSELNGFEGTDMKDMRLEAEAVVNDVLFAVNNMFVSKSLRCADDVAYINVETKERNRYCLELTEAGLKVVGYAFDQVDDHLQTPYHETVYSLLDTLSPAYREAFGNALLQRLEALKRDGQS

SEQ ID NO: 813039 - protein, 139 aa, Homo sapiens; identical to SEQ ID NO: 813038

SEQ ID NO: 813040 - protein, 139 aa, Homo sapiens; identical to SEQ ID NO: 813038

SEQ ID NO: 813041 - protein, 139 aa, Homo sapiens; identical to SEQ ID NO: 813038

SEQ ID NO: 813042 - protein, 139 aa, Homo sapiens; identical to SEQ ID NO: 813038

SEQ ID NO: 813043 - protein, 174 aa, Homo sapiens
LRGGGAEEGGEGGGGTAGRLQSPPEEGRRGRRARRMETDCNPMELSSMSGFEEGSELNGFEGTDMKDMRLEAEAVVNDVLFAVNNMFVSKSLRCADDVAYINVETKERNRYCLELTEAGLKVVGYAFDQVDDHLQTPYHETVYSLLDTLSPAYREAFGNALLQRLEALKRDGQS

SEQ ID NO: 813044 - protein, 190 aa, Homo sapiens
APRGRGGRRRGGRGRHRRSAPVASGGRKKRTPGAQLGADYHNCLVTYFTDLMETDCNPMELSSMSGFEEGSELNGFEGTDMKDMRLEAEAVVNDVLFAVNNMFVSKSLRCADDVAYINVETKERNRYCLELTEAGLKVVGYAFDQVDDHLQTPYHETVYSLLDTLSPAYREAFGNALLQRLEALKRDGQS

SEQ ID NO: 813045 - protein, 67 aa, Homo sapiens
RSCRIRHELEAGLKVVGYAFDQVDDHLQTPYHETVYSLLDTLSPAYREAFGNALLQRLEALKRDGQS

SEQ ID NO: 813046 - protein, 453 aa, Homo sapiens [sequence omitted]

SEQ ID NO: 813047 - protein, 453 aa, Homo sapiens [sequence omitted]

SEQ ID NO: 813048 - protein, 453 aa, Homo sapiens [sequence omitted]

SEQ ID NO: 813049 - protein, 464 aa, Homo sapiens
GIVPSALQASAMSKISEAVKRARAAFSSGRTRPLQFRIQQLEALQRLIQEQEQELVGALAADLHKNEWNAYYEEVVYVLEEIEYMIQKLPEWAADEPVEKTPQTQQDELYIHSEPLGVVLVIGTWNYPFNLTIQPMVGAIAAGNAVVLKPSELSENMASLLATIIPQYLDKDLYPVINGGVPETTELLKERFDHILYTGSTGVGKIIMTAAAKHLTPVTLELGGKSPCYVDKNCDLDVACRRIAWGKFMNSGQTCVAPDYILCDPSIQNQIVEKLKKSLKEFYGEDAKKSRDYGRIISARHFQRVMGLIEGQKVAYGGTGDAATRYIAPTILTDVDPQSPVMQEEIFGPVLPIVCVRSLEEAIQFINQREKPLALYMFSSNDKVIKKMIAETSSGGVAANDVIVHITLHSLPFGGVGNSGMGSYHGKKSFETFSHRRSCLVRPLMNDEGLKVRYPPSPAKMTQH

SEQ ID NO: 813050 - protein, 392 aa, Homo sapiens
MSKISEAVKRARAAFSSGRTRPLQFRIQQLEALQRLIQEQEQELVGALAADLHKNEWNAYYEEVVYVLEEIEYMIQKLPEWAADEPVEKTPQTQQDELYIHSEPLGVVLVIGTWNYPFNLTIQPMVGAIAAGNAVVLKPSELSENMASLLATIIPQYLDKDLYPVINGGVPETTELLKERFDHILYTGSTGVGKIIMTAAAKHLTPVTLELGGKSPCYVDKNCDLDVACRRIAWGKFMNSGQTCVAPDYILCDPSIQNQIVEKLKKSLKEFYGEDAKKSRDYGRIISARHFQRVMGLIEGQKVAYGGTGDAATRYIAPTILTDVDPQSPVMQEEIFGPVLPIVCVRSLEEAIQFINQREKPLALYMFSSNDKVIKKMIAETSIPSLHPFLDQ

SEQ ID NO: 813051 - protein, 396 aa, Homo sapiens [sequence omitted]

SEQ ID NO: 813052 - protein, 380 aa, Homo sapiens
MIQKLPEWAADEPVEKTPQTQQDELYIHSEPLGVVLVIGTWNYPFNLTIQPMVGAIAAGNAVVLKPSELSENMASLLATIIPQYLDKDLYPVINGGVPETTELLKERFDHILYTGSTGVGKIIMTAAAKHLTPVTLELGGKSPCYVDKNCDLDVACRRIAWGKFMNSGQTCVAPDYILCDPSIQNQIVEKLKKSLKEFYGEDAKKSRDYGRIISARHFQRVMGLIEGQKVAYGGTGDAATRYIAPTILTDVDPQSPVMQEEIFGPVLPIVCVRSLEEAIQFINQREKPLALYMFSSNDKVIKKMIAETSSGGVAANDVIVHITLHSLPFGGVGNSGMGSYHGKKSFETFSHRRSCLVRPLMNDEGLKVRYPPSPAKMTQH

SEQ ID NO: 813053 - protein, 453 aa, Homo sapiens
MSKISEAVKRARAAFSSGRGGEEQKKKKKSPALQRLIQEQEQELVGALAADLHKNEWNAYYEEVVYVLEEIEYMIQKLPEWAADEPVEKTPQTQQDELYIHSEPLGVVLVIGTWNYPFNLTIQPMVGAIAAGNAVVLKPSELSENMASLLATIIPQYLDKDLYPVINGGVPETTELLKERFDHILYTGSTGVGKIIMTAAAKHLTPVTLELGGKSPCYVDKNCDLDVACRRIAWGKFMNSGQTCVAPDYILCDPSIQNQIVEKLKKSLKEFYGEDAKKSRDYGRIISARHFQRVMGLIEGQKVAYGGTGDAATRYIAPTILTDVDPQSPVMQEEIFGPVLPIVCVRSLEEAIQFINQREKPLALYMFSSNDKVIKKMIAETSSGGVAANDVIVHITLHSLPFGGVGNSGMGSYHGKKSFETFSHRRSCLVRPLMNDEGLKVRYPPSPAKMTQH

SEQ ID NO: 813054 - protein, 409 aa, Homo sapiens
WKLTPALSLQNEWNAYYEEVVYVLEEIEYMIQKLPEWAADEPVEKTPQTQQDELYIHSEPLGVVLVIGTWNYPFNLTIQPMVGAIAAGNAVVLKPSELSENMASLLATIIPQYLDKDLYPVINGGVPETTELLKERFDHILYTGSTGVGKIIMTAAAKHLTPVTLELGGKSPCYVDKNCDLDVACRRIAWGKFMNSGQTCVAPDYILCDPSIQNQIVEKLKKSLKEFYGEDAKKSRDYGRIISARHFQRVMGLIEGQKVAYGGTGDAATRYIAPTILTDVDPQSPVMQEEIFGPVLPIVCVRSLEEAIQFINQREKPLALYMFSSNDKVIKKMIAETSSGGVAANDVIVHITLHSLPFGGVGNSGMGSYHGKKSFETFSHRRSCLVRPLMNDEGLKVRYPPSPAKMTQH

SEQ ID NO: 813055 - protein, 398 aa, Homo sapiens
VERDKIKLKRAWVFNWQRERLCQRRHEQDQRGREARPRRLQLGQIHSEPLGVVLVIGTWNYPFNLTIQPMVGAIAAGNAVVLKPSELSENMASLLATIIPQYLDKDLYPVINGGVPETTELLKERFDHILYTGSTGVGKIIMTAAAKHLTPVTLELGGKSPCYVDKNCDLDVACRRIAWGKFMNSGQTCVAPDYILCDPSIQNQIVEKLKKSLKEFYGEDAKKSRDYGRIISARHFQRVMGLIEGQKVAYGGTGDAATRYIAPTILTDVDPQSPVMQEEIFGPVLPIVCVRSLEEAIQFINQREKPLALYMFSSNDKVIKKMIAETSSGGVAANDVIVHITLHSLPFGGVGNSGMGSYHGKKSFETFSHRRSCLVRPLMNDEGLKVRYPPSPAKMTQH

SEQ ID NO: 813056 - protein, 297 aa, Homo sapiens
VPRSGGSSRAMPPLWALLALGCLRFGSAVNLQPQLASVTFATNNPTLTTVALEKPLCMFDSKEALTGTHEVYLYVLVDSAISRNASVQDSTNTPLGSTFLQTEGGRTGPYKAVAFDLIPCSDLPSLDAIGDVSKASQILNAYLVRVGANGTCLWDPNFQGLCNAPLSAATEYRFKYVLVNMSTGLVEDQTLWSDPIRTNQLTPYSTIDTWPGRRSGGMIVITSILGSLPFFLLVGFAGAIALSLVDMGSSDGETTHDSQITQEAVPKSLGASESSYTSVNRGPPLDRAEVYSSKLQD

SEQ ID NO: 813057 - protein, 98 aa, Homo sapiens
GSPGLAGFRGRVRHGCEKTTEGGSKLQQEKLCVRGRGLFRCRVSSSCTLFKSLHWRNSCHYQLPSCRREGETYIYSCQSVACRLFGFLPCNKIIAPTP

SEQ ID NO: 813058 - protein, 105 aa, Homo sapiens
NNGRKESLERVISKEFVSSDPRSLDFWKDRISPHQLRGSAWLRQLSHPWLRVRSLVCKPVPSCPRPWSPGFRRPGYMAFMPLFFDEVHLSLYYNKQKDCVYVCLI

SEQ ID NO: 813059 - protein, 474 aa, Homo sapiens
MVQQTNNAENTEALLAGESSDSGAGLELGIASSPTPGSTASTGGKADDPSWCKTPSGHIKRPMNAFMVWSQIERRKIMEQSPDMHNAEISKRLGKRWKLLKDSDKIPFIREAERLRLKHMADYPDYKYRPRKKVKSGNANSSSSAAASSKPGEKGDKVGGSGGGGHGGGGGGGSSNAGGGGGGASGGGANSKPAQKKSCGSKVAGGAGGGVSKPHAKLILAGGGGGGKAAAAAAASFAAEQAGAAALLPLGAAADHHSLYKARTPSASASASSAASASAALAAPGKHLAEKKVKRVYLFGGLGTSSSPVGGVGAGADPSDPLGLYEEEGAGCSPDAPSLSGRSSAASSPAAGRSPADHRGYASLRAASPAPSSAPSHASSSASSHSSSSSSSGSSSSDDEFEDDLLDLNPSSNFESMSLGSFSSSSALDRDLDFNFEPGSGSHFEFPDYCTPEVSEMISGDWLESSISNLVFTY

SEQ ID NO: 813060 - protein, 474 aa, Homo sapiens; identical to SEQ ID NO: 813059

SEQ ID NO: 813061 - protein, 474 aa, Homo sapiens; identical to SEQ ID NO: 813059

SEQ ID NO: 813062 - protein, 474 aa, Homo sapiens; identical to SEQ ID NO: 813059

SEQ ID NO: 813063 - protein, 474 aa, Homo sapiens; identical to SEQ ID NO: 813059

SEQ ID NO: 813064 - protein, 474 aa, Homo sapiens; identical to SEQ ID NO: 813059

SEQ ID NO: 813065 - protein, 474 aa, Homo sapiens; identical to SEQ ID NO: 813059

SEQ ID NO: 813066 - protein, 474 aa, Homo sapiens; identical to SEQ ID NO: 813059

SEQ ID NO: 813067 - protein, 474 aa, Homo sapiens; identical to SEQ ID NO: 813059

SEQ ID NO: 813068 - protein, 272 aa, Homo sapiens [sequence omitted]

SEQ ID NO: 813069 - protein, 474 aa, Homo sapiens; identical to SEQ ID NO: 813059

SEQ ID NO: 813070 - protein, 393 aa, Homo sapiens
MVQQTNNAENTEALLAGESSDSGAGLELGIASSPTPGSTASTGGKADDPSWCKTPSGHIKRPMNAFMVWSQIERRKIMEQSPDMHNAEISKRLGKRWKLLKDSDKIPFIREAERLRLKHMADYPDYKYRPRKKVKSGNANSSSSAAASSKPGEKGDKVGGSGGGGHGGGGGGGSSNAGGGGGGASGGGANSKPAQKKSCGSKVAGGAGGGVSKPHAKLILAGGGGGGKAAAAAAASFAAEQAGAAALLPLGAAADHHSLYKARTPSASASASSAASASAALAAPGKHLAEKKVKRVYLFGGLGTSSSPVGGVGAGADPSDPLGLYEEEGAGCSPDAPSLSGRSSAASSPAAGRSPADHRGYASLRAASRPTPPLPPPRAPRPPTTSSKTTCST

SEQ ID NO: 813071 - protein, 156 aa, Homo sapiens
MVQQTNNAENTEALLAGESSDSGAGLELGIASSPTPGSTASTGGKADDPSWCKTPSGHIKRPMNAFMVWSQIERRKIMEQSPDMHNAEISKRLGKRWKLLKDSDKIPFIREAERLRRPPRPARPRTRPPRPRPTPPLPPPRAPRPPTTSSKTTCST

SEQ ID NO: 813072 - protein, 126 aa, Homo sapiens
MVQQTNNAENTEALLAGESSDSGAGLELGIASSPTPGSTASTGGKADDPSWCKTPSGHIKRPMNAFMVWSQIERRKIMEQSPDMHNRPPRPARPRTRPPRPRPTPPLPPPRAPRPPTTSSKTTCST

SEQ ID NO: 813073 - protein, 419 aa, Homo sapiens
MVQQTNNAENTEALLAGESSDSGAGLELGIASSPTPGSTASTGGKADDPSWCKTPSGHIKRPMNAFMVWSQIERRKIMEQSPDMHNAEISKRLGKRWKLLKDSDKIPFIREAERLRLKHMADYPDYKYRPRKKVKSGNANSSSSAAASSKPGEKGDKVGGSGGGGHGGGGGGGSSNAGGGGGGASGGGANSKPAQKKSCGSKVAGGAGGGVSKPHAKLILAGGGGGGKAAAAAAASFAAEQAGAAALLPLGAAADHHSLYKARTPSASASASSAASASAALAAPGKHLAEKKVKRVYLFGGLGTSSSPVGGVGAGADPSDPLGLYEEEGAGCSPDAPSLSGRSSAASSPAAGRSPADHRGYASLRAASPAPSSAPSHASSSASSHSSSSSSPDYCTPEVSEMISGDWLESSISNLVFTY

SEQ ID NO: 813074 - protein, 176 aa, Homo sapiens
MVQQTNNAENTEALLAGESSDSGAGLELGIASSPTPGSTASTGGKADDPSWCKTPSGHIKRPMNAFMVWSQIERRKIMEQSPDMHNAEISKRLGKRWKLLKDSDKIPFIREAERLRLKHMADYPDYKYRPRKKVKSGNANSSSSAAASSKQGEGPGGVGEEKKKVKKRNEKDRRRV

SEQ ID NO: 813075 - protein, 474 aa, Homo sapiens; identical to SEQ ID NO: 813059

SEQ ID NO: 813076 - protein, 79 aa, Homo sapiens
AAAYYYYYYSLEFKLLTMYGDMSLGSFSSSSALDRDLDFNFEPGSGSHFEFPDYCTPEVSEMISGDWLESSISNLVFTY

SEQ ID NO: 813077 - protein, 205 aa, Homo sapiens
SSPAAGRSPADHRGYASLRAASPARRAEAMVQQTNNAENTEALLAGESSDSGAGLELGIASSPTPGSTASTGGKADDPSWCKTPSGHIKRPMNAFMVWSQIERRKIMEQSPDMHNAEISKRLGKRWKLLKDSDKIPFIREAERLRLKHMADYPDYKYRPRKKVKSGNANSSSSAAASSKQGEGPGGVGEEKKKVKKRNEKDRRRV

SEQ ID NO: 813078 - protein, 214 aa, Homo sapiens
NPNLKGQKTLELPTVGRPLLRTKLNPPGLQGIGTSVEGRRPSQCDRRLGNDPRTPLEAQQRELGAGAEEDTNWKGVHGQTEMDLHVGELGGGCLASAFFFYVKSVRRDFPDPGGVEERRLFDVVQAGRRAGGGRRGEKKSEKKKRKGQTKSLKRKGKKERKSKQGWLRPRSRRRIKERGGVLDPRSHPPPSRAGDPLCPAGGTRRRKRVDRGDL

SEQ ID NO: 813079 - protein, 181 aa, Homo sapiens
AALPGSKSWLFPSSLGKLRDESKRRLILTQISAWGMSLMTAAFPERGNTKFEVGHVSTILDELSLEVPEDIQVEEVAAWTEDTELGNVNTIKELESCTALQDREKKSEKKKRKGQTKSLKRKGKKERKSKQGWLRPRSRRRIKERGGVLDPRSHPPPSRAGDPLCPAGGTRRRKRVDRGDL

SEQ ID NO: 813080 - protein, 111 aa, Homo sapiens
RGGGGSWFRLRAQRWWWRRDRPGCNRRLSGSGWSGSGGRARREVTPQGSGGSGGSGGSRRRSGGRSSSSKTDSWRRAAAAAAGPGRVSRAEAGGESSPPPPPLPPPPPPPR

SEQ ID NO: 813081 - protein, 111 aa, Homo sapiens; identical to SEQ ID NO: 813080

SEQ ID NO: 813082 - protein, 111 aa, Homo sapiens; identical to SEQ ID NO: 813080

SEQ ID NO: 813083 - protein, 167 aa, Homo sapiens; identical to SEQ ID NO: 792639

SEQ ID NO: 813084 - protein, 178 aa, Homo sapiens
RGGGGSWFRLRAQRWWWRRDRPGCNRRLSGSGWSGSGGRARREVTPQGSGGSGGSGGSRRRSGGRSSSSKTDSWRRAAAAAAGPGRVSRAEAGGESSPQETQRRPQQQQQDVTAATATAAAAAAEVTEERGASSLPPPPDFNAQSPARQRFSLEYTLHIYGDSECEGRLLPGSAQHFR

SEQ ID NO: 813085 - protein, 167 aa, Homo sapiens; identical to SEQ ID NO: 792639

SEQ ID NO: 813086 - protein, 167 aa, Homo sapiens; identical to SEQ ID NO: 792639

SEQ ID NO: 813087 - protein, 152 aa, Homo sapiens
RGGGGSWFRLRAQRWWWRRDRPGCNRRLSGSGWSGSGGRARREVTPQGSGGSGGSGGSRRRSGGRSSSSKTDSWRRAAAAAAGPGRVSRAEAGGESSPQVTEERGASSLPPPPDFNAQSPARQRFSLEYTLHIYGDSECEGRLLPGSAQHFR

SEQ ID NO: 813088 - protein, 167 aa, Homo sapiens; identical to SEQ ID NO: 792639

SEQ ID NO: 813089 - protein, 111 aa, Homo sapiens; identical to SEQ ID NO: 813080

SEQ ID NO: 813090 - protein, 111 aa, Homo sapiens; identical to SEQ ID NO: 813080

SEQ ID NO: 813091 - protein, 111 aa, Homo sapiens; identical to SEQ ID NO: 813080

SEQ ID NO: 813092 - protein, 111 aa, Homo sapiens; identical to SEQ ID NO: 813080

SEQ ID NO: 813093 - protein, 111 aa, Homo sapiens; identical to SEQ ID NO: 813080

SEQ ID NO: 813094 - protein, 111 aa, Homo sapiens; identical to SEQ ID NO: 813080

SEQ ID NO: 813095 - protein, 111 aa, Homo sapiens; identical to SEQ ID NO: 813080

SEQ ID NO: 813096 - protein, 111 aa, Homo sapiens; identical to SEQ ID NO: 813080

SEQ ID NO: 813097 - protein, 111 aa, Homo sapiens; identical to SEQ ID NO: 813080

SEQ ID NO: 813098 - protein, 111 aa, Homo sapiens; identical to SEQ ID NO: 813080

SEQ ID NO: 813099 - protein, 68 aa, Homo sapiens
EIGAASAGIIDRRTKIHVPYLEQKKEGERSIPNSCFIWRNTDLRCDYASEIPMGIAVFSRRKCKRRLT

SEQ ID NO: 813100 - protein, 111 aa, Homo sapiens; identical to SEQ ID NO: 813080

SEQ ID NO: 813101 - protein, 111 aa, Homo sapiens; identical to SEQ ID NO: 813080

SEQ ID NO: 813102 - protein, 111 aa, Homo sapiens; identical to SEQ ID NO: 813080

SEQ ID NO: 813103 - protein, 111 aa, Homo sapiens; identical to SEQ ID NO: 813080

SEQ ID NO: 813104 - protein, 111 aa, Homo sapiens; identical to SEQ ID NO: 813080

SEQ ID NO: 813105 - protein, 111 aa, Homo sapiens; identical to SEQ ID NO: 813080

SEQ ID NO: 813106 - protein, 111 aa, Homo sapiens; identical to SEQ ID NO: 813080

SEQ ID NO: 813107 - protein, 111 aa, Homo sapiens; identical to SEQ ID NO: 813080

SEQ ID NO: 813108 - protein, 54 aa, Homo sapiens
VGNFKRVQLYFNKISQVTLGDSEAETKATSFPTGNILKNTREREVPQSTAIRPR

SEQ ID NO: 813109 - protein, 413 aa, Homo sapiens
MAEAGPQAPPPPGTPSRHEKSLGLLTTKFVSLLQEAKDGVLDLKLAADTLAVRQKRRIYDITNVLEGIGLIEKKSKNSIQWKGVGPGCNTREIADKLIELKAEIEELQQREQELDQHKVWVQQSIRNVTEDVQNSCLAYVTHEDICRCFAGDTLLAIRAPSGTSLEVPIPEGLNGQKKYQIHLKSVSGPIEVLLVNKEAWSSPPVAVPVPPPEDLLQSPSAVSTPPPLPKPALAQSQEASRPNSPQLTPTAVPGSAEVQGMAGPAAEITVSGGPGTDSKDSGELSSLPLGPTTLDTRPLQSSALLDSSSSSSSSSSSSSNSNSSSSSGPNPSTSFEPIKADPTGVLELPKELSEIFDPTRECMSSELLEELMSSEVFAPLLRLSPPPGDHDYIYNLDESEGVCDLFDVPVLNL

SEQ ID NO: 813110 - protein, 364 aa, Homo sapiens
MAEAGPQAPPPPGTPSRHEKSLGLLTTKFVSLLQEAKDGVLDLKLAADTLAVRQKRRIYDITNVLEGIGLIEKKSKNSIQWKGVGPGCNTREIADKLIELKAEIEELQQREQELDQHKVWVQQSIRNVTEDVQNSCLAYVTHEDICRCFAGDTLLAIRAPSGTSLEVPIPEGLNGQKKYQIHLKSVSGPIEVLLVNKEAWSSPPVAVPVPPPEDLLQSPSAVSTPPPLPKPALAQSQEASRPNSPQLTPTAVPGSAEVQGMAGPAAEITVSGGPGTDSKDSGELSSLPLGPTTLDTRPLQSSALLDAAKVPAKKITAASKKAPAQKVPAQKATGQKAAPAPKAQKGQKAPAQKAPAPKASGKKA

SEQ ID NO: 813111 - protein, 413 aa, Homo sapiens; identical to SEQ ID NO: 813109

SEQ ID NO: 813112 - protein, 413 aa, Homo sapiens; identical to SEQ ID NO: 813109

SEQ ID NO: 813113 - protein, 450 aa, Homo sapiens
KDESNNDPPHTHNNKENQKGQVLRPGVLAEGRRRAGAMAEAGPQAPPPPGTPSRHEKSLGLLTTKFVSLLQEAKDGVLDLKLAADTLAVRQKRRIYDITNVLEGIGLIEKKSKNSIQWKGVGPGCNTREIADKLIELKAEIEELQQREQELDQHKVWVQQSIRNVTEDVQNSCLAYVTHEDICRCFAGDTLLAIRAPSGTSLEVPIPEGLNGQKKYQIHLKSVSGPIEVLLVNKEAWSSPPVAVPVPPPEDLLQSPSAVSTPPPLPKPALAQSQEASRPNSPQLTPTAVPGSAEVQGMAGPAAEITVSGGPGTDSKDSGELSSLPLGPTTLDTRPLQSSALLDSSSSSSSSSSSSSNSNSSSSSGPNPSTSFEPIKADPTGVLELPKELSEIFDPTRECMSSELLEELMSSEVFAPLLRLSPPPGDHDYIYNLDESEGVCDLFDVPVLNL

SEQ ID NO: 813114 - protein, 420 aa, Homo sapiens
MAEAGPQAPPPPGTPSRHEKSLGLLTTKFVSLLQEAKDGVLDLKLAADTLAVRQKRRIYDITNVLEGIGLIEKKSKNSIQWKGVGPGCNTREIADKLIELKAEIEELQQREQELDQHKVWVQQSIRNVTEDVQNSCLAYVTHEDICRCFAGDTLLAIRAPSGTSLEVPIPEGLNGQKKYQIHLKSVSGPIEVLLVNKEAWSSPPVAVPVPPPEDLLQSPSAVSTPPPLPKPALAQSQEASRPNSPQLTPTAVPGSAEVQGMAGPAAEITVSGGPGTDSKDSGELSSLPLGPTTLDTRPLQSSALLDSSSSSSSSSSSSSSSSSSSSNSNSSSSSGPNPSTSFEPIKADPTGVLELPKELSEIFDPTRECMSSELLEELMSSEVFAPLLRLSPPPGDHDYIYNLDESEGVCDLFDVPVLNL

SEQ ID NO: 813115 - protein, 496 aa, Homo sapiens
KDESNNDPPHTHNNKENQKGQVLRPGVLAEGRRRAGAMAEAGPQAPPPPGTPSRHEKSLGLLTTKFVSLLQEAKDGVLDLKLAADTLAVRQKRRIYDITNVLEGIGLIEKKSKNSIQWNVSGHSGRVVESPTQKCRAWGGGAEEGRGHGTQSSQQSLSAPLPGLRGVGPGCNTREIADKLIELKAEIEELQQREQELDQHKVWVQQSIRNVTEDVQNSCLAYVTHEDICRCFAGDTLLAIRAPSGTSLEVPIPEGLNGQKKYQIHLKSVSGPIEVLLVNKEAWSSPPVAVPVPPPEDLLQSPSAVSTPPPLPKPALAQSQEASRPNSPQLTPTAVPGSAEVQGMAGPAAEITVSGGPGTDSKDSGELSSLPLGPTTLDTRPLQSSALLDSSSSSSSSSSSSSNSNSSSSSGPNPSTSFEPIKADPTGVLELPKELSEIFDPTRECMSSELLEELMSSEVFAPLLRLSPPPGDHDYIYNLDESEGVCDLFDVPVLNL

SEQ ID NO: 813116 - protein, 403 aa, Homo sapiens
MAEAGPQAPPPPGTPSRHEKSLGLLTTKFVSLLQEAKDGVLDLKLAADTLAVRQKRRIYDITNVLEGIGLIEKKSKNSIQWKGVGPGCNTREIADKLIELKAEIEELQQREQELDQHKVWVQQSIRNVTEDVQNSCLAYVTHEDICRCFAGDTLLAIRAPSGTSLEVPIPEGLNGQKKYQIHLKSVSGPIEVLLVNKEAWSSPPVAVPVPPPEDLLQSPSAVSTPPPLPKPALAQSQEASRPNSPQLTPTAVPGSAEVQGMAGPAAEITVSGGPGTDSKDSGELSSLPLGPTTLDTRPLQSSALLDSSSSSSSSSSSSSNSNSSSSSGPNPSTSFEPIKADPTGVLELPKELSEIFDPTRECMSSELLEELMSSEGTCPVWLGPRLSDLGVAWGPLPPDPYRA

SEQ ID NO: 813117 - protein, 298 aa, Homo sapiens
VIEDPGGEEGRYVTDGRQNSCLAYVTHEDICRCFAGDTLLAIRAPSGTSLEVPIPEGLNGQKKYQIHLKSVSGPIEVLLVNKEAWSSPPVAVPVPPPEDLLQSPSAVSTPPPLPKPALAQSQEASRPNSPQLTPTAVPGSAEVQGMAGPAAEITVSGGPGTDSKDSGELSSLPLGPTTLDTRPLQSSALLDSSSSSSSSSSSSSNSNSSSSSGPNPSTSFEPIKADPTGVLELPKELSEIFDPTRECMSSELLEELMSSEVFAPLLRLSPPPGDHDYIYNLDESEGVCDLFDVPVLNL

SEQ ID NO: 813118 - protein, 153 aa, Homo sapiens [sequence omitted]

SEQ ID NO: 813119 - protein, 402 aa, Homo sapiens
MAEAGPQAPPPPGTPSRHEKSLGLLTTKFVSLLQEAKDGVLDLKLAADTLAVRQKRRIYDITNVLEGIGLIEKKSKNSIQWKGVGPGCNTREIADKLIELKAEIEELQQREQELDQHKVWVQQSIRNVTEDVQNSCLAYVTHEDICRCFAGDTLLAIRAPSGTSLEVPIPEGLNGQKKYQIHLKSVSGPIEVLLVNKEAWSSPPVAVPVPPPEDLLQSPSAVSTPPPLPKPALAQSQEASRPNSPQLTPTAVPGSAEVQGMAGPAAEITVSGGPGTDSKDSGELSSLPLGPTTLDTRPLQSSALLDSSSSSSSSSSSSSNSNSSSSSGPNPSTSFEPIKADPTGVLELPKELSEIFDPTRELLLALSRAHFCWAFSPRTCRWWGRLPRRNRGLWGGVWVVQP

SEQ ID NO: 813120 - protein, 66 aa, Homo sapiens
WKVGVGVGRGWAAARGALAQGLRLVLSAVFAPLLRLSPPPGDHDYIYNLDESEGVCDLFDVPVLNL

SEQ ID NO: 813121 - protein, 103 aa, Homo sapiens
ARKWRRRAWPGLAEGRRRAGAMAEAGPQAPPPPGTPSRHEKSLGLLTTKFVSLLQEAKDGVLDLKLAADTLAVRQKRRIYDITNVLEGIGLIEKKSKNSIQWK

SEQ ID NO: 813122 - protein, 138 aa, Homo sapiens [sequence omitted]

SEQ ID NO: 813123 - protein, 705 aa, Homo sapiens
MWLLYLLVPALFCRAGGSIPIPQKLFGEVTSPLFPKPYPNNFETTTVITVPTGYRVKLVFQQFDLEPSEGCFYDYVKISADKKSLGRFCGQLGSPLGNPPGKKEFMSQGNKMLLTFHTDFSNEENGTIMFYKGFLAYYQAVDLDECASRSKSGEEDPQPQCQHLCHNYVGGYFCSCRPGYELQEDRHSCQAECSSELYTEASGYISSLEYPRSYPPDLRCNYSIRVERGLTLHLKFLEPFDIDDHQQVHCPYDQLQIYANGKNIGEFCGKQRPPDLDTSSNAVDLLFFTDESGDSRGWKLRYTTEIIKCPQPKTLDEFTIIQNLQPQYQFRDYFIATCKQGYQLIEGNQVLHSFTAVCQDDGTWHRAMPRCKIKDCGQPRNLPNGDFRYTTTMGVNTYKARIQYYCHEPYYKMQTRAGSRESEQGVYTCTAQGIWKNEQKGEKIPRCLPVCGKPVNPVEQRQRIIGGQKAKMGNFPWQVFTNIHGRGGGALLGDRWILTAAHTLYPKEHEAQSNASLDVFLGHTNVEELMKLGNHPIRRVSVHPDYRQDESYNFEGDIALLELENSVTLGPNLLPICLPDNDTFYDLGLMGYVSGFGVMEEKIAHDLRFVRLPVANPQACENWLRGKNRMDVFSQNMFCAGHPSLKQDACQGDSGGVFAVRDPNTDRWVATGIVSWGIGCSRGYGFYTKVLNYVDWIKKEMEEED

SEQ ID NO: 813124 - protein, 705 aa, Homo sapiens; identical to SEQ ID NO: 813123

SEQ ID NO: 813125 - protein, 705 aa, Homo sapiens; identical to SEQ ID NO: 813123

SEQ ID NO: 813126 - protein, 705 aa, Homo sapiens; identical to SEQ ID NO: 813123

SEQ ID NO: 813127 - protein, 705 aa, Homo sapiens; identical to SEQ ID NO: 813123

SEQ ID NO: 813128 - protein, 687 aa, Homo sapiens
MWLLYLLVPALFCRAGGSIPIPQKLFGEVTSPLFPKPYPNNFETTTVITVPTGYRVKLVFQQFDLEPSEGCFYDYVKISADKKSLGRFCGQLGSPLGNPPGKKEFMSQGNKMLLTFHTDFSNEENGTIMFYKGFLAYYQAVDLDECASRSKSGEEDPQPQCQHLCHNYVGGYFCSCRPGYELQEDRHSCQAECSSELYTEASGYISSLEYPRSYPPDLRCNYSIRVERGLTLHLKFLEPFDIDDHQQVHCPYDQLQIYANGKNIGEFCGKQRPPDLDTSSNAVDLLFFTDESGDSRGWKLRYTTEIIKCPQPKTLDEFTIIQNLQPQYQFRDYFIATCKQGYQLIEGNQVLHSFTAVCQDDGTWHRAMPRCKIKDCGQPRNLPNGDFRYTTTMGVNTYKARIQYYCHEPYYKMQTRAGSRESEQGVYTCTAQGIWKNEQKGEKIPRCLPVCGKPVNPVEQRQRIIGGHGGGALLGDRWILTAAHTLYPKEHEAQSNASLDVFLGHTNVEELMKLGNHPIRRVSVHPDYRQDESYNFEGDIALLELENSVTLGPNLLPICLPDNDTFYDLGLMGYVSGFGVMEEKIAHDLRFVRLPVANPQACENWLRGKNRMDVFSQNMFCAGHPSLKQDACQGDSGGVFAVRDPNTDRWVATGIVSWGIGCSRGYGFYTKVLNYVDWIKKEMEEED

SEQ ID NO: 813129 - protein, 386 aa, Homo sapiens
MWLLYLLVPALFCRAGGSIPIPQKLFGEVTSPLFPKPYPNNFETTTVITVPTGYRVKLVFQQFDLEPSEGCFYDYVKISADKKSLGRFCGQLGSPLGNPPGKKEFMSQGNKMLLTFHTDFSNEENGTIMFYKGFLAYYQAVDLDECASRSKSGEEDPQPQCQHLCHNYVGGYFCSCRPGYELQEDRHSCQAECSSELYTEASGYISSLEYPRSYPPDLRCNYSIRVERGLTLHLKFLEPFDIDDHQQVHCPYDQLQIYANGKNIGEFCGKQRPPDLDTSSNAVDLLFFTDESGDSRGWKLRYTTEIIKCPQPKTLDEFTIIQNLQPQYQFRDYFIATCKQGYQLIEGNQVLHSFTAVCQDDGTWHRAMPRCKITAFLVYASIRSLL

SEQ ID NO: 813130 - protein, 875 aa, Homo sapiens
MLMPWSFLPSGLLAGSSERRGPLAQDGTLCACVPHSTDGFSQTLLLNLWEPFQRPTGGNPHPPLTGPKPVLFLEGEGRDASGQGRRLERECEGSVVASGLDTALESDPMQQLHRPSSPPTPPAENMSVRFRVGREENAQWYGRLIPCHSHCPHGKSAEPPPAPDTLFCFGRWLLYLLVPALFCRAGGSIPIPQKLFGEVTSPLFPKPYPNNFETTTVITVPTGYRVKLVFQQFDLEPSEGCFYDYVKISADKKSLGRFCGQLGSPLGNPPGKKEFMSQGNKMLLTFHTDFSNEENGTIMFYKGFLAYYQAVDLDECASRSKSGEEDPQPQCQHLCHNYVGGYFCSCRPGYELQEDRHSCQAECSSELYTEASGYISSLEYPRSYPPDLRCNYSIRVERGLTLHLKFLEPFDIDDHQQVHCPYDQLQIYANGKNIGEFCGKQRPPDLDTSSNAVDLLFFTDESGDSRGWKLRYTTEIIKCPQPKTLDEFTIIQNLQPQYQFRDYFIATCKQGYQLIEGNQVLHSFTAVCQDDGTWHRAMPRCKIKDCGQPRNLPNGDFRYTTTMGVNTYKARIQYYCHEPYYKMQTRAGSRESEQGVYTCTAQGIWKNEQKGEKIPRCLPVCGKPVNPVEQRQRIIGGQKAKMGNFPWQVFTNIHGRGGGALLGDRWILTAAHTLYPKEHEAQSNASLDVFLGHTNVEELMKLGNHPIRRVSVHPDYRQDESYNFEGDIALLELENSVTLGPNLLPICLPDNDTFYDLGLMGYVSGFGVMEEKIAHDLRFVRLPVANPQACENWLRGKNRMDVFSQNMFCAGHPSLKQDACQGDSGGVFAVRDPNTDRWVATGIVSWGIGCSRGYGFYTKVLNYVDWIKKEMEEED

SEQ ID NO: 813131 - protein, 1063 aa, Homo sapiens
IDLSKSIAVGRAQDSTRALRNVSKGDGQPGGREKPGEKPGHGRQFRETGTPFSLHTPHQFHCAHAWTHTTHAPSLLLGIRGDFIHKMLMPWSFLPSGLLAGSSERRGPLAQDGTLCACVPHSTDGFSQTLLLNLWEPFQRPTGGNPHPPLTGPKPVLFLEGEGRDASGQGRRLERECEGSVVASGLDTALESDPMQQLHRPSSPPTPPAENMSVRFRVGREENAQWYGRLIPCHSHCPHGKSAEPPPAPDTLFCFGRWLLYLLVPALFCRAGGSIPIPQKLFGEVTSPLFPKPYPNNFETTTVITVPTGYRVKLVFQQFDLEPSEGCFYDYVKISADKKSLGRFCGQLGSPLGNPPGKKEFMSQGNKMLLTFHTDFSNEENGTIMFYKGFLAYYQAVDLDECASRSKSGEEDPQPQCQHLCHNYVGGYFCSCRPGYELQEDRHSCQAECSSELYTEASGYISSLEYPRSYPPDLRCNYSIRVERGLTLHLKFLEPFDIDDHQQVHCPYDQLQGTAVLPLKDPFLPFCLHLAPLVPTSSWIPWPAGAGTANITHGLGKFPHNYNWVMGIPFHLPLKTHIRQDFITTTTTLATRLLPSWPCVKTSKLKKKNPPPLQIYANGKNIGEFCGKQRPPDLDTSSNAVDLLFFTDESGDSRGWKLRYTTEIIKCPQPKTLDEFTIIQNLQPQYQFRDYFIATCKQGYQLIEGNQVLHSFTAVCQDDGTWHRAMPRCKIKDCGQPRNLPNGDFRYTTTMGVNTYKARIQYYCHEPYYKMQTRAGSRESEQGVYTCTAQGIWKNEQKGEKIPRCLPVCGKPVNPVEQRQRIIGGQKAKMGNFPWQVFTNIHGRGGGALLGDRWILTAAHTLYPKEHEAQSNASLDVFLGHTNVEELMKLGNHPIRRVSVHPDYRQDESYNFEGDIALLELENSVTLGPNLLPICLPDNDTFYDLGLMGYVSGFGVMEEKIAHDLRFVRLPVANPQACENWLRGKNRMDVFSQNMFCAGHPSLKQDACQGDSGGVFAVRDPNTDRWVATGIVSWGIGCSRGYGFYTKVLNYVDWIKKEMEEED

SEQ ID NO: 813132 - protein, 923 aa, Homo sapiens
RVERGLTLHLKFLEPFDIDDHQQVHCPYDQLQIYANGKNIGEFCGKQRPPDLDTSSNAVDLLFFTDESGDSRGWKLRYTTEIIKCPQPKTLDEFTIGGQKAKMGNFPWQVFTNIRGRGGGALLGDRWILTAAHTLYPKEHEAQSNASLDVFLGHTNVEELMKLGNHPIRRVSVHPDYRQDESYNFEGDIALLELENSVTLGPNLLPICLPDNDTFYDLGLMGYVSGFGVMEEKIAHDLRFVRLPVANHRPLFPKPYPNNFETTTVITVPTGYRVKLVFQQFDLEPSEGCFYDYVKISADKKSLGRFCGQLGSPLGNPPGKKEFMSQGNKMLLTFHTDFSNEENGTIMFYKGFLAYYQAVDLDECASRSKSGEEDPQPQCQHLCHNYVGGYFCSCRPGYELQEDRHSCQAECSSELYTEASGYISSLEYPRSYPPDLRCNYSIRVERGLTLHLKFLEPFDIDDHQQVHCPYDQLQIYANGKNIGEFCGKQRPPDLDTSSNAVDLLFFTDESGDSRGWKLRYTTEIIKCPQPKTLDEFTIIQNLQPQYQFRDYFIATCKQGYQLIEGNQVLHSFTAVCQDDGTWHRAMPRCKIKDCGQPRNLPNGDFRYTTTMGVNTYKARIQYYCHEPYYKMQTRAGSRESEQGVYTCTAQGIWKNEQKGEKIPRCLPVCGKPVNPVEQRQRIIGGQKAKMGNFPWQVFTNIHGRGGGALLGDRWILTAAHTLYPKEHEAQSNASLDVFLGHTNVEELMKLGNHPIRRVSVHPDYRQDESYNFEGDIALLELENSVTLGPNLLPICLPDNDTFYDLGLMGYVSGFGVMEEKIAHDLRFVRLPVANPQACENWLRGKNRMDVFSQNMFCAGHPSLKQDACQGDSGGVFAVRDPNTDRWVATGIVSWGIGCSRGYGFYTKVLNYVDWIKKEMEEED

SEQ ID NO: 813133 - protein, 734 aa, Homo sapiens
MWLLYLLVPALFCRAGGSIPIPQKLFGEVTSPLFPKPYPNNFETTTVITVPTGYRVKLVFQQFDLEPSEGCFYDYVKISADKKSLGRFCGQLGSPLGNPPGKKEFMSQGNKMLLTFHTDFSNEENGTIMFYKGFLAYYQAVGLWWVTSLRSEPLLRSPSRSLTLLPECLPDLDECASRSKSGEEDPQPQCQHLCHNYVGGYFCSCRPGYELQEDRHSCQAECSSELYTEASGYISSLEYPRSYPPDLRCNYSIRVERGLTLHLKFLEPFDIDDHQQVHCPYDQLQIYANGKNIGEFCGKQRPPDLDTSSNAVDLLFFTDESGDSRGWKLRYTTEIIKCPQPKTLDEFTIIQNLQPQYQFRDYFIATCKQGYQLIEGNQVLHSFTAVCQDDGTWHRAMPRCKIKDCGQPRNLPNGDFRYTTTMGVNTYKARIQYYCHEPYYKMQTRAGSRESEQGVYTCTAQGIWKNEQKGEKIPRCLPVCGKPVNPVEQRQRIIGGQKAKMGNFPWQVFTNIHGRGGGALLGDRWILTAAHTLYPKEHEAQSNASLDVFLGHTNVEELMKLGNHPIRRVSVHPDYRQDESYNFEGDIALLELENSVTLGPNLLPICLPDNDTFYDLGLMGYVSGFGVMEEKIAHDLRFVRLPVANPQACENWLRGKNRMDVFSQNMFCAGHPSLKQDACQGDSGGVFAVRDPNTDRWVATGIVSWGIGCSRGYGFYTKVLNYVDWIKKEMEEED

SEQ ID NO: 813134 - protein, 699 aa, Homo sapiens
RVERGLTLHLKFLEPFDIDDHQQVHCPYDQLQIYANGKNIGEFCGKQRPPDLDTSSNAVDLLFFTDESGDSRGWKLRYTTEIIKCPQPKTLDEFTIGGQKAKMGNFPWQVFTNIRGRGGGALLGDRWILTAAHTLYPKEHEAQSNASLDVFLGHTNVEELMKLGNHPIRRVSVHPDYRQDESYNFEGDIALLELENSVTLGPNLLPILPPDLRCNYSIRVERGLTLHLKFLEPFDIDDHQQVHCPYDQLQIYANGKNIGEFCGKQRPPDLDTSSNAVDLLFFTDESGDSRGWKLRYTTEIIKCPQPKTLDEFTIIQNLQPQYQFRDYFIATCKQGYQLIEGNQVLHSFTAVCQDDGTWHRAMPRCKIKDCGQPRNLPNGDFRYTTTMGVNTYKARIQYYCHEPYYKMQTRAGSRESEQGVYTCTAQGIWKNEQKGEKIPRCLPVCGKPVNPVEQRQRIIGGQKAKMGNFPWQVFTNIHGRGGGALLGDRWILTAAHTLYPKEHEAQSNASLDVFLGHTNVEELMKLGNHPIRRVSVHPDYRQDESYNFEGDIALLELENSVTLGPNLLPICLPDNDTFYDLGLMGYVSGFGVMEEKIAHDLRFVRLPVANPQACENWLRGKNRMDVFSQNMFCAGHPSLKQDACQGDSGGVFAVRDPNTDRWVATGIVSWGIGCSRGYGFYTKVLNYVDWIKKEMEEED

SEQ ID NO: 813135 - protein, 495 aa, Homo sapiens
MSSYGTHELWNYSIRVERGLTLHLKFLEPFDIDDHQQVHCPYDQLQIYANGKNIGEFCGKQRPPDLDTSSNAVDLLFFTDESGDSRGWKLRYTTEIIKCPQPKTLDEFTIIQNLQPQYQFRDYFIATCKQGYQLIEGNQVLHSFTAVCQDDGTWHRAMPRCKIKDCGQPRNLPNGDFRYTTTMGVNTYKARIQYYCHEPYYKMQTRAGSRESEQGVYTCTAQGIWKNEQKGEKIPRCLPVCGKPVNPVEQRQRIIGGQKAKMGNFPWQVFTNIHGRGGGALLGDRWILTAAHTLYPKEHEAQSNASLDVFLGHTNVEELMKLGNHPIRRVSVHPDYRQDESYNFEGDIALLELENSVTLGPNLLPICLPDNDTFYDLGLMGYVSGFGVMEEKIAHDLRFVRLPVANPQACENWLRGKNRMDVFSQNMFCAGHPSLKQDACQGDSGGVFAVRDPNTDRWVATGIVSWGIGCSRGYGFYTKVLNYVDWIKKEMEEED

SEQ ID NO: 813136 - protein, 233 aa, Homo sapiens
MWLLYLLVPALFCRAGGSIPIPQKLFGEVTSPLFPKPYPNNFETTTVITVPTGYRVKLVFQQFDLEPSEGCFYDYVKISADKKSLGRFCGQLGSPLGNPPGKKEFMSQGNKMLLTFHTDFSNEENGTIMFYKGFLAYYQAVDLDECASRSKSGEEDPQPQCQHLCHNYVGGYFCSCRPGYELQEDRHSCQAECSSELYTEASGYISSLEYPRSYPPDLRCNYSIRVERNLTKF

SEQ ID NO: 813137 - protein, 285 aa, Homo sapiens
MWLLYLLVPALFCRAGGSIPIPQKLFGEVTSPLFPKPYPNNFETTTVITVPTGYRVKLVFQQFDLEPSEGCFYDYVKISADKKSLGRFCGQLGSPLGNPPGKKEFMSQGNKMLLTFHTDFSNEENGTIMFYKGFLAYYQAVDLDECASRSKSGEEDPQPQCQHLCHNYVGGYFCSCRPGYELQEDRHSCQAECSSELYTEASGYISSLEYPRSYPPDLRCNYSIRVERHGHRVLGHRVQQGLWLLHQSAQLRGLDQERDGGGGLSPEFTRFESREQCGKKKTKNN

SEQ ID NO: 813138 - protein, 624 aa, Homo sapiens
TGRLYSTGSCTPPGGCTPPAVVLHRQVVLHRQVVLHRQVVLHRQVVLHRQVVFLEPFDIDDHQQVHCPYDQLQGTAVLPLKDPFLPFCLHLAPLVPTSSWIPWPAGAGTANITHGLGKFPHNYNWVMGIPFHLPLKTHIRQDFITTTTTLATRLLPSWPCVKTSKLKKKNPPPLQIYANGKNIGEFCGKQRPPDLDTSSNAVDLLFFTDESGDSRGWKLRYTTEIIKCPQPKTLDEFTIIQNLQPQYQFRDYFIATCKQGYQLIEGNQVLHSFTAVCQDDGTWHRAMPRCKIKDCGQPRNLPNGDFRYTTTMGVNTYKARIQYYCHEPYYKMQTRAGSRESEQGVYTCTAQGIWKNEQKGEKIPRCLPVCGKPVNPVEQRQRIIGGQKAKMGNFPWQVFTNIHGRGGGALLGDRWILTAAHTLYPKEHEAQSNASLDVFLGHTNVEELMKLGNHPIRRVSVHPDYRQDESYNFEGDIALLELENSVTLGPNLLPICLPDNDTFYDLGLMGYVSGFGVMEEKIAHDLRFVRLPVANPQACENWLRGKNRMDVFSQNMFCAGHPSLKQDACQGDSGGVFAVRDPNTDRWVATGIVSWGIGCSRGYGFYTKVLNYVDWIKKEMEEED

SEQ ID NO: 813139 - protein, 461 aa, Homo sapiens
MRQDTARLTMLQIYANGKNIGEFCGKQRPPDLDTSSNAVDLLFFTDESGDSRGWKLRYTTEIIKCPQPKTLDEFTIIQNLQPQYQFRDYFIATCKQGYQLIEGNQVLHSFTAVCQDDGTWHRAMPRCKIKDCGQPRNLPNGDFRYTTTMGVNTYKARIQYYCHEPYYKMQTRAGSRESEQGVYTCTAQGIWKNEQKGEKIPRCLPVCGKPVNPVEQRQRIIGGQKAKMGNFPWQVFTNIHGRGGGALLGDRWILTAAHTLYPKEHEAQSNASLDVFLGHTNVEELMKLGNHPIRRVSVHPDYRQDESYNFEGDIALLELENSVTLGPNLLPICLPDNDTFYDLGLMGYVSGFGVMEEKIAHDLRFVRLPVANPQACENWLRGKNRMDVFSQNMFCAGHPSLKQDACQGDSGGVFAVRDPNTDRWVATGIVSWGIGCSRGYGFYTKVLNYVDWIKKEMEEED

SEQ ID NO: 813140 - protein, 386 aa, Homo sapiens
RVERGLTLHLKFLEPFDIDDHQQVHCPYDQLQIYANGKNIGEFCGKQRPPDLDTSSNAVDLLFFTDESGDSRGWKLRYTTEIIKCPQPKTLDEFTIGGQKAKMGNFPWQVFTNIRGRGGGALLGDRWILTAAHTLYPKEHEAQSNASLDVFLGHTNVEELMKLGNHPIRRVSVHPDYRQDESYNFEGDIALLELENSVTLGPNLLPICLPDNDTFYDLGLMGYVSGFGVMEEKIAHDLRFVRLPVANHRPLFPKPYPNNFETTTVITVPTGYRVKLVFQQFDLEPSEGCFYDYVKISADKKSLGRFCGQLGSPLGNPPGKKEFMSQGNKMLLTFHTDFSNEENGTPRASCPGASGAAGAMASTPKCSTTWTGSRKRWRRRTEPRIH

SEQ ID NO: 813141 - protein, 212 aa, Homo sapiens
MTATEALLRVLLLLLAFGHSTYGAECFPACNPQNGFCEDDNVCRCQPGWQGPLCDQCVTSPGCLHGLCGEPGQCICTDGWDGELCDRDVRACSSAPCANNGTCVSLDDGLYECSCAPGYSGKDCQKKDGPCVINGSPCQHGGTCVDDEGRASHASCLCPPGFSGNFCEIVANSCTPNPCENDGVCTDIGGAFVRSTYDELKKVSKKSSEQQT

SEQ ID NO: 813142 - protein, 207 aa, Homo sapiens
MTATEALLRVLLLLLAFGHSTYGAECFPACNPQNGFCEDDNVCRCQPGWQGPLCDQCVTSPGCLHGLCGEPGQCICTDGWDGELCDRDVRACSSAPCANNGTCVSLDDGLYECSCAPGYSGKDCQKKDGPCVINGSPCQHGGTCVDDEGRASHASCLCPPGFSGNFCEIVANSCTPTMQTRVDESGTSCVQRYATERVHELNGTVKQ

SEQ ID NO: 813143 - protein, 203 aa, Homo sapiens
MTATEALLRVLLLLLAFGHSTYGAECFPACNPQNGFCEDDNVCRCQPGWQGPLCDQCVTSPGCLHGLCGEPGQCICTDGWDGELCDRDVRACSSAPCANNGTCVSLDDGLYECSCAPGYSGKDCQKKDGPCVINGSPCQHGGTCVDDEGRASHASCLCPPGFSGNFCEIVANSCTPKNAEETNGGFCNLKIRGGETFRARVAP

SEQ ID NO: 813144 - protein, 163 aa, Homo sapiens
MTATEALLRVLLLLLAFGHSTYGAECFPACNPQNGFCEDDNVCRCQPGWQGPLCDQCVTSTCRFTRLSRTPAASFRLSYRSLCLHYVTVFPSALDPLHICLPTRRHLPLSFSSPTILCDFLLLPTITFHALFYSSAPFHRSPSTHELPDYPSPPTLSSTPLPL

SEQ ID NO: 813145 - protein, 106 aa, Homo sapiens
MTATEALLRVLLLLLAFGHSTYGAECFPACNPQNGFCEDDNVCRCQPGWQGPLCDQCVTSPGCLHGLCGEPGQCICTDGWDGELCDRDVGPGSLRPPLAKTNGTCV

SEQ ID NO: 813146 - protein, 383 aa, Homo sapiens
MTATEALLRVLLLLLAFGHSTYGAECFPACNPQNGFCEDDNVCRCQPGWQGPLCDQCVTSPGCLHGLCGEPGQCICTDGWDGELCDRDVRACSSAPCANNGTCVSLDDGLYECSCAPGYSGKDCQKKDGPCVINGSPCQHGGTCVDDEGRASHASCLCPPGFSGNFCEIVANSCTPNPCENDGVCTDIGGDFRCRCPAGFIDKTCSRPVTNCASSPCQNGGTCLQHTQVSYECLCKPEFTGLTCVKKRALSPQQVTRLPSGYGLAYRLTPGVHELPVQQPEHRILKVSMKELNKKTPLLTEGQAICFTILGVLTSLVVLGTVGIVFLNKCETWVSNLRYNHMLRKKKNLLLQYNSGEDLAVNIIFPEKIDMTTFSKEAGDEEI

SEQ ID NO: 813147 - protein, 383 aa, Homo sapiens; identical to SEQ ID NO: 813146

SEQ ID NO: 813148 - protein, 310 aa, Homo sapiens
MTATEALLRVLLLLLAFGHSTYGAECFPACNPQNGFCEDDNVCRCQPGWQGPLCDQCVTSPGCLHGLCGEPGQCICTDGWDGELCDRDVRACSSAPCANNGTCVSLDDGLYECSCAPGYSGKDCQKKDGPCVINGSPCQHGGTCVDDEGRASHASCLCPPGFSGNFCEIVANSCTPNPCENDGVCTDIGGDFRCRCPAGFIDKTCSRPVTNCASSPCQNGGTCLQHTQGQAICFTILGVLTSLVVLGTVGIVFLNKCETWVSNLRYNHMLRKKKNLLLQYNSGEDLAVNIIFPEKIDMTTFSKEAGDEEI

SEQ ID NO: 813149 - protein, 348 aa, Homo sapiens
MTATEALLRVLLLLLAFGHSTYGAECFPACNPQNGFCEDDNVCRCQPGWQGPLCDQCVTSPGCLHGLCGEPGQCICTDGWDGELCDRDVRACSSAPCANNGTCVSLDDGLYECSCAPGYSGKDCQKKDGPCVINGSPCQHGGTCVDDEGRASHASCLCPPGFSGNFCEIVANSCTPNPCENDGVCTDIGGDFRCRCPAGFIDKTCSRPVTNCASSPCQNGGTCLQHTQVSYECLCKPEFTGLTCVKKRALSPQQVTRLPSGYGLAYRLTPGVHELPVQQPEHRILKVSMKELNKCETWVSNLRYNHMLRKKKNLLLQYNSGEDLAVNIIFPEKIDMTTFSKEAGDEEI

SEQ ID NO: 813150 - protein, 365 aa, Homo sapiens
MTATEALLRVLLLLLAFGHSTYGAECFPACNPQNGFCEDDNVCRCQPGWQGPLCDQCVTSPGCLHGLCGEPGQCICTDGWDGELCDRDVRACSSAPCANNGTCVSLDDGLYECSCAPGYSGKDCQSVDDEGRASHASCLCPPGFSGNFCEIVANSCTPNPCENDGVCTDIGGDFRCRCPAGFIDKTCSRPVTNCASSPCQNGGTCLQHTQVSYECLCKPEFTGLTCVKKRALSPQQVTRLPSGYGLAYRLTPGVHELPVQQPEHRILKVSMKELNKKTPLLTEGQAICFTILGVLTSLVVLGTVGIVFLNKCETWVSNLRYNHMLRKKKNLLLQYNSGEDLAVNIIFPEKIDMTTFSKEAGDEEI

SEQ ID NO: 813151 - protein, 345 aa, Homo sapiens
MTATEALLRVLLLLLAFGHSTYGAECFPACNPQNGFCEDDNVCRCQPGWQGPLCDQCVTSPGCLHGLCGEPGQCICTDGWDGELCDRDVRACSSAPCANNGTCVSLDDGLYECSHASCLCPPGFSGNFCEIVANSCTPNPCENDGVCTDIGGDFRCRCPAGFIDKTCSRPVTNCASSPCQNGGTCLQHTQVSYECLCKPEFTGLTCVKKRALSPQQVTRLPSGYGLAYRLTPGVHELPVQQPEHRILKVSMKELNKKTPLLTEGQAICFTILGVLTSLVVLGTVGIVFLNKCETWVSNLRYNHMLRKKKNLLLQYNSGEDLAVNIIFPEKIDMTTFSKEAGDEEI

SEQ ID NO: 813152 - protein, 280 aa, Homo sapiens
MTATEALLRVLLLLLAFGHSTYGAECFPACNPQNGFCEDDNVCRCQPGWQGPLCDQCVTSPGCLHGLCGEPGQCICTDGWDGELCDRDVRACSSAPCANNGTCVSLDDGLYECSHVASPQGYIVGEGTADGKHRTRTPDAVVTPVVPLLALDTSESNALTDEGMNECGRVVSSTNALIAARVVRHAWTIFKLIYHVESVERKAVMRVPLTAMSDASWTVTATSSILVAIQRCCADLSLLVRASPHGPASFPMPHREASRWHSPVPPGGTAKLVGPKAEPP

SEQ ID NO: 813153 - protein, 616 aa, Homo sapiens
TEVISLIIIYKALDYGLKENEERELSPPLEQLIHMANTVEADGSNDEGYAAEEGLGDEDEKRKISAIRSYRDVMKLCAAHLPTESDAPNHYQAVCRALFAETMELHTFLTKIKSAKENLKKIQEMEKSDESSTDLEELKNADWARFWVQVMRDLRNGVKLKKVQERQYNPLPIEYQLTPYEMLMDDIRCKRYTLRKVMVNGDIPPRLKKSAHEIILDFIRSRPPLNPVSARKLKPTPPRPRSLHERILEEIKAERKLRPVSPEEIRRSRLDVTTPESTKNLVESSMVNGGLTSQTKENGLSTSQQVPAQRKKLLRAPTLAELDSSESEEETLHKSTSSSSVSPSFPEEPVLEAVSTRKKPPKFLPISSTPQPERRQPPQRRHSIEKETPTNVRQFLPPSRQSSRSLEEFCYPVECLALTVEEVMHIRQVLVKAELEKYQQYKDIYTALKKGKLCFCCRTRRFSFFTWSYTCQFCKRPVCSQCCKKMRLPSKPYSTLPIFSLGPSALQRGESSMRSEKPSTAHHRPLRSIARFSSKSKSMDKSDEELQFPKELMEDWSTMEVCVDCKKFISEIISSSRRSLVLANKRARLKRKTQSFYMSSPGPSEYCPSERTISEI

SEQ ID NO: 813154 - protein, 480 aa, Homo sapiens
TEVISLIIIYKALDYGLKENEERELSPPLEQLIHMANTVEADGSNDEGYAAEEGLGDEDEKRKISAIRSYRDVMKLCAAHLPTESDAPNHYQAVCRALFAETMELHTFLTKIKSAKENLKKIQEMEKSDESSTDLEELKNADWARFWVQVMRDLRNGVKLKKVQERQYNPLPIEYQLTPYEMLMDDIRCKRYTLRKVMVNGDIPPRLKKSAHEIILDFIRSRPPLNPVSARKLKPTPPRPRSLHERILEEIKAERKLRPVSPEEIRRSRLGGILLPSGMPRSYCGRSDDIRQVLVKAELEKYQQYKDIYTALKKGKLCFCCRTRRFSFFTWSYTCQFCKRPVCSQCCKKMRLPSKPYSTLPIFSLGPSALQRGESSMRSEKPSTAHHRPLRSIARFSSKSKSMDKSDEELQFPKELMEDWSTMEVCVDCKKFISEIISSSRRSLVLANKRARLKRKTQSFYMSSPGPSEYCPSERTISEI

SEQ ID NO: 813155 - protein, 479 aa, Homo sapiens
NKLIWGISLITGVMRDLRNGVKLKKVQERQYNPLPIEYQLTPYEMLMDDIRCKRYTLRKVMVNGDIPPRLKKSAHEIILDFIRSRPPLNPVSARKLKPTPPRPRSLHERILEEIKAERKLRPVSPEEIRRSRLDVTTPESTKNLVESSMVNGGLTSQTKENGLSTSQQVPAQRKKLLRAPTLAELDSSESEEETLHKSTSSSSVSPSFPEEPVLEAVSTRKKPPKFLPISSTPQPERRQPPQRRHSIEKETPTNVRQFLPPSRQSSRSLEEFCYPVECLALTVEEVMHIRQVLVKAELEKYQQYKDIYTALKKGKLCFCCRTRRFSFFTWSYTCQFCKRPVCSQCCKKMRLPSKPYSTLPIFSLGPSALQRGESSMRSEKPSTAHHRPLRSIARFSSKSKSMDKSDEELQFPKELMEDWSTMEVCVDCKKFISEIISSSRRSLVLANKRARLKRKTQSFYMSSPGPSEYCPSERTISEI

SEQ ID NO: 813156 - protein, 616 aa, Homo sapiens; identical to SEQ ID NO: 813153

SEQ ID NO: 813157 - protein, 249 aa, Homo sapiens
IQTASLLSSHPFEAAMFGVAGAMYYLCERAFTSRWKSSKEEFCYPVECLALTVEEVMHIRQVLVKAELEKYQQYKDIYTALKKGKLCFCCRTRRFSFFTWSYTCQFCKRPVCSQCCKKMRLPSKPYSTLPIFSLGPSALQRGESSMRSEKPSTAHHRPLRSIARFSSKSKSMDKSDEELQFPKELMEDWSTMEVCVDCKKFISEIISSSRRSLVLANKRARLKRKTQSFYMSSPGPSEYCPSERTISEI

SEQ ID NO: 813158 - protein, 193 aa, Homo sapiens [sequence omitted]

SEQ ID NO: 813159 - protein, 616 aa, Homo sapiens; identical to SEQ ID NO: 813153

SEQ ID NO: 813160 - protein, 616 aa, Homo sapiens; identical to SEQ ID NO: 813153

SEQ ID NO: 813161 - protein, 162 aa, Homo sapiens
RAAGFAAAAMPSSPLRVAVVCSSNQNRSMEAHNILSKRGFSVRSFGTGTHVKLPGPAPDKPNVYDFKTTYDQMYNDLLRKDKELYPSGLPFKNPPCGPPWKVLRVARAQEACHPVQCTHWLLCLCESLVSIPGARRIVHGLVPVPPMAVGVVRRTDTVWGSP

SEQ ID NO: 813162 - protein, 218 aa, Homo sapiens
EPRDLRPPPCRRPRCGWRWCARATRTGAWRRTTSSGSWAPPCPRALCSGDRPSLLPGSPWPAPGPLRGSRAGPRSWVGWLGWQLDGSARSPHAGGHHREGRFRDEAPAVRWSFELSEAGPGGEGSVRRSSAAQPPPPPPPLLNRRHDDGVHLEGAPEPPPGTQRPPSSVQINLELYASYVYLFMSYYFDRDDVAVKDFATFFTSHEERDMLRTDEVQT

SEQ ID NO: 813163 - protein, 162 aa, Homo sapiens; identical to SEQ ID NO: 813161

SEQ ID NO: 813164 - protein, 280 aa, Homo sapiens
MLSAVARGYQGWFHPCARLSVRMSSTGIDRKGVLANRVAVVTGSTSGIGFAIARRLARDGAHVVISSRKQQNVDRAMAKLQGEGLSVAGIVCHVGKAEDREQLVAKALEHCGGVDFLVCSAGVNPLVGSTLGTSEQIWDKILSVNVKSPALLLSQLLPYMENRRGAVILVSSIAAYNPVVALGVYNVSKTALLGLTRTLALELAPKDIRVNCVVPGIIKTDFSKVFHGNESLWKNFKEHHQLQRIGESEDCAGIVSFLCSPDASYVNGENIAVAGYSTRL

SEQ ID NO: 813165 - protein, 315 aa, Homo sapiens
LSCRLPDRRAAKLHSRQTGAQPGLIQQEASQTPTTMLSAVARGYQGWFHPCARLSVRMSSTGIDRKGVLANRVAVVTGSTSGIGFAIARRLARDGAHVVISSRKQQNVDRAMAKLQGEGLSVAGIVCHVGKAEDREQLVAKALEHCGGVDFLVCSAGVNPLVGSTLGTSEQIWDKILSVNVKSPALLLSQLLPYMENRRGAVILVSSIAAYNPVVALGVYNVSKTALLGLTRTLALELAPKDIRVNCVVPGIIKTDFSKVFHGNESLWKNFKEHHQLQRIGESEDCAGIVSFLCSPDASYVNGENIAVAGYSTRL

SEQ ID NO: 813166 - protein, 326 aa, Homo sapiens
MLSAVARGYQGWFHPCARLSVRMSSTGIDRKGVLANRVAVVTGSTSGIGFAIARRLARDGAHVVISSRKQQNVDRAMAKLQGEGLSVAGIVCHVGKAEDREQLVAKALEHCGGVDFLVCSAGVNPLVGSTLGTSEQIWDKILSVNVKSPALLLSQLLPYMENRRGAVILVSSIAAYNPVVALGVYNVSKTALLGLTRTLALELAPKDIRVNCVVPGIIKTDFSKVFHGNESLWKNFKEHHQLQRIGESEDCAGIVSFLCSPDASYVNGENIAVAGNTRSEDWAAAPCPSPDLRVPETRLGAVAQQNDGALAAENRYTHTRHDTMSA

SEQ ID NO: 813167 - protein, 121 aa, Homo sapiens
MENRRGAVILVSSIAAYNPVVALGVYNVSKTALLGLTRTLALELAPKDIRVNCVVPGIIKTDFSKVFHGNESLWKNFKEHHQLQRIGESEDCAGIVSFLCSPDASYVNGENIAVAGYSTRL

SEQ ID NO: 813168 - protein, 313 aa, Homo sapiens
MRRGALLAGALAAYAAYLVLGALLVARLEGPHEARLRAELETLRAQLLQRSPCVAAPALDAFVERVLAAGRLGRVVLANASGSANASDPAWDFASALFFASTLITTVGYGYTTPLTDAGKAFSIAFALLGVPTTMLLLTASAQRLSLLLTHVPLSWLSMRWGWDPRRAACWHLVALLGVVVTVCFLVPAVIFAHLEEAWSFLDAFYFCFISLSTIGLGDYVPGEAPGQPYRALYKVLVTVYLFLGLVAMVLVLQTFRHVSDLHGLTELILLPPPCPASFNADEDDRVDILGPQPESHQQLSASSHTDYASIPR

SEQ ID NO: 813169 - protein, 313 aa, Homo sapiens; identical to SEQ ID NO: 813168

SEQ ID NO: 813170 - protein, 114 aa, Homo sapiens
MLSSTRLIPGTTYKCGLLLQWWDVKGSTPCPHVPGSTGHQHNLVLCPFSHPLYTVSLWLSGILAASVFPSCCLCFSFSFMFRLCLDTGSRWRHRLKMETQAQDGHDTVNTANVR

SEQ ID NO: 813171 - protein, 313 aa, Homo sapiens; identical to SEQ ID NO: 813168

SEQ ID NO: 813172 - protein, 124 aa, Homo sapiens
ALSLGELKAHSPTLGLPKGIQPHPAGSSRTAAPPGKSEPQDDQRPFSAFTVYLFLGLVAMVLVLQTFRHVSDLHGLTELILLPPPCPASFNADEDDRVDILGPQPESHQQLSASSHTDYASIPR

SEQ ID NO: 813173 - protein, 179 aa, Homo sapiens
MLLLTASAQRLSLLLTHVPLSWLSMRWGWDPRRAACWHLVALLGVVVTVCFLVPAVIFAHLEEAWSFLDAFYFCFISLSTIGLGDYVPGEAPGQPYRALYKVLVTVYLFLGLVAMVLVLQTFRHVSDLHGLTELILLPPPCPASFNADEDDRVDILGPQPESHQQLSASSHTDYASIPR

SEQ ID NO: 813174 - protein, 126 aa, Homo sapiens
MLLLTASAQRLSLLLTHVPLSWLSMRWGWDPRRAACWHLVALLGVVVTVCFLVPAVIFAHLEEAWSFLDAFYFVGSAAHEVAATMIRLGLLPHSFTPTTTTIYKPSHGHPLMSGRSIGFRSKITYA

SEQ ID NO: 813175 - protein, 693 aa, Homo sapiens
MLEGEAPHQSCSGEAIGKMQQQGIPGGIFFHCERFDQPIGEDSLCSILEELWQDNDQLEQRQENQNNLLSHVKVLIKERGYEHKNIEKIIHVTTKLVPSIKRLHNCDTILKHTLNSHNHNRNSATKNLGKIFGNGNNFPHSPSSTKNENAKTGANSCEHDHYEKHLSHKQAPTHHQKIHPEEKLYVCTECVMGFTQKSHLFEHQRIHAGEKSRECDKSNKVFPQKPQVDVHPSVYTGEKPYLCTQCGKVFTLKSNLITHQKIHTGQKPYKCSECGKAFFQRSDLFRHLRIHTGEKPYECSECGKGFSQNSDLSIHQKTHTGEKHYECNECGKAFTRKSALRMHQRIHTGEKPYVCADCGKAFIQKSHFNTHQRIHTGEKPYECSDCGKSFTKKSQLHVHQRIHTGEKPYICTECGKVFTHRTNLTTHQKTHTGEKPYMCAECGKAFTDQSNLIKHQKTHTGEKPYKCNGCGKAFIWKSRLKIHQKSHIGERHYECKDCGKAFIQKSTLSVHQRIHTGEKPYVCPECGKAFIQKSHFIAHHRIHTGEKPYECSDCGKCFTKKSQLRVHQKIHTGEKPNICAECGKAFTDRSNLITHQKIHTREKPYECGDCGKTFTWKSRLNIHQKSHTGERHYECSKCGKAFIQKATLSMHQIIHTGKKPYACTECQKAFTDRSNLIKHQKMHSGEKRYKASD

SEQ ID NO: 813176 - protein, 693 aa, Homo sapiens; identical to SEQ ID NO: 813175

SEQ ID NO: 813177 - protein, 657 aa, Homo sapiens
MLEGEAPHQSCSEELWQDNDQLEQRQENQNNLLSHVKVLIKERGYEHKNIEKIIHVTTKLVPSIKRLHNCDTILKHTLNSHNHNRNSATKNLGKIFGNGNNFPHSPSSTKNENAKTGANSCEHDHYEKHLSHKQAPTHHQKIHPEEKLYVCTECVMGFTQKSHLFEHQRIHAGEKSRECDKSNKVFPQKPQVDVHPSVYTGEKPYLCTQCGKVFTLKSNLITHQKIHTGQKPYKCSECGKAFFQRSDLFRHLRIHTGEKPYECSECGKGFSQNSDLSIHQKTHTGEKHYECNECGKAFTRKSALRMHQRIHTGEKPYVCADCGKAFIQKSHFNTHQRIHTGEKPYECSDCGKSFTKKSQLHVHQRIHTGEKPYICTECGKVFTHRTNLTTHQKTHTGEKPYMCAECGKAFTDQSNLIKHQKTHTGEKPYKCNGCGKAFIWKSRLKIHQKSHIGERHYECKDCGKAFIQKSTLSVHQRIHTGEKPYVCPECGKAFIQKSHFIAHHRIHTGEKPYECSDCGKCFTKKSQLRVHQKIHTGEKPNICAECGKAFTDRSNLITHQKIHTREKPYECGDCGKTFTWKSRLNIHQKSHTGERHYECSKCGKAFIQKATLSMHQIIHTGKKPYACTECQKAFTDRSNLIKHQKMHSGEKRYKASD

SEQ ID NO: 813178 - protein, 821 aa, Homo sapiens
MAANGDSPPWSPALAAEGRGSSCEVRRERTPEARIHSVKRYPDLSPGPKGRSSADHAALNSIVSLQASVSFEDVTVDFSKEEWQHLDPAQRRLYWDVTLENYSHLLSVGYQIPKSEAAFKLEQGEGPWMLEGEAPHQSCSGEAIGKMQQQGIPGGIFFHCERFDQPIGEDSLCSILEELWQDNDQLEQRQENQNNLLSHVKVLIKERGYEHKNIEKIIHVTTKLVPSIKRLHNCDTILKHTLNSHNHNRNSATKNLGKIFGNGNNFPHSPSSTKNENAKTGANSCEHDHYEKHLSHKQAPTHHQKIHPEEKLYVCTECVMGFTQKSHLFEHQRIHAGEKSRECDKSNKVFPQKPQVDVHPSVYTGEKPYLCTQCGKVFTLKSNLITHQKIHTGQKPYKCSECGKAFFQRSDLFRHLRIHTGEKPYECSECGKGFSQNSDLSIHQKTHTGEKHYECNECGKAFTRKSALRMHQRIHTGEKPYVCADCGKAFIQKSHFNTHQRIHTGEKPYECSDCGKSFTKKSQLHVHQRIHTGEKPYICTECGKVFTHRTNLTTHQKTHTGEKPYMCAECGKAFTDQSNLIKHQKTHTGEKPYKCNGCGKAFIWKSRLKIHQKSHIGERHYECKDCGKAFIQKSTLSVHQRIHTGEKPYVCPECGKAFIQKSHFIAHHRIHTGEKPYECSDCGKCFTKKSQLRVHQKIHTGEKPNICAECGKAFTDRSNLITHQKIHTREKPYECGDCGKTFTWKSRLNIHQKSHTGERHYECSKCGKAFIQKATLSMHQIIHTGKKPYACTECQKAFTDRSNLIKHQKMHSGEKRYKASD

SEQ ID NO: 813179 - protein, 789 aa, Homo sapiens
MGTLPHGPRPWLQRDVAAHVSADHAALNSIVSLQASVSFEDVTVDFSKEEWQHLDPAQRRLYWDVTLENYSHLLSVGYQIPKSEAAFKLEQGEGPWMLEGEAPHQSCSGEAIGKMQQQGIPGGIFFHCERFDQPIGEDSLCSILEELWQDNDQLEQRQENQNNLLSHVKVLIKERGYEHKNIEKIIHVTTKLVPSIKRLHNCDTILKHTLNSHNHNRNSATKNLGKIFGNGNNFPHSPSSTKNENAKTGANSCEHDHYEKHLSHKQAPTHHQKIHPEEKLYVCTECVMGFTQKSHLFEHQRIHAGEKSRECDKSNKVFPQKPQVDVHPSVYTGEKPYLCTQCGKVFTLKSNLITHQKIHTGQKPYKCSECGKAFFQRSDLFRHLRIHTGEKPYECSECGKGFSQNSDLSIHQKTHTGEKHYECNECGKAFTRKSALRMHQRIHTGEKPYVCADCGKAFIQKSHFNTHQRIHTGEKPYECSDCGKSFTKKSQLHVHQRIHTGEKPYICTECGKVFTHRTNLTTHQKTHTGEKPYMCAECGKAFTDQSNLIKHQKTHTGEKPYKCNGCGKAFIWKSRLKIHQKSHIGERHYECKDCGKAFIQKSTLSVHQRIHTGEKPYVCPECGKAFIQKSHFIAHHRIHTGEKPYECSDCGKCFTKKSQLRVHQKIHTGEKPNICAECGKAFTDRSNLITHQKIHTREKPYECGDCGKTFTWKSRLNIHQKSHTGERHYECSKCGKAFIQKATLSMHQIIHTGKKPYACTECQKAFTDRSNLIKHQKMHSGEKRYKASD

SEQ ID NO: 813180 - protein, 397 aa, Homo sapiens
MVKETTYYDVLGVKPNATQEELKKAYRKLALKYHPDKNPNEGEKFKQISQAYEVLSDAKKRELYDKGGEQAIKEGGAGGGFGSPMDIFDMFFGGGGRMQRERRGKNVVHQLSVTLEDLYNGATRKLALQKNVICDKCEGRGGKKGAVECCPNCRGTGMQIRIHQIGPGMVQQIQSVCMECQGHGERISPKDRCKSCNGRKIVREKKILEVHIDKGMKDGQKITFHGEGDQEPGLEPGDIIIVLDQKDHAVFTRRGEDLFMCMDIQLVEALCGFQKPISTLDNRTIVITSHPGQIVKHGDIKCVLNEGMPIYRRPYEKGRLIIEFKVNFPENGFLSPDKLSLLEKLLPERKEVEETDEMDQVELVDFDPNQERRRHYNGEAYEDDEHHPRGGVQCQTS

SEQ ID NO: 813181 - protein, 153 aa, Homo sapiens
MVKETTYYDVLGVKPNATQEELKKAYRKLALKYHPDKNPNEGEKFKQISQAYEVLSDAKKRELYDKGGEQAIKEGGAGGGFGSPMDIFDMFFGGGGRMQRERRGKKNLVFVQLTKVSCWSEQIFEKSPILNACLHVGIMLQTDHKLPLIYGVV

SEQ ID NO: 813182 - protein, 397 aa, Homo sapiens; identical to SEQ ID NO: 813180

SEQ ID NO: 813183 - protein, 397 aa, Homo sapiens; identical to SEQ ID NO: 813180

SEQ ID NO: 813184 - protein, 397 aa, Homo sapiens; identical to SEQ ID NO: 813180

SEQ ID NO: 813185 - protein, 396 aa, Homo sapiens
MVKETTYYDVLGVKPNATQEELKKAYRKLALKYHPDKNPNEGEKFKQISQAYEVLSDAKKRELYDKGGEQAIKEGGAGGGFGSPMDIFDMFFGGGGRMQRERRGKNVVHQLSVTLEDLYNGATRKLALQKNVICDKCEGRGGKKGAVECCPNCRGTGMQIRIHQIGPGMVQQIQSVCMECQGHGERISPKDRCKSCNGRKIVREKKILEVHIDKGMKDGQKITFHGEGDQEPGLEPGDIIIVLDQKDHAVFTRGLGDPFHMVYDKLAAFIKYALDLSMLDNLTWMRGDDDGQIVKHGDIKCVLNEGMPIYRRPYEKGRLIIEFKVNFPENGFLSPDKLSLLEKLLPERKEVEETDEMDQVELVDFDPNQERRRHYNGEAYEDDEHHPRGGVQCQTS

SEQ ID NO: 813186 - protein, 397 aa, Homo sapiens; identical to SEQ ID NO: 813180

SEQ ID NO: 813187 - protein, 397 aa, Homo sapiens; identical to SEQ ID NO: 813180

SEQ ID NO: 813188 - protein, 397 aa, Homo sapiens; identical to SEQ ID NO: 813180

SEQ ID NO: 813189 - protein, 397 aa, Homo sapiens; identical to SEQ ID NO: 813180

SEQ ID NO: 813190 - protein, 240 aa, Homo sapiens
MQIRIHQIGPGMVQQIQSVCMECQGHGERISPKDRCKSCNGRKIVREKKILEVHIDKGMKDGQKITFHGEGDQEPGLEPGDIIIVLDQKDHAVFTRRGEDLFMCMDIQLVEALCGFQKPISTLDNRTIVITSHPGQIVKHGDIKCVLNEGMPIYRRPYEKGRLIIEFKVNFPENGFLSPDKLSLLEKLLPERKEVEETDEMDQVELVDFDPNQERRRHYNGEAYEDDEHHPRGGVQCQTS

SEQ ID NO: 813191 - protein, 395 aa, Homo sapiens
LKARGATRGRIETGLSRNTGVGMYSVLVIRKPRQMNGGSRNGFKQISQAYEVLSDAKKRELYDKGGEQAIKEGGAGGGFGSPMDIFDMFFGGGGRMQRERRGKNVVHQLSVTLEDLYNGATRKLALQKNVICDKCEGRGGKKGAVECCPNCRGTGMQIRIHQIGPGMVQQIQSVCMECQGHGERISPKDRCKSCNGRKIVREKKILEVHIDKGMKDGQKITFHGEGDQEPGLEPGDIIIVLDQKDHAVFTRRGEDLFMCMDIQLVEALCGFQKPISTLDNRTIVITSHPGQIVKHGDIKCVLNEGMPIYRRPYEKGRLIIEFKVNFPENGFLSPDKLSLLEKLLPERKEVEETDEMDQVELVDFDPNQERRRHYNGEAYEDDEHHPRGGVQCQTS

SEQ ID NO: 813192 - protein, 313 aa, Homo sapiens
MDIFDMFFGGGGRMQRERRGKNVVHQLSVTLEDLYNGATRKLALQKNVICDKCEGRGGKKGAVECCPNCRGTGMQIRIHQIGPGMVQQIQSVCMECQGHGERISPKDRCKSCNGRKIVREKKILEVHIDKGMKDGQKITFHGEGDQEPGLEPGDIIIVLDQKDHAVFTRRGEDLFMCMDIQLVEALCGFQKPISTLDNRTIVITSHPGQIVKHGDIKCVLNEGMPIYRRPYEKGRLIIEFKVNFPENGFLSPDKLSLLEKLLPERKEVEETDEMDQVELVDFDPNQERRRHYNGEAYEDDEHHPRGGVQCQTS

SEQ ID NO: 813193 - protein, 375 aa, Homo sapiens
GRPNIRMVLQGQFPIRTQMKERFKQISQAYEVLSDAKKRELYDKGGEQAIKEGGAGGGFGSPMDIFDMFFGGGGRMQRERRGKNVVHQLSVTLEDLYNGATRKLALQKNVICDKCEGRGGKKGAVECCPNCRGTGMQIRIHQIGPGMVQQIQSVCMECQGHGERISPKDRCKSCNGRKIVREKKILEVHIDKGMKDGQKITFHGEGDQEPGLEPGDIIIVLDQKDHAVFTRRGEDLFMCMDIQLVEALCGFQKPISTLDNRTIVITSHPGQIVKHGDIKCVLNEGMPIYRRPYEKGRLIIEFKVNFPENGFLSPDKLSLLEKLLPERKEVEETDEMDQVELVDFDPNQERRRHYNGEAYEDDEHHPRGGVQCQTS

SEQ ID NO: 813194 - protein, 379 aa, Homo sapiens
MVKETTYYDVLGVKPNATQEELKKAYRKLALKYHPDKNPNEGEKFKQISQAYEVLSDAKSGGFGSPMDIFDMFFGGGGRMQRERRGKNVVHQLSVTLEDLYNGATRKLALQKNVICDKCEGRGGKKGAVECCPNCRGTGMQIRIHQIGPGMVQQIQSVCMECQGHGERISPKDRCKSCNGRKIVREKKILEVHIDKGMKDGQKITFHGEGDQEPGLEPGDIIIVLDQKDHAVFTRRGEDLFMCMDIQLVEALCGFQKPISTLDNRTIVITSHPGQIVKHGDIKCVLNEGMPIYRRPYEKGRLIIEFKVNFPENGFLSPDKLSLLEKLLPERKEVEETDEMDQVELVDFDPNQERRRHYNGEAYEDDEHHPRGGVQCQTS

SEQ ID NO: 813195 - protein, 240 aa, Homo sapiens; identical to SEQ ID NO: 813190

SEQ ID NO: 813196 - protein, 397 aa, Homo sapiens; identical to SEQ ID NO: 813180

SEQ ID NO: 813197 - protein, 397 aa, Homo sapiens; identical to SEQ ID NO: 813180

SEQ ID NO: 813198 - protein, 202 aa, Homo sapiens
SRGPLNGVGARHRFTVQGNGMKDGQKITFHGEGDQEPGLEPGDIIIVLDQKDHAVFTRRGEDLFMCMDIQLVEALCGFQKPISTLDNRTIVITSHPGQIVKHGDIKCVLNEGMPIYRRPYEKGRLIIEFKVNFPENGFLSPDKLSLLEKLLPERKEVEETDEMDQVELVDFDPNQERRRHYNGEAYEDDEHHPRGGVQCQTS

SEQ ID NO: 813199 - protein, 331 aa, Homo sapiens
MVKETTYYDVLGVKPNATQEELKKAYRKLALKYHPDKNPNEGEKFKQISQAYEVLSDAKKRELYDKGGEQAIKEGGAGGGFGSPMDIFDMFFGGGGRMQRERRGKNVVHQLSVTLEDLYNGATRKLALQKNVICDKCEGRGGKKGAVECCPNCRGTGMQIRIHQIGPGMVQQIQSVCMECQGHGERISPKDRCKSCNGRKIVREKKILEVHIDKGMKDGQKITFHGEGDQEPGLEPGDIIIVLDQKDHAVFTRRGEDLFMCMDIQLVEALCGFQKPISTLDNRTIVITSHPGQIVKHGDIKCVLNEGMPIYRRPYEKGRLIIEFKVSCNVL

SEQ ID NO: 813200 - protein, 396 aa, Homo sapiens; identical to SEQ ID NO: 813185

SEQ ID NO: 813201 - protein, 198 aa, Homo sapiens
MKLYSLSVLYKGEAKVVLLKAAYDVSSFSFFQRSSVQEFMTFTSQLIVERSSKGTRASVKEQDYLCHVYVRNDSLAGVVIADNEYPSRVAFTLLEKVLDEFSKQVDRIDWPVGSPATIHYPALDGHLSRYQNPREADPMTKVQAELDETKIILHNTMESLLERGEKLDDLVSKSEVLGTQSKAFYKTARKQNSCCAIM

SEQ ID NO: 813202 - protein, 164 aa, Homo sapiens
MKLYSLSVLYKGEAKVVLLKAAYDVSSFSFFQRSSVQEFMTFTSQLIVERSSKGTRASVKEQDYLCHVYVRNDSLAGVVIADNEYPSRVAFTLLEKVLDEFSKQVDRIDWPVGSPATIHYPALDGHLSRYQNPREADPMTKVQAELDETKIILARKQNSCCAIM

SEQ ID NO: 813203 - protein, 107 aa, Homo sapiens
MKLYSLSVLYKGEAKVVLLKAAYDVSSFSFFQRSSVQEFMTFTSQLIVERSSKGTRASVKEQDYLCHVYVRNDSLAGVVIADNEYPSRVAFTLLEKVSFLFASPGLG

SEQ ID NO: 813204 - protein, 198 aa, Homo sapiens; identical to SEQ ID NO: 813201

SEQ ID NO: 813205 - protein, 198 aa, Homo sapiens; identical to SEQ ID NO: 813201

SEQ ID NO: 813206 - protein, 198 aa, Homo sapiens; identical to SEQ ID NO: 813201

SEQ ID NO: 813207 - protein, 191 aa, Homo sapiens
MKLYSLSVLYKGEAKVVLLKAAYDVSSFSFFQRSSVQEFMTFTSQLIVERSSKGTRASVKEQDYLCHVYVRNDSLAGVVIADNEYPSRVAFTLLEKVLDEFSKQVDRIDWPVGSPATIHYPALDGHLSRYQNPREADPMTKVQAELDETKIILHNTMESLLERGEKLDDLVSKSEVLGTQSKAFYKTKIFN

SEQ ID NO: 813208 - protein, 198 aa, Homo sapiens; identical to SEQ ID NO: 813201

SEQ ID NO: 813209 - protein, 198 aa, Homo sapiens; identical to SEQ ID NO: 813201

SEQ ID NO: 813210 - protein, 158 aa, Homo sapiens
LGYEVVRVLLRPRLEASGHRIYDYLCHVYVRNDSLAGVVIADNEYPSRVAFTLLEKVLDEFSKQVDRIDWPVGSPATIHYPALDGHLSRYQNPREADPMTKVQAELDETKIILHNTMESLLERGEKLDDLVSKSEVLGTQSKAFYKTARKQNSCCAIM

SEQ ID NO: 813211 - protein, 161 aa, Homo sapiens
MKLYSLSVLYKGEAKVVLLKAAYDVSSFSFFQRSSVQEFMTFTSQLIVERSSKGTRASVKEQDYLCHVYVRNDSLAGVVIADNEYPSRVAFTLLEKVLDEFSKQVDRIDWPVGSPATIHYPALDGHLSRYQNPREADPMTKVQAELDETKIILVLFHPLGQ

SEQ ID NO: 813212 - protein, 164 aa, Homo sapiens; identical to SEQ ID NO: 813202

SEQ ID NO: 813213 - protein, 198 aa, Homo sapiens; identical to SEQ ID NO: 813201

SEQ ID NO: 813214 - protein, 198 aa, Homo sapiens; identical to SEQ ID NO: 813201

SEQ ID NO: 813215 - protein, 198 aa, Homo sapiens; identical to SEQ ID NO: 813201

SEQ ID NO: 813216 - protein, 84 aa, Homo sapiens
KTGGAYGEDLGSGPTSLSQVCDGNRYPVHVIEGDHRTLLEGSGLESIISIIHSSLAEPRVSVREGEARAALLRECPCPRFRTNK

SEQ ID NO: 813217 - protein, 198 aa, Homo sapiens; identical to SEQ ID NO: 813201

SEQ ID NO: 813218 - protein, 198 aa, Homo sapiens; identical to SEQ ID NO: 813201

SEQ ID NO: 813219 - protein, 198 aa, Homo sapiens; identical to SEQ ID NO: 813201

SEQ ID NO: 813220 - protein, 164 aa, Homo sapiens [sequence omitted]

SEQ ID NO: 813221 - protein, 141 aa, Homo sapiens
MKLYSLSVLYKGEAKVVLLKAAYDVSSFSFFQRSSVQEFMTFTSQLIVERSSKGTRASVKEQDYLCHVYVRNDSLAGVVIADNEYPSRVAFTLLEKVLDEFSKQVDRIDWPVGSPVLLCSVVNHLARLYFSNCCLTSLCSI

SEQ ID NO: 813222 - protein, 771 aa, Homo sapiens
MEEDKLLSAVPEEGDATRDPGPEPEEEPGVRNGMASEGLNSSLCSPGHERRGTPADTEEPTKDPDVAFHGLSLGLSLTNGLALGPDLNILEDSAESRPWRAGVLAEGDNASRSLYPDAEDPQLGLDGPGEPDVRDGFSATFEKILESELLRGTQYSSLDSLDGLSLTDESDSCVSFEAPLTPLIQQRARDSPEPGAGLGIGDMAFEGDMGAAGGDGELGSPLRRSISSSRSENVLSRLSLMAMPNGFHEDGPQGPGGDEDDDEEDTDKLLNSASDPSLKDGLSDSDSELSSSEGLEPGSADPLANGCQGVSEAAHRLARRLYHLEGFQRCDVARQLGKNNEFSRLVAGEYLSFFDFSGLTLDGALRTFLKAFPLMGETQERERVLTHFSRRYCQCNPDDSTSEDGIHTLTCALMLLNTDLHGHNIGKKMSCQQFIANLDQLNDGQDFAKDLLKTLYNSIKNEKLEWAIDEDELRKSLSELVDDKFGTGTKKVTRILDGGNPFLDVPQALSATTYKHGVLTRKTHADMDGKRTPRGRRGWKKFYAVLKGTILYLQKDEYRPDKALSEGDLKNAIRVHHALATRASDYSKKSNVLKLKTADWRVFLFQAPSKEEMLSWILRINLVAAIFSAPAFPAAVSSMKKFCRPLLPSCTTRLCQEEQLRSHENKLRQLTAELAEHRCHPVERGIKSKEAEEYRLKEHYLTFEKSRYETYIHLLAMKIKVGSDDLERIEARLATLEGDDPSLRKTHSSPALSQGHVTGSKTTKDATGPDT

SEQ ID NO: 813223 - protein, 771 aa, Homo sapiens; identical to SEQ ID NO: 813222

SEQ ID NO: 813224 - protein, 477 aa, Homo sapiens
MATYTCITCRVAFRDADMQRAHYKTDWHRYNLRRKVASMAPVTAEGFQERVRAQRAVAEEESKGSATYCTVCSKKFASFNAYENHLKSRRHVELEKKAVQAVNRKVEMMNEKNLEKGLGVDSVDKDAMNAAIQQAIKAQPSMSPKKAPPAPAKEARNVVAVGTGGRGTHDRDPSEKPPRLQWFEQQAKKLAKQQEEDSEEEEEDLDGDDWEDIDSDEELECEDTEAMDDVVEQDAEEEEAEEGPPLGAIPITDCLFCSHHSSSLMKNVAHMTKDHSFFIPDIEYLSDIKGLIKYLGEKVGVGKICLWCNEKGKSFYSTEAVQAHMNDKSHCKLFTDGDAALEFADFYDFRSSYPDHKEGEDPNKAEELPSEKNLEYDDETMELILPSGARVGHRSLMRYYKQRFGLSRAVAVAKNRKAVGRVLQQYRALGWTGSTGAALMRERDMQYVQRMKSKWMLKTGMKNNATKQMHFRVQVRF

SEQ ID NO: 813225 - protein, 477 aa, Homo sapiens; identical to SEQ ID NO: 813224

SEQ ID NO: 813226 - protein, 459 aa, Homo sapiens
MATYTCITCRVAFRDADMQRAHYKTDWHRYNLRRKVASMAPVTAEGFQERVRAQRAVAEEESKGSATYCTVCSKKFASFNAYENHLKSRRHVELEKKAVQAVNRKVEMMNEAAIQQAIKAQPSMSPKKAPPAPAKEARNVVAVGTGGRGTHDRDPSEKPPRLQWFEQQAKKLAKQQEEDSEEEEEDLDGDDWEDIDSDEELECEDTEAMDDVVEQDAEEEEAEEGPPLGAIPITDCLFCSHHSSSLMKNVAHMTKDHSFFIPDIEYLSDIKGLIKYLGEKVGVGKICLWCNEKGKSFYSTEAVQAHMNDKSHCKLFTDGDAALEFADFYDFRSSYPDHKEGEDPNKAEELPSEKNLEYDDETMELILPSGARVGHRSLMRYYKQRFGLSRAVAVAKNRKAVGRVLQQYRALGWTGSTGAALMRERDMQYVQRMKSKWMLKTGMKNNATKQMHFRVQVRF

SEQ ID NO: 813227 - protein, 285 aa, Homo sapiens
MATYTCITCRVAFRDADMQRAHYKTDWHRYNLRRKVASMAPVTAEGFQERVRAQRAVAEEESKGSATYCTVCSKKFASFNAYENHLKSRRHVELEKKAVQAVNRKVEMMNEKNLEKGLGVDSVDKDAMNAAIQQAIKAQPSMSPKKAPPAPAKEARNVVAVGTGGRGTHDRDPSEKPPRLQWFEQQAKKLAKQQEEDSEEEEEDLDGDDWEDIDSDEELECEDTEAMDDVVEQDAEEEEAEEGPPLGAIPITDCLFCSHHSSSLMKNVAHMTKDHSFSSLGGGSC

SEQ ID NO: 813228 - protein, 220 aa, Homo sapiens
MATYTCINESEERKSEGKRREEKRNRREERTTRTRHNNKTETRRETHTGTDKTHQHTKTRTTTTRAKNEKKKKQKNKHKRKEKRRTRKDKEDRKRKKRREDTKENREREREAERRRKERTKTIRGKTRRERKKGERNRAKRKRRSEEETKKKKKRERTNREEGRGKKREQKKREQKEEEKKADRKEEGEKKRKQKGRRKKRKESKTREEEGEANGRRKRD

SEQ ID NO: 813229 - protein, 794 aa, Homo sapiens
MELRPWLLWVVAATGTLVLLAADAQGQKVFTNTWAVRIPGGPAVANSVARKHGFLNLGQIFGDYYHFWHRGVTKRSLSPHRPRHSRLQREPQVQWLEQQVAKRRTKRDVYQEPTDPKFPQQWYLSGVTQRDLNVKAAWAQGYTGHGIVVSILDDGIEKNHPDLAGNYDPGASFDVNDQDPDPQPRYTQMNDNRHGTRCAGEVAAVANNGVCGVGVAYNARIGGVRMLDGEVTDAVEARSLGLNPNHIHIYSASWGPEDDGKTVDGPARLAEEAFFRGVSQGRGGLGSIFVWASGNGGREHDSCNCDGYTNSIYTLSISSATQFGNVPWYSEACSSTLATTYSSGNQNEKQIVTTDLRQKCTESHTGTSASAPLAAGIIALTLEANKNLTWRDMQHLVVQTSKPAHLNANDWATNGVGRKVSHSYGYGLLDAGAMVALAQNWTTVAPQRKCIIDILTEPKDIGKRLEVRKTVTACLGEPNHITRLEHAQARLTLSYNRRGDLAIHLVSPMGTRSTLLAARPHDYSADGFNDWAFMTTHSWDEDPSGEWVLEIENTSEANNYGTLTKFTLVLYGTAPEGLPVPPESSGCKTLTSSQACVVCEEGFSLHQKSCVQHCPPGFAPQVLDTHYSTENDVETIRASVCAPCHASCATCQGPALTDCLSCPSHASLDPVEQTCSRQSQSSRESPPQQQPPRLPPEVEAGQRLRAGLLPSHLPEVVAGLSCAFIVLVFVTVFLVLQLRSGFSFRGVKVYTMDRGLISYKGLPPEAWQEECPSDSEEDEGRGERTAFIKDQSAL

SEQ ID NO: 813230 - protein, 188 aa, Homo sapiens
PVRRQGPLRHSSMPEVVIVPEDLAQVEEPMLPQQWYLSGVTQRDLNVKAAWAQGYTGHGIVVSILDDGIEKNHPDLAGNYDPGASFDVNDQDPDPQPRYTQMNDNRHGTRCAGEVAAVANNGVCGVGVAYNARIGGVRMLDGEVTDAVEARSLGLNPNHIHIYSPLLSHPPALVASPAGFVRYWVGAQ

SEQ ID NO: 813231 - protein, 794 aa, Homo sapiens; identical to SEQ ID NO: 813229

SEQ ID NO: 813232 - protein, 707 aa, Homo sapiens
PVRRQGPLRHSSMPEVVIVPEDLAQVEEPMLPQQWYLSGVTQRDLNVKAAWAQGYTGHGIVVSILDDGIEKNHPDLAGNYDPGASFDVNDQDPDPQPRYTQMNDNRHGTRCAGEVAAVANNGVCGVGVAYNARIGGVRMLDGEVTDAVEARSLGLNPNHIHIYSASWGPEDDGKTVDGPARLAEEAFFRGVSQGRGGLGSIFVWASGNGGREHDSCNCDGYTNSIYTLSISSATQFGNVPWYSEACSSTLATTYSSGNQNEKQIVTTDLRQKCTESHTGTSASAPLAAGIIALTLEANKNLTWRDMQHLVVQTSKPAHLNANDWATNGVGRKVSHSYGYGLLDAGAMVALAQNWTTVAPQRKCIIDILTEPKDIGKRLEVRKTVTACLGEPNHITRLEHAQARLTLSYNRRGDLAIHLVSPMGTRSTLLAARPHDYSADGFNDWAFMTTHSWDEDPSGEWVLEIENTSEANNYGTLTKFTLVLYGTAPEGLPVPPESSGCKTLTSSQACVVCEEGFSLHQKSCVQHCPPGFAPQVLDTHYSTENDVETIRASVCAPCHASCATCQGPALTDCLSCPSHASLDPVEQTCSRQSQSSRESPPQQQPPRLPPEVEAGQRLRAGLLPSHLPEVVAGLSCAFIVLVFVTVFLVLQLRSGFSFRGVKVYTMDRGLISYKGLPPEAWQEECPSDSEEDEGRGERTAFIKDQSAL

SEQ ID NO: 813233 - protein, 602 aa, Homo sapiens
MHGTRCAGEVAAVANNGVCGVGVAYNARIGGVRMLDGEVTDAVEARSLGLNPNHIHIYSASWGPEDDGKTVDGPARLAEEAFFRGVSQGRGGLGSIFVWASGNGGREHDSCNCDGYTNSIYTLSISSATQFGNVPWYSEACSSTLATTYSSGNQNEKQIVTTDLRQKCTESHTGTSASAPLAAGIIALTLEANKNLTWRDMQHLVVQTSKPAHLNANDWATNGVGRKVSHSYGYGLLDAGAMVALAQNWTTVAPQRKCIIDILTEPKDIGKRLEVRKTVTACLGEPNHITRLEHAQARLTLSYNRRGDLAIHLVSPMGTRSTLLAARPHDYSADGFNDWAFMTTHSWDEDPSGEWVLEIENTSEANNYGTLTKFTLVLYGTAPEGLPVPPESSGCKTLTSSQACVVCEEGFSLHQKSCVQHCPPGFAPQVLDTHYSTENDVETIRASVCAPCHASCATCQGPALTDCLSCPSHASLDPVEQTCSRQSQSSRESPPQQQPPRLPPEVEAGQRLRAGLLPSHLPEVVAGLSCAFIVLVFVTVFLVLQLRSGFSFRGVKVYTMDRGLISYKGLPPEAWQEECPSDSEEDEGRGERTAFIKDQSAL

SEQ ID NO: 813234 - protein, 794 aa, Homo sapiens; identical to SEQ ID NO: 813229

SEQ ID NO: 813235 - protein, 438 aa, Homo sapiens
MQHLVVQTSKPAHLNANDWATNGVGRKVSHSYGYGLLDAGAMVALAQNWTTVAPQRKCIIDILTEPKEGWTQAGRGPVGPESRRGCPLVPLGQADHHGALLHRDIGKRLEVRKTVTACLGEPNHITRLEHAQARLTLSYNRRGDLAIHLVSPMGTRSTLLAARPHDYSADGFNDWAFMTTHSWDEDPSGEWVLEIENTSEANNYGTLTKFTLVLYGTAPEGLPVPPESSGCKTLTSSQACVVCEEGFSLHQKSCVQHCPPGFAPQVLDTHYSTENDVETIRASVCAPCHASCATCQGPALTDCLSCPSHASLDPVEQTCSRQSQSSRESPPQQQPPRLPPEVEAGQRLRAGLLPSHLPEVVAGLSCAFIVLVFVTVFLVLQLRSGFSFRGVKVYTMDRGLISYKGLPPEAWQEECPSDSEEDEGRGERTAFIKDQSAL

SEQ ID NO: 813236 - protein, 794 aa, Homo sapiens; identical to SEQ ID NO: 813229

SEQ ID NO: 813237 - protein, 794 aa, Homo sapiens; identical to SEQ ID NO: 813229

SEQ ID NO: 813238 - protein, 794 aa, Homo sapiens; identical to SEQ ID NO: 813229

SEQ ID NO: 813239 - protein, 794 aa, Homo sapiens; identical to SEQ ID NO: 813229

SEQ ID NO: 813240 - protein, 352 aa, Homo sapiens
MELRPWLLWVVAATGTLVLLAADAQGQKVFTNTWAVRIPGGPAVANSVARKHGFLNLGQIFGDYYHFWHRGVTKRSLSPHRPRHSRLQREPQVQWLEQQVAKRRTKRDVYQEPTDPKFPQQWYLSGVTQRDLNVKAAWAQGYTGHGIVVSILDDGIEKNHPDLAGNYDPGASFDVNDQDPDPQPRYTQMNDNRHGTRCAGEVAAVANNGVCGVGVAYNARIGGVRMLDGEVTDAVEARSLGLNPNHIHIYSASWGPEDDGKTVDGPARLAEEAFFRGVSQGRGGLGSIFVWASGNGGREHDSCNCDGYTNSIYTLSISSATQFGNVPWYSEALLLPGCPGPEVWGLQHVAEE

SEQ ID NO: 813241 - protein, 647 aa, Homo sapiens
MELRPWLLWVVAATGTLVLLAADAQGQKVFTNTWAVRIPGGPAVANSVARKHGFLNLGQIFGDYYHFWHRGVTKRSLSPHRPRHSRLQREPQVQWLEQQVAKRRTKRDVYQEPTDPKFPQQWYLSGVTQRDLNVKAAWAQGYTGHGIVVSILDDGIEKNHPDLAGNYDPGASFDVNDQDPDPQPRYTQMNDNRHGTRCAGEVAAVANNGVCGVGVAYNARIGGVRMLDGEVTDAVEARSLGLNPNHIHIYSASWGPEDDGKTVDGPARLAEEAFFRGVSQGRGGLGSIFVWASGNGGREHDSCNCDGYTNSIYTLSISSATQFGNVPWYSEACSSTLATTYSSGNQNEKQIVTTDLRQKCTESHTGTSASAPLAAGIIALTLEANKNLTWRDMQHLVVQTSKPAHLNANDWATNGVGRKVSHSYGYGLLDAGAMVALAQNWTTVAPQRKCIIDILTEPKDIGKRLEVRKTVTACLGEPNHITRLEHAQARLTLSYNRRGDLAIHLVSPMGTRSTLLAARPHDYSADGFNDWAFMTTHSWDEDPSGEWVLEIENTSEANNYGTLTKFTLVLYGTAPEGLPVPPESSGCKTLTSSQACVVCEEGSSLEQKSCVQQWTSRLTDHPRVLEYGTNRQRKNERWRNPSGAQRI

SEQ ID NO: 813242 - protein, 634 aa, Homo sapiens
MELRPWLLWVVAATGTLVLLAADAQGQKVFTNTWAVRIPGGPAVANSVARKHGFLNLGQIFGDYYHFWHRGVTKRSLSPHRPRHSRLQREPQVQWLEQQVAKRRTKRDVYQEPTDPKFPQQWYLSGVTQRDLNVKAAWAQGYTGHGIVVSILDDGIEKNHPDLAGNYDPGASFDVNDQDPDPQPRYTQMNDNRHGTRCAGEVAAVANNGVCGVGVAYNARIGGVRMLDGEVTDAVEARSLGLNPNHIHIYSASWGPEDDGKTVDGPARLAEEAFFRGVSQGRGGLGSIFVWASGNGGREHDSCNCDGYTNSIYTLSISSATQFGNVPWYSEACSSTLATTYSSGNQNEKQIVTTDLRQKCTESHTGTSASAPLAAGIIALTLEANKNLTWRDMQHLVVQTSKPAHLNANDWATNGVGRKVSHSYGYGLLDAGAMVALAQNWTTVAPQRKCIIDILTEPKDIGKRLEVRKTVTACLGEPNHITRLEHAQARLTLSYNRRGDLAIHLVSPMGTRSTLLAARPHDYSADGFNDWAFMTTHSWDEDPSGEWVLEIENTSEANNYGTLTKFTLVLYGTSASAPLAAGIIALTLEANKNLTWRDMQHLVVQTSKPAHLNANDWATNGVGRKVSHSYGYGL

SEQ ID NO: 813243 - protein, 377 aa, Homo sapiens
MELRPWLLWVVAATGTLVLLAADAQGQKVFTNTWAVRIPGGPAVANSVARKHGFLNLGQIFGDYYHFWHRGVTKRSLSPHRPRHSRLQREPQVQWLEQQVAKRRTKRDVYQEPTDPKFPQQWYLSGVTQRDLNVKAAWAQGYTGHGIVVSILDDGIEKNHPDLAGNYDPGASFDVNDQDPDPQPRYTQMNDNRHGTRCAGEVAAVANNGVCGVGVAYNARIGGVRMLDGEVTDAVEARSLGLNPNHIHIYSASWGPEDDGKTVDGPARLAEEAFFRGVSQGRGGLGSIFVWASGNGGREHDSCNCDGYTNSIYTLSISSATQFGNVPWYSEACSSTLATTYSKQHHEFAEQHHEFAEQHHEFAEQHHEFAEQNHEFA

SEQ ID NO: 813244 - protein, 921 aa, Homo sapiens
MATPSAAFEALMNGVTSWDVPEDAVPCELLLIGEASFPVMVNDMGQVLIAASSYGRGRLVVVSHEDYLVEAQLTPFLLNAVGWLCSSPGAPIGVHPSLAPLAKILEGSGVDAKVEPEVKDSLGVYCIDAYNETMTEKLVKFMKCGGGLLIGGQAWDWANQGEDERVLFTFPGNLVTSVAGIYFTDNKGDTSFFKVSKKMPKIPVLVSCEDDLSDDREELLHGISELDISNSDCFPSQLLVHGALAFPLGLDSYHGCVIAAARYGRGRVVVTGHKVLFTVGKLGPFLLNAVRWLDGGRRGKIVVQTELRTLSGLLAVGGIDTSIEPNLTSDASVYCFEPVSEVGVKELQEFVAEGGGLFVGAQAWWWAFKNPGVSPLARFPGNLLLNPFGISITSQSLNPGPFRTPKAGIRTYHFRSTLAEFQVIMGRKRGNVEKGWLAKLGPDGAAFLQIPAEEIPAYMSVHRLLRKLLSRYRLPVATRENPVINDCCRGAMLSLATGLAHSGSDLSLLVPEIEDMYSSPYLRPSESPITVEVNCTNPGTRYCWMSTGLYIPGRQIIEVSLPEAAASADLKIQIGCHTDDLTRASKLFRGPLVINRCCLDKPTKSITCLWGGLLYIIVPQNSKLGSVPVTVKGAVHAPYYKLGETTLEEWKRRIQENPGPWGELATDNIILTVPTANLRTLENPEPLLRLWDEVMQAVARLGAEPFPLRLPQRIVADVQISVGWMHAGYPIMCHLESVQELINEKLIRTKGLWGPVHELGRNQQRQEWEFPPHTTEATCNLWCVYVHETVLGIPRSRANIALWPPVREKRVRIYLSKGPNVKNWNAWTALETYLQLQEAFGWEPFIRLFTEYRNQTNLPTENVDKMNLWVKMFSHQVQKNLAPFFEAWAWPIQKEVATSLAYLPEWKENIMKLYLLTQMPH

SEQ ID NO: 813245 - protein, 967 aa, Homo sapiens
SFEPAALGTSLGGEAASSWEQPPPAPSRLLLPRTRAAGNSGANKTNRAMATPSAAFEALMNGVTSWDVPEDAVPCELLLIGEASFPVMVNDMGQVLIAASSYGRGRLVVVSHEDYLVEAQLTPFLLNAVGWLCSSPGAPIGVHPSLAPLAKILEGSGVDAKVEPEVKDSLGVYCIDAYNETMTEKLVKFMKCGGGLLIGGQAWDWANQGEDERVLFTFPGNLVTSVAGIYFTDNKGDTSFFKVSKKMPKIPVLVSCEDDLSDDREELLHGISELDISNSDCFPSQLLVHGALAFPLGLDSYHGCVIAAARYGRGRVVVTGHKVLFTVGKLGPFLLNAVRWLDGGRRGKIVVQTELRTLSGLLAVGGIDTSIEPNLTSDASVYCFEPVSEVGVKELQEFVAEGGGLFVGAQAWWWAFKNPGVSPLARFPGNLLLNPFGISITSQSLNPGPFRTPKAGIRTYHFRSTLAEFQVIMGRKRGNVEKGWLAKLGPDGAAFLQIPAEEIPAYMSVHRLLRKLLSRYRLPVATRENPVINDCCRGAMLSLATGLAHSGSDLSLLVPEIEDMYSSPYLRPSESPITVEVNCTNPGTRYCWMSTGLYIPGRQIIEVSLPEAAASADLKIQIGCHTDDLTRASKLFRGPLVINRCCLDKPTKSITCLWGGLLYIIVPQNSKLGSVPVTVKGAVHAPYYKLGETTLEEWKRRIQENPGPWGELATDNIILTVPTANLRTLENPEPLLRLWDEVMQAVARLGAEPFPLRLPQRIVADVQISVGWMHAGYPIMCHLESVQELINEKLIRTKGLWGPVHELGRNQQRQEWEFPPHTTEATCNLWCVYVHETVLGIPRSRANIALWPPVREKRVRIYLSKGPNVKNWNAWTALETYLQLQEAFGWEPFIRLFTEYRNQTNLPTENVDKMNLWVKMFSHQVQKNLAPFFEAWAWPIQKEVATSLAYLPEWKENIMKLYLLTQM

SEQ ID NO: 813246 - protein, 967 aa, Homo sapiens; identical to SEQ ID NO: 813245

SEQ ID NO: 813247 - protein, 776 aa, Homo sapiens
MVQLHQDTDPQIPKGQPCTLNSSEGGARPAVPHTLFSSALDRWLHNDSFIMAVGEPLVHIRVTLLLLWFGMFLSISGHSQARPSQYFTSPEVVIPLKVISRGRGAKAPGWLSYSLRFGGQRYIVHMRVNKLLFAAHLPVFTYTEQHALLQDQPFIQDDCYYHGYVEGVPESLVALSTCSGGFLGMLQINDLVYEIKPISVSATFEHLVYKIDSDDTQFPPMRCGLTEEKIAHQMELQLSYNFTLKQSSFVGWWTHQRFVELVVVVDNIRYLFSQSNATTVQHEVFNVVNIVDSFYHPLEVDVILTGIDIWTASNPLPTSGDLDNVLEDFSIWKNYNLNNRLQHDVAHLFIKDTQGMKLGVAYVKGICQNPFNTGVDVFEDNRLVVFAITLGHELGHNLGMQHDTQWCVCELQWCIMHAYRKVTTKFSNCSYAQYWDSTISSGLCIQPPPYPGNIFRLKYCGNLVVEEGEECDCGTIRQCAKDPCCLLNCTLHPGAACAFGICCKDCKFLPSGTLCRQQVGECDLPEWCNGTSHQCPDDVYVQDGISCNVNAFCYEKTCNNHDIQCKEIFGQDARSASQSCYQEINTQGNRFGHCGIVGTTYVKCWTPDIMCGRVQCENVGVIPNLIEHSTVQQFHLNDTTCWGTDYHLGMAIPDIGEVKDGTVCGPEKICIRKKCASMVHLSQACQPKTCNMRGICNNKQHCHCNHEWAPPYCKDKGYGGSADSGPPPKNNMEGLNVMGKLRYLSLLCLLPLVAFLLFCLHVLFKKRTKSKEDEEG

SEQ ID NO: 813248 - protein, 776 aa, Homo sapiens; identical to SEQ ID NO: 813247

SEQ ID NO: 813249 - protein, 776 aa, Homo sapiens; identical to SEQ ID NO: 813247

SEQ ID NO: 813250 - protein, 610 aa, Homo sapiens
MIASQFLSALTLVLLIKESGAWSYNTSTEAMTYDEASAYCQQRYTHLVAIQNKEEIEYLNSILSYSPSYYWIGIRKVNNVWVWVGTQKPLTEEAKNWAPGEPNNRQKDEDCVEIYIKREKDVGMWNDERCSKKKLALCYTAACTNTSCSGHGECVETINNYTCKCDPGFSGLKCEQIVNCTALESPEHGSLVCSHPLGNFSYNSSCSISCDRGYLPSSMETMQCMSSGEWSAPIPACNVVECDAVTNPANGFVECFQNPGSFPWNTTCTFDCEEGFELMGAQSLQCTSSGNWDNEKPTCKAVTCRAVRQPQNGSVRCSHSPAGEFTFKSSCNFTCEEGFMLQGPAQVECTTQGQWTQQIPVCEAFQCTALSNPERGYMNCLPSASGSFRYGSSCEFSCEQGFVLKGSKRLQCGPTGEWDNEKPTCEAVRCDAVHQPPKGLVRCAHSPIGEFTYKSSCAFSCEEGFELHGSTQLECTSQGQWTEEVPSCQVVKCSSLAVPGKINMSCSGEPVFGTVCKFACPEGWTLNGSAARTCGATGHWSGLLPTCEAPTESNIPLVAGLSAAGLSLLTLAPFLLWLRKCLRKAKKFVPASSCQSLESDGSYQKPSYIL

SEQ ID NO: 813251 - protein, 121 aa, Homo sapiens [sequence omitted]

SEQ ID NO: 813252 - protein, 1669 aa, Homo sapiens [sequence omitted]

SEQ ID NO: 813253 - protein, 1669 aa, Homo sapiens [sequence omitted]

SEQ ID NO: 813254 - protein, 1669 aa, Homo sapiens [sequence omitted]

SEQ ID NO: 813255 - protein, 738 aa, Homo sapiens
MRAQDIIGHHQSEDRETSDRAHDENKKKAKIQKKPIKKKKEDDVGIERGNIETTSEDGQVFSPKKGQKKKSIEKKRKKSKGDSDISDEEAAQQSKKKRGPRTPPITTKEELVEMCNGKNGILEDSQKKEDTAFSDWSDEDVPDRTEVTEAEHTATATTPGSTPSPLSSLLPPPPPVATATATTVPATLAATTAAAATSFSTSAITISTSATPTNTTNNTFANEDSHRKCHRTRVEKVETPHVTIEDAQHRKPMDQKRSSSLGSNRSNRSHTSGRLRSPSNDSAHRSGDDQSGRKRVLHSGSRDREKTKSLEITGERKSRIDQLKRGEPSRSTSSDRQDSRSHSSRRSSPESDRQVHSRSGSFDSRDRLQERDRYEHDRERERERRDTRQREWDRDADKDWPRNRDRDRLRERERERERDKRRDLDRERERLISDSVERDRDRDRDRTFESSQIESVKRCEAKLEGEHERDLESTSRDSLALDKERMDKDLGSVQGFEDTNKSERTESLEAGDDESKLDDAHSLGSGAGEGYEPISDDELDEILAGDAEKREDQQDEEKMPDPLDVIDVDWSGLMPKHPKEPREPGAALLKFTPGAVMLRVGISKKLAGSELFAKVKETCQRLLEKPKDADNLFEHELGALNMAALLRKEERASLLSNLGPCCKALCFRRDSAIRKQLVKNEKGTIKQAYTSAPMVDNELLRLSLRLFKRKTTCHAPGHEKTEDNKLSQSSIQQELCVS

SEQ ID NO: 813256 - protein, 1129 aa, Homo sapiens
SLPPASLPPVSLPPVVPATSRPVVPSTSRPSTSLPSTSLPSPFHQSPFHQQYHDSWETRSSYPERDRYPERDNRDQARDSSFERRHGERDRRDNRERDQRPSSPIRHQGRNDELERDERREERRVDRVDDRRDERARERDRERERDRERERERERERDREREKERELERERAREREREREKERDRERDRDRDHDRERERERERDREKEREREREERERERERERERERERERERERARERDKERERQRDWEDKDKGRDDRREKREEIREDRNPRDGHDERKSKKRYRNEGSPSPRQSPKRRREHSPDSDAYNSGDDKNEKHRLLSQVVRPQESRSLSPSHLTEDRQGRWKEEDRKPERKESSRRYEEQELKEKVSSVDKQREQTEILESSRMRAQDIIGHHQSEDRETSDRAHDENKKKAKIQKKPIKKKKEDDVGIERGNIETTSEDGQVFSPKKGQKKKSIEKKRKKSKGDSDISDEEAAQQSKKKRGPRTPPITTKEELVEMCNGKNGILEDSQKKEDTAFSDWSDEDVPDRTEVTEAEHTATATTPGSTPSPLSSLLPPPPPVATATATTVPATLAATTAAAATSFSTSAITISTSATPTNTTNNTFANEDSHRKCHRTRVEKVETPHVTIEDAQHRKPMDQKRSSSLGSNRSNRSHTSGRLRSPSNDSAHRSGDDQSGRKRVLHSGSRDREKTKSLEITGERKSRIDQLKRGEPSRSTSSDRQDSRSHSSRRSSPESDRQVHSRSGSFDSRDRLQERDRYEHDRERERERRDTRQREWDRDADKDWPRNRDRDRLRERERERERDKRRDLDRERERLISDSVERDRDRDRDRTFESSQIESVKRCEAKLEGEHERDLESTSRDSLALDKERMDKDLGSVQGFEDTNKSERTESLEAGDDESKLDDAHSLGSGAGEGYEPISDDELDEILAGDAEKREDQQDEEKMPDPLDVIDVDWSGLMPKHPKEPREPGAALLKFTPGAVMLRVGISKKLAGSELFAKVKETCQRLLEKPKDADNLFEHELGALNMAALLRKEERASLLSNLGPCCKALCFRRDSAIRKQLVKNEKGTIKQAYTSAPMVDNELLRLSLRLFKRKTTCHAPGHEKTEDNKLSQSSIQQELCVS

SEQ ID NO: 813257 - protein, 1564 aa, Homo sapiens
MSKIRRKVTVENTKTISDSTSRRPSVFERLGPSTGSTAETQCRNWLKTGNCLYGNTCRFVHGPSPRGKGYSSNYRRSPERPTGDLRERMKNKRQDVDTEPQKRNTEESSSPVRKESSRGRHREKEDIKITKERTPESEEENVEWETNRDDSDNGDINYDYVHELSLEMKRQKIQRELMKLEQENMEKREEIIIKKEVSPEVVRSKLSPSPSLRKSSKSPKRKSSPKSSSASKKDRKTSAVSSPLLDQQRNSKTNQSKKKGPRTPSPPPPIPEDIALGKKYKEKYKVKDRIEEKTRDGKDRGRDFERQREKRDKPRSTSPAGQHHSPISSRHHSSSSQSGSSIQRHSPSPRRKRTPSPSYQRTLTPPLRRSASPYPSHSLSSPQRKQSPPRHRSPMREKGRHDHERTSQSHDRRHERREDTRGKRDREKDSREEREYEQDQSSSRDHRDDREPRDGRDRRDARDTRDRRELRDSRDMRDSREMRDYSRDTKESRDPRDSRSTRDAHDYRDREGRDTHRKEDTYPEESRSYGRNHLREESSRTEIRNESRNESRSEIRNDRMGRSRGRVPELPEKGSRGSRGSQIDSHSSNSNYHDSWETRSSYPERDRYPERDNRDQARDSSFERRHGERDRRDNRERDQRPSSPIRHQGRNDELERDERREERRVDRVDDRRDERARERDRERERDRERERERERERDREREKERELERERAREREREREKERDRERDRDRDHDRERERERERDREKEREREREERERERERERERERERERERERARERDKERERQRDWEDKDKGRDDRREKREEIREDRNPRDGHDERKSKKRYRNEGSPSPRQSPKRRREHSPDSDAYNSGDDKNEKHRLLSQVVRPQESRSLSPSHLTEDRQGRWKEEDRKPERKESSRRYEEQELKEKVSSVDKQREQTEILESSRMRAQDIIGHHQSEDRETSDRAHDENKKKAKIQKKPIKKKKEDDVGIERGNIETTSEDGQVFSPKKGQKKKSIEKKRKKSKGDSDISDEEAAQQSKKKRGPRTPPITTKEELVEMCNGKNGILEDSQKKEDTAFSDWSDEDVPDRTEVTEAEHTATATTPGSTPSPLSSLLPPPPPVATATATTVPATLAATTAAAATSFSTSAITISTSATPTNTTNNTFANEDSHRKCHRTRVEKVETPHVTIEDAQHRKPMDQKRSSSLGSNRSNRSHTSGRLRSPSNDSAHRSGDDQSGRKRVLHSGSRDREKTKSLEITGERKSRIDQLKRGEPSRSTSSDRQDSRSHSSRRSSPESDRQVHSRSGSFDSRDRLQERDRYEHDRERERERRDTRQREWDRDADKDWPRNRDRDRLRERERERERDKRRDLDRERERLISDSVERDRDRDRDRTFESSQIESVKRCEAKLEGEHERDLESTSRDSLALDKERMDKDLGSVQGFEDTNKSERTESLEAGDDESKLDDAHSLGSGAGEGYEPISDDELDEILAGDAEKREDQQDEEKMPDPLDVIDVDWSGLMPKHPKEPREPGAALLKFTPGAVMLRVGISKKLAGSELFAKVKETCQRLLEKPKGSFILL

SEQ ID NO: 813258 - protein, 1657 aa, Homo sapiens
MSKIRRKVTVENTKTISDSTSRRPSVFERLGPSTGSTAETQCRNWLKTGNCLYGNTCRFVHGPSPRGKGYSSNYRRSPERPTGDLRERMKNKRQDVDTEPQKRNTEESSSPVRKESSRGRHREKEDIKITKERTPESEEENVEWETNRDDSDNGDINYDYVHELSLEMKRQKIQRELMKLEQENMEKREEIIIKKEVSPEVVRSKLSPSPSLRKSSKSPKRKSSPKSSSASKKDRKTSAVSSPLLDQQRNSKTNQSKKKGPRTPSPPPPIPEDIALGKKYKEKYKVKDRIEEKTRDGKDRGRDFERQREKRDKPRSTSPAGQHHSPISSRHHSSSSQSGSSIQRHSPSPRRKRTPSPSYQRTLTPPLRRSASPYPSHSLSSPQRKQSPPRHRSPMREKGRHDHERTSQSHDRRHERREDTRGKRDREKDSREEREYEQDQSSSRDHRDDREPRDGRDRRDARDTRDRRELRDSRDMRDSREMRDYSRDTKESRDPRDSRSTRDAHDYRDREGRDTHRKEDTYPEESRSYGRNHLREESSRTEIRNESRNESRSEIRNDRMGRSRGRVPELPEKGSRGSRGSQIDSHSSNSNYHDSWETRSSYPERDRYPERDNRDQARDSSFERRHGERDRRDNRERDQRPSSPIRHQGRNDELERDERREERRVDRVDDRRDERARERDRERERDRERERERERERDREREKERELERERAREREREREKERDRERDRDRDHDRERERERERDREKEREREREERERERERERERERERERERERARERDKERERQRDWEDKDKGRDDRREKREEIREDRNPRDGHDERKSKKRYRNEGSPSPRQSPKRRREHSPDSDAYNSGDDKNEKHRLLSQVVRPQESRSLSPSHLTEDRQGRWKEEDRKPERKESSRRYEEQELKEKVSSVDKQREQTEILESSRMRAQDIIGHHQSEDRETSDRAHDENKKKAKIQKKPIKKKKEDDVGIERGNIETTSEDGQVFSPKKGQKKKSIEKKRKKSKGDSDISDEEAAQQSKKKRGPRTPPITTKEELVEMCNGKNGILEDSQKKEDTAFSDRSRAYCHRHDILVVPLLLYLLFFLLHRLWLLPLLQLCLQTLAATTAAAATSFSTSAITISTSATPTNTTNNTFANEDSHRKCHRTRVEKVETPHVTIEDAQHRKPMDQKRSSSLGSNRSNRSHTSGRLRSPSNDSAHRSGDDQSGRKRVLHSGSRDREKTKSLEITGERKSRIDQLKRGEPSRSTSSDRQDSRSHSSRRSSPESDRQVHSRSGSFDSRDRLQERDRYEHDRERERERRDTRQREWDRDADKDWPRNRDRDRLRERERERERDKRRDLDRERERLISDSVERDRDRDRDRTFESSQIESVKRCEAKLEGEHERDLESTSRDSLALDKERMDKDLGSVQGFEDTNKSERTESLEAGDDESKLDDAHSLGSGAGEGYEPISDDELDEILAGDAEKREDQQDEEKMPDPLDVIDVDWSGLMPKHPKEPREPGAALLKFTPGAVMLRVGISKKLAGSELFAKVKETCQRLLEKPKDADNLFEHELGALNMAALLRKEERASLLSNLGPCCKALCFRRDSAIRKQLVKNEKGTIKQAYTSAPMVDNELLRLSLRLFKRKTTCHAPGHEKTEDNKLSQSSIQQELCVS

SEQ ID NO: 813259 - protein, 1446 aa, Homo sapiens
MSKIRRKVTVENTKTISDSTSRRPSVFERLGPSTGSTAETQCRNWLKTGNCLYGNTCRFVHGPSPRGKGYSSNYRRSPERPTGDLRERMKNKRQDVDTEPQKRNTEESSSPVRKESSRGRHREKEDIKITKERTPESEEENVEWETNRDDSDNGDINYDYVHELSLEMKRQKIQRELMKLEQENMEKREEIIIKKEVSPEVVRSKLSPSPSLRKSSKSPKRKSSPKSSSASKKDRKTSAVSSPLLDQQRNSKTNQSKKKGPRTPSPPPPIPEDIALGKKYKEKYKVKDRIEEKTRDGKDRGRDFERQREKRDKPRSTSPAGQHHSPISSRHHSSSSQSGSSIQRHSPSPRRKRTPSPSYQRTLTPPLRRSASPYPSHSLSSPQRKQSPPRHRSPMREKGRHDHERTSQSHDRRHERREDTRGKRDREKDSREEREYEQDQSSSRDHRDDREPRDGRDRRDARDTRDRRELRDSRDMRDSREMRDYSRDTKESRDPRDSRSTRDAHDYRDREGRDTHRKEDTYPEESRSYGRNHLREESSRTEIRNESRNESRSEIRNDRMGRSRGRVPELPEKGSRGSRGSQIDSHSSNSNYHDSWETRSSYPERDRYPERDNRDQARDSSFERRHGERDRRDNRERDQRPSSPIRHQGRNDELERDERREERRVDRVDDRRDERARERDRERERDRERERERERERDRERENLESSRMRAQDIIGHHQSEDRETSDRAHDENKKKAKIQKKPIKKKKEDDVGIERGNIETTSEDGQVFSPKKGQKKKSIEKKRKKSKGDSDISDEEAAQQSKKKRGPRTPPITTKEELVEMCNGKNGILEDSQKKEDTAFSDWSDEDVPDRTEVTEAEHTATATTPGSTPSPLSSLLPPPPPVATATATTVPATLAATTAAAATSFSTSAITISTSATPTNTTNNTFANEDSHRKCHRTRVEKVETPHVTIEDAQHRKPMDQKRSSSLGSNRSNRSHTSGRLRSPSNDSAHRSGDDQSGRKRVLHSGSRDREKTKSLEITGERKSRIDQLKRGEPSRSTSSDRQDSRSHSSRRSSPESDRQVHSRSGSFDSRDRLQERDRYEHDRERERERRDTRQREWDRDADKDWPRNRDRDRLRERERERERDKRRDLDRERERLISDSVERDRDRDRDRTFESSQIESVKRCEAKLEGEHERDLESTSRDSLALDKERMDKDLGSVQGFEDTNKSERTESLEAGDDESKLDDAHSLGSGAGEGYEPISDDELDEILAGDAEKREDQQDEEKMPDPLDVIDVDWSGLMPKHPKEPREPGAALLKFTPGAVMLRVGISKKLAGSELFAKVKETCQRLLEKPKDADNLFEHELGALNMAALLRKEERASLLSNLGPCCKALCFRRDSAIRKQLVKNEKGTIKQAYTSAPMVDNELLRLSLRLFKRKTTCHAPGHEKTEDNKLSQSSIQQELCVS

SEQ ID NO: 813260 - protein, 1051 aa, Homo sapiens
MSKIRRKVTVENTKTISDSTSRRPSVFERLGPSTGSTAETQCRNWLKTGNCLYGNTCRFVHGPSPRGKGYSSNYRRSPERPTGDLRERMKNKRQDVDTEPQKRNTEESSSPVRKESSRGRHREKEDIKITKERTPESEEENVEWETNRDDSDNGDINYDYVHELSLEMKRQKIQRELMKLEQENMEKREEIIIKKEVSPEVVRSKLSPSPSLRKSSKSPKRKSSPKSSSASKKDRKTSAVSSPLLDQQRNSKTNQSKKKGPRTPSPPPPIPEDIALGKKYKEKYKVKDRIEEKTRDGKDRGRDFERQREKRDKPRSTSPAGQHHSPISSRHHSSSSQSGSSIQRHSPSPRRKRTPSPSYQRTLTPPLRRSASPYPSHSLSSPQRKQSPPRHRSPMREKGRHDHERTSQSHDRRHERREDTRGKRDREKDSREEREYEQDQSSSRDHRDDREPRDGRDRRDARDTRDRRELRDSRDMRDSREMRDYSRDTKESRDPRDSRSTRDAHDYRDREGRDTHRKEDTYPEESRSYGRNHLREESSRTEIRNESRNESRSEIRNDRMGRSRGRVPELPEKGSRGSRGSQIDSHSSNSNYHDSWETRSSYPERDRYPERDNRDQARDSSFERRHGERDRRDNRERDQRPSSPIRHQGRNDELERDERREERRVDRVHSRSGSFDSRDRLQERDRYEHDRERERERRDTRQREWDRDADKDWPRNRDRDRLRERERERERDKRRDLDRERERLISDSVERDRDRDRDRTFESSQIESVKRCEAKLEGEHERDLESTSRDSLALDKERMDKDLGSVQGFEDTNKSERTESLEAGDDESKLDDAHSLGSGAGEGYEPISDDELDEILAGDAEKREDQQDEEKMPDPLDVIDVDWSGLMPKHPKEPREPGAALLKFTPGAVMLRVGISKKLAGSELFAKVKETCQRLLEKPKDADNLFEHELGALNMAALLRKEERASLLSNLGPCCKALCFRRDSAIRKQLVKNEKGTIKQAYTSAPMVDNELLRLSLRLFKRKTTCHAPGHEKTEDNKLSQSSIQQELCVS

SEQ ID NO: 813261 - protein, 1669 aa, Homo sapiens [sequence omitted]

SEQ ID NO: 813262 - protein, 740 aa, Homo sapiens
GRYYSKFAAASHQSEDRETSDRAHDENKKKAKIQKKPIKKKKEDDVGIERGNIETTSEDGQVFSPKKGQKKKSIEKKRKKSKGDSDISDEEAAQQSKKKRGPRTPPITTKEELVEMCNGKNGILEDSQKKEDTAFSDWSDEDVPDRTEVTEAEHTATATTPGSTPSPLSSLLPPPPPVATATATTVPATLAATTAAAATSFSTSAITISTSATPTNTTNNTFANEDSHRKCHRTRVEKVETPHVTIEDAQHRKPMDQKRSSSLGSNRSNRSHTSGRLRSPSNDSAHRSGDDQSGRKRVLHSGSRDREKTKSLEITGERKSRIDQLKRGEPSRSTSSDRQDSRSHSSRRSSPESDRQVHSRSGSFDSRDRLQERDRYEHDRERERERRDTRQREWDRDADKDWPRNRDRDRLRERERERERDKRRDLDRERERLISDSVERDRDRDRDRTFESSQIESVKRCEAKLEGEHERDLESTSRDSLALDKERMDKDLGSVQGFEDTNKSERTESLEAGDDESKLDDAHSLGSGAGEGYEPISDDELDEILAGDAEKREDQQDEEKMPDPLDVIDVDWSGLMPKHPKEPREPGAALLKFTPGAVMLRVGISKKLAGSELFAKVKETCQRLLEKPKDADNLFEHELGALNMAALLRKEERASLLSNLGPCCKALCFRRDSAIRKQLVKNEKGTIKQAYTSAPMVDNELLRLSLRLFKRKTTCHAPGHEKTEDNKLSQSSIQQELCVS

SEQ ID NO: 813263 - protein, 510 aa, Homo sapiens
RKRHLHRTKTASSSADEDAQHRKPMDQKRSSSLGSNRSNRSHTSGRLRSPSNDSAHRSGDDQSGRKRVLHSGSRDREKTKSLEITGERKSRIDQLKRGEPSRSTSSDRQDSRSHSSRRSSPESDRQVHSRSGSFDSRDRLQERDRYEHDRERERERRDTRQREWDRDADKDWPRNRDRDRLRERERERERDKRRDLDRERERLISDSVERDRDRDRDRTFESSQIESVKRCEAKLEGEHERDLESTSRDSLALDKERMDKDLGSVQGFEDTNKSERTESLEAGDDESKLDDAHSLGSGAGEGYEPISDDELDEILAGDAEKREDQQDEEKMPDPLDVIDVDWSGLMPKHPKEPREPGAALLKFTPGAVMLRVGISKKLAGSELFAKVKETCQRLLEKPKDADNLFEHELGALNMAALLRKEERASLLSNLGPCCKALCFRRDSAIRKQLVKNEKGTIKQAYTSAPMVDNELLRLSLRLFKRKTTCHAPGHEKTEDNKLSQSSIQQELCVS

SEQ ID NO: 813264 - protein, 696 aa, Homo sapiens
MSKIRRKVTVENTKTISDSTSRRPSVFERLGPSTGSTAETQCRNWLKTGNCLYGNTCRFVHGPSPRGKGYSSNYRRSPERPTGDLRERMKNKRQDVDTEPQKRNTEESSSPVRKESSRGRHREKEDIKITKERTPESEEENVEWETNRDDSDNGDINYDYVHELSLEMKRQKIQRELMKLEQENMEKREEIIIKKEVSPEVVRSKLSPSPSLRKSSKSPKRKSSPKSSSASKKDRKTSAVSSPLLDQQRNSKTNQSKKKGPRTPSPPPPIPEDIALGKKYKEKYKVKDRIEEKTRDGKDRGRDFERQREKRDKPRSTSPAGQHHSPISSRHHSSSSQSGSSIQRHSPSPRRKRTPSPSYQRTLTPPLRRSASPYPSHSLSSPQRKQSPPRHRSPMREKGRHDHERTSQSHDRRHERREDTRGKRDREKDSREEREYEQDQSSSRDHRDDREPRDGRDRRDARDTRDRRELRDSRDMRDSREMRDYSRDTKESRDPRDSRSTRDAHDYRDREGRDTHRKEDTYPEESRSYGRNHLREESSRTEIRNESRNESRSEIRNDRMGRSRGRVPELPEKGSRGSRGSQIDSHSSNSNYHDSWETRSSYPERDRYPERDNRDQARDSSFERRHGERDRRDNRERDQRPSSPIRHQGRNDELERDERREERRVDRVDDRRDERARERDRERERDNPAAQEVDAA

SEQ ID NO: 813265 - protein, 486 aa, Homo sapiens
MSKIRRKVTVENTKTISDSTSRRPSVFERLGPSTGSTAETQCRNWLKTGNCLYGNTCRFVHGPSPRGKGYSSNYRRSPERPTGDLRERMKNKRQDVDTEPQKRNTEESSSPVRKESSRGRHREKEDIKITKERTPESEEENVEWETNRDDSDNGDINYDYVHELSLEMKRQKIQRELMKLEQENMEKREEIIIKKEVSPEVVRSKLSPSPSLRKSSKSPKRKSSPKSSSASKKDRKTSAVSSPLLDQQRNSKTNQSKKKGPRTPSPPPPIPEDIALGKKYKEKYKVKDRIEEKTRDGKDRGRDFERQREKRDKPRSTSPAGQHHSPISSRHHSSSSQSGSSIQRHSPSPRRKRTPSPSYQRTLTPPLRRSASPYPSHSLSSPQRKQSPPRHRSPMREKGRHDHERTSQSHDRRHERREDTRGKRDREKDSREEREYEQDQSSSRDHRDDREPRDGRDRRDARDTRDRRELRDSRRYRSGEKIQRKI

SEQ ID NO: 813266 - protein, 252 aa, Homo sapiens
MSKIRRKVTVENTKTISDSTSRRPSVFERLGPSTGSTAETQCRNWLKTGNCLYGNTCRFVHGPSPRGKGYSSNYRRSPERPTGDLRERMKNKRQDVDTEPQKRNTEESSSPVRKESSRGRHREKEDIKITKERTPESEEENVEWETNRDDSDNGDINYDYVHELSLEMKRQKIQRELMKLEQENMEKREEIIIKKEVSPEVVRSKLSPSPSLRKSSKSPKRKSSPKSSSASKKDRKTSAVSSPLLDQQRSVG

SEQ ID NO: 813267 - protein, 62 aa, Homo sapiens
MRAQDIIGHHQSEDRETSDRAHDENKKKAKIQKKPIKKKKEDDVGIERGNIETTSEDGQVFS

SEQ ID NO: 813268 - protein, 1020 aa, Homo sapiens
AAATTLNSRPRQERRVDRVDDRRDERARERDRERERDRERERERERERDREREKERELERERAREREREREKERDRERDRDRDHDRERERERERDREKEREREREERERERERERERERERERERERARERDKERERQRDWEDKDKGRDDRREKREEIREDRNPRDGHDERKSKKRYRNEGSPSPRQSPKRRREHSPDSDAYNSGDDKNEKHRLLSQVVRPQESRSLSPSHLTEDRQGRWKEEDRKPERKESSRRYEEQELKEKVSSVDKQREQTEILESSRMRAQDIIGHHQSEDRETSDRAHDENKKKAKIQKKPIKKKKEDDVGIERGNIETTSEDGQVFSPKKGQKKKSIEKKRKKSKGDSDISDEEAAQQSKKKRGPRTPPITTKEELVEMCNGKNGILEDSQKKEDTAFSDWSDEDVPDRTEVTEAEHTATATTPGSTPSPLSSLLPPPPPVATATATTVPATLAATTAAAATSFSTSAITISTSATPTNTTNNTFANEDSHRKCHRTRVEKVETPHVTIEDAQHRKPMDQKRSSSLGSNRSNRSHTSGRLRSPSNDSAHRSGDDQSGRKRVLHSGSRDREKTKSLEITGERKSRIDQLKRGEPSRSTSSDRQDSRSHSSRRSSPESDRQVHSRSGSFDSRDRLQERDRYEHDRERERERRDTRQREWDRDADKDWPRNRDRDRLRERERERERDKRRDLDRERERLISDSVERDRDRDRDRTFESSQIESVKRCEAKLEGEHERDLESTSRDSLALDKERMDKDLGSVQGFEDTNKSERTESLEAGDDESKLDDAHSLGSGAGEGYEPISDDELDEILAGDAEKREDQQDEEKMPDPLDVIDVDWSGLMPKHPKEPREPGAALLKFTPGAVMLRVGISKKLAGSELFAKVKETCQRLLEKPKDADNLFEHELGALNMAALLRKEERASLLSNLGPCCKALCFRRDSAIRKQLVKNEKGTIKQAYTSAPMVDNELLRLSLRLFKRKTTCHAPGHEKTEDNKLSQSSIQQELCVS

SEQ ID NO: 813269 - protein, 1702 aa, Homo sapiens
MSKIRRKVTVENTKTISDSTSRRPSVFERLGPSTGSTAETQCRNWLKTGNCLYGNTCRFVHGPSPRGKGYSSNYRRSPERPTGDLRERMKNKRQDVDTEPQKRNTEESSSPVRKESSRGRHREKEDIKITKERTPESEEENVEWETNRDDSDNGDINYDYVHELSLEMKRQKIQRELMKLEQENMEKREEIIIKKEVSPEVVRSKLSPSPSLRKSSKSPKRKSSPKSSSASKKDRKTSAVSSPLLDQQRNSKTNQSKKKGPRTPSPPPPIPEDIALGKKYKEKYKVKDRIEEKTRDGKDRGRDFERQREKRDKPRSTSPAGQHHSPISSRHHSSSSQSGSSIQRHSPSPRRKRTPSPSYQRTLTPPLRRSASPYPSHSLSSPQRKQSPPRHRSPMREKGRHDHERTSQSHDRRHERREDTRGKRDREKDSREEREYEQDQSSSRDHRDDREPRDGRDRRDARDTRDRRELRDSRDMRDSREMRDYSRDTKESRDPRDSRSTRDAHDYRDREGRDTHRKEDTYPEESRSYGRNHLREESSRTEIRNESRNESRSEIRNDRMGRSRGRVPELPEKGSRGSRGSQIDSHSSNSNYHDSWETRSSYPERDRYPERDNRDQARDSSFERRHGERDRRDNRERDQRPSSPIRHQGRNDELERDERREERRVDRVDDRRDERARERDRERERDRERERERERERDREREKERELERERAREREREREKERDRERDRDRDHDRERERERERDREKEREREREERERERERERERERERERERERARERDKERERQRDWEDKDKGRDDRREKREEIREDRNPRDGHDERKSKKRYRNEGSPSPRQSPKRRREHSPDSDAYNSGDDKNEKHRLLSQVVRPQESRSLSPSHLTEDRQGRWKEEDRKPERKEKKRENKKESVLGNGREKEKKREIVKGIKNETTIESGKERGNETGKKNGNEKEKRERGKGLESSRMRAQDIIGHHQSEDRETSDRAHDENKKKAKIQKKPIKKKKEDDVGIERGNIETTSEDGQVFSPKKGQKKKSIEKKRKKSKGDSDISDEEAAQQSKKKRGPRTPPITTKEELVEMCNGKNGILEDSQKKEDTAFSDWSDEDVPDRTEVTEAEHTATATTPGSTPSPLSSLLPPPPPVATATATTVPATLAATTAAAATSFSTSAITISTSATPTNTTNNTFANEDSHRKCHRTRVEKVETPHVTIEDAQHRKPMDQKRSSSLGSNRSNRSHTSGRLRSPSNDSAHRSGDDQSGRKRVLHSGSRDREKTKSLEITGERKSRIDQLKRGEPSRSTSSDRQDSRSHSSRRSSPESDRQVHSRSGSFDSRDRLQERDRYEHDRERERERRDTRQREWDRDADKDWPRNRDRDRLRERERERERDKRRDLDRERERLISDSVERDRDRDRDRTFESSQIESVKRCEAKLEGEHERDLESTSRDSLALDKERMDKDLGSVQGFEDTNKSERTESLEAGDDESKLDDAHSLGSGAGEGYEPISDDELDEILAGDAEKREDQQDEEKMPDPLDVIDVDWSGLMPKHPKEPREPGAALLKFTPGAVMLRVGISKKLAGSELFAKVKETCQRLLEKPKDADNLFEHELGALNMAALLRKEERASLLSNLGPCCKALCFRRDSAIRKQLVKNEKGTIKQAYTSAPMVDNELLRLSLRLFKRKTTCHAPGHEKTEDNKLSQSSIQQELCVS

SEQ ID NO: 813270 - protein, 1669 aa, Homo sapiens [sequence omitted]

SEQ ID NO: 813271 - protein, 565 aa, Homo sapiens
MPQASEHRLGRTREPPVNIQPRVGSKLPFAPRARSKERRNPASGPNPMLRPLPPRPGLPDERLKKLELGRGRTSGPRPRGPLRADHGVPLPGSPPPTVALPLPSRTNLARSKSVSSGDLRPMGIALGGHRGTGELGAALSRLALRPEPPTLRRSTSLRRLGGFPGPPTLFSIRTEPPASHGSFHMISARSSEPFYSDDKMAHHTLLLGSGHVGLRNLGNTCFLNAVLQCLSSTRPLRDFCLRRDFRQEVPGGGRAQELTEAFADVIGALWHPDSCEAVNPTRFRAVFQKYVPSFSGYSQQDAQEFLKLLMERLHLEINRRGRRAPPILANGPVPSPPRRGGALLEEPELSDDDRANLMWKRYLEREDSKIVDLFVGQLKSCLKCQACGYRSTTFEVFCDLSLPIPKKGFAGGKVSLRDCFNLFTKEEELESENAPVCDRCRQKTRSTKKLTVQRFPRILVLHLNRFSASRGSIKKSSVGVDFPLQRLSLGDFASDKAGSPVYQLYALCNHSGSVHYGHYTALCRCQTGWHVYNDSRVSPVSENQVASSEGYVLFYQLMQEPPRCL

SEQ ID NO: 813272 - protein, 293 aa, Homo sapiens
MKHAWDGGGSGQHAVERLKCQVGYKELADCTLTFQAHHTLLLGSGHVGLRNLGNTCFLNAVLQCLSSTRPLRDFCLRRDFRQEVPGGGRAQELTEAFADVIGALWHPDSCEAVNPTRFRAVFQKYVPSFSGYSQQDAQEFLKLLMERLHLEINRRGRRAPPILANGPVPSPPRRGGALLEEPELSDDDRANLMWKRYLEREDSKIVDLFVGQLKSCLKCQACGYRSTTFEVFCDLSLPIPKVGFQRIPGWTGQGLCDPSLPTPRVWAGTLWVSGAELKPGLIEKSWKRKFRTC

SEQ ID NO: 813273 - protein, 551 aa, Homo sapiens
MPQASEHRLGRTREPPVNIQPRVGSKLPFAPRARSKERRNPASGPNPMLRPLPPRPGLPDERLKKLELGRGRTSGPRPRGPLRADHGVPLPGSPPPTVALPLPSRTNLARSKSVSSGDLRPMGIALGGHRGTGELGAALSRLALRPEPPTLRRSTSLRRLGGFPGPPTLFSIRTEPPASHGSFHMISARSSEPFYSDDKMAHHTLLLGSGHVGLRNLGNTCFLNAVLQCLSSTRPLRDFCLRRDFRQEVPGGGRAQELTEAFADVIGALWHPDSCEAVNPTRFRAVFQKYVPSFSGYSQQDAQEFLKLLMERLHLEINRRGRRAPPILANGPVPSPPRRGGALLEEPELSDDDRANLMWKRYLEREDSKIVDLFVGQLKSCLKCQACGYRSTTFEVFCDLSLPIPKKGFAGGKVSLRDCFNLFTKEEELESENAPVCDRCRQKTRSTKKLTVQRFPRILVLHLNRFSASRGSIKKSSVGVDFPLQRLSLGDFASDKAGSVHYGHYTALCRCQTGWHVYNDSRVSPVSENQVASSEGYVLFYQLMQEPPRCL

SEQ ID NO: 813274 - protein, 565 aa, Homo sapiens; identical to SEQ ID NO: 813271

SEQ ID NO: 813275 - protein, 565 aa, Homo sapiens; identical to SEQ ID NO: 813271

SEQ ID NO: 813276 - protein, 386 aa, Homo sapiens
MPQASEHRLGRTREPPVNIQPRVGSKLPFAPRARSKERRNPASGPNPMLRPLPPRPGLPDERLKKLELGRGRTSGPRPRGPLRADHGVPLPGSPPPTVALPLPSRTNLARSKSVSSGDLRPMGIALGGHRGTGELGAALSRLALRPEPPTLRRSTSLRRLGGFPGPPTLFSIRTEPPASHGSFHMISARSSEPFYSDDKMAHHTLLLGSGHVGLRNLGNTCFLNAVLQCLSSTRPLRDFCLRRDFRQEVPGGGRAQELTEAFADVIGALWHPDSCEAVNPTRFRAVFQKYVPSFSGYSQQDAQEFLKLLMERLHLEINRRGRRAPPILANGPVPSPPRRGGALLEEPELSDDDRANLMWKRYLEREDSKIVDLFVGQLKSCLKCQA

SEQ ID NO: 813277 - protein, 458 aa, Homo sapiens
MPQASEHRLGRTREPPVNIQPRVGSKLPFAPRARSKERRNPASGPNPMLRPLPPRPGLPDERLKKLELGRGRTSGPRPRGPLRADHGVPLPGSPPPTVALPLPSRTNLARSKSVSSGDLRPMGIALGGHRGTGELGAALSRLALRPEPPTLRRSTSLRRLGGFPGPPTLFSIRTEPPASHGSFHMISARSSEPFYSDDKMAHHTLLLGSGHVGLRNLGNTCFLNAVLQCLSSTRPLRDFCLRRDFRQEVPGGGRAQELTEAFADVIGALWHPDSCEAVNPTRFRAVFQKYVPSFSGYSQQDAQEFLKLLMERLHLEINRRGRRAPPILANGPVPSPPRRGGALLEEPELSDDDRANLMWKRYLEREDSKIVDLFVGQLKSCLKCQACGYRSTTFEVFCDLSLPIPKVGFQRIPGWTGQGLCDPSLPTPRVWAGTLWVSGAELKPGLIEKSWKRKFRTC

SEQ ID NO: 813278 - protein, 639 aa, Homo sapiens
MPQASEHRLGRTREPPVNIQPRVGSKLPFAPRARSKERRNPASGPNPMLRPLPPRPGLPDERLKKLELGRGRTSGPRPRGPLRADHGVPLPGSPPPTVALPLPSRTNLARSKSVSSGDLRPMGIALGGHRGTGELGAALSRLALRPEPPTLRRSTSLRRLGGFPGPPTLFSIRTEPPASHGSFHMISARSSEPFYSDDKMAHHTLLLGSGHVGLRNLGNTCFLNAVLQCLSSTRPLRDFCLRRDFRQEVPGGGRAQELTEAFADVIGALWHPDSCEAVNPTRFRAVFQKYVPSFSGYSQQDAQEFLKLLMERLHLEINRRGRRAPPILANGPVPSPPRRGGALLEEPELSDDDRANLMWKRYLEREDSKIVDLFVGQLKSCLKCQACGYRSTTFEVFCDLSLPIPKKGFAGGKVSLRDCFNLFTKEEELESENAPVCDRCRQKTRSTKKLTVQRFPRILVLHILIFRFLLLLGYLPYILFPPCFQRIEFSLGKVCHPLFHKMLPVCREWGEDSFQDRRSSPQRPTASQMLLNQGLDLNRFSASRGSIKKSSVGVDFPLQRLSLGDFASDKAGSPVYQLYALCNHSGSVHYGHYTALCRCQTGWHVYNDSRVSPVSENQVASSEGYVLFYQLMQEPPRCL

SEQ ID NO: 813279 - protein, 386 aa, Homo sapiens; identical to SEQ ID NO: 813276

SEQ ID NO: 813280 - protein, 381 aa, Homo sapiens
MISARSSEPFYSDDKMAHHTLLLGSGHVGLRNLGNTCFLNAVLQCLSSTRPLRDFCLRRDFRQEVPGGGRAQELTEAFADVIGALWHPDSCEAVNPTRFRAVFQKYVPSFSGYSQQDAQEFLKLLMERLHLEINRRGRRAPPILANGPVPSPPRRGGALLEEPELSDDDRANLMWKRYLEREDSKIVDLFVGQLKSCLKCQACGYRSTTFEVFCDLSLPIPKKGFAGGKVSLRDCFNLFTKEEELESENAPVCDRCRQKTRSTKKLTVQRFPRILVLHLNRFSASRGSIKKSSVGVDFPLQRLSLGDFASDKAGSPVYQLYALCNHSGSVHYGHYTALCRCQTGWHVYNDSRVSPVSENQVASSEGYVLFYQLMQEPPRCL

SEQ ID NO: 813281 - protein, 381 aa, Homo sapiens; identical to SEQ ID NO: 813280

SEQ ID NO: 813282 - protein, 458 aa, Homo sapiens; identical to SEQ ID NO: 813277

SEQ ID NO: 813283 - protein, 458 aa, Homo sapiens; identical to SEQ ID NO: 813277

SEQ ID NO: 813284 - protein, 305 aa, Homo sapiens [sequence omitted]

SEQ ID NO: 813285 - protein, 357 aa, Homo sapiens
PGSKMATVIPGPLSLGEDFYREAIEHCRSYNARLCAERSLRLPFLDSQTGVAQNNCYIWMEKTHRGPGLAPGQIYTYPARCWRKKRRLNILEDPRLRPCEYKIDCEAPLKKEGGLPEGPVLEALLCAETGEKKIELKEEETIMDCQKQQLLEFPHDLEVEDLEDDIPRRKNRAKGKAYGIGGLRKRQDTASLEDRDKPYVCDKFYKELAWVPEAQRKHTAKKAPDGTVIPNGYCDFCLGGSKKTGCPEDLISCADCGRSGHPSCLQFTVNMTAAVRTYRWQCIECKSCSLCGTSENDGASWAGLTPQDQLLFCDDCDRGYHMYCLSPPMAEPPEGSWSCHLCLRHLKEKASAYITLT

SEQ ID NO: 813286 - protein, 388 aa, Homo sapiens
MATAIQNPLKSLGEDFYREAIEHCRSYNARLCAERSLRLPFLDSQTGVAQNNCYIWMEKTHRGPGLAPGQIYTYPARCWRKKRRLNILEDPRLRPCEYKIDCEAPLKKEGGLPEGPVLEALLCAETGEKKIELKEEETIMDCQKQQLLEFPHDLEVEDLEDDIPRRKNRAKGKAYGIGGLRKRQDTASLEDRDKPYVCDICGKRYKNRPGLSYHYTHTHLAEEEGEENAERHALPFHRKNNHKQFYKELAWVPEAQRKHTAKKAPDGTVIPNGYCDFCLGGSKKTGCPEDLISCADCGRSGHPSCLQFTVNMTAAVRTYRWQCIECKSCSLCGTSENDDQLLFCDDCDRGYHMYCLSPPMAEPPEGSWSCHLCLRHLKEKASAYITLT

SEQ ID NO: 813287 - protein, 391 aa, Homo sapiens
PGSKMATVIPGPLSLGEDFYREAIEHCRSYNARLCAERSLRLPFLDSQTGVAQNNCYIWMEKTHRGPGLAPGQIYTYPARCWRKKRRLNILEDPRLRPCEYKIDCEAPLKKEGGLPEGPVLEALLCAETGEKKIELKEEETIMDCQKQQLLEFPHDLEVEDLEDDIPRRKNRAKGKAYGIGGLRKRQDTASLEDRDKPYVCDICGKRYKNRPGLSYHYTHTHLAEEEGEENAERHALPFHRKNNHKQFYKELAWVPEAQRKHTAKKAPDGTVIPNGYCDFCLGGSKKTGCPEDLISCADCGRSGHPSCLQFTVNMTAAVRTYRWQCIECKSCSLCGTSENDDQLLFCDDCDRGYHMYCLSPPMAEPPEGSWSCHLCLRHLKEKASAYITLT

SEQ ID NO: 813288 - protein, 420 aa, Homo sapiens
SCFLFGIPDSTLVDLQAMGPLTLTLAQTPGRRCATAVAGAQLHLGEDFYREAIEHCRSYNARLCAERSLRLPFLDSQTGVAQNNCYIWMEKTHRGPGLAPGQIYTYPARCWRKKRRLNILEDPRLRPCEYKIDCEAPLKKEGGLPEGPVLEALLCAETGEKKIELKEEETIMDCQKQQLLEFPHDLEVEDLEDDIPRRKNRAKGKAYGIGGLRKRQDTASLEDRDKPYVCDICGKRYKNRPGLSYHYTHTHLAEEEGEENAERHALPFHRKNNHKQFYKELAWVPEAQRKHTAKKAPDGTVIPNGYCDFCLGGSKKTGCPEDLISCADCGRSGHPSCLQFTVNMTAAVRTYRWQCIECKSCSLCGTSENDDQLLFCDDCDRGYHMYCLSPPMAEPPEGSWSCHLCLRHLKEKASAYITLT

SEQ ID NO: 813289 - protein, 192 aa, Homo sapiens
GWRRQGPGGADRPSWLARSPVCGKRYKNRPGLSYHYTHTHLAEEEGEENAERHALPFHRKNNHKPKKAPDGTVIPNGYCDFCLGGSKKTGCPEDLISCADCGRSGHPSCLQFTVNMTAAVRTYRWQCIECKSCSLCGTSENDDQLLFCDDCDRGYHMYCLSPPMAEPPEGSWSCHLCLRHLKEKASAYITLT

SEQ ID NO: 813290 - protein, 323 aa, Homo sapiens
MATAIQNPLKSLGEDFYREAIEHCRSYNARLCAERSLRLPFLDSQTGVAQNNCYIWMEKTHRGPGLAPGQIYTYPARCWRKKRRLNILEDPRLRPCEYKIDCEAPLKKEGGLPEGPVLEALLCAETGEKKIELKEEETIMDCQKQQLLEFPHDLEVEDLEDDIPRRKNRAKGKAYGIGGLRKRQDTASLEDRDKPYVCDICGKRYKNRPGLSYHYTHTHLAEEEGEENAERHALPFHRKNNHKPHKQFPRIAWVLSQGTPARRARGRIPGTVILPGARKGPRTTPGRGEGPCYIRIGRTTGDSVAEGALYGLSNTYVSPLNDR

SEQ ID NO: 813291 - protein, 1068 aa, Homo sapiens
HKSVITWRVNRSGGGESGLPALGRGRVPASAIPERQFPSLGSEENLPRPSPPRLREGTMAVPRGNQGLALLLRLDCSGVIMPHCSLDLPGLKQSSHFSLQSAGTTVWLSSWAESPKKDVTGADATAEPMILEQYVVVSNYKKQENSELSLQAGEVVDVIEKNESGWWFVSTSEEQGWVPATYLEAQNGTRDDSDINTSKTGEEEKYVTVQPYTSQSKDEIGFEKGVTVEVIRKNLEGWWYIRYLGKEGWAPASYLKKAKDDLPTRKKNLAGPVEIIGNIMEISNLLNKKASGDKETPPAEGEGHEAPIAKKEISLPILCNASNGSAVGVPDRTVSRLAQGSPAVARIAPQRAQISSPNLRTRPPPRRESSLGFQLPKPPEPPSVEVEYYTIAEFQSCISDGISFRGGQKAEVIDKNSGGWWYVQIGEKEGWAPASYIDKRKKPNLSRRTSTLTRPKVPPPAPPSKPKEAEEGPTGASESQDSPRKLKYEEPEYDIPAFGFDSEPELSEEPVEDRASGERRPAQPHRPSPASSLQRARFKVGESSEDVALEEETIYENEGFRPYAEDTLSARGSSGDSDSPGSSSLSLTRKNSPKSGSPKSSSLLKLKAEKNAQAEMGKNHSSASFSSSITINTTCCSSSSSSSSSLSKTSGDLKPRSASDAGIRGTPKVRAKKDADANAGLTSCPRAKPSVRPKPFLNRAESQSQEKMDISTLRRQLRPTGQLRGGLKGSKSEDSELPPQTASEAPSEGSRRSSSDLITLPATTPPCPTKKEWEGPATSYMTCSAYQKVQDSEISFPAGVEVQVLEKQESGWWYVRFGELEGWAPSHYLVLDENEQPDPSGKELDTVPAKGRQNEGKSDSLEKIERRVQALNTVNQSKKATPPIPSKPPGGFGKTSGTPAVKMRNGVRQVAVRPQSVFVSPPPKDNNLSCALRRNESLTATDGLRGVRRNSSFSTARSAAAEAKGRLAERAASQGSDSPLLPAQRNSIPVSPVRPKPIEKSQFIHNNLKDVYVSIADYEGDEETAGFQEGVSMEVLERNPNGWWYCQILDGVKPFKGWVPSNYLEKKN

SEQ ID NO: 813292 - protein, 1018 aa, Homo sapiens
PQALVRLPPHISQCDEVFRFFEARPEDVNPPKEDYGSSKRKSGADATAEPMILEQYVVVSNYKKQENSELSLQAGEVVDVIEKNESGWWFVSTSEEQGWVPATYLEAQNGTRDDSDINTSKTGEVSKRRKAHLRRLDRRWTLGGMVNRQHSREEKYVTVQPYTSQSKDEIGFEKGVTVEVIRKNLEGWWYIRYLGKEGWAPASYLKKAKDDLPTRKKNLAGPVEIIGNIMEISNLLNKKASGDKETPPAEGEGHEAPIAKKEISLPILCNASNGSAVGVPDRTVSRLAQGSPAVARIAPQRAQISSPNLRTRPPPRRESSLGFQLPKPPEPPSVEVEYYTIAEFQSCISDGISFRGGQKAEVIDKNSGGWWYVQIGEKEGWAPASYIDKRKKPNLSRRTSTLTRPKVPPPAPPSKPKEAEEGPTGASESQDSPRKLKYEEPEYDIPAFGFDSEPELSEEPVEDRASGERRPAQPHRPSPASSLQRARFKVGESSEDVALEEETIYENEGFRPYAEDTLSARGSSGDSDSPGSSSLSLTRKNSPKSGSPKSSSLLKLKAEKNAQAEMGKNHSSASFSSSITINTTCCSSSSSSSSSLSKTSGDLKPRSASDAGIRGTPKVRAKKDADANAGLTSCPRAKPSVRPKPFLNRAESQSQEKMDISTLRRQLRPTGQLRGGLKGSKSEDSELPPQTASEAPSEGSRRSSSDLITLPATTPPCPTKKEWEGPATSYMTCSAYQKVQDSEISFPAGVEVQVLEKQESGWWYVRFGELEGWAPSHYLVLDENEQPDPSGKELDTVPAKGRQNEGKSDSLEKIERRVQALNTVNQSKKATPPIPSKPPGGFGKTSGTPAVKMRNGVRQVAVRPQSVFVSPPPKDNNLSCALRRNESLTATDGLRGVRRNSSFSTARSAAAEAKGRLAERAASQGSDSPLLPAQRNSIPVSPVRPKPIEKSQFIHNNLKDVYVSIADYEGDEETAGFQEGVSMEVLERNPNGWWYCQILDGVKPFKGWVPSNYLEKKN

SEQ ID NO: 813293 - protein, 213 aa, Homo sapiens
HRSLSMVGCFGPGGKLDWLLGCWLLATDGRTETLDATPKTSGTPAVKMRNGVRQVAVRPQSVFVSPPPKDNNLSCALRRNESLTATDGLRGVRRNSSFSTARSAAAEAKGRLAERAASQGSDSPLLPAQRNSIPVSPVRPKPIEKSQFIHNNLKDVYVSIADYEGDEETAGFQEGVSMEVLERNPNGWWYCQILDGVKPFKGWVPSNYLEKKN

SEQ ID NO: 813294 - protein, 961 aa, Homo sapiens
PQALVRLPPHISQCDEVFRFFEARPEDVNPPKEDYGSSKRKSGADATAEPMILEQYVVVSNYKKQENSELSLQAGEVVDVIEKNESGWWFVSTSEEQGWVPATYLEAQNGTRDDSDINTSKTGEVSKRRKAHLRRLDRRWTLGGMVNRQHSREEKYVTVQPYTSQSKDEIGFEKGVTVEVIRKNLEGWWYIRYLGKEGWAPASYLKKAKDDLPTRKKNLAGPVEIIGNIMEISNLLNKKASGDKETPPAEGEGHEAPIAKKEISLPILCNASNGSAVGVPDRTVSRLAQGSPAVARIAPQRAQISSPNLRTRPPPRRESSLGFQLPKPPEPPSVEVEYYTIAEFQSCISDGISFRGGQKAEVIDKNSGGWWYVQIGEKEGWAPASYIDKRKKPNLSRRTSTLTRPKVPPPAPPSKPKEAEEGPTGASESQDSPRKLKYEEPEYDIPAFGFDSEPELSEEPVEDRASGERRPAQPHRPSPASSLQRARFKVGESSEDVALEEETIYENEGFRPYAEDTLSARGSSGDSDSPGSSSLSLTRKNSPKSGSPKSSSLLKLKAEKNAQAEMGKNHSSASFSSSITINTTCCSSSSSSSSSLSKTSGDLKPRSASDAGIRGTPKVRAKKDADANAGLTSCPRAKPSVRPKPFLNRAESQSQEKMDISTLRRQLRPTGQLRGGLKGSKSEDSELPPQTASEAPSEGSRRSSSDLITLPATTPPCPTKKEWEGPATSYMTCSAYQKVQDSEISFPAGVEVQVLEKQESGWWYVRFGELEGWAPSHYLVLDENEQPDPSGKELDTVPAKGRQNEGKSDSLEKIERRVQALNTVNQSKKATPPIPSKPPGGFGKTSGTPAVKMRNGVRQVAVRPQSVFVSPPPKDNNLSCALRRNESLTATDGLRGVRRNSSFSTARSAAAEAKGRLPAAGAASSPSAPGTLRSHRLTERRASSASRRSDGRRRAVKERGR

SEQ ID NO: 813295 - protein, 379 aa, Homo sapiens
KGGRLSLRAESESHSAPHPLSGTAYQTKVPKAVTSRPAARRPPPSARHGRRVQCPLGAPGTRRKRQVLPAAAAAAAAACSPGTRPAALGSRSSVSPENQPSRAMGTRLPLVLRQLRRPPQPPGPPRRLRVPCRASSGGGGGGGGGREGLLGQRRPQDGQARSSCSPGGRTPAARDSIVREVIQNSKEVLSLLQEKNPAFKPVLAIIQAGDDNLMQEINQNLAEEAGLNITHICLPPDSSEAEIIDEILKINEDTRVHGLALQISENLFSNKVLNALKPEKDVDGVTDINLGKLVRGDAHECFVSPVAKAVIELLEKSVGVNLDGKKILVVGAHGSLEAALQCLFQRKGSMTMSIQWKTRQLQSKTESRSVTRLECRRVI

SEQ ID NO: 813296 - protein, 1082 aa, Homo sapiens
KGGRLSLRAESESHSAPHPLSGTAYQTKVPKAVTSRPAARRPPPSARHGRRVQCPLGAPGTRRKRQVLPAAAAAAAAACSPGTRPAALGSRSSVSPENQPSRAMGTRLPLVLRQLRRPPQPPGPPRRLRVPCRASSGGGGGGGGGREGLLGQRRPQDGQARSSCSPGGRTPAARDSIVREVIQNSKEVLSLLQEKNPAFKPVLAIIQAGDDNLMQEINQNLAEEAGLNITHICLPPDSSEAEIIDEILKINEDTRVHGLALQISENLFSNKVLNALKPEKDVDGVTDINLGKLVRGDAHECFVSPVAKAVIELLEKSVGVNLDGKKILVVGAHGSLEAALQCLFQRKGSMTMSIQWKTRQLQSKLHEADIVVLGSPKPEEIPLTWIQPGTTVLNCSHDFLSGKVGCGSPRIHFGGLIEEDDVILLAAALRIQNMVSSGRRWLREQQHRRWRLHCLKLQPLSPVPSDIEISRGQTPKAVDVLAKEIGLLADEIEIYGKSKAKVRLSVLERLKDQADGKYVLVAGITPTPLGEGKSTVTIGLVQALTAHLNVNSFACLRQPSQGPTFGVKGGAAGGGYAQVIPMEEFNLHLTGDIHAITAANNLLAAAIDTRILHENTQTDKALYNRLVPLVNGVREFSEIQLARLKKLGINKTDPSTLTEEEVSKFARLDIDPSTITWQRVLDTNDRFLRKITIGQGNTEKGHYRQAQFDIAVASEIMAVLALTDSLADMKARLGRMVVASDKSGQPVTADDLGVTGALTVLMKDAIKPNLMQTLEGTPVFVHAGPFANIAHGNSSVLADKIALKLVGEEGFVVTEAGFGADIGMEKFFNIKCRASGLVPNVVVLVATVRALKMHGGGPSVTAGVPLKKEYTEENIQLVADGCCNLQKQIQITQLFGVPVVVALNVFKTDTRAEIDLVCELAKRAGAFDAVPCYHWSVGGKGSVDLARAVREAASKRSRFQFLYDVQVPIVDKIRTIAQAVYGAKDIELSPEAQAKIDRYTQQGFGNLPICMAKTHLSLSHQPDKKGVPRDFILPISDVRASIGAGFIYPLVGTMSTMPGLPTRPCFYDIDLDTETEQVKGLF

SEQ ID NO: 813297 - protein, 361 aa, Homo sapiens
KGGRLSLRAESESHSAPHPLSGTAYQTKVPKAVTSRPAARRPPPSARHGRRVQCPLGAPGTRRKRQVLPAAAAAAAAACSPGTRPAALGSRSSVSPENQPSRAMGTRLPLVLRQLRRPPQPPGPPRRLRVPCRASSGGGGGGGGGREGLLGQRRPQDGQARSSCSPGGRTPAARDSIVREVIQNSKEVLSLLQEKNPAFKPVLAIIQAGDDNLMQEINQNLAEEAGLNITHICLPPDSSEAEIIDEILKINEDTRVHGLALQISENLFSNKVLNALKPEKDVDGVTDINLGKLVRGDAHECFVSPVAKAVIELLEKSVGVNLDGKKILVVGAHGSLEAALQCLFQRKGSMTMSIQWCRRVI

SEQ ID NO: 813298 - protein, 869 aa, Homo sapiens
MQEINQNLAEEAGLNITHICLPPDSSEAEIIDEILKINEDTRVHGLALQISENLFSNKVLNALKPEKDVDGVTDINLGKLVRGDAHECFVSPVAKAVIELLEKSVGVNLDGKKILVVGAHGSLEAALQCLFQRKGSMTMSIQWKTRQLQSKLHEADIVVLGSPKPEEIPLTWIQPGTTVLNCSHDFLSGKVGCGSPRIHFGGLIEEDDVILLAAALRIQNMVSSGRRWLREQQHRRWRLHCLKLQPLSPVPSDIEISRGQTPKAVDVLAKEIGLLADEIEIYGKSKAKVRLSVLERLKDQADGKYVLVAGITPTPLGEGKSTVTIGLVQALTAHLNVNSFACLRQPSQGPTFGVKGGAAGGGYAQVIPMEEFNLHLTGDIHAITAANNLLAAAIDTRILHENTQTDKALYNRLVPLVNGVREFSEIQLARLKKLGINKTDPSTLTEEEVSKFARLDIDPSTITWQRVLDTNDRFLRKITIGQGNTEKGHYRQAQFDIAVASEIMAVLALTDSLADMKARLGRMVVASDKSGQPVTADDLGVTGALTVLMKDAIKPNLMQTLEGTPVFVHAGPFANIAHGNSSVLADKIALKLVGEEGFVVTEAGFGADIGMEKFFNIKCRASGLVPNVVVLVATVRALKMHGGGPSVTAGVPLKKEYTEENIQLVADGCCNLQKQIQITQLFGVPVVVALNVFKTDTRAEIDLVCELAKRAGAFDAVPCYHWSVGGKGSVDLARAVREAASKRSRFQFLYDVQVPIVDKIRTIAQAVYGAKDIELSPEAQAKIDRYTQQGFGNLPICMAKTHLSLSHQPDKKGVPRDFILPISDVRASIGAGFIYPLVGTMSTMPGLPTRPCFYDIDLDTETEQVKGLF

SEQ ID NO: 813299 - protein, 649 aa, Homo sapiens
MVSSGRRWLREQQHRRWRLHCLKLQPLSPVPSDIEISRGQTPKAVDVLAKEIGLLADEIEIYGKSKAKVRLSVLERLKDQADGKYVLVAGITPTPLGEGKSTVTIGLVQALTAHLNVNSFACLRQPSQGPTFGVKGGAAGGGYAQVIPMEEFNLHLTGDIHAITAANNLLAAAIDTRILHENTQTDKALYNRLVPLVNGVREFSEIQLARLKKLGINKTDPSTLTEEEVSKFARLDIDPSTITWQRVLDTNDRFLRKITIGQGNTEKGHYRQAQFDIAVASEIMAVLALTDSLADMKARLGRMVVASDKSGQPVTADDLGVTGALTVLMKDAIKPNLMQTLEGTPVFVHAGPFANIAHGNSSVLADKIALKLVGEEGFVVTEAGFGADIGMEKFFNIKCRASGLVPNVVVLVATVRALKMHGGGPSVTAGVPLKKEYTEENIQLVADGCCNLQKQIQITQLFGVPVVVALNVFKTDTRAEIDLVCELAKRAGAFDAVPCYHWSVGGKGSVDLARAVREAASKRSRFQFLYDVQVPIVDKIRTIAQAVYGAKDIELSPEAQAKIDRYTQQGFGNLPICMAKTHLSLSHQPDKKGVPRDFILPISDVRASIGAGFIYPLVGTMSTMPGLPTRPCFYDIDLDTETEQVKGLF

SEQ ID NO: 813300 - protein, 639 aa, Homo sapiens
RNSKARREKHFNLGHLFAPGNGEWAIRPDFYPVQPAFIQSFHIVILGLDCAGKTTVLYRLQFNEFVNTIPTKGFNTEKIRITPTPLGEGKSTVTIGLVQALTAHLNVNSFACLRQPSQGPTFGVKGGAAGGGYAQVIPMEEFNLHLTGDIHAITAANNLLAAAIDTRILHENTQTDKALYNRLVPLVNGVREFSEIQLARLKKLGINKTDPSTLTEEEVSKFARLDIDPSTITWQRVLDTNDRFLRKITIGQGNTEKGHYRQAQFDIAVASEIMAVLALTDSLADMKARLGRMVVASDKSGQPVTADDLGVTGALTVLMKDAIKPNLMQTLEGTPVFVHAGPFANIAHGNSSVLADKIALKLVGEEGFVVTEAGFGADIGMEKFFNIKCRASGLVPNVVVLVATVRALKMHGGGPSVTAGVPLKKEYTEENIQLVADGCCNLQKQIQITQLFGVPVVVALNVFKTDTRAEIDLVCELAKRAGAFDAVPCYHWSVGGKGSVDLARAVREAASKRSRFQFLYDVQVPIVDKIRTIAQAVYGAKDIELSPEAQAKIDRYTQQGFGNLPICMAKTHLSLSHQPDKKGVPRDFILPISDVRASIGAGFIYPLVGTMSTMPGLPTRPCFYDIDLDTETEQVKGLF

SEQ ID NO: 813301 - protein, 1139 aa, Homo sapiens
KGGRLSLRAESESHSAPHPLSGTAYQTKVPKAVTSRPAARRPPPSARHGRRVQCPLGAPGTRRKRQVLPAAAAAAAAACSPGTRPAALGSRSSVSPENQPSRAMGTRLPLVLRQLRRPPQPPGPPRRLRVPCRASSGGGGGGGGGREGLLGQRRPQDGQARSSCSPGGRTPAARDSIVREVIQNSKEVLSLLQEKNPAFKPVLAIIQAGDDNLMQEINQNLAEEAGLNITHICLPPDSSEAEIIDEILKINEDTRVHGLALQISENLFSNKVLNALKPEKDVDGVTDINLGKLVRGDAHECFVSPVAKAVIELLEKSVGVNLDGKKILVVGAHGSLEAALQCLFQRKGSMTMSIQWKTRQLQSKLHEADIVVLGSPKPEEIPLTWIQPGTTVLNCSHDFLSGKVGCGSPRIHFGGLIEEDDVILLAAALRIQNMVSSGRRWLREQQHRRWRLHCLKLQPLSPVPSDIEISRGQTPKAVDVLAKEIGLLADEIEIYGKSKAKVRLSVLERLKDQADGKYVLVAGITPTPLGEGKSTVTIGLVQALTAHLNVNSFACLRQPSQGPTFGVKGGAAGGGYAQVIPMEEFNLHLTGDIHAITAANNLLAAAIDTRILHENTQTDKALYNRLVPLVNGVREFSEIQLARLKKLGINKTDPSTLTEEEVSKFARLDIDPSTITWQRVLDTNDRFLRKITIGQGNTEKGHYRQAQFDIAVASEIMAVLALTDSLADMKARLGRMVVASDKSGQPVTADDLGVTGALTVLMKDAIKPNLMQTLEGTPVFVHAGPFANIAHGNSSVLADKIALKLVGEEGFVGLFYGMKCSDDGEGMDCGTIEESGVGSSYSHCTMPRIFTYRISLQKHNLVFQDAEYLLTEAGFGADIGMEKFFNIKCRASGLVPNVVVLVATVRALKMHGGGPSVTAGVPLKKEYTEENIQLVADGCCNLQKQIQITQLFGVPVVVALNVFKTDTRAEIDLVCELAKRAGAFDAVPCYHWSVGGKGSVDLARAVREAASKRSRFQFLYDVQVPIVDKIRTIAQAVYGAKDIELSPEAQAKIDRYTQQGFGNLPICMAKTHLSLSHQPDKKGVPRDFILPISDVRASIGAGFIYPLVGTMSTMPGLPTRPCFYDIDLDTETEQVKGLF

SEQ ID NO: 813302 - protein, 1082 aa, Homo sapiens; identical to SEQ ID NO: 813296

SEQ ID NO: 813303 - protein, 1082 aa, Homo sapiens; identical to SEQ ID NO: 813296

SEQ ID NO: 813304 - protein, 969 aa, Homo sapiens
KGGRLSLRAESESHSAPHPLSGTAYQTKVPKAVTSRPAARRPPPSARHGRRVQCPLGAPGTRRKRQVLPAAAAAAAAACSPGTRPAALGSRSSVSPENQPSRAMGTRLPLVLRQLRRPPQPPGPPRRLRVPCRASSGGGGGGGGGREGLLGQRRPQDGQARSSCSPGGRTPAARDSIVREVIQNSKEVLSLLQEKNPAFKPVLAIIQAGDDNLMQEINQNLAEEAGLNITHICLPPDSSEAEIIDEILKINEDTRVHGLALQISENLFSNKVLNALKPEKDVDGVTDINLGKLVRGDAHECFVSPVAKAVIELLEKSVGVNLDGKKILVVGAHGSLEAALQCLFQRKGSMTMSIQWKTRQLQSKLHEADIVVLGSPKPEEIPLTWIQPGTTVLNCSHDFLSGKVGCGSPRIHFGGLIEEDDVILLAAALRIQNMVSSGRRWLREQQHRRWRLHCLKLQPLSPVPSDIEISRGQTPKAVDVLAKEIGLLADEIEIYGKSKAKVRLSVLERLKDQADGKYVLVAGITPTPLGEGKSTVTIGLVQALTAHLNVNSFACLRQPSQGPTFGVKGGAAGGGYAQVIPMEEFNLHLTGDIHAITAANNLLAAAIDTRILHENTQTDKALYNRLVPLVNGVREFSEIQLARLKKLGINKTDPSTLTEEEVSKFARLDIDPSTITWQRVLDTNDRFLRKITIGQGNTEKGHYRQAQFDIAVASEIMAVLALTDSLADMKARLGRMVVASDKSGQPVTADDLGVTGALTVLMKDAIKPNLMQTLEGTPVFVHAGPFANIAHGNSSVLADKIALKLVGEEGFVVTEAGFGADIGMEKFFNIKCRASGLVPNVVVLVATVRALKMHGGGPSVTAGVPLKKEYTEENIQLVADGCCNLQKQIQITQLFGVPVVVALNVFKTDTRAEIDLVCELAKRAGAFDAVPCYHWSVGGKGSVDLARAVREAASKRSRFQFLYDVQPFS

SEQ ID NO: 813305 - protein, 259 aa, Homo sapiens [sequence omitted]

SEQ ID NO: 813306 - protein, 413 aa, Homo sapiens
KGGRLSLRAESESHSAPHPLSGTAYQTKVPKAVTSRPAARRPPPSARHGRRVQCPLGAPGTRRKRQVLPAAAAAAAAACSPGTRPAALGSRSSVSPENQPSRAMGTRLPLVLRQLRRPPQPPGPPRRLRVPCRASSGGGGGGGGGREGLLGQRRPQDGQARSSCSPGGRTPAARDSIVREVIQNSKEVLSLLQEKNPAFKPVLAIIQAGDDNLMQEINQNLAEEAGLNITHICLPPDSSEAEIIDEILKINEDTRVHGLALQISENLFSNKVLNALKPEKDVDGVTDINLGKLVRGDAHECFVSPVAKAVIELLEKSVGVNLDGKKILVVGAHGSLEAALQCLFQRKGSMTMSIQWKTRQLQSKLHEADIVVLGSPKPEEIPLTWIQPGTTVLNCSHDFLSESLIIIRRMAIF

SEQ ID NO: 813307 - protein, 1163 aa, Homo sapiens
MDRNREAEMELRRGPSPTRAGRGHEVDGDKATCHTCCICGKSFPFQSSLSQHMRKHTGEKPYKCPYCDHRASQKGNLKIHIRSHRTGTLIQGHEPEAGEAPLGEMRASEGLDACASPTKSASACNRLLNGASQADGARVLNGASQADSGRVLLRSSKKGAEGSACAPGEAKAAVQCSFCKSQFERKKDLELHVHQAHKPFKCRLCSYATLREESLLSHIERDHITAQGPGSGEACVENGKPELSPGEFPCEVCGQAFSQTWFLKAHMKKHRGSFDHGCHICGRRFKEPWFLKNHMKAHGPKTGSKNRPKSELDPIATINNVVQEEVIVAGLSLYEVCAKCGNLFTNLDSLNAHNAIHRRVEASRTRAPAEEGAEGPSDTKQFFLQCLNLRPSAAGDSCPGTQAGRRVAELDPVNSYQAWQLATRGKVAEPAEYLKYGAWDEALAGDVAFDKDRREYVLVSQEKRKREQDAPAAQGPPRKRASGPGDPAPAGHLDPRSAARPNRRAAATTGQGKSSECFECGKIFRTYHQMVLHSRVHRRARRERDSDGDRAARARCGSLSEGDSASQPSSPGSACAAADSPGSGLADEAAEDSGEEGAPEPAPGGQPRRCCFSEEVTSTELSSGDQSHKMGDNASERDTGESKAGIAASVSILENSSRETSRRQEQHRFSMDLKMPAFHPKQEVPVPGDGVEFPSSTGAEGQTGHPAEKLSDLHNKEHSGGGKRALAPDLMPLDLSARSTRDDPSNKETASSLQAALVVHPCPYCSHKTYYPEVLWMHKRIWHRVSCNSVAPPWIQPNGYKSIRSNLVFLSRSGRTGPPPALGGKECQPLLLARFTRTQVPGGMPGSKSGSSPLGVVTKAASMPKNKESHSGGPCALWAPGPDGYRQTKPCHGQEPHGAATQGPLAKPRQEASSKPVPAPGGGGFSRSATPTPTVIARAGAQPSANSKPVEKFGVPPAGAGFAPTNKHSAPDSLKAKFSAQPQGPPPAKGEGGAPPLPPREPPSKAAQELRTLATCAAGSRGDAALQAQPGVAGAPPVLHSIKQEPVAEGHEKRLDILNIFKTYIPKDFATLYQGWGVSGPGLEHRGTLRTQARPGEFVCIECGKSFHQPGHLRAHMRAHSVVFESDGPRGSEVHTTSADAPKQGRDHSNTGTVQTVPLRKGT

SEQ ID NO: 813308 - protein, 1163 aa, Homo sapiens; identical to SEQ ID NO: 813307

SEQ ID NO: 813309 - protein, 1163 aa, Homo sapiens; identical to SEQ ID NO: 813307

SEQ ID NO: 813310 - protein, 1163 aa, Homo sapiens; identical to SEQ ID NO: 813307

SEQ ID NO: 813311 - protein, 1163 aa, Homo sapiens; identical to SEQ ID NO: 813307

SEQ ID NO: 813312 - protein, 1091 aa, Homo sapiens
MDRNREAEMELRRGPSPTRAGRGHEVDGDKATCHTCCICGKSFPFQSSLSQHMRKHTGEKPYKCPYCDHRASQKGNLKIHIRSHRTGTLIQGHEPEAGEAPLGEMRASEGLDACASPTKSASACNRLLNGASQADGARVLNGASQADSGRVLLRSSKKGAEGSACAPGEAKAAVQCSFCKSQFERKKDLELHVHQAHKPFKCRLCSYATLREESLLSHIERDHITAQGPGSGEACVENGKPELSPGEFPCEVCGQAFSQTWFLKAHMKKHRGSFDHGCHICGRRFKEPWFLKNHMKAHGPKTGSKNRPKSELDPIATINNVVQEEVIVAGLSLYEVCAKCGNLFTNLDSLNAHNAIHRRVEASRTRAPAEEGAEGPSDTKQFFLQCLNLRPSAAGDSCPGTQAGRRVAELDPVNSYQAWQLATRGKVAEPAEYLKYGAWDEALAGDVAFDKDRREYVLVSQEKRKREQDAPAAQGPPRKRASGPGDPAPAGHLDPRSAARPNRRAAATTGQGKSSECFECGKIFRTYHQMVLHSRVHRRARRERDSDGDRAARARCGSLSEGDSASQPSSPGSACAAADSPGSGLADEAAEDSGEEGAPEPAPGGQPRRCCFSEEVTSTELSSGDQSHKMGDNASERDTGESKAGIAASVSILENSSRETSRRQEQHRFSMDLKMPAFHPKQEVPVPGDGVEFPSSTGAEGQTGHPAEKLSDLHNKEHSGGGKRALAPDLMPLDLSARSTRDDPSNKETASSLQAALVVHPCPYCSHKTYYPEVLWMHKRIWHRVSCNSVAPPWIQPNGYKSIRSNLVFLSRSGRTGPPPALGGKECQPLLLARFTRTQVPGGMPGSKSGSSPLGVVTKAASMPKNKESHSGGPCALWAPGPDGYRQTKPCHGQEPHGAATQGPLAKPRQEASSKPVPAPGGGGFSRSATPTPTVIARAGAQPSANSKPVEKFGVPPAGAGFAPTNKHSAPDSLKAKFSAQPQGPPPAKGEGGAPPLPPREPPSKAAQELRTLATCAAGSRGDAALQAQPGVAGAPPVLHSIKQEPVAEGHEKRLDILNIFKTYIPKDFATLYQGWGVSGPGLEHRGERPF

SEQ ID NO: 813313 - protein, 90 aa, Homo sapiens
MNMKPATASALLLLLLGLAWTQGSHGWGADASSLQKRAGRADQNYNYNQHAYPTAYGGKYSVKTPAKGGVSPSSSASRVQPGLLQWVKFW

SEQ ID NO: 813314 - protein, 152 aa, Homo sapiens
TNTHNTTHTLGEYELVFNRPRHRLKSGKGSSTGSSSGNHGGSGGGNGHKPGNSETSPGMFNFDTFWKNFKSKLGFINWDAINKNQVPPPSTRALLYFSRLWEDFKQNTPFLNWKAIIEGADASSLQKRAGRADQCRVHGMAWRWQLYRSMIY

SEQ ID NO: 813315 - protein, 106 aa, Homo sapiens
SEKPRQLRTGERRLQTQREGGQGVGRRRTEEGTETQSKGGKEETLVGGRHSGERGGWAEMKFQGPLACLLLALCLGSGEAGPLQKSAADFGNILLTAAYDVYMMFP

SEQ ID NO: 813316 - protein, 273 aa, Homo sapiens
MLGITSCSDQQAKEGEGLGRLERGLESDWGSNKSVTPLGTTGSPLGPLGQRLKSCFPLQGSSTGSSSGNHGGSGGGNGHKPGCEKPGNEARGSGESGIQGFRGQGVSSNMREISKEGNRLLGGSGDNYRNSETSPGMFNFDTFWKNFKSKLGFINWDAINKNQVPPPSTRALLYFSRLWEDFKQNTPFLNWKAIIEGADASSLQKRAGRADQPGAGWQEVAAVTSKNYNYNQHAYPTAYGGKYSVKTPAKGGVSPSSSASRVQPGLLQWVKFW

SEQ ID NO: 813317 - protein, 123 aa, Homo sapiens
MFNFDTFWKNFKSKLGFINWDAINKNQVPPPSTRALLYFSRLWEDFKQNTPFLNWKAIIEGADASSLQKRAGRADQNYNYNQHAYPTAYGGKYSVKTPAKGGVSPSSSASRVQPGLLQWVKFW

SEQ ID NO: 813318 - protein, 123 aa, Homo sapiens; identical to SEQ ID NO: 813317

SEQ ID NO: 813319 - protein, 212 aa, Homo sapiens
MLGITSCSDQQAKEGEGLGRLERGLESDWGSNKSVTPLGTTGSPLGPLGQRLKSCFPLQGSSTGSSSGNHGGSGGGNGHKPGNSETSPGMFNFDTFWKNFKSKLGFINWDAINKNQVPPPSTRALLYFSRLWEDFKQNTPFLNWKAIIEGADASSLQKRAGRADQNYNYNQHAYPTAYGGKYSVKTPAKGGVSPSSSASRVQPGLLQWVKFW

SEQ ID NO: 813320 - protein, 259 aa, Homo sapiens
MLGITSCSDQQAKEGEGLGRLERGLESDWGSNKSVTPLGTTGSPLGPLGQRLKSCFPLQGSSTGSSSGNHGGSGGGNGHKPGCEKPGNEARGSGESGIQGFRGQGVSSNMREISKEGNRLLGGSGDNYRNSETSPGMFNFDTFWKNFKSKLGFINWDAINKNQVPPPSTRALLYFSRLWEDFKQNTPFLNWKAIIEGADASSLQKRAGRADQNYNYNQHAYPTAYGGKYSVKTPAKGGVSPSSSASRVQPGLLQWVKFW

SEQ ID NO: 813321 - protein, 279 aa, Homo sapiens
MLGITSCSDQQAKEGEGLGRLERGLESDWGSNKSVTPLGTTGSPLGPLGQRLKSCFPLQGSSTGSSSGNHGGSGGGNGHKPGCEKPGNEARGSGESGIQGFRGQGVSSNMREISKEGNRLLGGSGDNYRGQGSSWGSGGGDAVGGVNTVNSETSPGMFNFDTFWKNFKSKLGFINWDAINKNQVPPPSTRALLYFSRLWEDFKQNTPFLNWKAIIEGADASSLQKRAGRADQNYNYNQHAYPTAYGGKYSVKTPAKGGVSPSSSASRVQPGLLQWVKFW

SEQ ID NO: 813322 - protein, 101 aa, Homo sapiens
ALRTAPRSPTPGPPSTSADSGEDFKQNTPFLNWKAIIEGADASSLQKRAGRADQNYNYNQHAYPTAYGGKYSVKTPAKGGVSPSSSASRVQPGLLQWVKFW

SEQ ID NO: 813323 - protein, 176 aa, Homo sapiens
MFNFDTFWKNFKSKLGFINWDAINKNQVPPPSTRALLYFSRLWEDFKQNTPFLNWKAIIEGADASSLQKRAGRADQGESLSSSYPAGPLVPLGLCSRDLGKSEILFHSSIQWLSQPGAGWQEVAAVTSKNYNYNQHAYPTAYGGKYSVKTPAKGGVSPSSSASRVQPGLLQWVKFW

SEQ ID NO: 813324 - protein, 179 aa, Homo sapiens
MFNFDTFWKNFKSKLGFINWDAINKNQVPPPSTRALLYFSRLWEDFKQNTPFLNWKAIIEGADASSLQKRAGRADQGESLSSSYPAGPLVPLGLCSRDLGKSEILFHSSIQWLSQPGAGWQEVAAVTSKVRHLPWTRWVTSWHFFSWSPTLTSQVTLEELAEVLRAGGGVGGGGGGHLG

SEQ ID NO: 813325 - protein, 137 aa, Homo sapiens
MFNFDTFWKNFKSKLGFINWDAINKNQVPPPSTRALLYFSRLWEDFKQNTPFLNWKAIIEGADASSLQKRAGRADQPGAGWQEVAAVTSKNYNYNQHAYPTAYGGKYSVKTPAKGGVSPSSSASRVQPGLLQWVKFW

SEQ ID NO: 813326 - protein, 123 aa, Homo sapiens; identical to SEQ ID NO: 813317

SEQ ID NO: 813327 - protein, 123 aa, Homo sapiens; identical to SEQ ID NO: 813317

SEQ ID NO: 813328 - protein, 184 aa, Homo sapiens
MREISKEGNRLLGGSGDNYRGQGSSWGSGGGDAVGGVNTVNSETSPGMFNFDTFWKNFKSKLGFINWDAINKNQVPPPSTRALLYFSRLWEDFKQNTPFLNWKAIIEGADASSLQKRAGRADQPGAGWQEVAAVTSKNYNYNQHAYPTAYGGKYSVKTPAKGGVSPSSSASRVQPGLLQWVKFW

SEQ ID NO: 813329 - protein, 123 aa, Homo sapiens; identical to SEQ ID NO: 813317

SEQ ID NO: 813330 - protein, 123 aa, Homo sapiens; identical to SEQ ID NO: 813317

SEQ ID NO: 813331 - protein, 137 aa, Homo sapiens; identical to SEQ ID NO: 813325

SEQ ID NO: 813332 - protein, 118 aa, Homo sapiens
MFNFDTFWKNFKSKLGFINWDAINKDFKQNTPFLNWKAIIEGADASSLQKRAGRADQPGAGWQEVAAVTSKNYNYNQHAYPTAYGGKYSVKTPAKGGVSPSSSASRVQPGLLQWVKFW

SEQ ID NO: 813333 - protein, 123 aa, Homo sapiens; identical to SEQ ID NO: 813317

SEQ ID NO: 813334 - protein, 123 aa, Homo sapiens; identical to SEQ ID NO: 813317

SEQ ID NO: 813335 - protein, 123 aa, Homo sapiens; identical to SEQ ID NO: 813317

SEQ ID NO: 813336 - protein, 123 aa, Homo sapiens; identical to SEQ ID NO: 813317

SEQ ID NO: 813337 - protein, 162 aa, Homo sapiens
MRIANRTRFSSPFLARGAGWTHGRGMMVVGTGTSLALSSLLSLLLFAGMQMYSRQLASTEWLTIQGGLLGSGLFVFSLTAFNNLENLVFGKGFQAKIFPEILLCLLLALFASGLIHRVCVTTCFIFSMVGLYYINKISSTLYQAAAPVLTPAKVTGKSKKRN

SEQ ID NO: 813338 - protein, 475 aa, Homo sapiens
MTPGTQSPFFLLLLLTVLTVVTGSGHASSTPGGEKETSATQRSSVPSSTEKNAVSMTSSVLSSHSPGSGSSTTQGQDVTLAPATEPASGSAATWGQDVTSVPVTRPALGSTTPPAHDVTSAPDNKPAPGSTAPPAHGVTSAPDTRPAPGSTAPPAHGVTSAPDNRPALGSTAPPVHNVTSASGSASGSASTLVHNGTSARATTTPASKSTPFSIPSHHSDTPTTLASHSTKTDASSTHHSTVPPLTSSNHSTSPQLSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 813339 - protein, 142 aa, Homo sapiens
GQELGKRLVGTGTSLALSSLLSLLLFAGMQMYSRQLASTEWLTIQGGLLGSGLFVFSLTAFNNLENLVFGKGFQAKIFPEILLCLLLALFASGLIHRVCVTTCFIFSMVGLYYINKISSTLYQAAAPVLTPAKVTGKSKKRN

SEQ ID NO: 813340 - protein, 162 aa, Homo sapiens; identical to SEQ ID NO: 813337

SEQ ID NO: 813341 - protein, 110 aa, Homo sapiens
MRIANRTRFSSPFLARGAGWTHGRGMMVVGTGTSLALSSLLSLLLFAGMQMYSRQLASTEWLTIQGGLLGSGLFVFSLTVSSLQLEGAGHVGMCPSPSPHSSVPVAHPTP

SEQ ID NO: 813342 - protein, 192 aa, Homo sapiens
MRIANRTRFSSPFLARGAGWTHGRGMMVVGTGTSLALSSLLSLLLFAGMQMYSRQLASTEWLTIQGGLLGSGLFVFSLTAFNNLENLVFGKGFQAKIFPEILLCLLLALFASGLIHRVCVTTCFIFSMVGLYYINKISSTLYQAAAPVLTPAKIYSSAKIYSSAKIYSSAKIYSSTKIYSSTKIYSSAKITH

SEQ ID NO: 813343 - protein, 114 aa, Homo sapiens
MQMYSRQLASTEWLTIQGGLLGSGLFVFSLTAFNNLENLVFGKGFQAKIFPEILLCLLLALFASGLIHRVCVTTCFIFSMVGLYYINKISSTLYQAAAPVLTPAKVTGKSKKRN

SEQ ID NO: 813344 - protein, 123 aa, Homo sapiens
MRIANRTRFSSPFLARGAGWTHGRGMMVVGTGTSLALSSLLSLLLFAGMQMYSRQLASTEWLTIQGGLLGSGLFVFSLTAFNNLENLVFGKGFQAKIFPEILRAPWPLERPTPGGKHRSISGG

SEQ ID NO: 813345 - protein, 528 aa, Homo sapiens
RSTSQAASACLNLFCPLPTHFTTTMTPGTQSPFFLLLLLTVLTATTAPKPATVVTGSGHASSTPGGEKETSATQRSSVPSSTEKNAVSMTSSVLSSHSPGSGSSTTQGQDVTLAPATEPASGSAATWGQDVTSVPVTRPALGSTTPPAHDVTSAPDNKPAPGSTAPPAHGVTSAPDTRPAPGSTAPPAHGVTPAPDTRPAPGSTAPPAHGVTSAPDNRPALGSTAPPVHNVTSASGSASGSASTLVHNGTSARATTTPASKSTPFSIPSHHSDTPTTLASHSTKTDASSTHHSTVPPLTSSNHSTSPQLSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 813346 - protein, 560 aa, Homo sapiens
RSRGPLIGSQGHEPRPMGREKEAAAGKEAANPGVTEAAHSPVLLVLFLWWPELIFSSCSYFSFIKTQPYDFNFFTATTAPKPATVVTGSGHASSTPGGEKETSATQRSSVPSSTEKNAVSMTSSVLSSHSPGSGSSTTQGQDVTLAPATEPASGSAATWGQDVTSVPVTRPALGSTTPPAHDVTSAPDNKPAPGSTAPPAHGVTSAPDTRPAPGSTAPPAHGVTSAPDTRPAPGSTAPPAHGVTSAPDNRPALGSTAPPVHNVTSASGSASGSASTLVHNGTSARATTTPASKSTPFSIPSHHSDTPTTLASHSTKTDASSTHHSTVPPLTSSNHSTSPQLSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 813347 - protein, 505 aa, Homo sapiens
MPQPGTQSPFFLLLLLTVLTATTAPKPATVVTGSGHASSTPGGEKETSATQRSSVPSSTEKNAVSMTSSVLSSHSPGSGSSTTQGQDVTLAPATEPASGSAATWGQDVTSVPVTRPALGSTTPPAHDVTSAPDNKPAPGSTAPPAHGVTSAPDTRPAPGSTAPPAHGVTSAPDTRPAPGSTAPPAHGVTSAPDNRPALGSTAPPVHNVTSASGSASGSASTLVHNGTSARATTTPASKSTPFSIPSHHSDTPTTLASHSTKTDASSTHHSTVPPLTSSNHSTSPQLSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 813348 - protein, 489 aa, Homo sapiens
RSTSQAASACLNLFCPLPTHFTTTMTPGTQSPFFLLLLLTVLTATTAPKPATVVTGSGHASSTPGGEKETSATQRSSVPSSTEKNAVSMTSSVLSSHSPGSGSSTTQGQDVTLAPATEPASGSAATWGQDVTSVPVTRPALGSTTPPAHDVTSAPDNKPAPGSTAPPAHGVTSAPDTRPAPGSTAPPAHGVTFSASGSASGSASTLVHNGTSARATTTPASKSTPFSIPSHHSDTPTTLASHSTKTDASSTHHSTVPPLTSSNHSTSPQLSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 813349 - protein, 271 aa, Homo sapiens
IENGVLLLAGVVVALAEVPLCTRVEAEPDASSTHHSTVPPLTSSNHSTSPQLSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 813350 - protein, 255 aa, Homo sapiens
MTPGTQSPFFLLLLLTVLTVVTGSGHASSTPGGEKETSATQRSSVPSSTEKNAFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 813351 - protein, 273 aa, Homo sapiens
MTPGTQSPFFLLLLLTVLTVVTGSGHASSTPGGEKETSATQRSSVPSSTEKNALSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 813352 - protein, 288 aa, Homo sapiens
RSTSQAASACLNLFCPLPTHFTTTMTPGTQSPFFLLLLLTVLTATTAPKPATVVTGSGHASSTPGGEKETSATQRSSVPSSTEKNAFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 813353 - protein, 230 aa, Homo sapiens
MTPGTQSPFFLLLLLTVLTVVTGSGHASSTPGGEKETSATQRSSVPSSTEKNAIPAPTTTKSCRETFLKWPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 813354 - protein, 652 aa, Homo sapiens
RSTSQAASACLNLFCPLPTHFTTTMTPGTQSPFFLLLLLTVLTATTAPKPATVVTGSGHASSTPGGEKETSATQRSSVPSSTEKNAVSMTSSVLSSHSPGSGSSTTQGQDVTLAPATEPASGSAATWGQDVTSVPVTRPALGSTTPPAHDVTSAPDNKPAPGSTAPPAHGVTSAPDTRPAPGSTAPPAHGVTFSASGSASGSASTLVHNGTSARATTTPASKSTPFSIPSHHSDTPTTLASHSTKTDASSTHHSTVPPLTSSNHSTSPQLSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKSGSRRTRYEESLRTRAVAEDAPSTHYFLPVARGRCVQALRGRKRRTRGEQVRVVGTGTSLALSSLLSLLLFAGMQMYSRQLASTEWLTIQGGLLGSGLFVFSLTAFNNLENLVFGKGFQAKIFPEILLCLLLALFASGLIHRVCVTTCFIFSMVGLYYINKISSTLYQAAAPVLTPAKVTGKSKKRN

SEQ ID NO: 813355 - protein, 489 aa, Homo sapiens; identical to SEQ ID NO: 813348

SEQ ID NO: 813356 - protein, 311 aa, Homo sapiens
RSTSQAASACLNLFCPLPTHFTTTMTPGTQSPFFLLLLLTVLTATTAPKPATVVTGSGHASSTPGGEKETSATQRSSVPSSTEKNAVSMTSSVLSSHSPGSGSSTTQGQDVTLAPATEPASGSAATWGQDVTSVPVTRPALGSTTPPAHDVTSAPDNKPAPGSTAPPAHGVTSAPDTRPAPGSTAPPAHGVTSRPQALHQAQLLLWCTTAPLPGLPQPQPARALHSQFPATTLILLPPLPAIAPRLMPVALTIARYLLSPPPITALLPSCLLGSLSFSCLFTFQTSSLIPLWKIPAPTTTKSCRETFLKCE

SEQ ID NO: 813357 - protein, 497 aa, Homo sapiens
RSTSQAASACLNLFCPLPTHFTTTMTPGTQSPFFLLLLLTVLTATTAPKPATVVTGSGHASSTPGGEKETSATQRSSVPSSTEKNAVSMTSSVLSSHSPGSGSSTTQGQDVTLAPATEPASGSAATWGQDVTSVPVTRPALGSTTPPAHDVTSAPDNKPAPGSTAPPAHGVTSAPDTRPAPGSTAPPAHGVTFSASGSASGSASTLVHNGTSARATTTPASKSTPFSIPSHHSDTPTTLASHSTKTDASSTHHSTVPPLTSSNHSTSPQLSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVRLGPTGQGKQRVWLGKDSEGGTWKTQRAWKR

SEQ ID NO: 813358 - protein, 443 aa, Homo sapiens
RSTSQAASACLNLFCPLPTHFTTTMTPGTQSPFFLLLLLTVLTATTAPKPATVVTGSGHASSTPGGEKETSATQRSSVPSSTEKNAVSMTSSVLSSHSPGSGSSTTQGQDVTLAPATEPASGSAATWGQDVTSVPVTRPALGSTTPPAHDVTSAPDNKPAPGSTAPPAHGVTSAPDTRPAPGSTAPPAHGVTSRPQALHQAQLLLWCTTAPLPGLPQPQPARALHSQFPATTLILLPPLPAIAPRLMPVALTIARYLLSPPPITALLPSCLLGSLSFSCLFTFQTSSLIPLWKIPAPTTTKSCRETFLKCFCRFINKGVFWASPILSSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 813359 - protein, 411 aa, Homo sapiens
RSTSQAASACLNLFCPLPTHFTTTMTPGTQSPFFLLLLLTVLTATTAPKPATVVTGSGHASSTPGGEKETSATQRSSVPSSTEKNAVSMTSSVLSSHSPGSGSSTTQGQDVTLAPATEPASGSAATWGQDVTSVPVTRPALGSTTPPAHDVTSAPDNKPAPGSTAPPAHGVTSAPDTRPAPGSTAPPAHGVTSRPQALHQAQLLLWCTTAPLPGLPQPQPARALHSQFPATTLILLPPLPAIAPRLMPVALTIARYLLSPPPITALLPSCLLGSLSFSCLFTFQTSSLIPLWKIPAPTTTKSCRETFLKCGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 813360 - protein, 475 aa, Homo sapiens
RSTSQAASACLNLFCPLPTHFTTTMTPGTQSPFFLLLLLTVLTATTAPKPATVVTGSGHASSTPGGEKETSATQRSSVPSSTEKNAVSMTSSVLSSHSPGSGSSTTQGQDVTLAPATEPASGSAATWGQDVTSVPVTRPALGSTTPPAHDVTSAPDNKPAPGSTAPPAHGVTSAPDTRPAPGSTAPPAHGVTFSASGSASGSASTLVHNGTSARATTTPASKSTPFSIPSHHSDTPTTLASHSTKTDASSTHHSTVPPLTSSNHSTSPQLSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKEWRVDRERLA

SEQ ID NO: 813361 - protein, 414 aa, Homo sapiens
RSTSQAASACLNLFCPLPTHFTTTMTPGTQSPFFLLLLLTVLTATTAPKPATVVTGSGHASSTPGGEKETSATQRSSVPSSTEKNAVSMTSSVLSSHSPGSGSSTTQGQDVTLAPATEPASGSAATWGQDVTSVPVTRPALGSTTPPAHDVTSAPDNKPAPGSTAPPAHGVTSAPDTRPAPGSTAPPAHGVTFSASGSASGSASTLVHNGTSARATTTPASKSTPFSIPSHHSDTPTTLASHSTKTDASSTHHSTVPPLTSSNHSTSPQLSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSGCLSVPPKELRAAGHLSSPGYLPSYERVPHLPHPWALCAP

SEQ ID NO: 813362 - protein, 652 aa, Homo sapiens; identical to SEQ ID NO: 813354

SEQ ID NO: 813363 - protein, 384 aa, Homo sapiens
RSTSQAASACLNLFCPLPTHFTTTMTPGTQSPFFLLLLLTVLTATTAPKPATVVTGSGHASSTPGGEKETSATQRSSVPSSTEKNAVSMTSSVLSSHSPGSGSSTTQGQDVTLAPATEPASGSAATWGQDVTSVPVTRPALGSTTPPAHDVTSAPDNKPAPGSTAPPAHGVTSAPDTRPAPGSTAPPAHGVTFSASGSASGSASTLVHNGTSARATTTPASKSTPFSIPSHHSDTPTTLASHSTKTDASSTHHSTVPPLTSSNHSTSPQLSTGVSFFFLSFHISNLQFNSSLEDPSTDYYQELQRDISEMAVCQCRRKNYGQLDIFPARDTYHPMSEYPTYHTHGRYVPPSSTDRSPYEKVSAGNGGSSLSYTNPAVAATSANL

SEQ ID NO: 813364 - protein, 689 aa, Homo sapiens
RSTSQAASACLNLFCPLPTHFTTTMTPGTQSPFFLLLLLTVLTATTAPKPATVVTGSGHASSTPGGEKETSATQRSSVPSSTEKNAVSMTSSVLSSHSPGSGSSTTQGQDVTLAPATEPASGSAATWGQDVTSVPVTRPALGSTTPPAHDVTSAPDNKPAPGSTAPPAHGVTSAPDTRPAPGSTAPPAHGVTFSASGSASGSASTLVHNGTSARATTTPASKSTPFSIPSHHSDTPTTLASHSTKTDASSTHHSTVPPLTSSNHSTSPQLSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKSGSRRTRYEESLRTRAVAEDAPSTHYFLPVARGRCVQALRGRKRRTRGVASPRGGYGHLAGALLPPVPAALCWDADVQPSAGLHRVAHHPGRPAWFGSLRVLAHCILPAVGGGGPRRHVPFPFPTQLCPRCTPYSFNSLNQAFNNLENLVFGKGFQAKIFPEILLCLLLALFASGLIHRVCVTTCFIFSMVGLYYINKISSTLYQAAAPVLTPAKVTGKSKKRN

SEQ ID NO: 813365 - protein, 643 aa, Homo sapiens
RSTSQAASACLNLFCPLPTHFTTTMTPGTQSPFFLLLLLTVLTATTAPKPATVVTGSGHASSTPGGEKETSATQRSSVPSSTEKNAVSMTSSVLSSHSPGSGSSTTQGQDVTLAPATEPASGSAATWGQDVTSVPVTRPALGSTTPPAHDVTSAPDNKPAPGSTAPPAHGVTSAPDTRPAPGSTAPPAHGVTFSASGSASGSASTLVHNGTSARATTTPASKSTPFSIPSHHSDTPTTLASHSTKTDASSTHHSTVPPLTSSNHSTSPQLSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKSGSRRTRYEESLRTRAVAEDAPSTHYFLPVARGRCVQALRGRKRRTRGEQVRVVGTGTSLALSSLLSLLLFAGMQMYSRQLASTEWLTIQGGLLGSGLFVFSLTAFNNLENLVFGKGFQAKIFPEILLCLLLALFASGLIHRVCVTTCFIFSMVGLYYINKISSTLYQAAAGGGGSSE

SEQ ID NO: 813366 - protein, 110 aa, Homo sapiens
VVTWHNPGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 813367 - protein, 572 aa, Homo sapiens
RSTSQAASACLNLFCPLPTHFTTTMTPGTQSPFFLLLLLTVLTATTAPKPATVVTGSGHASSTPGGEKETSATQRSSVPSSTEKNAVSMTSSVLSSHSPGSGSSTTQGQDVTLAPATEPASGSAATWGQDVTSVPVTRPALGSTTPPAHDVTSAPDNKPAPGSTAPPAHGVTSAPDTRPAPGSTAPPAHGVTFSASGSASGSASTLVHNGTSARATTTPASKSTPFSIPSHHSDTPTTLASHSTKTDASSTHHSTVPPLTSSNHSTSPQLSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKSGSRRTRYEESLRTRAVAEDAPSTHYFLPVARGRCVQALRGRKRRTRGVASPRGGYGHLAGALLPPVPAALCWDADVQPSAGLHRVAHHPGRPAWFGSLRVLAHCLQ

SEQ ID NO: 813368 - protein, 168 aa, Homo sapiens
MTPGTQSPFFLLLLLTVLTVVTGSGHASSTPGGEKETSATQRSSVPSSTEKNALSTGVSFFFLSFHISNLQFNSSLEDPSTDYYQELQRDISEMAVCQCRRKNYGQLDIFPARDTYHPMSEYPTYHTHGRYVPPSSTDRSPYEKVSAGNGGSSLSYTNPAVAATSANL

SEQ ID NO: 813369 - protein, 376 aa, Homo sapiens
RSTSQAASACLNLFCPLPTHFTTTMTPGTQSPFFLLLLLTVLTATTAPKPATVVTGSGHASSTPGGEKETSATQRSSVPSSTEKNAVSMTSSVLSSHSPGSGSSTTQGQDVTLAPATEPASGSAATWGQDVTSVPVTRPALGSTTPPAHDVTSAPDNKPAPGSTAPPAHGVTSAPDTRPAPGSTAPPAHGVTFSASGSASGSASTLVHNGTSARATTTPASKSTPFSIPSHHSDTPTTLASHSTKTDASSTHHSTVPPLTSSNHSTSPQLSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSVL

SEQ ID NO: 813370 - protein, 341 aa, Homo sapiens
RSTSQAASACLNLFCPLPTHFTTTMTPGTQSPFFLLLLLTVLTATTAPKPATVVTGSGHASSTPGGEKETSATQRSSVPSSTEKNAVSMTSSVLSSHSPGSGSSTTQGQDVTLAPATEPASGSAATWGQDVTSVPVTRPALGSTTPPAHDVTSAPDNKPAPGSTAPPAHGVTSAPDTRPAPGSTAPPAHGVTSRPQALHQAQLLLWCTTAPLPGLPQPQPARALHSQFPATTLILLPPLPAIAPRLMPVALTIARYLLSPPPITALLPSCLLGSLSFSCLFTFQTSSLIPLWKIPAPTTTKSCRETFLKCFCRFINKGVFWASPILSSARSCGGRISDPLI

SEQ ID NO: 813371 - protein, 214 aa, Homo sapiens
RSTSQAASACLNLFCPLPTHFTTTMTPGTQSPFFLLLLLTVLTATTAPKPATVVTGSGHASSTPGGEKETSATQRSSVPSSTEKNAVSMTSSVLSSHSPGSGSSTTQGQDVTLAPATEPASGSAATWGQDVTSVPVTRPALGSTTPPAHDVTSAPDNKPAPGSTAPPAHGVTSAPDTRPAPGSTAPPAHGVTCARQAHGVTSAPDTRPAPCQME

SEQ ID NO: 813372 - protein, 450 aa, Homo sapiens
MVPLVAVVSGPRAQLFACLLRLGTQQVGPLQLHTGASHAARNHYEVLVLGGGSGGITMAARMKRKVGAENVAIVEPSERHFYQPIWTLVGAGAKQLSSSGRPTASVIPSGVEWIKARVTELNPDKNCIHTDDDEKISYRYLIIALGIQLDYEKIKGLPEGFAHPKIGSNYSVKTVEKTWKALQDFKEGNAIFTFPNTPVKCAGAPQKIMYLSEAYFRKTGKRSKANIIFNTSLGAIFGVKKYADALQEIIQERNLTVNYKKNLIEVRADKQEAVFENLDKPGETQVISYEMLHVTPPMSPPDVLKTSPVADAAGWVDVDKETLQHRRYPNVFGIGDCTNLPTSKTAAAVAAQSGILDRTISVIMKNQTPTKKYDGYTSCPLVTGYNRVILAEFDYKAEPLETFPFDQSKERLSMYLMKADLMPFLYWNMMLRGYWGGPAFLRKLFHLGMS

SEQ ID NO: 813373 - protein, 183 aa, Homo sapiens
MVPLVAVVSGPRAQLFACLLRLGTQQVGPLQLHTGASHAARNHYEVLVLGGGSGGITMAARMKRKVGAENVAIVEPSERHFYQPIWTLVGAGAKQLSSSGRPTASVIPSGVEWIKARVTELNPDKNCIHTDDDEKISYRYLIIALGIQLDYEKIKAYLKVRSSPGLRGQCHLHLPYSSGVCWA

SEQ ID NO: 813374 - protein, 82 aa, Homo sapiens
YPCPPSGRTISVIMKNQSLTKKYDGYTSCPLVTGYNRVILAEFDYKAEPLETFPFDQSKERLSMYLMKADLMPFLYWNMMLR

SEQ ID NO: 813375 - protein, 450 aa, Homo sapiens; identical to SEQ ID NO: 813372

SEQ ID NO: 813376 - protein, 450 aa, Homo sapiens; identical to SEQ ID NO: 813372

SEQ ID NO: 813377 - protein, 450 aa, Homo sapiens; identical to SEQ ID NO: 813372

SEQ ID NO: 813378 - protein, 450 aa, Homo sapiens; identical to SEQ ID NO: 813372

SEQ ID NO: 813379 - protein, 450 aa, Homo sapiens; identical to SEQ ID NO: 813372

SEQ ID NO: 813380 - protein, 450 aa, Homo sapiens; identical to SEQ ID NO: 813372

SEQ ID NO: 813381 - protein, 450 aa, Homo sapiens; identical to SEQ ID NO: 813372

SEQ ID NO: 813382 - protein, 480 aa, Homo sapiens
MVPLVAVVSGPRAQLFACLLRLGTQQVGPLQLHTGASHAARNHYEVLVLGGGSGGITMAARMKRKVGAENVAIVEPSERHFYQPIWTLVGAGAKQLSSSGRPTASVIPSGVEWIKARVTELNPDKNCIHTDDDEKISYRYLIIALGIQLDYEKIKGLPEGFAHPKIGSNYSVKTVEKTWKALQDFKEGNAIFTFPNTPVKCAGAPQKIMYLSEAYFRKTGKRSKANIIFNTSLGAIFGVKKYADALQEIIQERNLTVNYKKNLIEVRADKQEAVFENLDKPGETQVISYEMLHVTPPMSPPDVLKTSPVADAAGWVDVDKETLQHRRYPNVFGIGDCTNLPTSKTAAAVAAQSGILDRTISVIMKNQTPTKKYDGYTSCPLVTGYNRVILAEFDYKAEPLETFPFDQSKERLSMYLMKADLMPFLYWNMMLRYIFLCYFLQGLLGRTSVSAQVVSSRYELRMAQHLLILDGFWAKTAVTE

SEQ ID NO: 813383 - protein, 160 aa, Homo sapiens
YCQRCYCQVVLLSWWCCCPGDAAGWVDVDKETLQHRRYPNVFGIGDCTNLPTSKTAAAVAAQSGILDRTISVIMKNQTPTKKYDGYTSCPLVTGYNRVILAEFDYKAEPLETFPFDQSKERLSMYLMKADLMPFLYWNMMLRGYWGGPAFLRKLFHLGMS

SEQ ID NO: 813384 - protein, 233 aa, Homo sapiens
MVPLVAVVSGPRAQLFACLLRLGTQQVGPLQLHTGASHAARNHYEVLVLGGGSGGITMAARMKRKVGAENVAIVEPSERHFYQPIWTLVGAGAKQLSSSGRPTASVIPSGVEWIKARVTELNPDKNCIHTDDDEKISYRYLIIALGIQLDYEKIKGLPEGFAHPKIGSNYSVKTVEKTWKALQDFKEGNAIFTFPNTPVKCAGAPQKIMYLSEAYFRKVCFLSGDRDEQGGQC

SEQ ID NO: 813385 - protein, 552 aa, Homo sapiens
MKKNRERFCNREREFVYKFKVGSQCLELRVPLKFPVQENASHLHGRLMLLHSLPCFIEKDLKEALTQFIEEESLSDYDRDAEASLAAVKSGEVDLHQLASTWAKAYAETTLEHARPEEPSWDEDFADVYHDLIHSPASETLLNLEHNYFVSISELIGERDVELKKLRERQGIEMEKVMQELGKSLTDQDVNSLAAQHFESQQDLENKWSNELKQSTAIQKQEYQEWVIKLHQDLKNPNNSSLSEEIKVQPSQFRESVEAIGRIYEEQRKLEESFTIHLGAQLKTMHNLRLLRADMLDFCKHKRNHRSGVKLHRLQTALSLYSTSLCGLVLLVDNRINSYSGIKRDFATVCQECTDFHFPRIEEQLEVVQQVVLYARTQRRSKLKESLDSGNQNGGNDDKTKNAERNYLNVLPGEFYITRHSNLSEIHVAFHLCVDDHVKSGNITARDPAIMGLRNILKVCCTHDITTISIPLLLVHDMSEEMTIPWCLRRAELVFKCVKGFMMEMASWDGGISRTVQFLVPQSISEEMFYQLSNMLPQIFRVSSTLTLTSKH

SEQ ID NO: 813386 - protein, 419 aa, Homo sapiens
MKKNRERFCNREREFVYKFKVGSQCLELRVPLKFPVQENASHLHGRLMLLHSLPCFIEKDLKEALTQFIEEESLSDYDRDAEASLAAVKSGEVDLHQLASTWAKAYAETTLEHARPEEPSWDEDFADVYHDLIHSPASETLLNLEHNYFVSISELIGERDVELKKLRERQGIEMEKVMQELGKSLTDQDVNSLAAQHFESQQDLENKWSNELKQSTAIQKQEYQEWVIKLHQDLKNPNNSSLSEEIKVQPSQFRESVEAIGRIYEEQRKLEESFTIHLGAQLKTMHNLRLLRADMLDFCKHKRNHRSGVKLHRLQTALSLYSTSLCGLVLLVDNRINSYSGIKRDFATVCQECTDFHFPRIEEQLEVVQQVVLYARTQRRSKLKESLDSGNQNGGNDDKTKNAERNYLNVLPGTTENTS

SEQ ID NO: 813387 - protein, 552 aa, Homo sapiens; identical to SEQ ID NO: 813385

SEQ ID NO: 813388 - protein, 528 aa, Homo sapiens
AVGVEKVCRQVSWFPSAGRADSSSERTAQDFGTRRDLKEALTQFIEEESLSDYDRDAEASLAAVKSGEVDLHQLASTWAKAYAETTLEHARPEEPSWDEDFADVYHDLIHSPASETLLNLEHNYFVSISELIGERDVELKKLRERQGIEMEKVMQELGKSLTDQDVNSLAAQHFESQQDLENKWSNELKQSTAIQKQEYQEWVIKLHQDLKNPNNSSLSEEIKVQPSQFRESVEAIGRIYEEQRKLEESFTIHLGAQLKTMHNLRLLRADMLDFCKHKRNHRSGVKLHRLQTALSLYSTSLCGLVLLVDNRINSYSGIKRDFATVCQECTDFHFPRIEEQLEVVQQVVLYARTQRRSKLKESLDSGNQNGGNDDKTKNAERNYLNVLPGEFYITRHSNLSEIHVAFHLCVDDHVKSGNITARDPAIMGLRNILKVCCTHDITTISIPLLLVHDMSEEMTIPWCLRRAELVFKCVKGFMMEMASWDGGISRTVQFLVPQSISEEMFYQLSNMLPQIFRVSSTLTLTSKH

SEQ ID NO: 813389 - protein, 268 aa, Homo sapiens
MHNLRLLRADMLDFCKHKRNHRSGVKLHRLQTALSLYSTSLCGLVLLVDNRINSYSGIKRDFATVCQECTDFHFPRIEEQLEVVQQVVLYARTQRRSKLKESLDSGNQNGGNDDKTKNAERNYLNVLPGEFYITRHSNLSEIHVAFHLCVDDHVKSGNITARDPAIMGLRNILKVCCTHDITTISIPLLLVHDMSEEMTIPWCLRRAELVFKCVKGFMMEMASWDGGISRTVQFLVPQSISEEMFYQLSNMLPQIFRVSSTLTLTSKH

SEQ ID NO: 813390 - protein, 552 aa, Homo sapiens; identical to SEQ ID NO: 813385

SEQ ID NO: 813391 - protein, 244 aa, Homo sapiens [sequence omitted]

SEQ ID NO: 813392 - protein, 167 aa, Homo sapiens
RYPTASVPTSTVPAECQRTSSRHFKEPARRGRKRRLRLRVLREERDFLRGCPVISGVAELLSGERVLYPNPVLLNPPTYFLSAPHTHKHRAAKNFHPPPPSLANFLPAFPELDDPRICKTGKKGRREGGQQRQDACFSLYQSRLKARQRAQGAGPTAAWMQSAALDA

SEQ ID NO: 813393 - protein, 1444 aa, Homo sapiens
MKNKGAKQKLKRKGAASAFGCDLTEYLESSGQDVPYVLKSCAEFIETHGIVDGIYRLSGVTSNIQRLRQEFGSDQCPDLTREVYLQDIHCVGSLCKLYFRELPNPLLTYELYEKFTEAVSHCPEEGQLARIQNVIQELPPSHYRTLEYLIRHLAHIASFSSKTNMHARNLALVWAPNLLRSKEIEATGCNGDAAFLAVRVQQVVIEFILNHVDQIFNNGAPGSLENDENRPIMKSLTLPALSLPMKLVSLEEAQARSLATNHPARKERRENSLPEIVPPMGTLFHTVLELPDNKRKLSSKSKKWKSIFNLGRSGSDSKSKLSRNGSVFVRGQRLSVEKATIRPAKSMDSLCSVPVEGKETKGNFNRTVTTGGFFIPATKMHSTGTGSSCDLTKQEGEWGQEGMPPGAEGGFDVSSDRSHLQGAQARPPPEQLKVFRPVEDPESEQTAPKMLGMFYTSNDSPSKSVFTSSLFQMEPSPRNQRKALNISEPFAVSVPLRVSAVISTNSTPCRTPPKELQSLSSLEEFSFHGSESGGWPEEEKPLGAETSAASVPKKAGLEDAKAVPEAPGTVECSKGLSQEPGAHLEEKKTPESSLSSQHLNELEKRPNPEKVVEEGREAGEMESSTLQESPRARAEAVLLHEMDEDDLANALIWPEIQQELKIIESEEELSSLPPPALKTSPIQPILESSLGPFIPSEPPGSLPCGSFPAPVSTPLEVWTRDPANQSTQGASTAASREKPEPEQGLHPDLASLAPLEIVPFEKASPQATVEVGGPGNLSPPLPPAPPPPTPLEESTPVLLSKGSPEREDSSRKLRTDLYIDQLKSQDSPEISSLCQGEEATPRHSDKQNSKNAASEGKGCGFPSPTREVEIVSQEEEDVTHSVQEPSDCDEDDTVTDIAQHGLEMVEPWEEPQWVTSPLHSPTLKDAHKAQVQGLQGHQLEKRLSHRPSLRQSHSLDSKPTVKSQWTLEVPSSSSCANLETERNSDPLQPQAPRREITGWDEKALRSFREFSGLKGAEAPPNQKGPSGVQPNPAETSPISLAEGKELGTHLGHSSPQIRQGGVPGPESSKESSPSVQDSTSPGEHPAKLQLKSTECGPPKGKNRPSSLNLDPAIPIADLFWFENVASFSSPGMQVSEPGDPKVTWMTSSYCKADPWRVYSQDPQDLDIVAHALTGRRNSAPVSVSAVRTSFMVKMCQARAVPVIPPKIQYTQIPQPLPSQSSGENGVQPLERSQEGPSSTSGTTQKPAKDDSPSSLESSKEEKPKQDPGAIKSSPVDATAPCMCEGPTLSPEPGSSNLLSTQDAVVQCRKRMSETEPSGDNLLSSKLERPSGGSKPFHRSRPGRPQSLILFSPPFPIMDHLPPSSTVTDSKVLLSPIRSPTQTVSPGLLCGELAENTWVTPEGVTLRNKMTIPKNGQRLETSTSCFYQPQRRSVILDGRSGRQIE

SEQ ID NO: 813394 - protein, 1444 aa, Homo sapiens; identical to SEQ ID NO: 813393

SEQ ID NO: 813395 - protein, 504 aa, Homo sapiens
LSGSVHERVHSSLQSISNGTTVNQWTLEVPSSSSCANLETERNSDPLQPQAPRREITGWDEKALRSFREFSGLKGAEAPPNQKGPSGVQPNPAETSPISLAEGKELGTHLGHSSPQIRQGGVPGPESSKESSPSVQDSTSPGEHPAKLQLKSTECGPPKGKNRPSSLNLDPAIPIADLFWFENVASFSSPGMQVSEPGDPKVTWMTSSYCKADPWRVYSQDPQDLDIVAHALTGRRNSAPVSVSAVRTSFMVKMCQARAVPVIPPKIQYTQIPQPLPSQSSGENGVQPLERSQEGPSSTSGTTQKPAKDDSPSSLESSKEEKPKQDPGAIKSSPVDATAPCMCEGPTLSPEPGSSNLLSTQDAVVQCRKRMSETEPSGDNLLSSKLERPSGGSKPFHRSRPGRPQSLILFSPPFPIMDHLPPSSTVTDSKVLLSPIRSPTQTVSPGLLCGELAENTWVTPEGVTLRNKMTIPKNGQRLETSTSCFYQPQRRSVILDGRSGRQIE

SEQ ID NO: 813396 - protein, 1444 aa, Homo sapiens; identical to SEQ ID NO: 813393

SEQ ID NO: 813397 - protein, 1444 aa, Homo sapiens; identical to SEQ ID NO: 813393

SEQ ID NO: 813398 - protein, 1444 aa, Homo sapiens; identical to SEQ ID NO: 813393

SEQ ID NO: 813399 - protein, 1438 aa, Homo sapiens
MKNKGAKQKLKRKGAASAFGCDLTEYLESSGQDVPYVLKSCAEFIETHGIVDGIYRLSGVTSNIQRLRQEFGSDQCPDLTREVYLQDIHCVGSLCKLYFRELPNPLLTYELYEKFTEAVSHCPEEGQLARIQNVIQELPPSHYRTLEYLIRHLAHIASFSSKTNMHARNLALVWAPNLLRSKEIEATGCNGDAAFLAVRVQQVVIEFILNHVDQIFNNGAPGSLENDENRPIMKSLTLPALSLPMKLVSLEEAQARSLATNHPARKERRENSLPEIVPPMGTLFHTVLELPDNKRKLSSKSKKWKSIFNLGRSGSDSKSKLSRNGSVFVRGQRLSVEKATIRPAKSMDSLCSVPVEGKETKGNFNRTVTTGGFFIPATKMHSTGTGSSCDLTKQEGEWGQEGMPPGAEGGFDVSSDRSHLQGAQARPPPEQLKVFRPVEDPESEQTAPKMLGMFYTSNDSPSKSVFTSSLFQMEPSPRNQRKALNISEPFAVSVPLRVSAVISTNSTPCRTPPKELQSLSSLEEFSFHGSESGGWPEEEKPLGAETSAASVPKKAGLEDAKAVPEAPGTVECSKGLSQEPGAHLEEKKTPESSLSSQHLNELEKRPNPEKVVEEGREAGEMESSTLQESPRARAEAVLLHEMDEDDLANALIWPEIQQELKIIESEEELSSLPPPALKTSPIQPILESSLGPFIPSEPPGSLPCGSFPAPVSTPLEVWTRDPANQSTQGASTAASREKPEPEQGLHPDLASLAPLEIVPFEKASPQATVEVGGPGNLSPPLPPAPPPPTPLEESTPVLLSKGSPEREDSSRKLRTDLYIDQLKSQDSPEISSLCQGEEATPRHSDKQNSKNAASEGKGCGFPSPTREVEIVSQEEEDVTHSVQEPSDCDEDDTVTDIAQHGLEMVEPWEEPQWVTSPLHSPTLKDAHKAQVQGLQGHQLEKRLSHRPSLRQSHSLDSKPTVKSQWTLEVPSSSSCANLETERNSDPLQPQAPRREITGWDEKALRSFREFSGLKGAEAPPNQKGPSGVQPNPAETSPISLAEGKELGTHLGHSSPQIRQGGVPGPESSKESSPSVQDSTSPGEHPAKLQLKSTECGPPKGKNRPSSLNLDPAIPIADLFWFENVASFSSPGMQVSEPGDPKVTWMTSSYCKADPWRVYSQDPQDLDIVAHALTGRRNSAPVSVSAVRTSFMVKMCQARAVPVIPPKIQYTQIPQPLPSQSSGENGVQPLERSQEGPSSTSGTTQKPAKDDSPSSLESSKEEKPKQDPGAIKSSPVDATAPCMCEGPTLSPEPGSSNLLSTQDAVVQCRKRMSETEPSGDNLLSSKLERPSGGSKPFHRSRPGRPQSLILFSPPFPIMDHLPPSSTVTDSKVLLSPIRSPTQTVSPGLLCGELAENTWVTPEGVTLRNKMTIPKNGQCGERVCGESQCGEKCGESQCEE

SEQ ID NO: 813400 - protein, 617 aa, Homo sapiens
MDLKTAVFNAARDGKLRLLTKLLASKSKEEVSSLISEKTNGATPLLMAARYGHLDMVEFLLEQCSASIEVGGSVNFDGETIEGAPPLWAASAAGHLKVVQSLLNHGASVNNTTLTNSTPLRAACFDGHLEIVKYLVEHKADLEVSNRHGHTCLMISCYKGHKEIAQYLLEKGADVNRKSVKGNTALHDCAESGSLDIMKMLLMYCAKMEKDGYGMTPLLSASVTGHTNIVDFLTHHAQTSKTERINALELLGATFVDKKRDLLGALKYWKKAMNMRYSDRTNIISKPVPQTLIMAYDYAKEVNSAEELEGLIADPDEMRMQALLIRERILGPSHPDTSYYIRYRGAVYADSGNFKRCINLWKYALDMQQSNLDPLSPMTASSLLSFAELFSFMLQDRAKGLLGTTVTFDDLMGILCKSVLEIERAIKQTQCPADPLQLNKALSIILHLICLLEKVPCTLEQDHFKKQTIYRFLKLHPRGKNNFSPLHLAVDKNTTCVGRYPVCKFPSLQVTAILIECGADVNVRDSDDNSPLHIAALNNHPDIMNLLIKSGAHFDATNLHKQTASDLLDEKEIAKNLIQPINHTTLQCLAARVIVNHRIYYKGHIPEKLETFVSLHR

SEQ ID NO: 813401 - protein, 617 aa, Homo sapiens; identical to SEQ ID NO: 813400

SEQ ID NO: 813402 - protein, 617 aa, Homo sapiens; identical to SEQ ID NO: 813400

SEQ ID NO: 813403 - protein, 617 aa, Homo sapiens; identical to SEQ ID NO: 813400

SEQ ID NO: 813404 - protein, 550 aa, Homo sapiens
MTGDKGPQRLSGSSYGSISSPTSPTSPGPQQAPPRETYLSEKIPIPDTKPGTFSLRKLWAFTGPGFLMSIAFLDPGNIESDLQAGAVAGFKLLWVLLWATVLGLLCQRLAARLGVVTGKDLGEVCHLYYPKVPRTVLWLTIELAIVGSDMQEVIGTAIAFNLLSAGRIPLWGGVLITIVDTFFFLFLDNYGLRKLEAFFGLLITIMALTFGYEYVVARPEQGALLRGLFLPSCPGCGHPELLQAVGIVGAIIMPHNIYLHSALVKSREIDRARRADIREANMYFLIEATIALSVSFIINLFVMAVFGQAFYQKTNQAAFNICANSSLHDYAKIFPMNNATVAVDIYQGGVILGCLFGPAALYIWAIGLLAAGQSSTMTGTYAGQFVMEGFLRLRWSRFARVLLTRSCAILPTVLVAVFRDLRDLSGLNDLLNVLQSLLLPFAVLPILTFTSMPTLMQEFANGLLNKVVTSSIMVLVCAINLYFVVSYLPSLPHPAYFGLAALLAAAYLGLSTYLVWTCCLAHGATFLAHSSHHHFLYGLLEEDQKGETSG

SEQ ID NO: 813405 - protein, 483 aa, Homo sapiens
MSIAFLDPGNIESDLQAGAVAGFKLLWVLLWATVLGLLCQRLAARLGVVTGKDLGEVCHLYYPKVPRTVLWLTIELAIVGSDMQEVIGTAIAFNLLSAGRIPLWGGVLITIVDTFFFLFLDNYGLRKLEAFFGLLITIMALTFGYEYVVARPEQGALLRGLFLPSCPGCGHPELLQAVGIVGAIIMPHNIYLHSALVKSREIDRARRADIREANMYFLIEATIALSVSFIINLFVMAVFGQAFYQKTNQAAFNICANSSLHDYAKIFPMNNATVAVDIYQGGVILGCLFGPAALYIWAIGLLAAGQSSTMTGTYAGQFVMEGFLRLRWSRFARVLLTRSCAILPTVLVAVFRDLRDLSGLNDLLNVLQSLLLPFAVLPILTFTSMPTLMQEFANGLLNKVVTSSIMVLVCAINLYFVVSYLPSLPHPAYFGLAALLAAAYLGLSTYLVWTCCLAHGATFLAHSSHHHFLYGLLEEDQKGETSG

SEQ ID NO: 813406 - protein, 550 aa, Homo sapiens; identical to SEQ ID NO: 813404

SEQ ID NO: 813407 - protein, 550 aa, Homo sapiens; identical to SEQ ID NO: 813404

SEQ ID NO: 813408 - protein, 648 aa, Homo sapiens
MTGDKGPQRLSGSSYGSISSPTSPTSPGPQQAPPRETYLSEKIPIPDTKPLLWVLLWATVLGLLCQRLAARLGVVTGKDLGEVCHLYYPKVPRTVLWLTIELAIVGSDMQEVIGTAIAFNLLSAGRYHPSVPQLFRPGREQLLLLPPLTSPSQSLFYPAVPSEAGLLPCFPKCKVTCLKSHRCESCRTLGLQPQTPCCAGCQVSPLALPCLDCSMPHSHSPCPSCLGALRVLLPGGQIPVSSPEAPKELETPGPGWADPGHSGFRIPLWGGVLITIVDTFFFLFLDNYGLRKLEAFFGLLITIMALTFGYEYVVARPEQGALLRGLFLPSCPGCGHPELLQAVGIVGAIIMPHNIYLHSALVKSREIDRARRADIREANMYFLIEATIALSVSFIINLFVMAVFGQAFYQKTNQAAFNICANSSLHDYAKIFPMNNATVAVDIYQGGVILGCLFGPAALYIWAIGLLAAGQSSTMTGTYAGQFVMEGFLRLRWSRFARVLLTRSCAILPTVLVAVFRDLRDLSGLNDLLNVLQSLLLPFAVLPILTFTSMPTLMQEFANGLLNKVVTSSIMVLVCAINLYFVVSYLPSLPHPAYFGLAALLAAAYLGLSTYLVWTCCLAHGATFLAHSSHHHFLYGLLEEDQKGETSG

SEQ ID NO: 813409 - protein, 345 aa, Homo sapiens
MALTFGYEYVVARPEQGALLRGLFLPSCPGCGHPELLQAVGIVGAIIMPHNIYLHSALVKSREIDRARRADIREANMYFLIEATIALSVSFIINLFVMAVFGQAFYQKTNQAAFNICANSSLHDYAKIFPMNNATVAVDIYQGGVILGCLFGPAALYIWAIGLLAAGQSSTMTGTYAGQFVMEGFLRLRWSRFARVLLTRSCAILPTVLVAVFRDLRDLSGLNDLLNVLQSLLLPFAVLPILTFTSMPTLMQEFANGLLNKVVTSSIMVLVCAINLYFVVSYLPSLPHPAYFGLAALLAAAYLGLSTYLVWTCCLAHGATFLAHSSHHHFLYGLLEEDQKGETSG

SEQ ID NO: 813410 - protein, 575 aa, Homo sapiens
MTGDKGPQRLSGSSYGSISSPTSPTSPGPQQAPPRETYLSEKIPIPDTKPGTFSLRKLWAFTGPGFLMSIAFLDPGNIESDLQAGAVAGFKLLWVLLWATVLGLLCQRLAARLGVVTGKDLGEVCHLYYPKSESRSVAQSGVQWCDVSSLQTSTSQVPRTVLWLTIELAIVGSDMQEVIGTAIAFNLLSAGRIPLWGGVLITIVDTFFFLFLDNYGLRKLEAFFGLLITIMALTFGYEYVVARPEQGALLRGLFLPSCPGCGHPELLQAVGIVGAIIMPHNIYLHSALVKSREIDRARRADIREANMYFLIEATIALSVSFIINLFVMAVFGQAFYQKTNQAAFNICANSSLHDYAKIFPMNNATVAVDIYQGGVILGCLFGPAALYIWAIGLLAAGQSSTMTGTYAGQFVMEGFLRLRWSRFARVLLTRSCAILPTVLVAVFRDLRDLSGLNDLLNVLQSLLLPFAVLPILTFTSMPTLMQEFANGLLNKVVTSSIMVLVCAINLYFVVSYLPSLPHPAYFGLAALLAAAYLGLSTYLVWTCCLAHGATFLAHSSHHHFLYGLLEEDQKGETSG

SEQ ID NO: 813411 - protein, 553 aa, Homo sapiens
MTGDKGPQRLSGSSYGSISSPTSPTSPGPQQAPPRETYLSEKIPIPDTKPGTFSLRKLWAFTGPGFLMSIAFLDPGNIESDLQAGAVAGFKLLWVLLWATVLGLLCQRLAARLGVVTGKDLGEVCHLYYPKVPRTVLWLTIELAIVGSDMQEVIGTAIAFNLLSAGRIPLWGGVLITIVDTFFFLFLDNYGLGESWKAFVGTSLQPLLALNLGAMQYVVARPEQGALLRGLFLPSCPGCGHPELLQAVGIVGAIIMPHNIYLHSALVKSREIDRARRADIREANMYFLIEATIALSVSFIINLFVMAVFGQAFYQKTNQAAFNICANSSLHDYAKIFPMNNATVAVDIYQGGVILGCLFGPAALYIWAIGLLAAGQSSTMTGTYAGQFVMEGFLRLRWSRFARVLLTRSCAILPTVLVAVFRDLRDLSGLNDLLNVLQSLLLPFAVLPILTFTSMPTLMQEFANGLLNKVVTSSIMVLVCAINLYFVVSYLPSLPHPAYFGLAALLAAAYLGLSTYLVWTCCLAHGATFLAHSSHHHFLYGLLEEDQKGETSG

SEQ ID NO: 813412 - protein, 114 aa, Homo sapiens
MRRISSFLKGQRCEWVPQGEKRWDRSGATWASAAEGTWARGPPASSGFGTGEDGSMPAEGGDGWGTFSEERHLPDPLASWKCPRCTPYTPLLALSASPLPGSVLQVGEGGKVPN

SEQ ID NO: 813413 - protein, 114 aa, Homo sapiens; identical to SEQ ID NO: 813412

SEQ ID NO: 813414 - protein, 326 aa, Homo sapiens [sequence omitted]

SEQ ID NO: 813415 - protein, 141 aa, Homo sapiens
MQLVRSGSYGWSRGTRAAMASHVECRPLGVFECELCTLTAPYSYVGQKPPNTQSMVLLEESYVMKDPFTSDKDRFLVLGSCCSLCSRLVCVGPECSLFYSKRFCLPCVRENINAFPQEIRQDLEKRKAPSKRTPSQPGSRT

SEQ ID NO: 813416 - protein, 237 aa, Homo sapiens
DWGERAVALPCAASGCLPLAGTEFRAGVACWVPSARSRRSRSQLWGRDREAGCGPHGTVPPDLGQRWGERGQAEARGDHQHPRTLSAVPVHRRRPQEPRQGPRTPRRAEEKRDQMASHVECRPLGVFECELCTLTAPYSYVGQKPPNTQSMVLLEESYVMKDPFTSDKDRFLVLGSCCSLCSRLVCVGPECSLFYSKRFCLPCVRENINAFPQEIRQDLEKRKAPSKRTPSQPGSRT

SEQ ID NO: 813417 - protein, 190 aa, Homo sapiens
APWTRSRGTRAAPPGGKLCHEGSLHLRQGQIPGPRLVLQFVQQAGVCGPGMQFILLQEILPPLCPGEHQCFSSGNSARLGEKESSIKEDPQPARFSDVSATGARSSGGTLHRAPGPACARDAAELGAAMPGLVSGPLGAALQPRGAGVQLGAATGPGSCSKRVVQRQMPDKTQPGTRPGPPTCPSGPRPE

SEQ ID NO: 813418 - protein, 196 aa, Homo sapiens
MQLVRSGSYGWSRGTRAAMASHVECRPLGVFECELCTLTAPYSYVGQKPPNTQSMGMQFILLQEILPPLCPGEHQCFSSGNSARLGEKESSIKEDPQPARFSDVSATGARSSGGTLHRAPGPACARDAAELGAAMPGLVSGPLGAALQPRGAGVQLGAATGPGSCSKRVVQRQMPDKTQPGTRPGPPTCPSGPRPE

SEQ ID NO: 813419 - protein, 257 aa, Homo sapiens
MASHVECRPLGVFECELCTLTAPYSYVGQKPPNTQSMVLLEESYVMKDPFTSDKDRFLVLGSCCSLCSRLVCVGPMFLEGSPGEGTVLSGALVVCQVLCLGPVLLLRLHSVLPLSSGMQFILLQEILPPLCPGEHQCFSSGNSARLGEKESSIKEDPQPARFSDVSATGARSSGGTLHRAPGPACARDAAELGAAMPGLVSGPLGAALQPRGAGVQLGAATGPGSCSKRVVQRQMPDKTQPGTRPGPPTCPSGPRPE

SEQ ID NO: 813420 - protein, 175 aa, Homo sapiens
MQLVRSGSYGWSRGTRAAMASHVECRPLGVFECELCTLTAPYSYVGQKPPNTQSMVLLEESYVMKDPFTSDKDRFLVLGSCCSLCSRLVCVGPECSLFYSKRFCLPCVRENINAFPQEIRQDLEKRKAPSKRTPSQPGSRTTSSCLEKESSTETFGYPTFSLDTWPGNSWGLLGS

SEQ ID NO: 813421 - protein, 237 aa, Homo sapiens; identical to SEQ ID NO: 813416

SEQ ID NO: 813422 - protein, 346 aa, Homo sapiens
MAASGKLSTCRLPPLPTIREIIKLLRLQAAKQLSQNFLLDLRLTDKIVRKAGNLTNAYVYEVGPGPGGITRSILNADVAELLVVEKDTRFIPGLQMLSDAAPGKLRIVHGDVLTFKVEKAFSESLKRPWEDDPPNVHIIGNLPFSVSTPLIIKWLENISCRDGPFVYGRTQMTLTFQKEVAERLAANTGSKQRSRLSVMAQYLCNVRHIFTIPGQAFVPKPEVDVGVVHFTPLIQPKIEQPFKLVEKVVQNVFQFRRKYCHRGLRMLFPEAQRLESTGRLLELADIDPTLRPRQLSISHFKSLCDVYRKMCDEDPQLFAYNFREELKRRKSKNEEKEEDDAENYRL

SEQ ID NO: 813423 - protein, 288 aa, Homo sapiens
MAASGKLSTCRLPPLPTIREIIKLLRLQAAKQLSQNFLLDLRLTDKIVRKAGNLTNAYVYEVGPGPGGITRSILNADVAELLVVEKDTRFIPGLQMLSDAAPGKLRIVHGDVLTFKVEKAFSESLKRPWEDDPPNVHIIGNLPFSVSTPLIIKWLENISCRDGPFVYGRTQMTLTFQKEVAERLAANTGSKQRSRLSVMAQYLCNVRHIFTIPGQAFVPKPEVDVGVVHFTPLIQPKIEQPFKLVEKVVQNVFQFRRKYCHRGLREELKRRKSKNEEKEEDDAENYRL

SEQ ID NO: 813424 - protein, 103 aa, Homo sapiens
MAASGKLSTCRLPPLPTIREIIKLLRLQAAKQLSQNFLLDLRLTDKIVRKAGNLTNAYVYEVGPGPGGITRSILNADVAELLVVEKDTRFIPGLQVRCLKCLL

SEQ ID NO: 813425 - protein, 267 aa, Homo sapiens
MAASGKLSTCRLPPLPTIREIIKLLRLQAAKQLSQNFLLDLRLTDKIVRKAGNLTNAYVYEVGPGPGGITRSILNADVAELLVVEKDTRFIPGLQMLSDAAPGKLRIVHGDVLTFKVEKAFSESLKRPWEDDPPNVHIIGNLPFSVSTPLIIKWLENISCRDGPFVYGRTQMTLTFQKEVAERLAANTGSKQRSRLSVMAQYLCNVRHIFTIPGQAFVPKPESCLCLSGHLKLLLESSVAFQTTLMNSVQLINQCLPKISGVSIWEV

SEQ ID NO: 813426 - protein, 407 aa, Homo sapiens
MAASGKLSTCRLPPLPTIREIIKLLRLQAAKQLSQNFLLDLRLTGGWLSSAPRMSPQCPWGRGPGGLARPRGRVSRHWRATGFWSGPSTSLYQKNSGPTAQETRDNKIVRKAGNLTNAYVYEVGPGPGGITRSILNADVAELLVVEKDTRFIPGLQMLSDAAPGKLRIVHGDVLTFKVEKAFSESLKRPWEDDPPNVHIIGNLPFSVSTPLIIKWLENISCRDGPFVYGRTQMTLTFQKEVAERLAANTGSKQRSRLSVMAQYLCNVRHIFTIPGQAFVPKPEVDVGVVHFTPLIQPKIEQPFKLVEKVVQNVFQFRRKYCHRGLRMLFPEAQRLESTGRLLELADIDPTLRPRQLSISHFKSLCDVYRKMCDEDPQLFAYNFREELKRRKSKNEEKEEDDAENYRL

SEQ ID NO: 813427 - protein, 382 aa, Homo sapiens
MAASGKLSTCRLPPLPTIREIIKLLRLQAAKQLSQNFLLDLRLTDGVSLLLPKLECNGMISAHCNLRLPGSSDSLCLSLPDKIVRKAGNLTNAYVYEVGPGPGGITRSILNADVAELLVVEKDTRFIPGLQMLSDAAPGKLRIVHGDVLTFKVEKAFSESLKRPWEDDPPNVHIIGNLPFSVSTPLIIKWLENISCRDGPFVYGRTQMTLTFQKEVAERLAANTGSKQRSRLSVMAQYLCNVRHIFTIPGQAFVPKPEVDVGVVHFTPLIQPKIEQPFKLVEKVVQNVFQFRRKYCHRGLRMLFPEAQRLESTGRLLELADIDPTLRPRQLSISHFKSLCDVYRKMCDEDPQLFAYNFREELKRRKSKNEEKEEDDAENYRL

SEQ ID NO: 813428 - protein, 251 aa, Homo sapiens
MLSDAAPGKLRIVHGDVLTFKVEKAFSESLKRPWEDDPPNVHIIGNLPFSVSTPLIIKWLENISCRDGPFVYGRTQMTLTFQKEVAERLAANTGSKQRSRLSVMAQYLCNVRHIFTIPGQAFVPKPEVDVGVVHFTPLIQPKIEQPFKLVEKVVQNVFQFRRKYCHRGLRMLFPEAQRLESTGRLLELADIDPTLRPRQLSISHFKSLCDVYRKMCDEDPQLFAYNFREELKRRKSKNEEKEEDDAENYRL

SEQ ID NO: 813429 - protein, 172 aa, Homo sapiens
MLSDAAPGKLRIVHGDVLTFKVEKAFSESLKRPWEDDPPNVHIIGNLPFSVSTPLIIKWLENISCRDGPFVYGRTQMTLTFQKEVAERLAANTGSKQRSRLSVMAQYLCNVRHIFTIPGQAFVPKPESCLCLSGHLKLLLESSVAFQTTLMNSVQLINQCLPKISGVSIWEV

SEQ ID NO: 813430 - protein, 931 aa, Homo sapiens
MPPLKSPAAFHEQRRSLERARTEDYLKRKIRSRPERSELVRMHILEETSAEPSLQAKQLKLKRARLADDLNEKIAQRPGPMELVEKNILPVESSLKEAIIVGQVNYPKVADSSSFDEDSSDALSPEQPASHESQGSVPSPLEARVSEPLLSATSASPTQVVSQLPMGRDSREMLFLAEQPPLPPPPLLPPSLTNGTTIPTAKSTPTLIKQSQPKSASEKSQRSKKAKELKPKVKKLKYHQYIPPDQKQDRGAPPMDSSYAKILQQQQLFLQLQILNQQQQQHHNYQAILPAPPKSAGEALGSSGTPPVRSLSTTNSSSSSGAPGPCGLARQNSTSLTGKPGALPANLDDMKVAELKQELKLRSLPVSGTKTELIERLRAYQDQISPVPGAPKAPAATSILHKAGEVVVAFPAARLSTGPALVAAGLAPAEVVVATVASSGVVKFGSTGSTPPVSPTPSERSLLSTGDENSTPGDTFGEMVTSPLTQLTLQASPLQILVKEEGPRAGSCCLSPGGRAELEGRDKDQMLQEKDKQIEALTRMLRQKQQLVERLKLQLEQEKRAQQPAPAPAPLGTPVKQENSFSSCQLSQQPLGPAHPFNPSLAAPATNHIDPCAVAPGPPSVVVKQEALQPEPEPVPAPQLLLGPQGPSLIKGVAPPTLITDSTGTHLVLTVTNKNADSPGLSSGSPQQPSSQPGSPAPAPSAQMDLEHPLQPLFGTPTSLLKKEPPGYEEAMSQQPKQQENGSSSQQMDDLFDILIQSGEISADFKEPPSLPGKEKPSPKTVCGSPLAAQPSPSAELPQAAPPPPGSPSLPGRLEDFLESSTGLPLLTSGHDGPEPLSLIDDLHSQMLSSTAILDHPPSPMDTSELHFVPEPSSTMGLDLADGHLDSMDWLELSSGGPVLSLAPLSTTAPSLFSTDFLDGHDLQLHWDSCL

SEQ ID NO: 813431 - protein, 1839 aa, Homo sapiens
MKGKERSPVKAKRSRGGEDSTSRGERSKKLGGSGGSNGSSSGKTDSGGGSRRSLHLDKSSSRGGSREYDTGGGSSSSRLHSYSSPSTKNSSGGGESRSSSRGGGGESRSSGAASSAPGGGDGAEYKTLKISELGSQLSDEAVEDGLFHEFKRFGDVSVKISHLSGSGSGDERVAFVNFRRPEDARAAKHARGRLVLYDRPLKIEAVYVSRRRSRSPLDKDTYPPSASVVGASVGGHRHPPGGGGGQRSLSPGGAALGYRDYRLQQLALGRLPPPPPPPLPRDLERERDYPFYERVRPAYSLEPRVGAGAGAAPFREVDEISPEDDQRANRTLFLGNLDITVTESDLRRAFDRFGVITEVDIKRPSRGQTSTYGFLKFENLDMSHRAKLAMSGKIIIRNPIKIGYGKATPTTRLWVGGLGPWVPLAALAREFDRFGTIRTIDYRKGDSWAYIQYESLDAAHAAWTHMRGFPLGGPDRRLRVDFADTEHRYQQQYLQPLPLTHYELVTDAFGHRAPDPLRGARDRTPPLLYRDRDRDLYPDSDWVPPPPPVRERSTRTAATSVPAYEPLDSLDRRRDGWSLDRDRGDRDLPSSRDQPRKRRLPEESGGRHLDRSPESDRPRKRHCAPSPDRSPELSSSRDRYNSDNDRSSRLLLERPSPIRDRRGSLEKSQGDKRDRKNSASAERDRKHRTTAPTEGKSPLKKEDRSDGSAPSTSTASSKLKSPSQKQDGGTAPVASASPKLCLAWQGMLLLKNSNFPSNMHLLQGDLQVASSLLVEGSTGGKVAQLKITQRLRLDQPKLDEVTRRIKVAGPNGYAILLAVPGSSDSRSSSSSAASDTATSTQRPLRNLVSYLKQKQAAGVISLPVGGNKDKENTGVLHAFPPCEFSQQFLDSPAKALAKSEEDYLVMIIVRALKSPAAFHEQRRSLERARTEDYLKRKIRSRPERSELVRMHILEETSAEPSLQAKQLKLKRARLADDLNEKIAQRPGPMELVEKNILPVESSLKEAIIVGQVNYPKVADSSSFDEDSSDALSPEQPASHESQGSVPSPLEARVSEPLLSATSASPTQVVSQLPMGRDSREMLFLAEQPPLPPPPLLPPSLTNGTTIPTAKSTPTLIKQSQPKSASEKSQRSKKAKELKPKVKKLKYHQYIPPDQKQDRGAPPMDSSYAKILQQQQLFLQLQILNQQQQQHHNYQAILPAPPKSAGEALGSSGTPPVRSLSTTNSSSSSGAPGPCGLARQNSTSLTGKPGALPANLDDMKVAELKQELKLRSLPVSGTKTELIERLRAYQDQISPVPGAPKAPAATSILHKAGEVVVAFPAARLSTGPALVAAGLAPAEVVVATVASSGVVKFGSTGSTPPVSPTPSERSLLSTGDENSTPGDTFGEMVTSPLTQLTLQASPLQILVKEEGPRAGSCCLSPGGRAELEGRDKDQMLQEKDKQIEALTRMLRQKQQLVERLKLQLEQEKRAQQPAPAPAPLGTPVKQENSFSSCQLSQQPLGPAHPFNPSLAAPATNHIDPCAVAPGPPSVVVKQEALQPEPEPVPAPQLLLGPQGPSLIKGVAPPTLITDSTGTHLVLTVTNKNADSPGLSSGSPQQPSSQPGSPAPAPSAQMDLEHPLQPLFGTPTSLLKKEPPGYEEAMSQQPKQQENGSSSQQMDDLFDILIQSGEISADFKEPPSLPGKEKPSPKTVCGSPLAAQPSPSAELPQAAPPPPGSPSLPGRLEDFLESSTGLPLLTSGHDGPEPLSLIDDLHSQMLSSTAILDHPPSPMDTSELHFVPEPSSTMGLDLADGHLDSMDWLELSSGGPVLSLAPLSTTAPSLFSTDFLDGHDLQLHWDSCL

SEQ ID NO: 813432 - protein, 958 aa, Homo sapiens
MRREGSTVLQLKLQQRRTREELVSQGIMPPLKSPAAFHEQRRSLERARTEDYLKRKIRSRPERSELVRMHILEETSAEPSLQAKQLKLKRARLADDLNEKIAQRPGPMELVEKNILPVESSLKEAIIVGQVNYPKVADSSSFDEDSSDALSPEQPASHESQGSVPSPLEARVSEPLLSATSASPTQVVSQLPMGRDSREMLFLAEQPPLPPPPLLPPSLTNGTTIPTAKSTPTLIKQSQPKSASEKSQRSKKAKELKPKVKKLKYHQYIPPDQKQDRGAPPMDSSYAKILQQQQLFLQLQILNQQQQQHHNYQAILPAPPKSAGEALGSSGTPPVRSLSTTNSSSSSGAPGPCGLARQNSTSLTGKPGALPANLDDMKVAELKQELKLRSLPVSGTKTELIERLRAYQDQISPVPGAPKAPAATSILHKAGEVVVAFPAARLSTGPALVAAGLAPAEVVVATVASSGVVKFGSTGSTPPVSPTPSERSLLSTGDENSTPGDTFGEMVTSPLTQLTLQASPLQILVKEEGPRAGSCCLSPGGRAELEGRDKDQMLQEKDKQIEALTRMLRQKQQLVERLKLQLEQEKRAQQPAPAPAPLGTPVKQENSFSSCQLSQQPLGPAHPFNPSLAAPATNHIDPCAVAPGPPSVVVKQEALQPEPEPVPAPQLLLGPQGPSLIKGVAPPTLITDSTGTHLVLTVTNKNADSPGLSSGSPQQPSSQPGSPAPAPSAQMDLEHPLQPLFGTPTSLLKKEPPGYEEAMSQQPKQQENGSSSQQMDDLFDILIQSGEISADFKEPPSLPGKEKPSPKTVCGSPLAAQPSPSAELPQAAPPPPGSPSLPGRLEDFLESSTGLPLLTSGHDGPEPLSLIDDLHSQMLSSTAILDHPPSPMDTSELHFVPEPSSTMGLDLADGHLDSMDWLELSSGGPVLSLAPLSTTAPSLFSTDFLDGHDLQLHWDSCL

SEQ ID NO: 813433 - protein, 881 aa, Homo sapiens
MPPLKSPAAFHEQRRSLERARTEDYLKRKIRSRPERSELVRMHILEETSAEPSLQAKQLKLKRARLADDLNEKIAQRPGPMELVEKNILPVESSLKEAIIVGQVNYPKVADSSSFDEDSSDALSPEQPASHESQGSVPSPLEARVSEPLLSATSASPTQQSQPKSASEKSQRSKKAKELKPKVKKLKYHQYIPPDQKQDRGAPPMDSSYAKILQQQQLFLQLQILNQQQQQHHNYQAILPAPPKSAGEALGSSGTPPVRSLSTTNSSSSSGAPGPCGLARQNSTSLTGKPGALPANLDDMKVAELKQELKLRSLPVSGTKTELIERLRAYQDQISPVPGAPKAPAATSILHKAGEVVVAFPAARLSTGPALVAAGLAPAEVVVATVASSGVVKFGSTGSTPPVSPTPSERSLLSTGDENSTPGDTFGEMVTSPLTQLTLQASPLQILVKEEGPRAGSCCLSPGGRAELEGRDKDQMLQEKDKQIEALTRMLRQKQQLVERLKLQLEQEKRAQQPAPAPAPLGTPVKQENSFSSCQLSQQPLGPAHPFNPSLAAPATNHIDPCAVAPGPPSVVVKQEALQPEPEPVPAPQLLLGPQGPSLIKGVAPPTLITDSTGTHLVLTVTNKNADSPGLSSGSPQQPSSQPGSPAPAPSAQMDLEHPLQPLFGTPTSLLKKEPPGYEEAMSQQPKQQENGSSSQQMDDLFDILIQSGEISADFKEPPSLPGKEKPSPKTVCGSPLAAQPSPSAELPQAAPPPPGSPSLPGRLEDFLESSTGLPLLTSGHDGPEPLSLIDDLHSQMLSSTAILDHPPSPMDTSELHFVPEPSSTMGLDLADGHLDSMDWLELSSGGPVLSLAPLSTTAPSLFSTDFLDGHDLQLHWDSCL

SEQ ID NO: 813434 - protein, 904 aa, Homo sapiens
LGTIPSLGNEELVRLYILEETSAEPSLQAKQLKLKRARLADDLNEKIAQRPGPMELVEKNILPVESSLKEAIIVGQVNYPKVADSSSFDEDSSDALSPEQPASHESQGSVPSPLEARVSEPLLSATSASPTQVVSQLPMGRDSREMLFLAEQPPLPPPPLLPPSLTNGTTIPTAKSTPTLIKQSQPKSASEKSQRSKKAKELKPKVKKLKYHQYIPPDQKQDRGAPPMDSSYAKILQQQQLFLQLQILNQQQQQHHNYQAILPAPPKSAGEALGSSGTPPVRSLSTTNSSSSSGAPGPCGLARQNSTSLTGKPGALPANLDDMKVAELKQELKLRSLPVSGTKTELIERLRAYQDQISPVPGAPKAPAATSILHKAGEVVVAFPAARLSTGPALVAAGLAPAEVVVATVASSGVVKFGSTGSTPPVSPTPSERSLLSTGDENSTPGDTFGEMVTSPLTQLTLQASPLQILVKEEGPRAGSCCLSPGGRAELEGRDKDQMLQEKDKQIEALTRMLRQKQQLVERLKLQLEQEKRAQQPAPAPAPLGTPVKQENSFSSCQLSQQPLGPAHPFNPSLAAPATNHIDPCAVAPGPPSVVVKQEALQPEPEPVPAPQLLLGPQGPSLIKGVAPPTLITDSTGTHLVLTVTNKNADSPGLSSGSPQQPSSQPGSPAPAPSAQMDLEHPLQPLFGTPTSLLKKEPPGYEEAMSQQPKQQENGSSSQQMDDLFDILIQSGEISADFKEPPSLPGKEKPSPKTVCGSPLAAQPSPSAELPQAAPPPPGSPSLPGRLEDFLESSTGLPLLTSGHDGPEPLSLIDDLHSQMLSSTAILDHPPSPMDTSELHFVPEPSSTMGLDLADGHLDSMDWLELSSGGPVLSLAPLSTTAPSLFSTDFLDGHDLQLHWDSCL

SEQ ID NO: 813435 - protein, 931 aa, Homo sapiens; identical to SEQ ID NO: 813430

SEQ ID NO: 813436 - protein, 256 aa, Homo sapiens
PPGHWSSPCSPVQPSSQPGSPAPAPSAQMDLEHPLQPLFGTPTSLLKKEPPGYEEAMSQQPKQQENGSSSQQMDDLFDILIQSGEISADFKEPPSLPGKEKPSPKTVCGSPLAAQPSPSAELPQAAPPPPGSPSLPGRLEDFLESSTGLPLLTSGHDGPEPLSLIDDLHSQMLSSTAILDHPPSPMDTSELHFVPEPSSTMGLDLADGHLDSMDWLELSSGGPVLSLAPLSTTAPSLFSTDFLDGHDLQLHWDSCL

SEQ ID NO: 813437 - protein, 811 aa, Homo sapiens
MPPLKSPAAFHEQRRSLERARTEDYLKRKIRSRPERSELVRMHILEETSAEPSLQAKQLKLKRARLADDLNEKIAQRPGPMELVEKNILPVESSLKEAIIVGQVNYPKVADSSSFDEDSSDALSPEQPASHESQGSVPSPLEARVSEPLLSATSASPTQVVSQLPMGRDSREMLFLAEQPPLPPPPLLPPSLTNGTTIPTAKSTPTLIKQSQPKSASEKSQRSKKAKELKPKVKKLKYHQYIPPDQKQDRGAPPMDSSYAKILQQQQLFLQLQILNQQQQQHHNYQAILPAPPKSAGEALGSSGTPPVRSLSTTNSSSSSGAPGPCGLARQNSTSLTGKPGALPANLDDMKVAELKQELKLRSLPVSGTKTELIERLRAYQDQISPVPGAPKAPAATSILHKAGEVVVAFPAARLSTGPALVAAGLAPAEVVVATVASSGVVKFGSTGSTPPVSPTPSERSLLSTGDENSTPGDTFGEMVTSPLTQLTLQASPLQILVKEEGPRAGSCCLSPGGRAELEGRDKDQMLQEKDKQIEALTRMLRQKQQLVERLKLQLEQEKRAQQPAPAPAPLGTPVKQENSFSSCQLSQQPLGPAHPFNPSLAAPATNHIDPCAVAPGPPSVVVKQEALQPEPEPVPAPQLLLGPQGPSLIKGVAPPTLITDSTGTHLVLTVTNKNADSPGLSSGSPQQPSSQPGSPAPAPSAQMDLEHPLQPLFGTPTSLLKKEPPGYEEAMSQQPKQQENGSSSQQMDDLFDILIQSGEISADFKEPPSLPCFLAPYQCHEGRGATWPSCQELSTHSHSVPAASLQPAWP

SEQ ID NO: 813438 - protein, 112 aa, Homo sapiens
MPPLKSPAAFHEQRRSLERARTEDYLKRKIRSRPERSELVRMHILEETSAEPSLQAKQLKLKRARLADDLNEKIAQRPGPMELVEKNILPVESSLKEAIIVRRTQPPCVRGS

SEQ ID NO: 813439 - protein, 17 aa, Homo sapiens [sequence omitted]

SEQ ID NO: 813440 - protein, 164 aa, Homo sapiens
MRREGSTVLQLKLQQRRTREELVSQGIMPPLKSPAAFHEQRRSLERARTEDYLKRKIRSRPERSELVRMHILEETSAEPSLQAKQLKLKRARLADDLNEKIAQRPGPMELVEKNILPVESSLKEAIIAASVALGQEELRAQLHPAVGLRGGHLLPWGHWLHILG

SEQ ID NO: 813441 - protein, 931 aa, Homo sapiens; identical to SEQ ID NO: 813430

SEQ ID NO: 813442 - protein, 1861 aa, Homo sapiens
MKGKERSPVKAKRSRGGEDSTSRGERSKKLGGSGGSNGSSSGKTDSGGGSRRSLHLDKSSSRGGSREYDTGGGSSSSRLHSYSSPSTKNSSGGGESRSSSRGGGGESRSSGAASSAPGGGDGAEYKTLKISELGSQLSDEAVEDGLFHEFKRFGDVSVKISHLSGSGSGDERVAFVNFRRPEDARAAKHARGRLVLYDRPLKIEAVYVSRRRSRSPLDKDTYPPSASVVGASVGGHRHPPGGGGGQRSLSPGGAALGYRDYRLQQLALGRLPPPPPPPLPRDLERERDYPFYERVRPAYSLEPRVGAGAGAAPFREVDEISPEDDQRANRTLFLGNLDITVTESDLRRAFDRFGVITEVDIKRPSRGQTSTYGFLKFENLDMSHRAKLAMSGKIIIRNPIKIGYGKATPTTRLWVGGLGPWVPLAALAREFDRFGTIRTIDYRKGDSWAYIQYESLDAAHAAWTHMRGFPLGGPDRRLRVDFADTEHRYQQQYLQPLPLTHYELVTDAFGHRAPDPLRGARDRTPPLLYRDRDRDLYPDSDWVPPPPPVRERSTRTAATSVPAYEPLDSLDRRRDGWSLDRDRGDRDLPSSRDQPRKRRLPEESGGRHLDRSPESDRPRKRHCAPSPDRSPELSSSRDRYNSDNDRSSRLLLERPSPIRDRRGSLEKSQGDKRDRKNSASAERDRKHRTTAPTEGKSPLKKEDRSDGSAPSTSTASSKLKSPSQKQDGGTAPVASASPKLCLAWQGMLLLKNSNFPSNMHLLQGDLQVASSLLVEGSTGGKVAQLKITQRLRLDQPKLDEVTRRIKVAGPNGYAILLAVPGSSDSRSSSSSAASDTATSTQRPLRNLVSYLKQKQAAGVISLPVGGNKDKENTGVLHAFPPCEFSQQFLDSPAKALAKSEEDYLVMIIVRVLQLKLQQRRTREELVSQGIMPPLKSPAAFHEQRRSLERARTEDYLKRKIRSRPERSELVRMHILEETSAEPSLQAKQLKLKRARLADDLNEKIAQRPGPMELVEKNILPVESSLKEAIIVGQVNYPKVADSSSFDEDSSDALSPEQPASHESQGSVPSPLEARVSEPLLSATSASPTQVVSQLPMGRDSREMLFLAEQPPLPPPPLLPPSLTNGTTIPTAKSTPTLIKQSQPKSASEKSQRSKKAKELKPKVKKLKYHQYIPPDQKQDRGAPPMDSSYAKILQQQQLFLQLQILNQQQQQHHNYQAILPAPPKSAGEALGSSGTPPVRSLSTTNSSSSSGAPGPCGLARQNSTSLTGKPGALPANLDDMKVAELKQELKLRSLPVSGTKTELIERLRAYQDQISPVPGAPKAPAATSILHKAGEVVVAFPAARLSTGPALVAAGLAPAEVVVATVASSGVVKFGSTGSTPPVSPTPSERSLLSTGDENSTPGDTFGEMVTSPLTQLTLQASPLQILVKEEGPRAGSCCLSPGGRAELEGRDKDQMLQEKDKQIEALTRMLRQKQQLVERLKLQLEQEKRAQQPAPAPAPLGTPVKQENSFSSCQLSQQPLGPAHPFNPSLAAPATNHIDPCAVAPGPPSVVVKQEALQPEPEPVPAPQLLLGPQGPSLIKGVAPPTLITDSTGTHLVLTVTNKNADSPGLSSGSPQQPSSQPGSPAPAPSAQMDLEHPLQPLFGTPTSLLKKEPPGYEEAMSQQPKQQENGSSSQQMDDLFDILIQSGEISADFKEPPSLPGKEKPSPKTVCGSPLAAQPSPSAELPQAAPPPPGSPSLPGRLEDFLESSTGLPLLTSGHDGPEPLSLIDDLHSQMLSSTAILDHPPSPMDTSELHFVPEPSSTMGLDLADGHLDSMDWLELSSGGPVLSLAPLSTTAPSLFSTDFLDGHDLQLHWDSCL

SEQ ID NO: 813443 - protein, 1047 aa, Homo sapiens
IVSWIDITTGLKLRLGLRWGDVLSSSRSIAVTRGLDGGGAGENDDEPVLVSLSAAPSPQSEAVANELQELSLQPELTLGLHPGRNPNLPPLSERKNVLQLKLQQRRTREELVSQGIMPPLKSPAAFHEQRRSLERARTEDYLKRKIRSRPERSELVRMHILEETSAEPSLQAKQLKLKRARLADDLNEKIAQRPGPMELVEKNILPVESSLKEAIIVGQVNYPKVADSSSFDEDSSDALSPEQPASHESQGSVPSPLEARVSEPLLSATSASPTQVVSQLPMGRDSREMLFLAEQPPLPPPPLLPPSLTNGTTIPTAKSTPTLIKQSQPKSASEKSQRSKKAKELKPKVKKLKYHQYIPPDQKQDRGAPPMDSSYAKILQQQQLFLQLQILNQQQQQHHNYQAILPAPPKSAGEALGSSGTPPVRSLSTTNSSSSSGAPGPCGLARQNSTSLTGKPGALPANLDDMKVAELKQELKLRSLPVSGTKTELIERLRAYQDQISPVPGAPKAPAATSILHKAGEVVVAFPAARLSTGPALVAAGLAPAEVVVATVASSGVVKFGSTGSTPPVSPTPSERSLLSTGDENSTPGDTFGEMVTSPLTQLTLQASPLQILVKEEGPRAGSCCLSPGGRAELEGRDKDQMLQEKDKQIEALTRMLRQKQQLVERLKLQLEQEKRAQQPAPAPAPLGTPVKQENSFSSCQLSQQPLGPAHPFNPSLAAPATNHIDPCAVAPGPPSVVVKQEALQPEPEPVPAPQLLLGPQGPSLIKGVAPPTLITDSTGTHLVLTVTNKNADSPGLSSGSPQQPSSQPGSPAPAPSAQMDLEHPLQPLFGTPTSLLKKEPPGYEEAMSQQPKQQENGSSSQQMDDLFDILIQSGEISADFKEPPSLPGKEKPSPKTVCGSPLAAQPSPSAELPQAAPPPPGSPSLPGRLEDFLESSTGLPLLTSGHDGPEPLSLIDDLHSQMLSSTAILDHPPSPMDTSELHFVPEPSSTMGLDLADGHLDSMDWLELSSGGPVLSLAPLSTTAPSLFSTDFLDGHDLQLHWDSCL

SEQ ID NO: 813444 - protein, 766 aa, Homo sapiens
MGRDSREMLFLAEQPPLPPPPLLPPSLTNGTTIPTAKSTPTLIKQSQPKSASEKSQRSKKAKELKPKVKKLKYHQYIPPDQKQDRGAPPMDSSYAKILQQQQLFLQLQILNQQQQQHHNYQAILPAPPKSAGEALGSSGTPPVRSLSTTNSSSSSGAPGPCGLARQNSTSLTGKPGALPANLDDMKVAELKQELKLRSLPVSGTKTELIERLRAYQDQISPVPGAPKAPAATSILHKAGEVVVAFPAARLSTGPALVAAGLAPAEVVVATVASSGVVKFGSTGSTPPVSPTPSERSLLSTGDENSTPGDTFGEMVTSPLTQLTLQASPLQILVKEEGPRAGSCCLSPGGRAELEGRDKDQMLQEKDKQIEALTRMLRQKQQLVERLKLQLEQEKRAQQPAPAPAPLGTPVKQENSFSSCQLSQQPLGPAHPFNPSLAAPATNHIDPCAVAPGPPSVVVKQEALQPEPEPVPAPQLLLGPQGPSLIKGVAPPTLITDSTGTHLVLTVTNKNADSPGLSSGSPQQPSSQPGSPAPAPSAQMDLEHPLQPLFGTPTSLLKKEPPGYEEAMSQQPKQQENGSSSQQMDDLFDILIQSGEISADFKEPPSLPGKEKPSPKTVCGSPLAAQPSPSAELPQAAPPPPGSPSLPGRLEDFLESSTGLPLLTSGHDGPEPLSLIDDLHSQMLSSTAILDHPPSPMDTSELHFVPEPSSTMGLDLADGHLDSMDWLELSSGGPVLSLAPLSTTAPSLFSTDFLDGHDLQLHWDSCL

SEQ ID NO: 813445 - protein, 184 aa, Homo sapiens
MDDLFDILIQSGEISADFKEPPSLPGKEKPSPKTVCGSPLAAQPSPSAELPQAAPPPPGSPSLPGRLEDFLESSTGLPLLTSGHDGPEPLSLIDDLHSQMLSSTAILDHPPSPMDTSELHFVPEPSSTMGLDLADGHLDSMDWLELSSGGPVLSLAPLSTTAPSLFSTDFLDGHDLQLHWDSCL

SEQ ID NO: 813446 - protein, 319 aa, Homo sapiens
MPPLKSPAAFHEQRRSLERARTEDYLKRKIRSRPERSELVRMHILEETSAEPSLQAKQLKLKRARLADDLNEKIAQRPGPMELVEKNILPVESSLKEAIIVGQVNYPKVADSSSFDEDSSDALSPEQPASHESQGSVPSPLEARVSEPLLSATSASPTQVVSQLPMGRDSREMLFLAEQPPLPPPPLLPPSLTNGTTIPTAKSTPTLIKQSQPKSASEKSQRSKKAKELKPKVKKLKYHQYIPPDQKQDRGAPPMDSSYAKILQQQQLFLQLQILNQQQQQHHNYQAILPAPPKSAGEALGSSSLPLYRHPASYTARGL

SEQ ID NO: 813447 - protein, 84 aa, Homo sapiens
AERSRRRQCLWWPRRRERRSHLSHPLGCRWPHALRWRRLLSSVRPGWTVSLERRRGRLEPEWGEPRNPAGSRARRDRRVWLAWN

SEQ ID NO: 813448 - protein, 25 aa, Homo sapiens [sequence omitted]

SEQ ID NO: 813449 - protein, 173 aa, Homo sapiens
RGKPCAISHGQPHRVLRHCRRREPLGRVSFELFADKVPKTAENFRALSTGEKGFGYKGSCFHRIIPGFMCQGGDFTRHNGTGGKSIYGEKFEDENFILKHTGPGILSMANAGPNTNGSQFFICTAKTEWLDGKHVVFGKVKEGMNIVEAMERFGSRNGKTSKKITIADCGQLE

SEQ ID NO: 813450 - protein, 173 aa, Homo sapiens; identical to SEQ ID NO: 813449

SEQ ID NO: 813451 - protein, 92 aa, Homo sapiens
FFLEVDEVMLTLKQAFSTAAALQSAKTQIKLCEACPMHSLHKLCERIEGHRISWPWPNKSLLWHLDAFATRFGSRNGKTSKKITIADCGQLE

SEQ ID NO: 813452 - protein, 272 aa, Homo sapiens
MVLLTAVLLLLAAYAGPAQSLGSFVHCEPCDEKALSMCPPSPLGCELVKEPGCGCCMTCALAEGQSCGVYTERCAQGLRCLPRQDEEKPLHALLHGRGVCLNEKSYREQVKIERDSREHEEPTTSEMAEETYSPKIFRPKHTRISELKAEAVKKDRRKKLTQSKFVGGAENTAHPRIISAPEMRQESEQGPCRRHMEASLQELKASPRMVPRAVYLPNCDRKGFYKRKQCKPSRGRKRGICWCVDKYGMKLPGMEYVDGDFQCHTFDSSNVE

SEQ ID NO: 813453 - protein, 103 aa, Homo sapiens
PAAHGRSSRAQVRGLDFWPLVEFPEVFFLSLVNNCENTANGFPDDSDLKELGGRTACHFGDAQLGQLHLQVVQLFQQLLLFLPAKISSLDFGHCCTNRQHLYW

SEQ ID NO: 813454 - protein, 272 aa, Homo sapiens; identical to SEQ ID NO: 813452

SEQ ID NO: 813455 - protein, 272 aa, Homo sapiens; identical to SEQ ID NO: 813452

SEQ ID NO: 813456 - protein, 272 aa, Homo sapiens; identical to SEQ ID NO: 813452

SEQ ID NO: 813457 - protein, 143 aa, Homo sapiens [sequence omitted]

SEQ ID NO: 813458 - protein, 272 aa, Homo sapiens; identical to SEQ ID NO: 813452

SEQ ID NO: 813459 - protein, 272 aa, Homo sapiens; identical to SEQ ID NO: 813452

SEQ ID NO: 813460 - protein, 272 aa, Homo sapiens; identical to SEQ ID NO: 813452

SEQ ID NO: 813461 - protein, 143 aa, Homo sapiens [sequence omitted]

SEQ ID NO: 813462 - protein, 143 aa, Homo sapiens [sequence omitted]

SEQ ID NO: 813463 - protein, 143 aa, Homo sapiens [sequence omitted]

SEQ ID NO: 813464 - protein, 272 aa, Homo sapiens; identical to SEQ ID NO: 813452

SEQ ID NO: 813465 - protein, 110 aa, Homo sapiens
VPFDTVRRRMMMQSGRKGADIMYTGTVDCWRKIFRDEGGKAFFKGAWSNVLRGMGGAFVLVLYDELRKVSNFRRVLDFRSQIGRISLNWPCFGRDKTMCSAAHLQPAMRD

SEQ ID NO: 813466 - protein, 143 aa, Homo sapiens [sequence omitted]

SEQ ID NO: 813467 - protein, 130 aa, Homo sapiens [sequence omitted]

SEQ ID NO: 813468 - protein, 272 aa, Homo sapiens; identical to SEQ ID NO: 813452

SEQ ID NO: 813469 - protein, 272 aa, Homo sapiens; identical to SEQ ID NO: 813452

SEQ ID NO: 813470 - protein, 272 aa, Homo sapiens; identical to SEQ ID NO: 813452

SEQ ID NO: 813471 - protein, 272 aa, Homo sapiens; identical to SEQ ID NO: 813452

SEQ ID NO: 813472 - protein, 272 aa, Homo sapiens; identical to SEQ ID NO: 813452

SEQ ID NO: 813473 - protein, 272 aa, Homo sapiens; identical to SEQ ID NO: 813452

SEQ ID NO: 813474 - protein, 272 aa, Homo sapiens; identical to SEQ ID NO: 813452

SEQ ID NO: 813475 - protein, 38 aa, Homo sapiens
MAQGAKDTGRTGGVSPKKRRGPGFDNTHGRASGYTAPA

SEQ ID NO: 813476 - protein, 664 aa, Homo sapiens
MKTGLFFLCLLGTAAAIPTNARLLSDHSKPTAETVAPDNTAIPSLRAEAEENEKETAVSTEDDSHHKAEKSSVLKSKEESHEQSAEQGKSSSQELGLKDQEDSDGHLSVNLEYAPTEGTLDIKEDMSEPQEKKLSENTDFLAPGVSSFTDSNQQESITKREENQEQPRNYSHHQLNRSSKHSQGLRDQGNQEQDPNISNGEEEEEKEPGEVGTHNDNQERKTELPREHANSKQEEDNTQSDDILEESDQPTQVSKMQEDEFDQGNQEQEDNSNAEMEEENASNVNKHIQETEWQSQEGKTGLEAISNHKETEEKTVSEALLMEPTDDGNTTPRNHGVDDDGDDDGDDGGTDGPRHSASDDYFIPSQAFLEAERAQSIAYHLKIEEQREKVHENENIGTTEPGEHQEAKKAENSSNEEETSSEGNMRVHAVDSCMSFQCKRGHICKADQQGKPHCVCQDPVTCPPTKPLDQVCGTDNQTYASSCHLFATKCRLEGTKKGHQLQLDYFGACKSIPTCTDFEVIQFPLRMRDWLKNILMQLYEANSEHAGYLNEKQRNKVKKIYLDEKRLLAGDHPIDLLLRDFKKNYHMYVYPVHWQFSELDQHPMDRVLTHSELAPLRASLVPMEHCITRFFEECDPNKDKHITLKEWGHCFGIKEEDIDENLLF

SEQ ID NO: 813477 - protein, 664 aa, Homo sapiens; identical to SEQ ID NO: 813476

SEQ ID NO: 813478 - protein, 664 aa, Homo sapiens; identical to SEQ ID NO: 813476

SEQ ID NO: 813479 - protein, 538 aa, Homo sapiens
MKTGLFFLCLLGTAAAIPTNARLLSDHSKPTAETVAPDNTAIPSLRAEAEENEKETAVSTEDDSHHKAEKSSVLKSKEESHEQSAEQGKSSSQELGLKDQEDSDGHLSVNLEYAPTEGTLDIKEDMSEPQEKKLSENTDFLAPGVSSFTDSNQQESITKREENQEQPRNYSHHQLNRSSKHSQGLRDQGNQEQDPNISNGEEEEEKEPGEVGTHNDNQERKTELPREHANSKQEEDNTQSDDILEESDQPTQVSKMQEDEFDQGNQEQEDNSNAEMEEENASNVNKHIQETEWQSQEGKTGLEAISNHKETEEKTVSEALLMEPTDDGNTTPRNHGVDDDGDDDGDDGGTDGPRHSASDDYFIPSQAFLEAERAQSIAYHLKIEEQREKVHENENIGTTEPGEHQEAKKAENSSNEEETSSEGNMRVHAVDSCMSFQCKRGHICKADQQGKPHCVCQDPVTCPPTKPLDQVCGTDNQTYASSCHLFATKCRLEGTKKGHQLQLDYFGACKSIPTCTDFEVIQFPLRMRDWLKNILMQV

SEQ ID NO: 813480 - protein, 443 aa, Homo sapiens
MKTGLFFLCLLGTAAAIPTNARLLSDHSKPTAETVAPDNTAIPSLRAEAEENEKETAVSTEDDSHHKAEKSSVLKSKEESHEQSAEQGKSSSQELGLKDQEDSDGHLSVNLEYAPTEGTLDIKEDMSEPQEKKLSENTDFLAPGVSSFTDSNQQESITKREENQEQPRNYSHHQLNRSSKHSQGLRDQGNQEQDPNISNGEEEEEKEPGEVGTHNDNQERKTELPREHANSKQEEDNTQSDDILEESDQPTQVSKMQEDEFDQGNQEQEDNSNAEMEEENASNVNKHIQETEWQSQEGKTGLEAISNHKETEEKTVSEALLMEPTDDGNTTPRNHGVDDDGDDDGDDGGTDGPRHSASDDYFIPSQAFLEAERAQSIAYHLKIEEQRERKTKNNLEIIHIISVNRSSKHSQGLRDQGNQEQDPNISNGEEEEEKEPGEVGTHN

SEQ ID NO: 813481 - protein, 381 aa, Homo sapiens
MKTGLFFLCLLGTAAAIPTNARLLSDHSKPTAETVAPDNTAIPSLRAEAEENEKETAVSTEDDSHHKAEKSSVLKSKEESHEQSAEQGKSSSQELGLKDQEDSDGHLSVNLEYAPTEGTLDIKEDMSEPQEKKLSENTDFLAPGVSSFTDSNQQESITKREENQEQPRNYSHHQLNRSSKHSQGLRDQGNQEQDPNISNGEEEEEKEPGEVGTHNDNQERKTELPREHANSKQEEDNTQSDDILEESDQPTQVSKMQEDEFDQGNQEQEDNSNAEMEEENASNVNKHIQETEWQSQEGKTGLEAISNHKETEEKTVSEALLMEPTDDGTHNDNQERKTELPREHANSKQEEDNTQSDDILEESDQPTQVSKMQEDEFDQGN

SEQ ID NO: 813482 - protein, 664 aa, Homo sapiens; identical to SEQ ID NO: 813476

SEQ ID NO: 813483 - protein, 551 aa, Homo sapiens
MKTGLFFLCLLGTAAAIPTNARLLSDHSKPTAETVAPDNTAIPSLRAEAEENEKETAVSTEDDSHHKAEKSSVLKSKEESHEQSAEQGKSSSQELGLKDQEDSDGHLSVNLEYAPTEGTLDIKEDMSEPQEKKLSENTDFLAPGVSSFTDSNQEQEDNSNAEMEEENASNVNKHIQETEWQSQEGKTGLEAISNHKETEEKTVSEALLMEPTDDGNTTPRNHGVDDDGDDDGDDGGTDGPRHSASDDYFIPSQAFLEAERAQSIAYHLKIEEQREKVHENENIGTTEPGEHQEAKKAENSSNEEETSSEGNMRVHAVDSCMSFQCKRGHICKADQQGKPHCVCQDPVTCPPTKPLDQVCGTDNQTYASSCHLFATKCRLEGTKKGHQLQLDYFGACKSIPTCTDFEVIQFPLRMRDWLKNILMQLYEANSEHAGYLNEKQRNKVKKIYLDEKRLLAGDHPIDLLLRDFKKNYHMYVYPVHWQFSELDQHPMDRVLTHSELAPLRASLVPMEHCITRFFEECDPNKDKHITLKEWGHCFGIKEEDIDENLLF

SEQ ID NO: 813484 - protein, 677 aa, Homo sapiens
ARYPLALNLDLESMKTGLFFLCLLGTAAAIPTNARLLSDHSKPTAETVAPDNTAIPSLRAEAEENEKETAVSTEDDSHHKAEKSSVLKSKEESHEQSAEQGKSSSQELGLKDQEDSDGHLSVNLEYAPTEGTLDIKEDMSEPQEKKLSENTDFLAPGVSSFTDSNQQESITKREENQEQPRNYSHHQLNRSSKHSQGLRDQGNQEQDPNISNGEEEEEKEPGEVGTHNDNQERKTELPREHANSKQEEDNTQSDDILEESDQPTQVSKMQEDEFDQGNQEQEDNSNAEMEEENASNVNKHIQETEWQSQEGKTGLEAISNHKETEEKTVSEALLMEPTDDGNTTPRNHGVDDDGDDDGDDGGTDGPRHSASDDYFIPSQAFLEAERAQSIAYHLKIEEQREKVHENENIGTTEPGEHQEAKKAENSSNEEETSSEGNMRVHAVDSCMSFQCKRGHICKADQQGKPHCVCQDPVTCPPTKPLDQVCGTDNQTYASSCHLFATKCRLEGTKKGHQLQLDYFGACKSIPTCTDFEVIQFPLRMRDWLKNILMQLYEANSEHAGYLNEKQRNKVKKIYLDEKRLLAGDHPIDLLLRDFKKNYHMYVYPVHWQFSELDQHPMDRVLTHSELAPLRASLVPMEHCITRFFEECDPNKDKHITLKEWGHCFGIKEEDIDENLLF

SEQ ID NO: 813485 - protein, 616 aa, Homo sapiens
LGPVCSTSQQYPQKMIHHKAEKSSVLKSKEESHEQSAEQGKSSSQELGLKDQEDSDGHLSVNLEYAPTEGTLDIKEDMSEPQEKKLSENTDFLAPGVSSFTDSNQQESITKREENQEQPRNYSHHQLNRSSKHSQGLRDQGNQEQDPNISNGEEEEEKEPGEVGTHNDNQERKTELPREHANSKQEEDNTQSDDILEESDQPTQVSKMQEDEFDQGNQEQEDNSNAEMEEENASNVNKHIQETEWQSQEGKTGLEAISNHKETEEKTVSEALLMEPTDDGNTTPRNHGVDDDGDDDGDDGGTDGPRHSASDDYFIPSQAFLEAERAQSIAYHLKIEEQREKVHENENIGTTEPGEHQEAKKAENSSNEEETSSEGNMRVHAVDSCMSFQCKRGHICKADQQGKPHCVCQDPVTCPPTKPLDQVCGTDNQTYASSCHLFATKCRLEGTKKGHQLQLDYFGACKSIPTCTDFEVIQFPLRMRDWLKNILMQLYEANSEHAGYLNEKQRNKVKKIYLDEKRLLAGDHPIDLLLRDFKKNYHMYVYPVHWQFSELDQHPMDRVLTHSELAPLRASLVPMEHCITRFFEECDPNKDKHITLKEWGHCFGIKEEDIDENLLF

SEQ ID NO: 813486 - protein, 623 aa, Homo sapiens
LKIEEQREKVHENENIGTTEDDSHHKAEKSSVLKSKEESHEQSAEQGKSSSQELGLKDQEDSDGHLSVNLEYAPTEGTLDIKEDMSEPQEKKLSENTDFLAPGVSSFTDSNQQESITKREENQEQPRNYSHHQLNRSSKHSQGLRDQGNQEQDPNISNGEEEEEKEPGEVGTHNDNQERKTELPREHANSKQEEDNTQSDDILEESDQPTQVSKMQEDEFDQGNQEQEDNSNAEMEEENASNVNKHIQETEWQSQEGKTGLEAISNHKETEEKTVSEALLMEPTDDGNTTPRNHGVDDDGDDDGDDGGTDGPRHSASDDYFIPSQAFLEAERAQSIAYHLKIEEQREKVHENENIGTTEPGEHQEAKKAENSSNEEETSSEGNMRVHAVDSCMSFQCKRGHICKADQQGKPHCVCQDPVTCPPTKPLDQVCGTDNQTYASSCHLFATKCRLEGTKKGHQLQLDYFGACKSIPTCTDFEVIQFPLRMRDWLKNILMQLYEANSEHAGYLNEKQRNKVKKIYLDEKRLLAGDHPIDLLLRDFKKNYHMYVYPVHWQFSELDQHPMDRVLTHSELAPLRASLVPMEHCITRFFEECDPNKDKHITLKEWGHCFGIKEEDIDENLLF

SEQ ID NO: 813487 - protein, 376 aa, Homo sapiens
MKTGLFFLCLLGTAAAIPTNARLLSDHSKPTAETVAPDNTAIPSLRAEAEENEKETAVSTEDDSHHKAEKSSVLKSKEESHEQSAEQGKSSSQELGLKDQEDSDGHLSVNLEYAPTEGTLDIKEDMSEPQEKKLSENTDFLAPGVSSFTDSNQQESITKREENQEQPRNYSHHQLNRSSKHSVCGTDNQTYASSCHLFATKCRLEGTKKGHQLQLDYFGACKSIPTCTDFEVIQFPLRMRDWLKNILMQLYEANSEHAGYLNEKQRNKVKKIYLDEKRLLAGDHPIDLLLRDFKKNYHMYVYPVHWQFSELDQHPMDRVLTHSELAPLRASLVPMEHCITRFFEECDPNKDKHITLKEWGHCFGIKEEDIDENLLF

SEQ ID NO: 813488 - protein, 191 aa, Homo sapiens
MKTGLFFLCLLGTAAAIPTNARLLSDHSKPTAETVAPDNTAIPSLRAEAEENEKETAVSTEDDSHHKAEKSSVLKSKEESHEQSAEQGKSSSQELGLKDQEDSDGHLSVNLEYAPTEGTLDIKEDMSEPQEKKLSENTDFLAPGVSSFTDSNQQESITKREENQEQPRNYSHHQLNRSSKHSRDPQTRPSS

SEQ ID NO: 813489 - protein, 448 aa, Homo sapiens
ARMRERETIEDPRAEHAQEDNTQSDDILEESDQPTQVSKMQEDEFDQGNQEQEDNSNAEMEEENASNVNKHIQETEWQSQEGKTGLEAISNHKETEEKTVSEALLMEPTDDGNTTPRNHGVDDDGDDDGDDGGTDGPRHSASDDYFIPSQAFLEAERAQSIAYHLKIEEQREKVHENENIGTTEPGEHQEAKKAENSSNEEETSSEGNMRVHAVDSCMSFQCKRGHICKADQQGKPHCVCQDPVTCPPTKPLDQVCGTDNQTYASSCHLFATKCRLEGTKKGHQLQLDYFGACKSIPTCTDFEVIQFPLRMRDWLKNILMQLYEANSEHAGYLNEKQRNKVKKIYLDEKRLLAGDHPIDLLLRDFKKNYHMYVYPVHWQFSELDQHPMDRVLTHSELAPLRASLVPMEHCITRFFEECDPNKDKHITLKEWGHCFGIKEEDIDENLLF

SEQ ID NO: 813490 - protein, 456 aa, Homo sapiens
CGDDGDGDGDDDDGDGDYGDDGDDKKEDNTQSDDILEESDQPTQVSKMQEDEFDQGNQEQEDNSNAEMEEENASNVNKHIQETEWQSQEGKTGLEAISNHKETEEKTVSEALLMEPTDDGNTTPRNHGVDDDGDDDGDDGGTDGPRHSASDDYFIPSQAFLEAERAQSIAYHLKIEEQREKVHENENIGTTEPGEHQEAKKAENSSNEEETSSEGNMRVHAVDSCMSFQCKRGHICKADQQGKPHCVCQDPVTCPPTKPLDQVCGTDNQTYASSCHLFATKCRLEGTKKGHQLQLDYFGACKSIPTCTDFEVIQFPLRMRDWLKNILMQLYEANSEHAGYLNEKQRNKVKKIYLDEKRLLAGDHPIDLLLRDFKKNYHMYVYPVHWQFSELDQHPMDRVLTHSELAPLRASLVPMEHCITRFFEECDPNKDKHITLKEWGHCFGIKEEDIDENLLF

SEQ ID NO: 813491 - protein, 495 aa, Homo sapiens
GRLEDPREKHTAEKSSVLKSKEESHEQSAEQGKSSSQELGLKDQEDSDGHLSVNLEYAPTEGTLDIKEDMSEPQEKKLSENTDFLAPGVSSFTDSNQEQEDNSNAEMEEENASNVNKHIQETEWQSQEGKTGLEAISNHKETEEKTVSEALLMEPTDDGNTTPRNHGVDDDGDDDGDDGGTDGPRHSASDDYFIPSQAFLEAERAQSIAYHLKIEEQREKVHENENIGTTEPGEHQEAKKAENSSNEEETSSEGNMRVHAVDSCMSFQCKRGHICKADQQGKPHCVCQDPVTCPPTKPLDQVCGTDNQTYASSCHLFATKCRLEGTKKGHQLQLDYFGACKSIPTCTDFEVIQFPLRMRDWLKNILMQLYEANSEHAGYLNEKQRNKVKKIYLDEKRLLAGDHPIDLLLRDFKKNYHMYVYPVHWQFSELDQHPMDRVLTHSELAPLRASLVPMEHCITRFFEECDPNKDKHITLKEWGHCFGIKEEDIDENLLF

SEQ ID NO: 813492 - protein, 370 aa, Homo sapiens
SRGSDCICASISNHKETEEKTVSEALLMEPTDDGNTTPRNHGVDDDGDDDGDDGGTDGPRHSASDDYFIPSQAFLEAERAQSIAYHLKIEEQREKVHENENIGTTEPGEHQEAKKAENSSNEEETSSEGNMRVHAVDSCMSFQCKRGHICKADQQGKPHCVCQDPVTCPPTKPLDQVCGTDNQTYASSCHLFATKCRLEGTKKGHQLQLDYFGACKSIPTCTDFEVIQFPLRMRDWLKNILMQLYEANSEHAGYLNEKQRNKVKKIYLDEKRLLAGDHPIDLLLRDFKKNYHMYVYPVHWQFSELDQHPMDRVLTHSELAPLRASLVPMEHCITRFFEECDPNKDKHITLKEWGHCFGIKEEDIDENLLF

SEQ ID NO: 813493 - protein, 147 aa, Homo sapiens
GNQEQEDNSNAEMEEENASNVNKHIQETEWQSQEGKTGLEAISNHKETEEKTVSEALLMEPTDDGNTTPRNHGVDDDGDDDGDDGGTDGPRHSASDDYFIPSQAFLEAERAQSIAYHLKIEEQREKVHENENIGTTEPGEHQEVKLF

SEQ ID NO: 813494 - protein, 664 aa, Homo sapiens; identical to SEQ ID NO: 813476

SEQ ID NO: 813495 - protein, 460 aa, Homo sapiens
MASLLQSDRVLYLVQGEKKVRAPLSQLYFCRYCSELRSLECVSHEVDSHYCPSCLENMPSAEAKLKKNRCANCFDCPGCMHTLSTRATSISTQLPDDPAKTTMKKAYYLACGFCRWTSRDVGMADKSVASGGWQEPENPHTQRMNKLIEYYQQLAQKEKVERDRKKLARRRNYMPLAFSDKYGLGTRLQRPRAGASISTLAGLSLKEGEDQKEIKIEPAQAVDEVEPLPEDYYTRPVNLTEVTTLQQRLLQPDFQPVCASQLYPRHKHLLIKRSLRCRKCEHNLSKPEFNPTSIKFKIQLVAVNYIPEVRIMSIPNLRYMKESQVLLTLTNPVENLTHVTLFECEEGDPDDINSTAKVVVPPKELVLAGKDAAAEYDELAEPQDFQDDPDIIAFRKANKVGIFIKVTPQREEGEVTVCFKMKHDFKNLAAPIRPIEESDQGTEVIWLTQHVELSLGPLLP

SEQ ID NO: 813496 - protein, 460 aa, Homo sapiens; identical to SEQ ID NO: 813495

SEQ ID NO: 813497 - protein, 460 aa, Homo sapiens; identical to SEQ ID NO: 813495

SEQ ID NO: 813498 - protein, 403 aa, Homo sapiens
MPSAEAKLKKNRCANCFDCPGCMHTLSTRATSISTQLPDDPAKTTMKKAYYLACGFCRWTSRDVGMADKSVASGGWQEPENPHTQRMNKLIEYYQQLAQKEKVERDRKKLARRRNYMPLAFSDKYGLGTRLQRPRAGASISTLAGLSLKEGEDQKEIKIEPAQAVDEVEPLPEDYYTRPVNLTEVTTLQQRLLQPDFQPVCASQLYPRHKHLLIKRSLRCRKCEHNLSKPEFNPTSIKFKIQLVAVNYIPEVRIMSIPNLRYMKESQVLLTLTNPVENLTHVTLFECEEGDPDDINSTAKVVVPPKELVLAGKDAAAEYDELAEPQDFQDDPDIIAFRKANKVGIFIKVTPQREEGEVTVCFKMKHDFKNLAAPIRPIEESDQGTEVIWLTQHVELSLGPLLP

SEQ ID NO: 813499 - protein, 317 aa, Homo sapiens
MNKLIEYYQQLAQKEKVERDRKKLARRRNYMPLAFSDKYGLGTRLQRPRAGASISTLAGLSLKEGEDQKEIKIEPAQAVDEVEPLPEDYYTRPVNLTEVTTLQQRLLQPDFQPVCASQLYPRHKHLLIKRSLRCRKCEHNLSKPEFNPTSIKFKIQLVAVNYIPEVRIMSIPNLRYMKESQVLLTLTNPVENLTHVTLFECEEGDPDDINSTAKVVVPPKELVLAGKDAAAEYDELAEPQDFQDDPDIIAFRKANKVGIFIKVTPQREEGEVTVCFKMKHDFKNLAAPIRPIEESDQGTEVIWLTQHVELSLGPLLP

SEQ ID NO: 813500 - protein, 460 aa, Homo sapiens; identical to SEQ ID NO: 813495

SEQ ID NO: 813501 - protein, 460 aa, Homo sapiens; identical to SEQ ID NO: 813495

SEQ ID NO: 813502 - protein, 460 aa, Homo sapiens; identical to SEQ ID NO: 813495

SEQ ID NO: 813503 - protein, 460 aa, Homo sapiens; identical to SEQ ID NO: 813495

SEQ ID NO: 813504 - protein, 460 aa, Homo sapiens; identical to SEQ ID NO: 813495

SEQ ID NO: 813505 - protein, 303 aa, Homo sapiens
MASLLQSDRVLYLVQGEKKVRAPLSQLYFCRYCSELRSLECVSHEVDSHYCPSCLENMPSAEAKLKKNRCANCFDCPGCMHTLSTRATSISTQLPDDPAKTTMKKAYYLACGFCRWTSRDVGMADKSVASGGWQEPENPHTQRMNKLIEYYQQLAQKEKVERDRKKLARRRNYMPLAFSDKYGLGTRLQRPRAGASISTLAGLSLKEGEDQKEIKIEPAQAVDEVEPLPEDYYTRPVNLTEVTTLQQRLLQPDFQPVCASQLYPRHKHLLIKRSLRCRKCEHNLSKPEFNPTSIKFKIQLVAV

SEQ ID NO: 813506 - protein, 306 aa, Homo sapiens
MASLLQSDRVLYLVQGEKKVRAPLSQLYFCRYCSELRSLECVSHEVDSHYCPSCLENMPSAEAKLKKNRCANCFDCPGCMHTLSTRATSISTQLPDDPAKTTMKKAYYLACGFCRWTSRDVGMADKSVASGGWQEPENPHTQRMNKLIEYYQQLAQKEKVERDRKKLARRRNYMPLAFSDKYGLGTRLQRPRAGASISTLAGLSLKEGEDQKEIKIEPAQAVDEVEPLPEDYYTRPVNLTEVTTLQQRLLQPDFQPVCASQLYPRHKHLLILSFFKAEKLKKQNKTKQKSNFSRIHLISSVYISIS

SEQ ID NO: 813507 - protein, 106 aa, Homo sapiens
MESEITGNTGLSQLNFIQAWCLYQRWLGKGREIHLVQAVICSEFYKTYPIQTYLNSTVGLLNQCWNNFAKQTRPVRYSLMSWQVAAARVFPKMTFPAQNTSVKSTE

SEQ ID NO: 813508 - protein, 206 aa, Homo sapiens
DWLEADVPARRPPRPPGRPRRAGVRCPPATRFLPPAAAMLPAALLRRPGLGRLVRHARAYAEAAAAPAAASGPNQMSFTFASPTQVFFNGANVRQVDVPTLTGAFGILAAHVPTLQVLRPGLVVVHAEDGTTSKYFVSSGSIAVNADSSVQLLAEEAVTLDMLDLGAAKANLEKAQAELVGTADEATRAEIQIRIEANEALVKALE

SEQ ID NO: 813509 - protein, 206 aa, Homo sapiens; identical to SEQ ID NO: 813508

SEQ ID NO: 813510 - protein, 206 aa, Homo sapiens; identical to SEQ ID NO: 813508

SEQ ID NO: 813511 - protein, 463 aa, Homo sapiens
MLLKSLCKNSLRPVSGCSYPFSGLSSGSCRPVFRGRLSAPVFSRELLNRHRGHLYTFRPVCNLRLSSSELRSGSSPFTLKFLLGHCLLSSSLLFFFNLFRISVEVQIRHDLPWVFTGNGATHAQNFPSQHPPHQTHCVSSLVVAWDGNVHIAQRRICVTQRNGRKVNIRCLRERLVVSPGVSNHKKPWLPEGCLDLVSEGSRSEAASNWSGSSGSSKLQHSPLASIPGGYNTDISRVFNGNNCTSCQQKLLPGPLEIYDIDAITFPFIDVLFHLEVKIGATYVGSCCKELKDILLLHLQDIKGSGHCENFPLSYDGIQNNAVWTAAASGPNQMSFTFASPTQVFFNGANVRQVDVPTLTGAFGILAAHVPTLQVLRPGLVVVHAEDGTTSKYFVSSGSIAVNADSSVQLLAEEAVTLDMLDLGAAKANLEKAQAELVGTADEATRAEIQIRIEANEALVKALE

SEQ ID NO: 813512 - protein, 108 aa, Homo sapiens
MRGLSFRLSRSPHVPTLQVLRPGLVVVHAEDGTTSKYFVSSGSIAVNADSSVQLLAEEAVTLDMLDLGAAKANLEKAQAELVGTADEATRAEIQIRIEANEALVKALE

SEQ ID NO: 813513 - protein, 207 aa, Homo sapiens
MVSTHASRTRRGPPRPPGRPRRAGVRCPPATRFLPPAAAMLPAALLRRPGLGRLVRHARAYAEAAAAPAAASGPNQMSFTFASPTQVFFNGANVRQVDVPTLTGAFGILAAHVPTLQVLRPGLVVVHAEDGTTSKYFVSSGSIAVNADSSVQLLAEEAVTLDMLDLGAAKANLEKAQAELVGTADEATRAEIQIRIEANEALVKALE

SEQ ID NO: 813514 - protein, 206 aa, Homo sapiens; identical to SEQ ID NO: 813508

SEQ ID NO: 813515 - protein, 206 aa, Homo sapiens; identical to SEQ ID NO: 813508

SEQ ID NO: 813516 - protein, 206 aa, Homo sapiens; identical to SEQ ID NO: 813508

SEQ ID NO: 813517 - protein, 206 aa, Homo sapiens; identical to SEQ ID NO: 813508

SEQ ID NO: 813518 - protein, 282 aa, Homo sapiens
MPGGPSQLLGSRPPGEAAPAKEATRGQCRLLPGPQALPVLKALGTGPGKLLLSFELWLPPMGLSFRLSRSPQPDGPLTIPSALQSQPPRLTSASEPPLDELPPAPAPLKTRKPEKKKKKKKQPHTNKHHNTATPQKETYKKYNINTTNNISRKQIQTSVPQPRALRGKDEDTERRGHERGGEEQLCSAAAHAKKRQGQRAPNKSDEKTRREQRKQRRKVRNGHRDEAEQEKGEKKGACDEAETQPGARSDEEGARGRGQEARGRGGKDPQRRPRPTPEEESG

SEQ ID NO: 813519 - protein, 422 aa, Homo sapiens
GLARGRRPCASSSSPSRPPAPRRSPLSASYPLPAARRCHAARRAAPPPGTWPPRPPRPCLCRGRRRPGCRLWPQPDVLHLRLSHAGVLQRCQRPAGGRAHADRSLRHPGGPRAHAAGPGEGPGVGGAYPVSRGPARGWAGMPGGPSQLLGSRPPGEAAPAKEATRGQCRLLPGPQALPVLKALGTGPGKLLLSFELWLPPMGLSFRLSRSPQPDGPLTIPSALQSQPPRLTSASEPPLDELPPAPAPLKTRKPEKKKKKKKQPHTNKHHNTATPQKETYKKYNINTTNNISRKQIQTSVPQPRALRGKDEDTERRGHERGGEEQLCSAAAHAKKRQGQRAPNKSDEKTRREQRKQRRKVRNGHRDEAEQEKGEKKGACDEAETQPGARSDEEGARGRGQEARGRGGKDPQRRPRPTPEEESG

SEQ ID NO: 813520 - protein, 123 aa, Homo sapiens
DWLEADVPARRPPRPPGRPRRAGVRCPPATRFLPPAAAMLPAALLRRPGLGRLVRHARAYAEAAAAPAAASGPNQMSFTFASPTQVFFNGANVRQVDVPTLTGAFGILAAHVPTLQALVKALE

SEQ ID NO: 813521 - protein, 168 aa, Homo sapiens
PPRPPGRPRRAGVRCPPATRFLPPAAAMLPAALLRRPGLGRLVRHARAYAEAAAAPAAASGPNQMSFTFASPTQVRALRVGTLRGRRPRSPGSPPPGRDPRFRAPGPARPGSRGYSALDPRPCLCCPSPALPSSRAPPRDKRLLGALPDLPGQSLGVAGSLHSHFADQ

SEQ ID NO: 813522 - protein, 389 aa, Homo sapiens
ASPDALDSPLRTQRQLTWGVAIRAGRSWFSGPAAPAAAMSFFPELYFNVDNGYLEGLVRGLKAGVLSQADYLNLVQCETLEDLKLHLQSTDYGNFLANEASPLTVSVIDDRLKEKMVVEFRHMRNHAYEPLASFLDFITYSYMIDNVILLITGTLHQRSIAELVPKCHPLGSFEQMEAVNIAQTPAELYNAILVDTPLAAFFQDCISEQDLDEMNIEIIRNTLYKAYLESFYKFCTLLGGTTADAMCPILEFEADRRAFIITINSFGTELSKEDRAKLFPHCGRLYPEGLAQLARADDYEQVKNVADYYPEYKLLFEGAGSNPGDKTLEDRFFEHEVKLNKLAFLNQFHFGVFYAFVKLKEQECRNIVWIAECIAQRHRAKIDNYIPIF

SEQ ID NO: 813523 - protein, 389 aa, Homo sapiens; identical to SEQ ID NO: 813522

SEQ ID NO: 813524 - protein, 389 aa, Homo sapiens; identical to SEQ ID NO: 813522

SEQ ID NO: 813525 - protein, 389 aa, Homo sapiens; identical to SEQ ID NO: 813522

SEQ ID NO: 813526 - protein, 423 aa, Homo sapiens
ASPDALDSPLRTQRQLTWGVAIRAGRSWFSGPAAPAAAMSFFPELYFNVDNGYLEGLVRGLKAGVLSQADYLNLVQCETLEDLKLHLQSTDYGNFLANEASPLTVSVIDDRLKEKMVVEFRHMRNHAYEPLASFLDFITYSYMIDNVILLITGTLHQRSIAELVPKCHPLGSFEQMEAVNIAQTPAELYNAILVDTPLAAFFQDCISEQDLDEMNIEIIRNTLYKAYLESFYKFCTLLGGTTADAMCPILEFEADRRAFIITINSFGTELSKEDRAKLFPHCGRLYPEGLAQLARADDYEQVKNVADYYPEYKLLFEGAGSNPGDKTLEDRFFEHEVSLQGLLVRGRPTWWFRPDSVAMATWTPHLPVSQVKLNKLAFLNQFHFGVFYAFVKLKEQECRNIVWIAECIAQRHRAKIDNYIPIF

SEQ ID NO: 813527 - protein, 456 aa, Homo sapiens
ASPDALDSPLRTQRQLTWGVAIRAGRSWFSGPAAPAAAMSFFPELYFNVDNGYLEGLVRGLKAGVLSQADYLNLVQCETLEDLKLHLQSTDYGNFLANEASPLTVSVIDDRLKEKMVVEFRHMRNHAYEPLASFLDFITYSYMIDNVILLITGTLHQRSIAELVPKCHPLGSFEQMEAVNIAQTPAELYNAILVDTPLAAFFQDCISEQDLDEMNIEIIRNTLYKAYLESFYKFCTLLGGTTADAMCPILEFEADRRAFIITINSFGTELSKEDRAKLFPHCGRLYPEGLAQLARADDYEQVKNVADYYPVSAPAGRTAVGCVVTSTPTQNPHACASPHPPGQEYKLLFEGAGSNPGDKTLEDRFFEHEVSLQGLLSEGGQPGGLDLTLWPWPPGHHICPCPQVKLNKLAFLNQFHFGVFYAFVKLKEQECRNIVWIAECIAQRHRAKIDNYIPIF

SEQ ID NO: 813528 - protein, 351 aa, Homo sapiens
MLGLRARGLTGCGGEAELQLQGYMDCWVKVTGTIQFGGLHSGDDLKLHLQSTDYGNFLANEASPLTVSVIDDRLKEKMVVEFRHMRNHAYEPLASFLDFITYSYMIDNVILLITGTLHQRSIAELVPKCHPLGSFEQMEAVNIAQTPAELYNAILVDTPLAAFFQDCISEQDLDEMNIEIIRNTLYKAYLESFYKFCTLLGGTTADAMCPILEFEADRRAFIITINSFGTELSKEDRAKLFPHCGRLYPEGLAQLARADDYEQVKNVADYYPEYKLLFEGAGSNPGDKTLEDRFFEHEVKLNKLAFLNQFHFGVFYAFVKLKEQECRNIVWIAECIAQRHRAKIDNYIPIF

SEQ ID NO: 813529 - protein, 247 aa, Homo sapiens
MIDNVILLITGTLHQRSIAELVPKCHPLGSFEQMEAVNIAQTPAELYNAILVDTPLAAFFQDCISEQDLDEMNIEIIRNTLYKAYLESFYKFCTLLGGTTADAMCPILEFEADRRAFIITINSFGTELSKEDRAKLFPHCGRLYPEGLAQLARADDYEQVKNVADYYPEYKLLFEGAGSNPGDKTLEDRFFEHEVKLNKLAFLNQFHFGVFYAFVKLKEQECRNIVWIAECIAQRHRAKIDNYIPIF

SEQ ID NO: 813530 - protein, 319 aa, Homo sapiens
ASPDALDSPLRTQRQLTWGVAIRAGRSWFSGPAAPAAAMSFFPELYFNVDNGYLEGLVRGLKAGVLSQADYLNLVQCETLEDLKLHLQSTDYGNFLANEASPLTVSVIDDRLKEKMVVEFRHMRNHAYEPLASFLDFITYSYMIDNVILLITGTLHQRSIAELVPKCHPLGSFEQMEAVNIAQTPAELYNAILVDTPLAAFFQDCISEQDLDEMNIEIIRNTLYKAYLESFYKFCTLLGGTTADAMCPILESCPKRTVPSSFHTVGGSTLRAWRSWLGLTTMNRSRTWPITTRSTSCSSRVQVATLETRRWRTDSLSTR

SEQ ID NO: 813531 - protein, 275 aa, Homo sapiens
GRRGSTHASSRNTLYKRQLTWGVAIRAGRSWFSGPAAPAAAMSFFPELYFNVDNGYLEGLVRGLKAGVLSQADYLNLVQCETLEAAFFQDCISEQDLDEMNIEIIRNTLYKAYLESFYKFCTLLGGTTADAMCPILEFEADRRAFIITINSFGTELSKEDRAKLFPHCGRLYPEGLAQLARADDYEQVKNVADYYPEYKLLFEGAGSNPGDKTLEDRFFEHEVKLNKLAFLNQFHFGVFYAFVKLKEQECRNIVWIAECIAQRHRAKIDNYIPIF

SEQ ID NO: 813532 - protein, 180 aa, Homo sapiens
GRRGSTHASSRNTLYKAYLESFYKFCTLLGGTTADAMCPILEFEADRRAFIITINSFGTELSKEDRAKLFPHCGRLYPEGLAQLARADDYEQVKNVADYYPEYKLLFEGAGSNPGDKTLEDRFFEHEVKLNKLAFLNQFHFGVFYAFVKLKEQECRNIVWIAECIAQRHRAKIDNYIPIF

SEQ ID NO: 813533 - protein, 146 aa, Homo sapiens
MYRGARFGSTYTKIGTIQRRLAEPLRKDDTQIREAVPYCGRLYPEGLAQLARADDYEQVKNVADYYPEYKLLFEGAGSNPGDKTLEDRFFEHEVKLNKLAFLNQFHFGVFYAFVKLKEQECRNIVWIAECIAQRHRAKIDNYIPIF

SEQ ID NO: 813534 - protein, 330 aa, Homo sapiens
ASPDALDSPLRTQRQLTWGVAIRAGRSWFSGPAAPAAAMSFFPELYFNVDNGYLEGLVRGLKAGVLSQADYLNLVQCETLEDLKLHLQSTDYGNFLANEASPLTVSVIDDRLKEKMVVEFRHMRNHAYEPLASFLDFITYSYMIDNVILLITGTLHQRSIAELVPKCHPLGSFEQMEAVNIAQTPAELYNAILVDTPLAAFFQDCISEQDLDEMNIEIIRNTLYKAYLESFYKFCTLLGGTTADAMCPILEFEADRRAFIITINSFGTELSKEDRAKLFPHCGRLYPEGLALYSVVVIGHVLDLFIVVSPSQLRQALRVEPPTVWSLGVC

SEQ ID NO: 813535 - protein, 177 aa, Homo sapiens
MCPILEFEADRRAFIITINSFGTELSKEDRAKLFPHCGRLYPEGLAQLARADDYEQVKNVADYYPVSAPAGRTAVGCVVTSTPTQNPHACASPHPPGQEYKLLFEGAGSNPGDKTLEDRFFEHEVKLNKLAFLNQFHFGVFYAFVKLKEQECRNIVWIAECIAQRHRAKIDNYIPIF

SEQ ID NO: 813536 - protein, 109 aa, Homo sapiens
AYLRVLRVSSLLMSAGLRAAIMAVREFPPKCSLSSQVSTESLCSVERTALRSTEHEVKLNKLAFLNQFHFGVFYAFVKLKEQECRNIVWIAECIAQRHRAKIDNYIPIF

SEQ ID NO: 813537 - protein, 139 aa, Homo sapiens
ASPDALDSPLRTQRQLTWGVAIRAGRSWFSGPAAPAAAMSFFPELYFNVDNGYLEGLVRGLKAGVLSQADYLNLVQCETLEDLKLHLQSTDYGNFLANEASPLTVSVIDDRLKEKMVVEFRHMRNHAYEPLASFLDFIT

SEQ ID NO: 813538 - protein, 389 aa, Homo sapiens; identical to SEQ ID NO: 813522

SEQ ID NO: 813539 - protein, 392 aa, Homo sapiens
GRRGSTHASSRNTLYKRQLTWGVAIRAGRSWFSGPAAPAAAMSFFPELYFNVDNGYLEGLVRGLKAGVLSQADYLNLVQCETLEDLKLHLQSTDYGNFLANEASPLTVSVIDDRLKEKMVVEFRHMRNHAYEPLASFLDFITYSYMIDNVILLITGTLHQRSIAELVPKCHPLGSFEQMEAVNIAQTPAELYNAILVDTPLAAFFQDCISEQDLDEMNIEIIRNTLYKAYLESFYKFCTLLGGTTADAMCPILEFEADRRAFIITINSFGTELSKEDRAKLFPHCGRLYPEGLAQLARADDYEQVKNVADYYPEYKLLFEGAGSNPGDKTLEDRFFEHEVKLNKLAFLNQFHFGVFYAFVKLKEQECRNIVWIAECIAQRHRAKIDNYIPIF

SEQ ID NO: 813540 - protein, 318 aa, Homo sapiens
PGKHSGASARAANAGAWGYRDFRGGQKKGWWTTPQLVATMPVSPAGSHKQQNFGLNNATQPKKSISFFATMKATSVKGYTGANQSRMAVSKTVLIPPELKTVEKPNPNIKTTQVFDINGTDVTPRPLYHPDPLTGTAKPSKLLTSQEGSLGSEFISSYSLYQNTINPSTLGQFTRSVLGSSTVSKSSVSASESIAEDLEEPSYKRERLTSFTDLQVIRAAPEKIVTKEDLEKNIEIILTETETLRFFDLPTVMVSVESEEAEKVTQRNKNYEVLCRNRLGNDLYVERMMQTFNGAPKNKDVQCDKIIMEDKGNFYHSA

SEQ ID NO: 813541 - protein, 813 aa, Homo sapiens
PGKHSGASARAANAGAWGYRDFRGGQKKGWWTTPQLVATMPVSPAGSHKQQNFGLNNATQPKKSISFFATMKATSVKGYTGANQSRMAVSKTVLIPPELKTVEKPNPNIKTTQVFDINGTDVTPRPLYHPDPLTGTAKPSKLLTSQEGSLGSEFISSYSLYQNTINPSTLGQFTRSVLGSSTVSKSSVSASESIAEDLEEPSYKRERLTSFTDLQVIRAAPEKIVTKEDLEKNIEIILTETETLRFFDLPTVMVSVESEEAEKVTQRNKNYEVLCRNRLGNDLYVERMMQTFNGAPKNKDVQCDKIIMEDKGIMSTAWDLYDSYNAMELVSLSVKQSVVESSSKANVLPKDQDQRLPGSTTEKNSETSSLMDIENVILAKIHEDEEDHSDAILKSDKFHQDLFFMERVLMENIFQPKLAAYRQLPVLKEPEPEEPEDVLESAKHEEVEEESKKEEEEEIHAEESTIPANLERLWSFSCDLTKGLNVSSLAWNKTNPDLLAVGYGHFGFKEQKRGLACCWSIKNPMWPERIYQSPYGVTAVDFSIGAPNLLAVGYHNGTIAIYNVRSNSNVPVLDSSESPQKHLGPVWQLQWIEQDRGTTGDGKREILVSISADGRISKWVIRKGLDCYDLMRLKRTTAASNKKGGEKEKKDEALISRQAPGMCFAFHPKGPVYKVTWNPFCHDVFLSCSADWGVIIWQQENVKPSLSFYPATSVVYDVAWSPKSSYIFAAANENRVEIWDLHISTLDPLIVNTANPGIKFTTILFAKQTDCLLVGDSDGQVSVYELRNMPTVLETGRGDIMDTLLGSKSNQSA

SEQ ID NO: 813542 - protein, 638 aa, Homo sapiens
PGKHSGASARAANAGAWGYRDFRGGQKKGWWTTPQLVATMPVSPAGSHKQQNFGLNNATQPKKSISFFATMKATSVKGYTGANQSRMAVSKTVLIPPELKTVEKPNPNIKTTQVFDINGTDVTPRPLYHPDPLTGTAKPSKLLTSQEGSLGSEFISSYSLYQNTINPSTLGQFTRSVLGSSTVSKSSVSASESIAEDLEEPSYKRERLTSFTDLQVIRAAPEKIVTKEDLEKNIEIILTETETLRFFDLPTVMVSVESEEAEKVTQRNKNYEVLCRNRLGNDLYVERMMQTFNGAPKNKDVQCDKIIMEDKGIMSTAWDLYDSYNAMELVSLSVKQSVVESSSKANVLPKDQDQRLPGSTTEKKPEPEEPEDVLESAKHEEVEEESKKEEEEEIHAEESTIPANLERLWSFSCDLTKGLNVSSLAWNKTNPDLLAVGYGHFGFKEQKRGLACCWSIKNPMWPERIYQSPYGVTAVDFSIGAPNLLAVGYHNGTIAIYNVRSNSNVPVLDSSESPQKHLGPVWQLQWIEQDRGTTGDGKREILVSISADGRISKWVIRKGLDCYDLMRLKRTTAASNKKGGEKEKKDEALISRQAPGMCFAFHPKDTNIYLAGTEEGHIHKCSCSYNEQYLDTYRGSSV

SEQ ID NO: 813543 - protein, 390 aa, Homo sapiens
MSTAWDLYDSYNAMELVSLSVKQSVVESSSKANVLPKDQDQRLPGSTTEKNSETSSLMDIENVILAKIHEDEEDHSDAILKSDKFHQDLFFMERVLMENIFQPKLAAYRQLPVLKEPEPEEPEDVLESAKHEEVEEESKKEEEEEIHAEESTIPANLERLWSFSCDLTKGLNVSSLAWNKTNPDLLAVGYGHFGFKEQKRGLACCWSIKNPMWPERIYQSPYGVTAVDFSIGAPNLLAVGYHNGTIAIYNVRSNSNVPVLDSSESPQKHLGPVWQLQWIEQDRGTTGDGKREILVSISADGRISKWVIRKGLDCYDLMRLKRTTAASNKKGGEKEKKDEALISRQAPGMCFAFHPKDTNIYLAGTEEGHIHKCSCSYNEQYLDTYRGSSV

SEQ ID NO: 813544 - protein, 161 aa, Homo sapiens
YVDGETCIAIQKSHDFKGPVYKVTWNPFCHDVFLSCSADWGVIIWQQENVKPSLSFYPATSVVYDVAWSPKSSYIFAAANENRVEIWDLHISTLDPLIVNTANPGIKFTTILFAKQTDCLLVGDSDGQVSVYELRNMPTVLETGRGDIMDTLLGSKSNQSA

SEQ ID NO: 813545 - protein, 638 aa, Homo sapiens; identical to SEQ ID NO: 813542

SEQ ID NO: 813546 - protein, 543 aa, Homo sapiens
PGKHSGASARAANAGAWGYRDFRGGQKKGWWTTPQLVATMPVSPAGSHKQQNFGLNNATQPKKSISFFATMKATSVKGYTGANQSRMAVSKTVLIPPELKTVEKPNPNIKTTQVFDINGTDVTPRPLYHPDPLTGTAKPSKLLTSQEGSLGSEFISSYSLYQNTINPSTLGQFTRSVLGSSTVSKSSVSASESIAEDLEEPSYKRERLTSFTDLQVIRAAPEKIVTKEDLEKNIEIILTETETLRFFDLPTVMVSVESEEAEKVTQRNKNYEVLCRNRLGNDLYVERMMQTFNGAPKNKDVQCDKIIMEDKGIMSTAWDLYDSYNAMELVSLSVKQSVVESSSKANVLPKDQDQRLPGSTTEKNSETSSLMDIENVILAKIHEDEEDHSDAILKSDKFHQDLFFMERVLMENIFQPKLAAYRQLPVLKEPEPEEPEDVLESAKHEEVEEESKKEEEEEIHAEESTIPANLERLWSFSCDLTKGLNVSSLAWNKTNPDLLAVGYGHFGFKEQKRGLACCWSIKNPMVTQTRIRSIFIWLLTKFS

SEQ ID NO: 813547 - protein, 478 aa, Homo sapiens
PGKHSGASARAANAGAWGYRDFRGGQKKGWWTTPQLVATMPVSPAGSHKQQNFGLNNATQPKKSISFFATMKATSVKGYTGANQSRMAVSKTVLIPPELKTVEKPNPNIKTTQVFDINGTDVTPRPLYHPDPLTGTAKPSKLLTSQEGSLGSEFISSYSLYQNTINPSTLGQFTRSVLGSSTVSKSSVSASESIAEDLEEPSYKRERLTSFTDLQVIRAAPEKIVTKEDLEKNIEIILTETETLRFFDLPTVMVSVESEEAEKVTQRNKNYEVLCRNRLGNDLYVERMMQTFNGAPKNKDVQCDKIIMEDKGIMSTAWDLYDSYNAMELVSLSVKQSVVESSSKANVLPKDQDQRLPGSTTEKKPEPEEPEDVLESAKHEEVEEESKKEEEEEIHAEESTIPANLERLWSFSCDLTKGLNVSSLAWNKTNPDLLAVGYGHFGFKEQKRGLACCWSIKNPMVTQTRIRSIFIWLLTKFS

SEQ ID NO: 813548 - protein, 405 aa, Homo sapiens
PGKHSGASARAANAGAWGYRDFRGGQKKGWWTTPQLVATMPVSPAGSHKQQNFGLNNATQPKKSISFFATMKATSVKGYTGANQSRMAVSKTVLIPPELKTVEKPNPNIKTTQVFDINGTDVTPRPLYHPDPLTGTAKPSKLLTSQEGSLGSEFISSYSLYQNTINPSTLGQFTRSVLGSSTVSKSSVSASESIAEDLEEPSYKRERLTSFTDLQVIRAAPEKIVTKEDLEKNIEIILTETETLRFFDLPTVMVSVESEEAEKVTQRNKNYEVLCRNRLGNDLYVERMMQTFNGAPKNKDVQCDKIIMEDKGIMSTAWDLYDSYNAMELVSLSVKQSVVESSSKANVLPKDQDQRLPGSTTEKSLLVEAIKNCSEQSNLRLEITLGLYIRSIFSTPLRPLTYKNV

SEQ ID NO: 813549 - protein, 796 aa, Homo sapiens
MLAPLRNAPGREGATSPSPPTDATGSLGEWDVDRNVKTEGWVSKERISKLHRLRMADILSQSETLASQDLSGDFKKPALPVSPAARSKAPASSSSNPEEVQKEGPTALQDSNSGEPDIPPPQPDCGDFRSLQEEQSRPPTAVSSPGGPARAPPYQEPPWGGPATAPYSLETLKGGTILGTRSLKGTSYCLFGRLSGCDVCLEHPSVSRYHAVLQHRASGPDGECDSNGPGFYLYDLGSTHGTFLNKTRIPPRTYCRVHVGHVVRFGGSTRLFILQGPEEDREAESELTVTQLKELRKQQQILLEKKMLGEDSDEEEEMDTSERKINAGSQDDEMGCTWGMGEDAVEDDAEENPIVLEFQQEREAFYIKDPKKALQGFFDREGEELEYEFDEQGHSTWLCRVRLPVDDSTGKQLVAEAIHSGKKKEAMIQCSLEACRILDTLGLLRQEAVSRKRKAKNWEDEDFYDSDDDTFLDRTGLIEKKRLNRMKKAGKIDEKPETFESLVAKLNDAERELSEISERLKASSQVLSESPSQDSLDAFMSEMKSGSTLDGVSRKKLHLRTFELRKEQQRLKGLIKIVKPAEIPELKKTETQTTGAENKAKKLTLPLFGAMKGGSKFKLKTGTVGKLPPKRPELPPTLMRMKDEPEVEEEEEEEEEEEKEKEEHEKKKLEDGSLSRPQPEIEPEAAVQEMRPPTDLTHFKETQTHENMSQLSEEEQNKDYQDCSKTTSLCAGPSASKNEYEKSRGELKKKKTPGPGKLPPTLSSKYPEDDPDYCVWVPPEGQSGDGRTHLNDKYGY

SEQ ID NO: 813550 - protein, 79 aa, Homo sapiens
RPPPSSNSDGKRAPVHFHQHFLPNILKMTQTTVCGSHLKVKVEMAEPILMTSMAIDCFRIPKENLVDHVTWNIWDNVSN

SEQ ID NO: 813551 - protein, 389 aa, Homo sapiens
ADLEDPGHLQHHSGKKKEAMIQCSLEACRILDTLGLLRQEAVSRKRKAKNWEDEDFYDSDDDTFLDRTGLIEKKRLNRMKKAGKIDEKPETFESLVAKLNDAERELSEISERLKASSQVLSESPSQDSLDAFMSEMKSGSTLDGVSRKKLHLRTFELRKEQQRLKGLIKIVKPAEIPELKKTETQTTGAENKAKKLTLPLFGAMKGGSKFKLKTGTVGKLPPKRPELPPTLMRMKDEPEVEEEEEEEEEEEKEKEEHEKKKLEDGSLSRPQPEIEPEAAVQEMRPPTDLTHFKETQTHENMSQLSEEEQNKDYQDCSKTTSLCAGPSASKNEYEKSRGELKKKKTPGPGKLPPTLSSKYPEDDPDYCVWVPPEGQSGDGRTHLNDKYGY

SEQ ID NO: 813552 - protein, 84 aa, Homo sapiens
VRSLDRMVAPTVFVKVEEKFYFHQHFLPNILKMTQTTVCGSHLKVKVEMAEPILMTSMAIDCFRIPKENLVDHVTWNIWDNVSN

SEQ ID NO: 813553 - protein, 796 aa, Homo sapiens; identical to SEQ ID NO: 813549

SEQ ID NO: 813554 - protein, 796 aa, Homo sapiens; identical to SEQ ID NO: 813549

SEQ ID NO: 813555 - protein, 796 aa, Homo sapiens; identical to SEQ ID NO: 813549

SEQ ID NO: 813556 - protein, 796 aa, Homo sapiens; identical to SEQ ID NO: 813549

SEQ ID NO: 813557 - protein, 807 aa, Homo sapiens
MAATELRGVVGPGPAAIAALGGGGAGPPVVGGGGGRGDAGPGSGAASGTVVAAAAGGPGPGAGGVAAAGPAPAPPTGGSGGSGAGGSGSAREGWLFKWTNYIKGYQRRWFVLSNGLLSYYRSKAEMRHTCRGTINLATANITVEDSCNFIISNGGAQTYHLKASSEVERQRWVTALELAKAKAVKMLAESDESGDEESVSQTDKTELQNTLRTLSSKVEDLSTCNDLIAKHGTALQRSLSELESLKLPAESNEKIKQVNERATLFRITSNAMINACRDFLMLAQTHSKKWQKSLQYERDQRIRLEETLEQLAKQHNHLERAFRGATVLPANTPGNVGSGKDQCCSGKGDMSDEDDENEFFDAPEIITMPENLGHKRTGSNISGASSDISLDEQYKHQLEETKKEKRTRIPYKPNYSLNLWSIMKNCIGKELSKIPMPVNFNEPLSMLQRLTEDLEYHELLDRAAKCENSLEQLCYVAAFTVSSYSTTVFRTSKPFNPLLGETFELDRLEENGYRSLCEQVSHHPPAAAHHAESKNGWTLRQEIKITSKFRGKYLSIMPLGTIHCIFHATGHHYTWKKVTTTVHNIIVGKLWIDQSGEIDIVNHKTGDKCNLKFVPYSYFSRDVARKVTGEVTDPSGKVHFALLGTWDEKMECFKVQPVIGENGGDARQRGHEAEESRVMLWKRNPLPKNAENMYYFSELALTLNAWESGTAPTDSRLRPDQRLMENGRWDEANAEKQRLEEKQRLSRKKREAEAMKATEDGTPYDPYKALWFERKKDPVTKELTHIYRGEYWECKEKQDWSSCPDIF

SEQ ID NO: 813558 - protein, 807 aa, Homo sapiens; identical to SEQ ID NO: 813557

SEQ ID NO: 813559 - protein, 807 aa, Homo sapiens; identical to SEQ ID NO: 813557

SEQ ID NO: 813560 - protein, 807 aa, Homo sapiens; identical to SEQ ID NO: 813557

SEQ ID NO: 813561 - protein, 531 aa, Homo sapiens
MAATELRGVVGPGPAAIAALGGGGAGPPVVGGGGGRGDAGPGSGAASGTVVAAAAGGPGPGAGGVAAAGPAPAPPTGGSGGSGAGGSGSAREGWLFKWTNYIKGYQRRWFVLSNGLLSYYRSKAEMRHTCRGTINLATANITVEDSCNFIISNGGAQTYHLKASSEVERQRWVTALELAKAKAVKMLAESDESGDEESVSQTDKTELQNTLRTLSSKVEDLSTCNDLIAKHGTALQRSLSELESLKLPAESNEKIKQVNERATLFRITSNAMINACRDFLMLAQTHSKKWQKSLQYERDQRIRLEETLEQLAKQHNHLERAFRGATVLPANTPGNVGSGKDQCCSGKGDMSDEDDENEFFDAPEIITMPENLGHKRTGSNISGASSDISLDEQYKHQLEETKKEKRTRIPYKPNYSLNLWSIMKNCIGKELSKIPMPVNFNEPLSMLQRLTEDLEYHELLDRAAKCENSLEQLCYVAAFTVSSYSTTVFRTSKPFNPLLGETFELDRLEENGYRSLCEQVKEPQNHNAFPF

SEQ ID NO: 813562 - protein, 526 aa, Homo sapiens
MSAPALIGTEESLQYERDQRIRLEETLEQLAKQHNHLERAFRGATVLPANTPGNVGSGKDQCCSGKGDMSDEDDENEFFDAPEIITMPENLGHKRTGSNISGASSDISLDEQYKHQLEETKKEKRTRIPYKPNYSLNLWSIMKNCIGKELSKIPMPVNFNEPLSMLQRLTEDLEYHELLDRAAKCENSLEQLCYVAAFTVSSYSTTVFRTSKPFNPLLGETFELDRLEENGYRSLCEQVSHHPPAAAHHAESKNGWTLRQEIKITSKFRGKYLSIMPLGTIHCIFHATGHHYTWKKVTTTVHNIIVGKLWIDQSGEIDIVNHKTGDKCNLKFVPYSYFSRDVARKVTGEVTDPSGKVHFALLGTWDEKMECFKVQPVIGENGGDARQRGHEAEESRVMLWKRNPLPKNAENMYYFSELALTLNAWESGTAPTDSRLRPDQRLMENGRWDEANAEKQRLEEKQRLSRKKREAEAMKATEDGTPYDPYKALWFERKKDPVTKELTHIYRGEYWECKEKQDWSSCPDIF

SEQ ID NO: 813563 - protein, 182 aa, Homo sapiens
MSDEDDENEFFDAPEIITMPENLGHKRTGSNISGASSDISLDEQYKHQLEETKKEKRTRIPYKPNYSLNLWSIMKNCIGKELSKIPMPVNFNEPLSMLQRLTEDLEYHELLDRAAKCENSLEQLCYVAAFTVSSYSTTVFRTSKPFNPLLGETFELDRLEENGYRSLCEQVKEPQNHNAFPF

SEQ ID NO: 813564 - protein, 407 aa, Homo sapiens
MAATELRGVVGPGPAAIAALGGGGAGPPVVGGGGGRGDAGPGSGAMLQRLTEDLEYHELLDRAAKCENSLEQLCYVAAFTVSSYSTTVFRTSKPFNPLLGETFELDRLEENGYRSLCEQVSHHPPAAAHHAESKNGWTLRQEIKITSKFRGKYLSIMPLGTIHCIFHATGHHYTWKKVTTTVHNIIVGKLWIDQSGEIDIVNHKTGDKCNLKFVPYSYFSRDVARKVTGEVTDPSGKVHFALLGTWDEKMECFKVQPVIGENGGDARQRGHEAEESRVMLWKRNPLPKNAENMYYFSELALTLNAWESGTAPTDSRLRPDQRLMENGRWDEANAEKQRLEEKQRLSRKKREAEAMKATEDGTPYDPYKALWFERKKDPVTKELTHIYRGEYWECKEKQDWSSCPDIF

SEQ ID NO: 813565 - protein, 362 aa, Homo sapiens [sequence omitted]

SEQ ID NO: 813566 - protein, 531 aa, Homo sapiens; identical to SEQ ID NO: 813561

SEQ ID NO: 813567 - protein, 150 aa, Homo sapiens
RVRDGGRGGGGRPGPGGRGSGGGWPGPCAADWGLGRLGRWGFGLGSRGLALQMDQLYQRLPAAMVRAEQRAPELLQVTASGALSLTLPPPYLPTVPAPALPPAGTAARVAPGPFSSSVRIDSPGVGAHCHESEKPLDVHLPSPRVTHSWC

SEQ ID NO: 813568 - protein, 261 aa, Homo sapiens
AEGASVSQDGSPAGYSGGLGGRQGARAAACCPPKMEFLLGNPFSTPVGQCLEKATDGSLQSEDWTLNMEICDIINETEEGPKDAIRALKKRLNGNRNYREVMLALTVLETCVKNCGHRFHILVANRDFIDSVLVKIISPKNNPPTIVQDKVLALIQAWADAFRSSPDLTGVVHIYEELKRKGVEFPMADLDALSPIHTPQRSVPEVDPAATMPRSQSQQRTSAGSYSSPPPAPYSAPQAPALSVTGPITANSEQVLAYFGA

SEQ ID NO: 813569 - protein, 60 aa, Homo sapiens
MQQRIVELISRVSNEEVTEELLHVNDDLNNVFLRYERWEPDFFFFFFLVLTKGPMADDLP

SEQ ID NO: 813570 - protein, 137 aa, Homo sapiens [sequence omitted]

SEQ ID NO: 813571 - protein, 137 aa, Homo sapiens [sequence omitted]

SEQ ID NO: 813572 - protein, 137 aa, Homo sapiens [sequence omitted]

SEQ ID NO: 813573 - protein, 208 aa, Homo sapiens
AEGASVSQDGSPAGYSGGLGGRQGARAAACCPPKMEFLLGNPFSTPVGQCLEKATDGSLQSEDWTLNMEICDIINETEEGPKDAIRALKKRLNGNRNYREVMLALTVLETCVKNCGHRFHILVANRDFIDSVLVKIISPKNNPPTIVQDKVLALIQAWADAFRSSPDLTGVVHIYEDHQPPSQNCFCLSIPPGSPGEGDGYLFPKVCT

SEQ ID NO: 813574 - protein, 350 aa, Homo sapiens
AEGASVSQDGSPAGYSGGLGGRQGARAAACCPPKMEFLLGNPFSTPVGQCLEKATDGSLQSEDWTLNMEICDIINETEEGPKDAIRALKKRLNGNRNYREVMLALTVLETCVKNCGHRFHILVANRDFIDSVLVKIISPKNNPPTIVQDKVLALIQAWADAFRSSPDLTGVVHIYEELKRKGVEFPMADLDALSPIHTPQRSVPEVDPAATMPRSQSQQRTSAGSYSSPPPAPYSAPQAPALSVTGPITANSEQIARLRSELDVVRGNTKVMSEMLTEMVPGQEDSSDLELLQELNRTCRAMQQRIVELISRVSNEEVTEELLHVNDDLNNVFLRYERWEPDFFFFFFSP

SEQ ID NO: 813575 - protein, 300 aa, Homo sapiens
AEGASVSQDGSPAGYSGGLGGRQGARAAACCPPKMEFLLGNPFSTPVGQCLEKATDGSLQSEDWTLNMEICDIINETEEGPKDAIRALKKRLNGNRNYREVMLALTAWADAFRSSPDLTGVVHIYEELKRKGVEFPMADLDALSPIHTPQRSVPEVDPAATMPRSQSQQRTSAGSYSSPPPAPYSAPQAPALSVTGPITANSEQIARLRSELDVVRGNTKVMSEMLTEMVPGQEDSSDLELLQELNRTCRAMQQRIVELISRVSNEEVTEELLHVNDDLNNVFLRYERWEPDFFFFFFSP

SEQ ID NO: 813576 - protein, 305 aa, Homo sapiens
AEGASVSQDGSPAGYSGGLGGRQGARAAACCPPKMEFLLGNPFSTPVGQCLEKATDGSLQSEDWTLNMEICDIINETEEGPKDAIRALKKRLNGNRNYREVMLALTVLETCVKNCGHRFHILVANRDFIDSVLVKIISPKNNPPTIVQDKVLALIQSVPEVDPAATMPRSQSQQRTSAGSYSSPPPAPYSAPQAPALSVTGPITANSEQIARLRSELDVVRGNTKVMSEMLTEMVPGQEDSSDLELLQELNRTCRAMQQRIVELISRVSNEEVTEELLHVNDDLNNVFLRYERWEPDFFFFFFSP

SEQ ID NO: 813577 - protein, 79 aa, Homo sapiens
PAPTGVTLFLPSPHQVLETCVKNCGHRFHILVANRDFIDSVLVKIISPKNNPPTIVQDKVLALIQVGWTPCPICWNRVR

SEQ ID NO: 813578 - protein, 486 aa, Homo sapiens
MVAGMLGLREEKSEDQDLQGLKDKPLKFKKVKKDKKEEKEGKHEPVQPSAHHSAEPAEAGKAETSEGSGSAPAVPEASASPKQRRSIIRDRGPMYDDPTLPEGWTRKLKQRKSGRSAGKYDVYLINPQGKAFRSKVELIAYFEKVGDTSLDPNDFDFTVTGRGSPSRREQKPPKKPKSPKAPGTGRGRGRPKGSGTTRPKAATSEGVQVKRVLEKSPGKLLVKMPFQTSPGGKAEGGGATTSTQVMVIKRPGRKRKAEADPQAIPKKRGRKPGSVVAAAAAEAKKKAVKESSIRSVQETVLPIKKRKTRETVSIEVKEVVKPLLVSTLGEKSGKGLKTCKSPGRKSKESSPKGRSSSASSPPKKEHHHHHHHSESPKAPVPLLPPLPPPPPEPESSEDPTSPPEPQDLSSSVCKEEKMPRGGSLESDGCPKEPAKTQPAVATAATAAEKYKHRGEGERKDIVSSSMPRPNREEPVDSRTPVTERVS

SEQ ID NO: 813579 - protein, 404 aa, Homo sapiens
MVAGMLGLREEKSEDQDLQGLKDKPLKFKKVKKDKKEEKEGKHEPVQPSAHHSAEPAEAGKAETSEGSGSAPAVPEASASPKQRRSIIRDRGPMYDDPTLPEGWTRKLKQRKSGRSAGKYDVYLINPQGKAFRSKVELIAYFEKVGDTSLDPNDFDFTVTGRGSPSRREQKPPKKPKSPKAPGTGRGRGRPKGSGTTRPKAATSEGVQVKRVLEKSPGKLLVKMPFQTSPGGKAEGGGATTSTQVMVIKRPGRKRKAEADPQAIPKKRGRKPGSVVAAAAAEAKKKAVKESSIRSVQETVLPIKKRKTRETVSIEVKEVVKPLLVSTLGEKSGKGLKTCKSPGRKSKESSPKGRSSSASSPPKKEHHHHHNYSPKGPGNAPHRTNTYTGANKTTQTNRDTRDPS

SEQ ID NO: 813580 - protein, 245 aa, Homo sapiens
MVAGMLGLREEKSEDQDLQGLKDKPLKFKKVKKDKKEEKEGKHEPVQPSAHHSAEPAEAGKAETSEGSGSAPAVPEASASPKQRRSIIRDRGPMYDDPTLPEGWTRKLKQRKSGRSAGKYDVYLINPQGKAFRSKVELIAYFEKVGDTSLDPNDFDFTVTGRGSPSRREQKPPKKPKSPKAPGTGRGRGRPKGSGTTRPKAATSEGVQVKRVLEKSPGKLLVKMPFQTSPGGKAEGGGATTSTST

SEQ ID NO: 813581 - protein, 329 aa, Homo sapiens
MVAGMLGLREEKSEDQDLQGLKDKPLKFKKVKKDKKEEKEGKHEPVQPSAHHSAEPAEAGKAETSEGSGSAPAVPEASASPKQRRSIIRDRGPMYDDPTLPEGWTRKLKQRKSGRSAGKYDVYLINPQGKAFRSKVELIAYFEKVGDTSLDPNDFDFTVTGRGSPSRREQKPPKKPKSPKAPGTGRGRGRPKGSGTTRPKAATSEGVQVKRVLEKSPGKLLVKMPFQTSPGGKAEGGGATTSTQVMVIKRPGRKRKAEADPQAIPERRSRMCVSVREAKKRRLHRWEERSHKGDGSHQKKEPWSPKGETVTGNTRGLPGTKRGQNQENQ

SEQ ID NO: 813582 - protein, 172 aa, Homo sapiens
MLQITEWRFLARDEGESAVAEDPTWGEDEEPSACTTDSWAQGSVPVLHASTSEGLENFQGEVHSSGASPDSSAIAPALPFPTSHCPSAFPQDPGGVDRIPLGRSWMGRGSQEQMESWEPSPQLRVTSAPPPTSELFQEAGPGGPVEEADGQSRGLSSAGSLSASFQLSVEEA

SEQ ID NO: 813583 - protein, 172 aa, Homo sapiens; identical to SEQ ID NO: 813582

SEQ ID NO: 813584 - protein, 138 aa, Homo sapiens
RPPPSPPRLPTPAAAPLSLSPRPPLAPSPPPSRRTRGAGNELPCDARPLRELSVTHELPTSPAAGRGLRAGKTRGRGGGKGRKVLRRVQLSASESEGSRNEENLQELPSAICSMVPGYPLASPFPWQAWKHRFGVVLL

SEQ ID NO: 813585 - protein, 841 aa, Homo sapiens
MSVDEKPDSPMYVYESTVHCTNILLGLNDQRKKDILCDVTLIVERKEFRAHRAVLAACSEYFWQALVGQTKNDLVVSLPEEVTARGFGPLLQFAYTAKLLLSRENIREVIRCAEFLRMHNLEDSCFSFLQTQLLNSEDGLFVCRKDAACQRPHEDCENSAGEEEDEEEETMDSETAKMACPRDQMLPEPISFEAAAIPVAEKEEALLPEPDVPTDTKESSEKDALTQYPRYKKYQLACTKNVYNASSHSTSGFASTFREDNSSNSLKPGLARGQIKSEPPSEENEEESITLCLSGDEPDAKDRAGDVEMDRKQPSPAPTPTAPAGAACLERSRSVASPSCLRSLFSITKSVELSGLPSTSQQHFARSPACPFDKGITQGDLKTDYTPFTGNYGQPHVGQKEVSNFTMGSPLRGPGLEALCKQEGELDRRSVIFSSSACDQVSTSVHSYSGVSSLDKDLSEPVPKGLWVGAGQSLPSSQAYSHGGLMADHLPGRMRPNTSCPVPIKVCPRSPPLETRTRTSSSCSSYSYAEDGSGGSPCSLPLCEFSSSPCSQGARFLATEHQEPGLMGDGMYNQVRPQIKCEQSYGTNSSDESGSFSEADSESCPVQDRGQEVKLPFPVDQITDLPRNDFQMMIKMHKLTSEQLEFIHDVRRRSKNRIAAQRCRKRKLDCIQNLECEIRKLVCEKEKLLSERNQLKACMGELLDNFSCLSQEVCRDIQSPEQIQALHRYCPVLRPMDLPTASSINPAPLGAEQNIAASQCAVGENVPCCLEPGAAPPGPPWAPSNTSENCTSGRRLEGTDPGTFSERGPPLEPRSQTVTVDFCQEMTDKCTTDEQPRKDYT

SEQ ID NO: 813586 - protein, 841 aa, Homo sapiens; identical to SEQ ID NO: 813585

SEQ ID NO: 813587 - protein, 841 aa, Homo sapiens; identical to SEQ ID NO: 813585

SEQ ID NO: 813588 - protein, 841 aa, Homo sapiens; identical to SEQ ID NO: 813585

SEQ ID NO: 813589 - protein, 129 aa, Homo sapiens
RPPPSPPRLPTPAAAPLSLSPRPPLAPSPPPSRRTRGAGNELPCDARPLRELSVTHELPTSPAAGRGLRAGKTRGRGGGKGRKVLRRVQLSASESEGSRNEENLQELPRTVTCLIPCSHPCSMNKVDTH

SEQ ID NO: 813590 - protein, 129 aa, Homo sapiens; identical to SEQ ID NO: 813589

SEQ ID NO: 813591 - protein, 554 aa, Homo sapiens
RAHNCLLRPKNKSVRWGPGAGAALLRPSPAALGAGSRACSGPPAAPAQTPRPQVSAPAWGPGRAAGGSGRMERRMKAGYLDQQVPYTFSSKSPGNGSLREALIGPLGKLMDPGSLPPLDSEDLFQDLSHFQETWLAEAQVPDSDEQFVPDFHSENLAFHSPTTRIKKEPQSPRTDPALSCSRKPPLPYHHGEQCLYSSAYDPPRQIAIKSPAPGALGQSPLQPFPRAEQRNFLRSSGTSQPHPGHGYLGEHSSVFQQPLDICHSFTSQGGGREPLPAPYQHQLSEPCPPYPQQSFKQEYHDPLYEQAGQPAVDQGGVNGHRYPGAGVVIKQEQTDFAYDSDVTGCASMYLHTEGFSGPSPGDGAMGYGYEKPLRPFPDDVCVVPEKFEGDIKQEGVGAFREGPPYQRRGALQLWQFLVALLDDPTNAHFIAWTGRGMEFKLIEPEEVARLWGIQKNRPAMNYDKLSRSLRYYYEKGIMQKVAGERYVYKFVCEPEALFSLAFPDNQRPALKAEFDRPVSEEDTVPLSHLDESPAYLPELAGPAQPFGPKGGYSY

SEQ ID NO: 813592 - protein, 103 aa, Homo sapiens
RAHNCLLRPKNKSVRWGPGAGAALLRPSPAALGAGSRACSGPPAAPAQTPRPQVSAPAWGPGRAAGGSGRMERRMKAGYLDQQVPYTFSSVSAAPASTPAPPR

SEQ ID NO: 813593 - protein, 510 aa, Homo sapiens
CERSPLPHQVSAPAWGPGRAAGGSGRMERRMKAGYLDQQVPYTFSSKSPGNGSLREALIGPLGKLMDPGSLPPLDSEDLFQDLSHFQETWLAEAQVPDSDEQFVPDFHSENLAFHSPTTRIKKEPQSPRTDPALSCSRKPPLPYHHGEQCLYSSAYDPPRQIAIKSPAPGALGQSPLQPFPRAEQRNFLRSSGTSQPHPGHGYLGEHSSVFQQPLDICHSFTSQGGGREPLPAPYQHQLSEPCPPYPQQSFKQEYHDPLYEQAGQPAVDQGGVNGHRYPGAGVVIKQEQTDFAYDSDVTGCASMYLHTEGFSGPSPGDGAMGYGYEKPLRPFPDDVCVVPEKFEGDIKQEGVGAFREGPPYQRRGALQLWQFLVALLDDPTNAHFIAWTGRGMEFKLIEPEEVARLWGIQKNRPAMNYDKLSRSLRYYYEKGIMQKVAGERYVYKFVCEPEALFSLAFPDNQRPALKAEFDRPVSEEDTVPLSHLDESPAYLPELAGPAQPFGPKGGYSY

SEQ ID NO: 813594 - protein, 484 aa, Homo sapiens
MERRMKAGYLDQQVPYTFSSKSPGNGSLREALIGPLGKLMDPGSLPPLDSEDLFQDLSHFQETWLAEAQVPDSDEQFVPDFHSENLAFHSPTTRIKKEPQSPRTDPALSCSRKPPLPYHHGEQCLYSSAYDPPRQIAIKSPAPGALGQSPLQPFPRAEQRNFLRSSGTSQPHPGHGYLGEHSSVFQQPLDICHSFTSQGGGREPLPAPYQHQLSEPCPPYPQQSFKQEYHDPLYEQAGQPAVDQGGVNGHRYPGAGVVIKQEQTDFAYDSDVTGCASMYLHTEGFSGPSPGDGAMGYGYEKPLRPFPDDVCVVPEKFEGDIKQEGVGAFREGPPYQRRGALQLWQFLVALLDDPTNAHFIAWTGRGMEFKLIEPEEVARLWGIQKNRPAMNYDKLSRSLRYYYEKGIMQKVAGERYVYKFVCEPEALFSLAFPDNQRPALKAEFDRPVSEEDTVPLSHLDESPAYLPELAGPAQPFGPKGGYSY

SEQ ID NO: 813595 - protein, 496 aa, Homo sapiens
GCPAPESPEDPNLVPQTKRLRVTRGHSPRFSQKSPGNGSLREALIGPLGKLMDPGSLPPLDSEDLFQDLSHFQETWLAEAQVPDSDEQFVPDFHSENLAFHSPTTRIKKEPQSPRTDPALSCSRKPPLPYHHGEQCLYSSAYDPPRQIAIKSPAPGALGQSPLQPFPRAEQRNFLRSSGTSQPHPGHGYLGEHSSVFQQPLDICHSFTSQGGGREPLPAPYQHQLSEPCPPYPQQSFKQEYHDPLYEQAGQPAVDQGGVNGHRYPGAGVVIKQEQTDFAYDSDVTGCASMYLHTEGFSGPSPGDGAMGYGYEKPLRPFPDDVCVVPEKFEGDIKQEGVGAFREGPPYQRRGALQLWQFLVALLDDPTNAHFIAWTGRGMEFKLIEPEEVARLWGIQKNRPAMNYDKLSRSLRYYYEKGIMQKVAGERYVYKFVCEPEALFSLAFPDNQRPALKAEFDRPVSEEDTVPLSHLDESPAYLPELAGPAQPFGPKGGYSY

SEQ ID NO: 813596 - protein, 517 aa, Homo sapiens
RAHNCLLRPKNKSVRWGPGAGAALLRPSPAALGAGSRACSGPPAAPAQTPRPQKSPGNGSLREALIGPLGKLMDPGSLPPLDSEDLFQDLSHFQETWLAEAQVPDSDEQFVPDFHSENLAFHSPTTRIKKEPQSPRTDPALSCSRKPPLPYHHGEQCLYSSAYDPPRQIAIKSPAPGALGQSPLQPFPRAEQRNFLRSSGTSQPHPGHGYLGEHSSVFQQPLDICHSFTSQGGGREPLPAPYQHQLSEPCPPYPQQSFKQEYHDPLYEQAGQPAVDQGGVNGHRYPGAGVVIKQEQTDFAYDSDVTGCASMYLHTEGFSGPSPGDGAMGYGYEKPLRPFPDDVCVVPEKFEGDIKQEGVGAFREGPPYQRRGALQLWQFLVALLDDPTNAHFIAWTGRGMEFKLIEPEEVARLWGIQKNRPAMNYDKLSRSLRYYYEKGIMQKVAGERYVYKFVCEPEALFSLAFPDNQRPALKAEFDRPVSEEDTVPLSHLDESPAYLPELAGPAQPFGPKGGYSY

SEQ ID NO: 813597 - protein, 207 aa, Homo sapiens
MYLHTEGFSGPSPGDGAMGYGYEKPLRPFPDDVCVVPEKFEGDIKQEGVGAFREGPPYQRRGALQLWQFLVALLDDPTNAHFIAWTGRGMEFKLIEPEEVARLWGIQKNRPAMNYDKLSRSLRYYYEKGIMQKVAGERYVYKFVCEPEALFSLAFPDNQRPALKAEFDRPVSEEDTVPLSHLDESPAYLPELAGPAQPFGPKGGYSY

SEQ ID NO: 813598 - protein, 490 aa, Homo sapiens
GCPAPESPEDPNLVPQTKRLRVTRGHSPRFSQKSPGNGSLREALIGPLGKLMDPGSLPPLDSEDLFQDLSHFQETWLAEAQVPDSDEQFVPDFHSENLAFHSPTTRIKKEPQSPRTDPALSCSRKPPLPYHHGEQCLYSRQIAIKSPAPGALGQSPLQPFPRAEQRNFLRSSGTSQPHPGHGYLGEHSSVFQQPLDICHSFTSQGGGREPLPAPYQHQLSEPCPPYPQQSFKQEYHDPLYEQAGQPAVDQGGVNGHRYPGAGVVIKQEQTDFAYDSDVTGCASMYLHTEGFSGPSPGDGAMGYGYEKPLRPFPDDVCVVPEKFEGDIKQEGVGAFREGPPYQRRGALQLWQFLVALLDDPTNAHFIAWTGRGMEFKLIEPEEVARLWGIQKNRPAMNYDKLSRSLRYYYEKGIMQKVAGERYVYKFVCEPEALFSLAFPDNQRPALKAEFDRPVSEEDTVPLSHLDESPAYLPELAGPAQPFGPKGGYSY

SEQ ID NO: 813599 - protein, 510 aa, Homo sapiens; identical to SEQ ID NO: 813593

SEQ ID NO: 813600 - protein, 138 aa, Homo sapiens
ISGDNAREIYPYYDPWMGRGMEFKLIEPEEVARLWGIQKNRPAMNYDKLSRSLRYYYEKGIMQKVAGERYVYKFVCEPEALFSLAFPDNQRPALKAEFDRPVSEEDTVPLSHLDESPAYLPELAGPAQPFGPKGGYSY

SEQ ID NO: 813601 - protein, 510 aa, Homo sapiens; identical to SEQ ID NO: 813593

SEQ ID NO: 813602 - protein, 129 aa, Homo sapiens
MAATKRKRRGGFAVQAKKPKRNEIDAEPPAKRHATAEEVEEEERDRIPGPVCKGKWKNKERILIFSSRGINFRTRHLMQDLRMLMPHSKADTKMDRKDKLFVINEVCEMKNCNKCIYFEAKKKQDLYMW

SEQ ID NO: 813603 - protein, 313 aa, Homo sapiens
MAATKRKRRGGFAVQAKKPKRNEIDAEPPAKRHATAEEVEEEERDRIPGPVCKGKWKNKERILIFSSRGINFRTRHLMQDLRMLMPHSKADTKMDRKDKLFVINEVCEMKNCNKCIYFEAKKKQDLYMWLSNSPHGPSAKFLVQNIHTLAELKMTGNCLKGSRPLLSFDPAFDELPHYALLKELLIQIFSTPRYHPKSQPFVDHVFTFTILDNRIWFRNFQIIEEDAALVEIGPRFVLNLIKIFQGSFGGPTLYENPHYQSPNMHRRVIRSITAAKYREKQQVKDVQKLRKKEPKTLLPHDPTADVWYTVREP

SEQ ID NO: 813604 - protein, 353 aa, Homo sapiens
MAATKRKRRGGFAVQAKKPKRNEIDAEPPAKRHATAEEVEEEERDRIPGPVCKGKWKNKERILIFSSRGINFRTRHLMQDLRMLMPHSKADTKMDRKDKLFVINEVCEMKNCNKCIYFEAKKKQDLYMWLSNSPHGPSAKFLVQNIHTLAELKMTGNCLKGSRPLLSFDPAFDELPHYALLKELLIQIFSTPRYHPKSQPFVDHVFTFTILDNRIWFRNFQIIEEDAALVEIGPRFVLNLIKIFQGSFGGPTLYENPHYQSPNMHRRVIRSITAAKYREKQQVKDVQKLRKKEPKTLLPHDPTADVFVTPAEEKPIEIQWVKPEPKVDLKARKKRIYKRQRKMKQRMDSGKTK

SEQ ID NO: 813605 - protein, 353 aa, Homo sapiens; identical to SEQ ID NO: 813604

SEQ ID NO: 813606 - protein, 365 aa, Homo sapiens
RTRGSTHASGGKMAATKRKRRGGFAVQAKKPKRNEIDAEPPAKRHATAEEVEEEERDRIPGPVCKGKWKNKERILIFSSRGINFRTRHLMQDLRMLMPHSKADTKMDRKDKLFVINEVCEMKNCNKCIYFEAKKKQDLYMWLSNSPHGPSAKFLVQNIHTLAELKMTGNCLKGSRPLLSFDPAFDELPHYALLKELLIQIFSTPRYHPKSQPFVDHVFTFTILDNRIWFRNFQIIEEDAALVEIGPRFVLNLIKIFQGSFGGPTLYENPHYQSPNMHRRVIRSITAAKYREKQQVKDVQKLRKKEPKTLLPHDPTADVFVTPAEEKPIEIQWVKPEPKVDLKARKKRIYKRQRKMKQRMDSGKTK

SEQ ID NO: 813607 - protein, 234 aa, Homo sapiens
DAWVDPRVRWLSNSPHGPSAKFLVQNIHTLAELKMTGNCLKGSRPLLSFDPAFDELPHYALLKELLIQIFSTPRYHPKSQPFVDHVFTFTILDNRIWFRNFQIIEEDAALVEIGPRFVLNLIKIFQGSFGGPTLYENPHYQSPNMHRRVIRSITAAKYREKQQVKDVQKLRKKEPKTLLPHDPTADVFVTPAEEKPIEIQWVKPEPKVDLKARKKRIYKRQRKMKQRMDSGKTK

SEQ ID NO: 813608 - protein, 150 aa, Homo sapiens
GRRGFPRPPSSRSWGGCHVSLPRAWGDGRRDGDVSGGRPPRVHHCFLRNFPSAHPPVLRVPEGRSWARLRAPAPNRVPSPFQRESSRRGMPGRGPAAGGREAEKEKQRGGGARSWRQREQQIAPSQWQRQDEVAPNSLRPMTSRSLQKPH

SEQ ID NO: 813609 - protein, 322 aa, Homo sapiens
MPLYLEDDIRPDIKDDIYDPTYKDKEGPSPKVEYVWRNIILMSLLHLGALYGITLIPTCKFYTWLWGVFYYFVSALGITAGAHRLWSHRSYKARLPLRLFLIIANTMAFQNDVYEWARDHRAHHKFSETHADPHNSRRGFFFSHVGWLLVRKHPAVKEKGSTLDLSDLEAEKLVMFQRRYYKPGLLMMCFILPTLVPWYFWGETFQNSVFVATFLRYAVVLNATWLVNSAAHLFGYRPYDKNISPRENILVSLGAVGEGFHNYHHSFPYDYSASEYRWHINFTTFFIDCMAALGLAYDRKKVSKAAILARIKRTGDGNYKSG

SEQ ID NO: 813610 - protein, 341 aa, Homo sapiens
MPAHLLQDDISSSYTTTTTITAPPSRVLQNGGDKLETMPLYLEDDIRPDIKDDIYDPTYKDKEGPSPKVEYVWRNIILMSLLHLGALYGITLIPTCKFYTWLWGVFYYFVSALGITAGAHRLWSHRSYKARLPLRLFLIIANTMAFQNDVYEWARDHRAHHKFSETHADPHNSRRGFFFSHVGWLLVRKHPAVKEKGSTLDLSDLEAEKLVMFQRRYYKPGLLMMCFILPTLVPWYFWGETFHWLVNSAAHLFGYRPYDKNISPRENILVSLGAVGEGFHNYHHSFPYDYSASEYRWHINFTTFFIDCMAALGLAYDRKKVSKAAILARIKRTGDGNYKSG

SEQ ID NO: 813611 - protein, 359 aa, Homo sapiens
MPAHLLQDDISSSYTTTTTITAPPSRVLQNGGDKLETMPLYLEDDIRPDIKDDIYDPTYKDKEGPSPKVEYVWRNIILMSLLHLGALYGITLIPTCKFYTWLWGVFYYFVSALGITAGAHRLWSHRSYKARLPLRLFLIIANTMAFQNDVYEWARDHRAHHKFSETHADPHNSRRGFFFSHVGWLLVRKHPAVKEKGSTLDLSDLEAEKLVMFQRRYYKPGLLMMCFILPTLVPWYFWGETFQNSVFVATFLRYAVVLNATWLVNSAAHLFGYRPYDKNISPRENILVSLGAVGEGFHNYHHSFPYDYSASEYRWHINFTTFFIDCMAALGLAYDRKKVSKAAILARIKRTGDGNYKSG

SEQ ID NO: 813612 - protein, 102 aa, Homo sapiens
RERGLTLDWSRLVVLLSERGKNISPRENILVSLGAVGEGFHNYHHSFPYDYSASEYRWHINFTTFFIDCMAALGLAYDRKKVSKAAILARIKRTGDGNYKSG

SEQ ID NO: 813613 - protein, 89 aa, Homo sapiens
QDSPGGYVLVIKDAYPEEVGSTVHQPGGIKHHSFPYDYSASEYRWHINFTTFFIDCMAALGLAYDRKKVSKAAILARIKRTGDGNYKSG

SEQ ID NO: 813614 - protein, 359 aa, Homo sapiens; identical to SEQ ID NO: 813611

SEQ ID NO: 813615 - protein, 359 aa, Homo sapiens; identical to SEQ ID NO: 813611

SEQ ID NO: 813616 - protein, 359 aa, Homo sapiens; identical to SEQ ID NO: 813611

SEQ ID NO: 813617 - protein, 359 aa, Homo sapiens; identical to SEQ ID NO: 813611

SEQ ID NO: 813618 - protein, 359 aa, Homo sapiens; identical to SEQ ID NO: 813611

SEQ ID NO: 813619 - protein, 359 aa, Homo sapiens; identical to SEQ ID NO: 813611

SEQ ID NO: 813620 - protein, 359 aa, Homo sapiens; identical to SEQ ID NO: 813611

SEQ ID NO: 813621 - protein, 359 aa, Homo sapiens; identical to SEQ ID NO: 813611

SEQ ID NO: 813622 - protein, 359 aa, Homo sapiens; identical to SEQ ID NO: 813611

SEQ ID NO: 813623 - protein, 359 aa, Homo sapiens; identical to SEQ ID NO: 813611

SEQ ID NO: 813624 - protein, 359 aa, Homo sapiens; identical to SEQ ID NO: 813611

SEQ ID NO: 813625 - protein, 359 aa, Homo sapiens; identical to SEQ ID NO: 813611

SEQ ID NO: 813626 - protein, 335 aa, Homo sapiens
MPAHLLQDDISSSYTTTTTITAPPSRVLQNGGDKLETMPLYLEDDIRPDIKDDIYDPTYKDKEGPSPKVEYVWRNIILMSLLHLGALYGITLIPTCKFYTWLWGVFYYFVSALGITAGAHRLWSHRSYKARLPLRLFLIIANTMAFQNDVYEWARDHRAHHKFSETHADPHNSRRGFFFSHVGWLLVRKHPAVKEKGSTLDLSDLEAEKLVMFQRRYYKPGLLMMCFILPTLVPWYFWGETFQNSVFVATFLRYAVVLNATWLVNSAAHLFGYRPYDKNISPRENILVSLGAVGEGFHNYHHSFPYDYSASEYRWHINFTTFFIDCMARRTFWPR

SEQ ID NO: 813627 - protein, 216 aa, Homo sapiens
MPAHLLQDDISSSYTTTTTITAPPSRVLQNGGDKLETMPLYLEDDIRPDIKDDIYDPTYKDKEGPSPKVEYVWRNIILMSLLHLGALYGITLIPTCKFYTWLWGVFYYFVSALGITAGAHRLWSHRSYKARLPLRLFLIIANTMAFQNDVYEWARDHRAHHKFSETHADPHNSRRGFFFSHVGWLLVRKHPAVKEKGSTLDLSDLEAEKLVMFQRR

SEQ ID NO: 813628 - protein, 205 aa, Homo sapiens
MPAHLLQDDISSSYTTTTTITAPPSRVLQNGGDKLETMPLYLEDDIRPDIKDDIYDPTYKDKEGPSPKVEYVWRNIILMSLLHLGALYGITLIPTCKFYTWLWGVFYYFVSALGITAGAHRLWSHRSYKARLPLRLFLIIANTMAFQPLGNKPVFSARSVDQEHISPLLYIVVLCLCCNSGWREGGVYICCMSRWVRTLVYACVL

SEQ ID NO: 813629 - protein, 359 aa, Homo sapiens; identical to SEQ ID NO: 813611

SEQ ID NO: 813630 - protein, 159 aa, Homo sapiens
MPAHLLQDDISSSYTTTTTITAPPSRVLQNGGDKLETMPLYLEDDIRPDIKDDIYDPTYKDKEGPSPKVEYVWRNIILMSLLHLGALYGITLIPTCKFYTWLWGVFYYFVSALGITAGAHRLWSHRSYKGLAPLRALFLESFAQTTKMGHFPKKMEVLN

SEQ ID NO: 813631 - protein, 266 aa, Homo sapiens
MALRGAPAGGGVVRWSPAFPGDTGPSFEVEKFLVLKPRLPLRLFLIIANTMAFQNDVYEWARDHRAHHKFSETHADPHNSRRGFFFSHVGWLLVRKHPAVKEKGSTLDLSDLEAEKLVMFQRRYYKPGLLMMCFILPTLVPWYFWGETFQNSVFVATFLRYAVVLNATWLVNSAAHLFGYRPYDKNISPRENILVSLGAVGEGFHNYHHSFPYDYSASEYRWHINFTTFFIDCMAALGLAYDRKKVSKAAILARIKRTGDGNYKSG

SEQ ID NO: 813632 - protein, 148 aa, Homo sapiens
MFQRRYYKPGLLMMCFILPTLVPWYFWGETFQNSVFVATFLRYAVVLNATWLVNSAAHLFGYRPYDKNISPRENILVSLGAVGEGFHNYHHSFPYDYSASEYRWHINFTTFFIDCMAALGLAYDRKKVSKAAILARIKRTGDGNYKSG

SEQ ID NO: 813633 - protein, 88 aa, Homo sapiens
TGVHKSRKPQCTVTPELLAFVSGEGFHNYHHSFPYDYSASEYRWHINFTTFFIDCMAALGLAYDRKKVSKAAILARIKRTGDGNYKSG

SEQ ID NO: 813634 - protein, 359 aa, Homo sapiens; identical to SEQ ID NO: 813611

SEQ ID NO: 813635 - protein, 359 aa, Homo sapiens; identical to SEQ ID NO: 813611

SEQ ID NO: 813636 - protein, 359 aa, Homo sapiens; identical to SEQ ID NO: 813611

SEQ ID NO: 813637 - protein, 359 aa, Homo sapiens; identical to SEQ ID NO: 813611

SEQ ID NO: 813638 - protein, 359 aa, Homo sapiens; identical to SEQ ID NO: 813611

SEQ ID NO: 813639 - protein, 359 aa, Homo sapiens; identical to SEQ ID NO: 813611

SEQ ID NO: 813640 - protein, 359 aa, Homo sapiens; identical to SEQ ID NO: 813611

SEQ ID NO: 813641 - protein, 359 aa, Homo sapiens; identical to SEQ ID NO: 813611

SEQ ID NO: 813642 - protein, 359 aa, Homo sapiens; identical to SEQ ID NO: 813611

SEQ ID NO: 813643 - protein, 133 aa, Homo sapiens
LLTQGRAAANSGASCALILDSWLYPVCPFSLTRSFSSLNVFFFPWTGSLLCVYSEAVMTCCPGSSLLHTECSGSLNHCFSFESRASCHFHVASAVSPPTPLVLPCHTDGSRQGWQTLPETSLAQKASLSLPLS

SEQ ID NO: 813644 - protein, 359 aa, Homo sapiens; identical to SEQ ID NO: 813611

SEQ ID NO: 813645 - protein, 359 aa, Homo sapiens; identical to SEQ ID NO: 813611

SEQ ID NO: 813646 - protein, 359 aa, Homo sapiens; identical to SEQ ID NO: 813611

SEQ ID NO: 813647 - protein, 359 aa, Homo sapiens; identical to SEQ ID NO: 813611

SEQ ID NO: 813648 - protein, 307 aa, Homo sapiens
MPAHLLQDDISSSYTTTTTITAPPSRVLQNGGDKLETMPLYLEDDIRPDIKDDIYDPTYKDKEGPSPKVEYVWRNIILMSLLHLGALYGITLIPTCKFYTWLWGVFYYFVSALGITAGAHRLWSHRSYKARLPLRLFLIIANTMAFQNDVYEWARDHRAHHKFSETHADPHNSRRGFFFSHVGWLLVRKHPAVKEKGSTLDLSDLEAEKLVMFQRRYYKPGLLMMCFILPTLVPWYFWGETFQNSVFVATFLRYAVVLNATWLVNSAAHLFGYRPYDKNISPRENILVSLGAVGKSAVQVRLHPVVC

SEQ ID NO: 813649 - protein, 108 aa, Homo sapiens
MPAHLLQDDISSSYTTTTTITAPPSRVLQNGGDKLETMPLYLEDDIRPDIKDDIYDPTYKDKEGPSPKVEYVWRNIILMSLLHLGALYVVSDIKDDIYDPTYEDKEGP

SEQ ID NO: 813650 - protein, 380 aa, Homo sapiens
MEEGGDFDNYYGADNQSECEYTDWKSSGALIPAIYMLVFLLGTTGNGLVLWTVFRSSREKRRSADIFIASLAVADLTFVVTLPLWATYTYRDYDWPFGTFFCKLSSYLIFVNMYASVFCLTGLSFDRYLAIVRPVANARLRLRVSGAVATAVLWVLAALLAMPVMVLRTTGDLENTTKVQCYMDYSMVATVSSEWAWEVGLGVSSTTVGFVVPFTIMLTCYFFIAQTIAGHFRKERIEGLRKRRRLLSIIVVLVVTFALCWMPYHLVKTLYMLGSLLHWPCDFDLFLMNIFPYCTCISYVNSCLNPFLYAFFDPRFRQACTSMLCCGQSRCAGTSHSSSGEKSASYSSGHSQGPGPNMGKGGEQMHEKSIPYSQETLVVD

SEQ ID NO: 813651 - protein, 380 aa, Homo sapiens; identical to SEQ ID NO: 813650

SEQ ID NO: 813652 - protein, 380 aa, Homo sapiens; identical to SEQ ID NO: 813650

SEQ ID NO: 813653 - protein, 380 aa, Homo sapiens; identical to SEQ ID NO: 813650

SEQ ID NO: 813654 - protein, 380 aa, Homo sapiens; identical to SEQ ID NO: 813650

SEQ ID NO: 813655 - protein, 253 aa, Homo sapiens
KLAAAFLLGILFALVCRSPRAQPPDFAAAWSRLAATSAARRPPGSPVYGNSHESAQSRRVVISHNMDKALKEVFDYSYRDYILSWYGNLSRDEGQLYHLLLEDFWEIARQLHHRLSHVDVVKVVCNDVVRTLLTHFCDLKAANARHEEQPRPFVLHACLRNSDDEVRFLQTCSRVLVFCLLPSKDVQSLSLRIMLAEILTTKVLKPVVELLSNPDYINQMLLAQLAYREQMNEHHKRAYTYAPSYEDFIKLIN

SEQ ID NO: 813656 - protein, 166 aa, Homo sapiens
KLAAAFLLGILFALVCRSPRAQPPDFAAAWSRLAATSAARRPPGSPVYGNSHESAQSRRVVISHNMDKALKEVFDYSYRDYILSWYGNLSRDEGQLYHLLLEDFWEIARQLHHRLSHVDVVKVVCNDVVRTLLTHFCDLKAANARHEEQPRPFVLHACLRNSDDES

SEQ ID NO: 813657 - protein, 190 aa, Homo sapiens
LYCRRLFLGVPKGYFLLAKAHFEKVRVMVHNPYLAKSTGSAKLNLGKQFGISYFNNEMADVMILREYKKPPEPFYLKAANARHEEQPRPFVLHACLRNSDDEVRFLQTCSRVLVFCLLPSKDVQSLSLRIMLAEILTTKVLKPVVELLSNPDYINQMLLAQLAYREQMNEHHKRAYTYAPSYEDFIKLIN

SEQ ID NO: 813658 - protein, 346 aa, Homo sapiens
MSAKSKGNPSSSCPAEGPPAASKTKVKEQIKIIVEDLELVLGDLKDVAKELKEMKSHSVAQAESAMAQSGLTATSASQVQAILLPQPASVRHYAWVVDQIDTLTSDLQLEDEMTDSSKTDTLNSSSSGTTASSLEKIKVQANAPLIKPPAHPSAILTVLRKPNPPPPPPRLTPVKCEDPKRVVPTANPVKTNGTLLRNGGLPGGPNKIPNGDICCIPNSNLDKAPVQLLMHRPEKDRCPQAGPRERVRFNEKVQYHGYCPDCDTRYNIKNREVHLHSEPVHPPGKIPHQGPPLPPTPHLPPFPLENGGMGISHSNSFPPIRPATVPPPTAPKPQKTILRKSTTTTV

SEQ ID NO: 813659 - protein, 133 aa, Homo sapiens
MSAKSKGNPSSSCPAEGPPAASKTKVKEQIKIIVEDLELVLGDLKDVAKELKEVLLFFQTKEKENHTAPQMTLDTDRSWGVTYMFICCLVIKIISVVTTYIFKDSLLETKMSYFHTSFCGCLTFFFFFFFSLI

SEQ ID NO: 813660 - protein, 107 aa, Homo sapiens
MSAKSKGNPSSSCPAEGPPAASKTKVKEQIKIIVEDLELVLGDLKDVAKELKESPTLLPTASSPDDRARPSEVVYLNIPKHIKDTVTIWYNLVGPPLYNIRSSLLME

SEQ ID NO: 813661 - protein, 304 aa, Homo sapiens
MSAKSKGNPSSSCPAEGPPAASKTKVKEQIKIIVEDLELVLGDLKDVAKELKEVVDQIDTLTSDLQLEDEMTDSSKTDTLNSSSSGTTASSLEKIKVQANAPLIKPPAHPSAILTVLRKPNPPPPPPRLTPVKCEDPKRVVPTANPVKTNGTLLRNGGLPGGPNKIPNGDICCIPNSNLDKAPVQLLMHRPEKDRCPQAGPRERVRFNEKVQYHGYCPDCDTRYNIKNREVHLHSEPVHPPGKIPHQGPPLPPTPHLPPFPLENGGMGISHSNSFPPIRPATVPPPTAPKPQKTILRKSTTTTV

SEQ ID NO: 813662 - protein, 234 aa, Homo sapiens
MTDSSKTDTLNSSSSGTTASSLEKIKVQANAPLIKPPAHPSAILTVLRKPNPPPPPPRLTPVKCEDPKRVVPTANPVKTNGTLLRNGGLPGGPNKIPNGDICCIPNSNLDKAPVQLLMHRPEKDRCPQAGPRERVRFNEKVQYHGYCPDCDTRYNIKNREVHLHSEPVHPPGKIPHQGPPLPPTPHLPPFPLENGGMGISHSNSFPPIRPATVPPPTAPKPQKTILRKSTTTTV

SEQ ID NO: 813663 - protein, 300 aa, Homo sapiens
HEENMFEFWDWVGGRYSLWSAIGLSIALHVGFDNFEQLLSGAHWMDQHFRTTPLEKNAPVLLALLGIWYINCFGCETHAMLPYDQYLHRFAAYFQQGDMESNGKYITKSGTRVDHQTGPIVWGEPGTNGQHAFYQLIHQGTKMIPCDFLIPVQTQHPIRKGLHHKILLANFLAQTEALMRGKSTEEARKELQAAGKSPEDLERLLPHKVFEGNRPTNSIVFTKLTPFMLGALVAMYEHKIFVQGIIWDINSFDQWGVELGKQLAKKIEPELDGSAQVTSHDASTNGLINFIKQQREARVQ

SEQ ID NO: 813664 - protein, 300 aa, Homo sapiens; identical to SEQ ID NO: 813663

SEQ ID NO: 813665 - protein, 300 aa, Homo sapiens; identical to SEQ ID NO: 813663

SEQ ID NO: 813666 - protein, 300 aa, Homo sapiens; identical to SEQ ID NO: 813663

SEQ ID NO: 813667 - protein, 1016 aa, Homo sapiens
MSQGPPTGESSEPEAKVLHTKRLYRAVVEAVHRLDLILCNKTAYQEVFKPENISLRNKLRELCVKLMFLHPVDYGRKAEELLWRKVYYEVIQLIKTNKKHIHSRSTLECAYRTHLVAGIGFYQHLLLYIQSHYQLELQCCIDWTHVTDPLIGCKKPVSASGKEMDWAQMACHRCLVYLGDLSRYQNELAGVDTELLAERFYYQALSVAPQIGMPFNQLGTLAGSKYYNVEAMYCYLRCIQSEVSFEGAYGNLKRLYDKAAKMYHQLKKCETRKLSPGKKRCKDIKRLLVNFMYLQSLLQPKSSSVDSELTSLCQSVLEDFNLCLFYLPSSPNLSLASEDEEEYESGYAFLPDLLIFQMVIICLMCVHSLERAGSKQYSAAIAFTLALFSHLVNHVNIRLQAELEEGENPVPAFQSDGTDEPESKEPVEKEEEPDPEPPPVTPQVGEGRKSRKFSRLSCLRRRRHPPKVGDDSDLSEGFESDSSHDSARASEGSDSGSDKSLEGGGTAFDAETDSEMNSQESRSDLEDMEEEEGTRSPTLEPPRGRSEAPDSLNGPLGPSEASIASNLQAMSTQMFQTKRCFRLAPTFSNLLLQPTTNPHTSASHRPCVNGDVDKPSEPASEEGSESEGSESSGRSCRNERSIQEKLQVLMAEGLLPAVKVFLDWLRTNPDLIIVCAQSSQSLWNRLSVLLNLLPAAGELQESGLALCPEVQDLLEGCELPDLPSSLLLPEDMALRNLPPLRAAHRRFNFDTDRPLLSTLEESVVRICCIRSFGHFIARLQGSILQFNPEVGIFVSIAQSEQESLLQQAQAQFRMAQEEARRNRLMRDMAQLRLQLEVSQLEGSLQQPKAQSAMSPYLVPDTQALCHHLPVIRQLATSGRFIVIIPRTVIDGLDLLKKEHPGARDGIRYLEAEFKKGNRYIRCQKEVGKSFERHKLKRQDADAWTLYKILDSCKQLTLAQGAGEEDPSGMVTIITGLPLDNPSVLSGPMQAALQAAAHASVDIKNVLDFYKQWKEIG

SEQ ID NO: 813668 - protein, 1016 aa, Homo sapiens; identical to SEQ ID NO: 813667

SEQ ID NO: 813669 - protein, 970 aa, Homo sapiens
MSQGPPTGESSEPEAKVLHTKRLYRAVVEAVHRLDLILCNKTAYQEVFKPENISLRNKLRELCVKLMFLHPVDYGRKAEELLWRKVYYEVIQLIKTNKKHIHSRSTLECAYRTHLVAGIGFYQHLLLYIQSHYQLELQCCIDWTHVTDPLIGCKKPVSASGKEMDWAQMACHRCLVYLGDLSRYQNELAGVDTELLAERFYYQALSVAPQIGMPFNQLGTLAGSKYYNVEAMYCYLRCIQSEVSFEGAYGNLKRLYDKAAKMYHQLKKCETRKLSPGKKRCKDIKRLLVNFMYLQSLLQPKSSSVDSELTSLCQSVLEDFNLCLFYLPSSPNLSLASEDEEEYESGYAFLPDLLIFQMVIICLMCVHSLERADEPESKEPVEKEEEPDPEPPPVTPQVGEGRKSRKFSRLSCLRRRRHPPKVGDDSDLSEGFESDSSHDSARASEGSDSGSDKSLEGGGTAFDAETDSEMNSQESRSDLEDMEEEEGTRSPTLEPPRGRSEAPDSLNGPLGPSEASIASNLQAMSTQMFQTKRCFRLAPTFSNLLLQPTTNPHTSASHRPCVNGDVDKPSEPASEEGSESEGSESSGRSCRNERSIQEKLQVLMAEGLLPAVKVFLDWLRTNPDLIIVCAQSSQSLWNRLSVLLNLLPAAGELQESGLALCPEVQDLLEGCELPDLPSSLLLPEDMALRNLPPLRAAHRRFNFDTDRPLLSTLEESVVRICCIRSFGHFIARLQGSILQFNPEVGIFVSIAQSEQESLLQQAQAQFRMAQEEARRNRLMRDMAQLRLQLEVSQLEGSLQQPKAQSAMSPYLVPDTQALCHHLPVIRQLATSGRFIVIIPRTVIDGLDLLKKEHPGARDGIRYLEAEFKKGNRYIRCQKEVGKSFERHKLKRQDADAWTLYKILDSCKQLTLAQGAGEEDPSGMVTIITGLPLDNPSVLSGPMQAALQAAAHASVDIKNVLDFYKQWKEIG

SEQ ID NO: 813670 - protein, 853 aa, Homo sapiens
MDWAQMACHRCLVYLGDLSRYQNELAGVDTELLAERFYYQALSVAPQIGMPFNQLGTLAGSKYYNVEAMYCYLRCIQSEVSFEGAYGNLKRLYDKAAKMYHQLKKCETRKLSPGKKRCKDIKRLLVNFMYLQSLLQPKSSSVDSELTSLCQSVLEDFNLCLFYLPSSPNLSLASEDEEEYESGYAFLPDLLIFQMVIICLMCVHSLERAGSKQYSAAIAFTLALFSHLVNHVNIRLQAELEEGENPVPAFQSDGTDEPESKEPVEKEEEPDPEPPPVTPQVGEGRKSRKFSRLSCLRRRRHPPKVGDDSDLSEGFESDSSHDSARASEGSDSGSDKSLEGGGTAFDAETDSEMNSQESRSDLEDMEEEEGTRSPTLEPPRGRSEAPDSLNGPLGPSEASIASNLQAMSTQMFQTKRCFRLAPTFSNLLLQPTTNPHTSASHRPCVNGDVDKPSEPASEEGSESEGSESSGRSCRNERSIQEKLQVLMAEGLLPAVKVFLDWLRTNPDLIIVCAQSSQSLWNRLSVLLNLLPAAGELQESGLALCPEVQDLLEGCELPDLPSSLLLPEDMALRNLPPLRAAHRRFNFDTDRPLLSTLEESVVRICCIRSFGHFIARLQGSILQFNPEVGIFVSIAQSEQESLLQQAQAQFRMAQEEARRNRLMRDMAQLRLQLEVSQLEGSLQQPKAQSAMSPYLVPDTQALCHHLPVIRQLATSGRFIVIIPRTVIDGLDLLKKEHPGARDGIRYLEAEFKKGNRYIRCQKEVGKSFERHKLKRQDADAWTLYKILDSCKQLTLAQGAGEEDPSGMVTIITGLPLDNPSVLSGPMQAALQAAAHASVDIKNVLDFYKQWKEIG

SEQ ID NO: 813671 - protein, 910 aa, Homo sapiens
MISRIWPPLVAGIGFYQHLLLYIQSHYQLELQCCIDWTHVTDPLIGCKKPVSASGKEMDWAQMACHRCLVYLGDLSRYQNELAGVDTELLAERFYYQALSVAPQIGMPFNQLGTLAGSKYYNVEAMYCYLRCIQSEVSFEGAYGNLKRLYDKAAKMYHQLKKCETRKLSPGKKRCKDIKRLLVNFMYLQSLLQPKSSSVDSELTSLCQSVLEDFNLCLFYLPSSPNLSLASEDEEEYESGYAFLPDLLIFQMVIICLMCVHSLERAGSKQYSAAIAFTLALFSHLVNHVNIRLQAELEEGENPVPAFQSDGTDEPESKEPVEKEEEPDPEPPPVTPQVGEGRKSRKFSRLSCLRRRRHPPKVGDDSDLSEGFESDSSHDSARASEGSDSGSDKSLEGGGTAFDAETDSEMNSQESRSDLEDMEEEEGTRSPTLEPPRGRSEAPDSLNGPLGPSEASIASNLQAMSTQMFQTKRCFRLAPTFSNLLLQPTTNPHTSASHRPCVNGDVDKPSEPASEEGSESEGSESSGRSCRNERSIQEKLQVLMAEGLLPAVKVFLDWLRTNPDLIIVCAQSSQSLWNRLSVLLNLLPAAGELQESGLALCPEVQDLLEGCELPDLPSSLLLPEDMALRNLPPLRAAHRRFNFDTDRPLLSTLEESVVRICCIRSFGHFIARLQGSILQFNPEVGIFVSIAQSEQESLLQQAQAQFRMAQEEARRNRLMRDMAQLRLQLEVSQLEGSLQQPKAQSAMSPYLVPDTQALCHHLPVIRQLATSGRFIVIIPRTVIDGLDLLKKEHPGARDGIRYLEAEFKKGNRYIRCQKEVGKSFERHKLKRQDADAWTLYKILDSCKQLTLAQGAGEEDPSGMVTIITGLPLDNPSVLSGPMQAALQAAAHASVDIKNVLDFYKQWKEIG

SEQ ID NO: 813672 - protein, 804 aa, Homo sapiens
MPFNQLGTLAGSKYYNVEAMYCYLRCIQSEVSFEGAYGNLKRLYDKAAKMYHQLKKCETRKLSPGKKRCKDIKRLLVNFMYLQSLLQPKSSSVDSELTSLCQSVLEDFNLCLFYLPSSPNLSLASEDEEEYESGYAFLPDLLIFQMVIICLMCVHSLERAGSKQYSAAIAFTLALFSHLVNHVNIRLQAELEEGENPVPAFQSDGTDEPESKEPVEKEEEPDPEPPPVTPQVGEGRKSRKFSRLSCLRRRRHPPKVGDDSDLSEGFESDSSHDSARASEGSDSGSDKSLEGGGTAFDAETDSEMNSQESRSDLEDMEEEEGTRSPTLEPPRGRSEAPDSLNGPLGPSEASIASNLQAMSTQMFQTKRCFRLAPTFSNLLLQPTTNPHTSASHRPCVNGDVDKPSEPASEEGSESEGSESSGRSCRNERSIQEKLQVLMAEGLLPAVKVFLDWLRTNPDLIIVCAQSSQSLWNRLSVLLNLLPAAGELQESGLALCPEVQDLLEGCELPDLPSSLLLPEDMALRNLPPLRAAHRRFNFDTDRPLLSTLEESVVRICCIRSFGHFIARLQGSILQFNPEVGIFVSIAQSEQESLLQQAQAQFRMAQEEARRNRLMRDMAQLRLQLEVSQLEGSLQQPKAQSAMSPYLVPDTQALCHHLPVIRQLATSGRFIVIIPRTVIDGLDLLKKEHPGARDGIRYLEAEFKKGNRYIRCQKEVGKSFERHKLKRQDADAWTLYKILDSCKQLTLAQGAGEEDPSGMVTIITGLPLDNPSVLSGPMQAALQAAAHASVDIKNVLDFYKQWKEIG

SEQ ID NO: 813673 - protein, 853 aa, Homo sapiens
VDIPQIHQTSVTCHLWDLSRYQNELAGVDTELLAERFYYQALSVAPQIGMPFNQLGTLAGSKYYNVEAMYCYLRCIQSEVSFEGAYGNLKRLYDKAAKMYHQLKKCETRKLSPGKKRCKDIKRLLVNFMYLQSLLQPKSSSVDSELTSLCQSVLEDFNLCLFYLPSSPNLSLASEDEEEYESGYAFLPDLLIFQMVIICLMCVHSLERAGSKQYSAAIAFTLALFSHLVNHVNIRLQAELEEGENPVPAFQSDGTDEPESKEPVEKEEEPDPEPPPVTPQVGEGRKSRKFSRLSCLRRRRHPPKVGDDSDLSEGFESDSSHDSARASEGSDSGSDKSLEGGGTAFDAETDSEMNSQESRSDLEDMEEEEGTRSPTLEPPRGRSEAPDSLNGPLGPSEASIASNLQAMSTQMFQTKRCFRLAPTFSNLLLQPTTNPHTSASHRPCVNGDVDKPSEPASEEGSESEGSESSGRSCRNERSIQEKLQVLMAEGLLPAVKVFLDWLRTNPDLIIVCAQSSQSLWNRLSVLLNLLPAAGELQESGLALCPEVQDLLEGCELPDLPSSLLLPEDMALRNLPPLRAAHRRFNFDTDRPLLSTLEESVVRICCIRSFGHFIARLQGSILQFNPEVGIFVSIAQSEQESLLQQAQAQFRMAQEEARRNRLMRDMAQLRLQLEVSQLEGSLQQPKAQSAMSPYLVPDTQALCHHLPVIRQLATSGRFIVIIPRTVIDGLDLLKKEHPGARDGIRYLEAEFKKGNRYIRCQKEVGKSFERHKLKRQDADAWTLYKILDSCKQLTLAQGAGEEDPSGMVTIITGLPLDNPSVLSGPMQAALQAAAHASVDIKNVLDFYKQWKEIG

SEQ ID NO: 813674 - protein, 661 aa, Homo sapiens
LREQSWTGPPSRIRPLGGSKQYSAAIAFTLALFSHLVNHVNIRLQAELEEGENPVPAFQSDGTDEPESKEPVEKEEEPDPEPPPVTPQVGEGRKSRKFSRLSCLRRRRHPPKVGDDSDLSEGFESDSSHDSARASEGSDSGSDKSLEGGGTAFDAETDSEMNSQESRSDLEDMEEEEGTRSPTLEPPRGRSEAPDSLNGPLGPSEASIASNLQAMSTQMFQTKRCFRLAPTFSNLLLQPTTNPHTSASHRPCVNGDVDKPSEPASEEGSESEGSESSGRSCRNERSIQEKLQVLMAEGLLPAVKVFLDWLRTNPDLIIVCAQSSQSLWNRLSVLLNLLPAAGELQESGLALCPEVQDLLEGCELPDLPSSLLLPEDMALRNLPPLRAAHRRFNFDTDRPLLSTLEESVVRICCIRSFGHFIARLQGSILQFNPEVGIFVSIAQSEQESLLQQAQAQFRMAQEEARRNRLMRDMAQLRLQLEVSQLEGSLQQPKAQSAMSPYLVPDTQALCHHLPVIRQLATSGRFIVIIPRTVIDGLDLLKKEHPGARDGIRYLEAEFKKGNRYIRCQKEVGKSFERHKLKRQDADAWTLYKILDSCKQLTLAQGAGEEDPSGMVTIITGLPLDNPSVLSGPMQAALQAAAHASVDIKNVLDFYKQWKEIG

SEQ ID NO: 813675 - protein, 1016 aa, Homo sapiens; identical to SEQ ID NO: 813667

SEQ ID NO: 813676 - protein, 189 aa, Homo sapiens
MAQLRLQLEVSQLEGSLQQPKAQSAMSPYLVPDTQALCHHLPVIRQLATSGRFIVIIPRTVIDGLDLLKKEHPGARDGIRYLEAEFKKGNRYIRCQKEVGKSFERHKLKRQDADAWTLYKILDSCKQLTLAQGAGEEDPSGMVTIITGLPLDNPSVLSGPMQAALQAAAHASVDIKNVLDFYKQWKEIG

SEQ ID NO: 813677 - protein, 1016 aa, Homo sapiens; identical to SEQ ID NO: 813667

SEQ ID NO: 813678 - protein, 120 aa, Homo sapiens
MYEAGWLSAQGYLEAEFKKGNRYIRCQKEVGKSFERHKLKRQDADAWTLYKILDSCKQLTLAQGAGEEDPSGMVTIITGLPLDNPSVLSGPMQAALQAAAHASVDIKNVLDFYKQWKEIG

SEQ ID NO: 813679 - protein, 1016 aa, Homo sapiens; identical to SEQ ID NO: 813667

SEQ ID NO: 813680 - protein, 1016 aa, Homo sapiens; identical to SEQ ID NO: 813667

SEQ ID NO: 813681 - protein, 943 aa, Homo sapiens [sequence omitted]

SEQ ID NO: 813682 - protein, 92 aa, Homo sapiens
SVPAQQPRARSTAPVGLVGTGQNGMPGREERGCSLRPPPPFLSKGGLKTRGRHSVGSRKERLLEAAQSEAPVPPFAFRRTEDLKGLAFGVLR

SEQ ID NO: 813683 - protein, 733 aa, Homo sapiens
MSQGPPTGESSEPEAKVLHTKRLYRAVVEAVHRLDLILCNKTAYQEVFKPENISLRNKLRELCVKLMFLHPVDYGRKAEELLWRKVYYEVIQLIKTNKKHIHSRSTLECAYRTHLVAGIGFYQHLLLYIQSHYQLELQCCIDWTHVTDPLIGCKKPVSASGKEMDWAQMACHRCLVYLGDLSRYQNELAGVDTELLAERFYYQALSVAPQIGMPFNQLGTLAGSKYYNVEAMYCYLRCIQSEVSFEGAYGNLKRLYDKAAKMYHQLKKCETRKLSPGKKRCKDIKRLLVNFMYLQSLLQPKSSSVDSELTSLCQSVLEDFNLCLFYLPSSPNLSLASEDEEEYESGYAFLPDLLIFQMVIICLMCVHSLERAGSKQYSAAIAFTLALFSHLVNHVNIRLQAELEEGENPVPAFQSDGTDEPESKEPVEKEEEPDPEPPPVTPQVGEGRKSRKFSRLSCLRRRRHPPKVGDDSDLSEGFESDSSHDSARASEGSDSGSDKSLEGGGTAFDAETDSEMNSQESRSDLEDMEEEEGTRSPTLEPPRGRSEAPDSLNGPLGPSEASIASNLQAMSTQMFQTKRCFRLAPTFSNLLLQPTTNPHTSASHRPCVNGDVDKPSEPASEEGSESEGSESSGRSCRNERSIQEKLQVLMAEGLLPAVKVFLDWLRTNPDLIIVCAQAWPCVLRSKIFLKVVNCLTSPLAFCSQRTWLFVTCPRSELPTDALTLTRIGPCSAP

SEQ ID NO: 813684 - protein, 120 aa, Homo sapiens; identical to SEQ ID NO: 813678

SEQ ID NO: 813685 - protein, 538 aa, Homo sapiens
MSQGPPTGESSEPEAKVLHTKRLYRAVVEAVHRLDLILCNKTAYQEVFKPENISLRNKLRELCVKLMFLHPVDYGRKAEELLWRKVYYEVIQLIKTNKKHIHSRSTLECAYRTHLVAGIGFYQHLLLYIQSHYQLELQCCIDWTHVTDPLIGCKKPVSASGKEMDWAQMACHRCLVYLGDLSRYQNELAGVDTELLAERFYYQALSVAPQIGMPFNQLGTLAGSKYYNVEAMYCYLRCIQSEVSFEGAYGNLKRLYDKAAKMYHQLKKCETRKLSPGKKRCKDIKRLLVNFMYLQSLLQPKSSSVDSELTSLCQSVLEDFNLCLFYLPSSPNLSLASEDEEEYESGYAFLPDLLIFQMVIICLMCVHSLERAGSKQYSAAIAFTLALFSHLVNHVNIRLQAELEEGENPVPAFQSDGTDEPESKEPVEKEEEPDPEPPPVTPQVGEGRKSRKFSRLSCLRRRRHPPKVGDDSDLSEGFESDSSHDSARASEGSDSGSDKSLEGGGTAFDAETDSEMNSQESRSDLEDMEDSWLPASLL

SEQ ID NO: 813686 - protein, 238 aa, Homo sapiens
MSQGPPTGESSEPEAKVLHTKRLYRAVVEAVHRLDLILCNKTAYQEVFKPENISLRNKLRELCVKLMFLHPVDYGRKAEELLWRKVYYEVIQLIKTNKKHIHSRSTLECAYRTHLVAGIGFYQHLLLYIQSHYQLELQCCIDWTHVTDPLIGCKKPVSASGKEMDWAQMACHRCLVYLGDLSRYQNELAGVDTELLAERFYYQALSVAPQIGMPFNQLGTLAGSKYYNVEAMYCYLRW

SEQ ID NO: 813687 - protein, 636 aa, Homo sapiens
VAGVPPAAAETPCAFAFSAPGPGPAPPPPLPAFPEAPGSEPACCPLAFRVDPFTDYGSSLTVTLPPELQAHQPFQVILRYTSTDAPAIWWLDPELTYGCAKPFVFTQGHSVCNRSFFPCFDTPAVKCTYSAVVKAPSGVQVLMSATRSAYMEEEGVFHFHMEHPVPAYLVALVAGDLKPADIGPRSRVWAEPCLLPTATSKLSGAVEQWLSAAERLYGPYMWGRYDIVFLPPSFPIVAMENPCLTFIISSILESDEFLVIDVIHEVAHSWFGNAVTNATWEEMWLSEGLATYAQRRITTETYGAAFTCLETAFRLDALHRQMKLLGEDSPVSKLQVKLEPGVNPSHLMNLFTYEKGYCFVYYLSQLCGDPQRFDDFLRAYVEKYKFTSVVAQDLLDSFLSFFPELKEQSVDCRAGLEFERWLNATGPPLAEPDLSQGSSLTRPVEALFQLWTAEPLDQAAASASAIDISKWRTFQTALFLDRLLDGSPLPQEVVMSLSKCYSSLLDSMNAEIRIRWLQIVVRNDYYPDLHRVRRFLESQMSRMYTIPLYEDLCTGALKSFALEVFYQTQGRLHPNLRRAIQQILSQGLGSSTEPASEPSTELGKAEADTDSDAQALLLGDEAPSSAISLRDVNVSA

SEQ ID NO: 813688 - protein, 582 aa, Homo sapiens
SSSPHHPLTTPHSQTTARCEAGLAAVTRSTPRSIWWLDPELTYGCAKPFVFTQGHSVCNRSFFPCFDTPAVKCTYSAVVKAPSGVQVLMSATRSAYMEEEGVFHFHMEHPVPAYLVALVAGDLKPADIGPRSRVWAEPCLLPTATSKLSGAVEQWLSAAERLYGPYMWGRYDIVFLPPSFPIVAMENPCLTFIISSILESDEFLVIDVIHEVAHSWFGNAVTNATWEEMWLSEGLATYAQRRITTETYGAAFTCLETAFRLDALHRQMKLLGEDSPVSKLQVKLEPGVNPSHLMNLFTYEKGYCFVYYLSQLCGDPQRFDDFLRAYVEKYKFTSVVAQDLLDSFLSFFPELKEQSVDCRAGLEFERWLNATGPPLAEPDLSQGSSLTRPVEALFQLWTAEPLDQAAASASAIDISKWRTFQTALFLDRLLDGSPLPQEVVMSLSKCYSSLLDSMNAEIRIRWLQIVVRNDYYPDLHRVRRFLESQMSRMYTIPLYEDLCTGALKSFALEVFYQTQGRLHPNLRRAIQQILSQGLGSSTEPASEPSTELGKAEADTDSDAQALLLGDEAPSSAISLRDVNVSA

SEQ ID NO: 813689 - protein, 756 aa, Homo sapiens
VAGVPPAAAETPCAFAFSAPGPGPAPPPPLPAFPEAPGSEPACCPLAFRVDPFTDYGSSLTVTLPPELQAHQPFQVILRYTSTDAPAIWWLDPELTYGCAKPFVFTQGHSVCNRSFFPCFDTPAVKCTYSAVVKAPSGVQVLMSATRSAYMEEEGVFHFHMEHPVPAYLVALVAGDLKPADIGPRSRVWAEPCLLPTATSKLSGAVEQWLSAAERLYGPYMWGRYDIVFLPPSFPIVAMENPCLTFIISSILESDEFLVIDVIHEVAHSWFGNAVTNATWEEMWLSEGLATYAQRRITTETYGAAFTCLETAFRLDALHRQMKLLGEDSPVSKLQVKLEPGVNPSHLMNLFTYEKGYCFVYYLSQLCGDPQRFDDFLRVSSPLPGTALLPSAPSPSPAHRAACSCGSWGGTGRGLGAWLGPSLPFFVGSAWVATSPSATLFAPLAGPACQVLAPQCPLAAPVPSTYLGARPAVPCRPLVGLPVPHPSRPAEAPPPATQAYVEKYKFTSVVAQDLLDSFLSFFPELKEQSVDCRAGLEFERWLNATGPPLAEPDLSQGSSLTRPVEALFQLWTAEPLDQAAASASAIDISKWRTFQTALFLDRLLDGSPLPQEVVMSLSKCYSSLLDSMNAEIRIRWLQIVVRNDYYPDLHRVRRFLESQMSRMYTIPLYEDLCTGALKSFALEVFYQTQGRLHPNLRRAIQQILSQGLGSSTEPASEPSTELGKAEADTDSDAQALLLGDEAPSSAISLRDVNVSA

SEQ ID NO: 813690 - protein, 366 aa, Homo sapiens
GSEQQSQWCVSPQSSPRPCRCTPRASVHIWTCEGQWRLALAAPRSLTTAPPYSTGHWWFRTPAQVGVHLAGVNPSHLMNLFTYEKGYCFVYYLSQLCGDPQRFDDFLRAYVEKYKFTSVVAQDLLDSFLSFFPELKEQSVDCRAGLEFERWLNATGPPLAEPDLSQGSSLTRPVEALFQLWTAEPLDQAAASASAIDISKWRTFQTALFLDRLLDGSPLPQEVVMSLSKCYSSLLDSMNAEIRIRWLQIVVRNDYYPDLHRVRRFLESQMSRMYTIPLYEDLCTGALKSFALEVFYQTQGRLHPNLRRAIQQILSQGLGSSTEPASEPSTELGKAEADTDSDAQALLLGDEAPSSAISLRDVNVSA

SEQ ID NO: 813691 - protein, 636 aa, Homo sapiens; identical to SEQ ID NO: 813687

SEQ ID NO: 813692 - protein, 625 aa, Homo sapiens
VAGVPPAAAETPCAFAFSAPGPGPAPPPPLPAFPEAPGSEPACCPLAFRVDPFTDYGSSLTVTLPPELQAHQPFQVILRYTSTDAPAIWWLDPELTYGCAKPFVFTQGHSVCNRSFFPCFDTPAVKCTYSAVVKAPSGVQVLMSATRSAYMEEEGVFHFHMEHPVPAYLVALVAGDLKPADIGPRSRVWAEPCLLPTATSKLSGAVEQWLSAAERLYGPYMWGRYDIVFLPPSFPIVAMENPCLTFIISSILESDEFLVIDVIHEVAHSWFGNAVTNATWEEMWLSEGLATYAQRRITTETYGAAFTCLETAFRLDALHRQMKLLGEDSPVSKLQVKLEPGVNPSHLMNLFTYEKGYCFVYYLSQLCGDPQRFDDFLRAYVEKYKFTSVVAQDLLDSFLSFFPELKEQSVDCRAGPPLAEPDLSQGSSLTRPVEALFQLWTAEPLDQAAASASAIDISKWRTFQTALFLDRLLDGSPLPQEVVMSLSKCYSSLLDSMNAEIRIRWLQIVVRNDYYPDLHRVRRFLESQMSRMYTIPLYEDLCTGALKSFALEVFYQTQGRLHPNLRRAIQQILSQGLGSSTEPASEPSTELGKAEADTDSDAQALLLGDEAPSSAISLRDVNVSA

SEQ ID NO: 813693 - protein, 655 aa, Homo sapiens
VAGVPPAAAETPCAFAFSAPGPGPAPPPPLPAFPEAPGSEPACCPLAFRVDPFTDYGSSLTVTLPPELQAHQPFQVILRYTSTDAPAIWWLDPELTYGCAKPFVFTQGHSVCNRSFFPCFDTPAVKCTYSAVVKAPSGVQVLMSATRSAYMEEEGVFHFHMEHPVPAYLVALVAGDLKPADIGPRSRVWAEPCLLPTATSKLSGAVEQWLSAAERLYGPYMWGRYDIVFLPPSFPIVAMENPCLTFIISSILESDEFLVIDVIHEVAHSWFGNAVTNATWEEMWLSEGLATYAQRRITTETYGAAFTCLETAFRLDALHRQMKLLGEDSPVSKLQVKLEPGVNPSHLMNLFTYEKGYCFVYYLSQLCGDPQRFDDFLRAYVEKYKFTSVVAQDLLDSFLSFFPELKEQSVDCRAGLEFERWLNATGPPLAEPDLSQGSSLTRPVEALFQLWTAEPLDQAAASASAIDISKWRTFQTALFLDRLLDGSPLPQEVVMSLSKCYSSLLDSMNAEIRIRWLQIVVRNDYYPDLHRVRRFLESQMSRMYTIPLYEDLCTGALKSFALEVFYQTQGDTGRGWLSLGRALWPQATLAPQNRESQDPGRVWGQDSLSLVASWGGRHRGKAIPQGKWEVVLVLSPGPPCWERRPEPGASSLGLL

SEQ ID NO: 813694 - protein, 437 aa, Homo sapiens
VAGVPPAAAETPCAFAFSAPGPGPAPPPPLPAFPEAPGSEPACCPLAFRVDPFTDYGSSLTVTLPPELQAHQPFQVILRYTSTDAPAIWWLDPELTYGCAKPFVFTQGHSVCNRSFFPCFDTPAVKCTYSAVVKAPSGVQVLMSATRSAYMEEEGVFHFHMEHPVPAYLVALVAGDLKPADIGPRSRVWAEPCLLPTATSKLSGAVEQWLSAAERLYGPYMWGRYDIVFLPPSFPIVAMENPCLTFIISSILESDEFLVIDVIHEVAHSWFGNAVTNATWEEMWLSEGLATYAQRRITTETYGAAFTCLETAFRLDALHRQMKLLGEDSPVSKLQVKLEPGVNPSHLMNLFTYEKGYCFVYYLSQLCGDPQRFDDFLRAYVEKYKFTSVVAQDLLDSFLSFFPELKEQSVDCRAGEADPQPCSQGAVGMMAGGASAA

SEQ ID NO: 813695 - protein, 444 aa, Homo sapiens
VAGVPPAAAETPCAFAFSAPGPGPAPPPPLPAFPEAPGSEPACCPLAFRVDPFTDYGSSLTVTLPPELQAHQPFQVILRYTSTDAPAIWWLDPELTYGCAKPFVFTQGHSVCNRSFFPCFDTPAVKCTYSAVVKAPSGVQVLMSATRSAYMEEEGVFHFHMEHPVPAYLVALVAGDLKPADIGPRSRVWAEPCLLPTATSKLSGAVEQWLSAAERLYGPYMWGRYDIVFLPPSFPIVAMENPCLTFIISSILESDEFLVIDVIHEVAHSWFGNAVTNATWEEMWLSEGLATYAQRRITTETYGAAFTCLETAFRLDALHRQMKLLGEDSPVSKLQVKLEPGVNPSHLMNLFTYEKGYCFVYYLSQLCGDPQRFDDFLRAYVEKYKFTSVVAQDLLDSFLSFFPELKEQSVDCRAGWNSSAGSMPRAGSGWIPETGPAQPAAGVD

SEQ ID NO: 813696 - protein, 124 aa, Homo sapiens
MLPAVGSADEEEDPAEEDCPELVPMETTQSEEEEKSGLGAKIPVTIITGYLGAGKTTLLNYILTEQHSKRVAVILNEFGEGSALEKSLAVSQGGELYEEWLELRNGCLCCSVKVRNVFTVYMVY

SEQ ID NO: 813697 - protein, 179 aa, Homo sapiens
RGVNFFPHKKKKKRFFFGEIVDLSNVLDLHAFDSLSGISLQKKLQHVPGTQPHLDQSIVTITFEVPGNAKEEHLNMFIQNLLWEKNVRNKDNHCMEVIRLKGLVSIKDKSQQVIVQGVHELYDLEETPVSWKDDTERTNRLVLLGRNLDKDILKQLFIATVTETEKQWTTHFKEDQVCT

SEQ ID NO: 813698 - protein, 32 aa, Homo sapiens
MNKFLVQNNVFQTCRSGLSRIAHWCNTNKITG

SEQ ID NO: 813699 - protein, 395 aa, Homo sapiens
MLPAVGSADEEEDPAEEDCPELVPMETTQSEEEEKSGLGAKIPVTIITGYLGAGKTTLLNYILTEQHSKRVAVILNEFGEGSALEKSLAVSQGGELYEEWLELRNGCLCCSVKDNGLRAIENLMQKKGKFDYILLETTGLADPGAVASMFWVDAELGSDIYLDGIITIVDSKYGLKHLAEEKPDGLINEATRQVALADAILINKTDLVPEEDVKKLRATIRSINGLGQILETQRSRVDLSNVLDLHAFDSLSGISLQKKLQHVPGTQPHLDQSIVTITFEVPGNAKEEHLNMFIQNLLWEKNVRNKDNHCMEVIRLKGLVSIKDKSQQVIVQGVHELYDLEETPVSWKDDTERTNRLVLLGRNLDKDILKQLFIATVTETEKQWTTHFKEDQVCT

SEQ ID NO: 813700 - protein, 320 aa, Homo sapiens
MLPAVGSADEEEDPAEEDCPELVPMETTQSEEEEKSGLGAKIPVTIITGYLGAGKTTLLNYILTEQHSKRVAVILNEFGEGSALEKSLAVSQGGELYEEWLELRNGCLCCSVKDNGLRAIENLMQKKGKFDYILLETTGLADPGAVASMFWVDAELGSDIYLDGIITIVDSKYGLKHLAEEKPDGLINEATRQVALADAILINKTDLVPEEDVKKLRATIRSINGLGQILETQRSRVDLSNVLDLHAFDSLSGISLQKKLQHVPGTQPHLDQSIVTITFEVPGNAKEEHLNMFIQNLLWEKNVRNKDNHCMEVIRLKAEI

SEQ ID NO: 813701 - protein, 395 aa, Homo sapiens; identical to SEQ ID NO: 813699

SEQ ID NO: 813702 - protein, 395 aa, Homo sapiens; identical to SEQ ID NO: 813699

SEQ ID NO: 813703 - protein, 372 aa, Homo sapiens
MLPAVGSADEEEDPAEEDCPELVPMETTQSEEEEKSGLGAKIPVTIITGYLGAGKTTLLNYILTEQHSKRVAVILNEFGEGSALEKSLAVSQGGELYEEWLELRNGCLCCSVKDNGLRAIENLMQKKGKFDYILLETTGLADPGAVASMFWVDAELGSDIYLDGIITIVDSKYGLKHLAEEKPDGLINEATRQVALADAILINKTDLVPEEDVKKLRATIRSINGLGQILETQRSRVDLSNVLDLHAFDSLSGISLQKKLQHVPGTQPHLDQSIVTITFEVPGNAKEEHLNMFIQNLLWEKNVRNKDNHCMEVIRLKGLVSIKDKSQQVIVQGVHELYDLEETPVSWKDDTERTNRLVLLGKSERIHSFKTK

SEQ ID NO: 813704 - protein, 182 aa, Homo sapiens
MLPAVGSADEEEDPAEEDCPELVPMETTQSEEEEKSGLGAKIPVTIITGYLGAGKTTLLNYILTEQHSKRVAVILNEFGEGSALEKSLAVSQGGELYEEWLELRNGCLCCSVKDNGLRAIENLMQKKGKFDYILLETTGLADPGAVASMFWVDAELGSDIYLDGIITIVDSKYGLKAKNWTT

SEQ ID NO: 813705 - protein, 359 aa, Homo sapiens
MYFKRAARAFPVLLTGAGKTTLLNYILTEQHSKRVAVILNEFGEGSALEKSLAVSQGGELYEEWLELRNGCLCCSVKDNGLRAIENLMQKKGKFDYILLETTGLADPGAVASMFWVDAELGSDIYLDGIITIVDSKYGLKHLAEEKPDGLINEATRQVALADAILINKTDLVPEEDVKKLRATIRSINGLGQILETQRSRVDLSNVLDLHAFDSLSGISLQKKLQHVPGTQPHLDQSIVTITFEVPGNAKEEHLNMFIQNLLWEKNVRNKDNHCMEVIRLKGLVSIKDKSQQVIVQGVHELYDLEETPVSWKDDTERTNRLVLLGRNLDKDILKQLFIATVTETEKQWTTHFKEDQVCT

SEQ ID NO: 813706 - protein, 146 aa, Homo sapiens
MYFKRAARAFPVLLTGAGKTTLLNYILTEQHSKRVAVILNEFGEGSALEKSLAVSQGGELYEEWLELRNGCLCCSVKDNGLRAIENLMQKKGKFDYILLETTGLADPGAVASMFWVDAELGSDIYLDGIITIVDSKYGLKAKNWTT

SEQ ID NO: 813707 - protein, 390 aa, Homo sapiens
MLPAVGSADEEEDPAEEDCPELVPMETTQSEEEEKSGLGAKIPVTIITGYLGAGKTTLLNYILTEQHSKRVAVILNEFGEGSALEKSLAVSQGGELYEEWLELRNGCLCCSVKTMALRAELRIVDYYDCVETTVVADPGAVASMFWVDAELGSDIYLDGIITIVDSKYGLKHLAEEKPDGLINEATRQVALADAILINKTDLVPEEDVKKLRATIRSINGLGQILETQRSRVDLSNVLDLHAFDSLSGISLQKKLQHVPGTQPHLDQSIVTITFEVPGNAKEEHLNMFIQNLLWEKNVRNKDNHCMEVIRLKGLVSIKDKSQQVIVQGVHELYDLEETPVSWKDDTERTNRLVLLGRNLDKDILKQLFIATVTETEKQWTTHFKEDQVCT

SEQ ID NO: 813708 - protein, 172 aa, Homo sapiens
LQEFGTRETQRSRVDLSNVLDLHAFDSLSGISLQKKLQHVPGTQPHLDQSIVTITFEVPGNAKEEHLNMFIQNLLWEKNVRNKDNHCMEVIRLKGLVSIKDKSQQVIVQGVHELYDLEETPVSWKDDTERTNRLVLLGRNLDKDILKQLFIATVTETEKQWTTHFKEDQVCT

SEQ ID NO: 813709 - protein, 275 aa, Homo sapiens
MLPAVGSADEEEDPAEEDCPELVPMETTQSEEEEKSGLGAKIPVTIITGYLGAGKTTLLNYILTEQHSKRVAVILNEFGEGSALEKSLAVSQGGELYEEWLELRNGCLCCSVKDNGLRAIENLMQKKGKFDYILLETTGLADPGAVASMFWVDAELGSDIYLDGIITIVDSKYGLKHLAEEKPDGLINEATRQVALADGSSLYHRRDRGRIPIAIITTWYRVIRHTEDMREVVCVKRLRPIVSNRWNSDECLRAVLKLMSECWAHNSSLQTHSFD

SEQ ID NO: 813710 - protein, 113 aa, Homo sapiens
MLPAVGSADEEEDPAEEDCPELVPMETTQSEEEEKSGLGAKIPVTIITGYLGAGKTTLLNYILTEQHSKRVAVILNEFGEGSALEKSLAVSQGGELYEEWLELRNGCLCCSVN

SEQ ID NO: 813711 - protein, 111 aa, Homo sapiens
MLPAVGSADEEEDPAEEDCPELVPMETTQSEEEEKSGLGAKIPVTIITGYLGAGKTTLLNYILTEQHSKRVAVILNEFGEEHRWTNPEPSYMDACFIMSGSILGTVASDVH

SEQ ID NO: 813712 - protein, 318 aa, Homo sapiens
MSLLLYYALPALGSYAMLSIFFLRRPHLLHTPRAPTFRIRLGAHRGGSGELLENTMEAMENSMAQRSDLLELDCQLTRDRVVVVSHDENLCRQSGLNRDVGSLDFEDLPLYKEKLEVYFSPGHFAHGSDRRMVRLEDLFQRFPRTPMSVEIKGKNEELIREIAGLVRRYDRNEITIWASEKSSVMKKCKAANPEMPLSFTISRGFWVLLSYYLGLLPFIPIPEKFFFCFLPNIINRTYFPFSCSCLNQLLAVVSKWLIMRKSLIRHLEERGVQVVFWCLNEESDFEAAFSVGATGVITDYPTALRHYLDNHGPAARTS

SEQ ID NO: 813713 - protein, 256 aa, Homo sapiens
MAQRSDLLELDCQLTRDRVVVVSHDENLCRQSGLNRDVGSLDFEDLPLYKEKLEVYFSPGHFAHGSDRRMVRLEDLFQRFPRTPMSVEIKGKNEELIREIAGLVRRYDRNEITIWASEKSSVMKKCKAANPEMPLSFTISRGFWVLLSYYLGLLPFIPIPEKFFFCFLPNIINRTYFPFSCSCLNQLLAVVSKWLIMRKSLIRHLEERGVQVVFWCLNEESDFEAAFSVGATGVITDYPTALRHYLDNHGPAARTS

SEQ ID NO: 813714 - protein, 171 aa, Homo sapiens
MSLLLYYALPALGSYAMLSIFFLRRPHLLHTPRAPTFRIRLGAHRGGSGELLENTMEAMENSMAQRSDLLELDCQLTRDRVVVVSHDENLCRQSGLNRDVGSLDFEDLPLYKEKLEVYFSPGHFATDQSVRMLTCERTDPNTFSRNLSCSSQILDYYLGTLQNSRSVRSLG

SEQ ID NO: 813715 - protein, 145 aa, Homo sapiens
IPELPETGTLGKVRAQQHQREIELGPPEVPRPRGEGGWGGEGFLAAPIPEKFFFCFLPNIINRTYFPFSCSCLNQLLAVVSKWLIMRKSLIRHLEERGVQVVFWCLNEESDFEAAFSVGATGVITDYPTALRHYLDNHGPAARTS

SEQ ID NO: 813716 - protein, 256 aa, Homo sapiens; identical to SEQ ID NO: 813713

SEQ ID NO: 813717 - protein, 349 aa, Homo sapiens
MSLLLYYALPALGSYAMLSIFFLRRPHLLHTPRAPTFRIRLGAHRGGSGELLENTMEAMENSMAQRSDLLELDCQLTRDRVVVVSHDENLCRQSGLNRDVGSLDFEDLPLYKEKLEVYFSPGHFAHGSDRRMVRLEDLFQRFPRTPMSVEIKGKNEELIREIAGLVRRYDRNEITIWASEKSSVMKKCKAANPEMPLSFTISRGFWVLLSYYLGLLPFIPIPEKFFFCFLPNIINRTYFPFSCSCLNQLLAVVSKWLIMRKSLIRHLEERGVQVEAVTTTSTAHRPGSRVPVPLCCQLAASLGQVVFWCLNEESDFEAAFSVGATGVITDYPTALRHYLDNHGPAARTS

SEQ ID NO: 813718 - protein, 256 aa, Homo sapiens
MSLLLYYALPALGSYAMLSIFFLRRPHLLHTPRAPTFRIRLGAHRGGSGELLENTMEAMENSMAQRSDLLELDCQLTRDRVVVVSHDENLCRQSGLNRDVGSLDFEDLPLYKEKLEVYFSPGHFAHGSDRRMVRLEDLFQRFPRTPMSVEIKGKNEELIREIAGLVRRYDRNEITIWASEKSSVMKKCKAANPEMPLSFTISRGFWVLLSYYLGLLPFIPIPEKFFFCFLPNIINRTYFPFSCSCLNQLLAVVSKW

SEQ ID NO: 813719 - protein, 279 aa, Homo sapiens [sequence omitted]

SEQ ID NO: 813720 - protein, 124 aa, Homo sapiens
MPLSFTISRGFWVLLSYYLGLLPFIPIPEKFFFCFLPNIINRTYFPFSCSCLNQLLAVVSKWLIMRKSLIRHLEERGVQVVFWCLNEESDFEAAFSVGATGVITDYPTALRHYLDNHGPAARTS

SEQ ID NO: 813721 - protein, 102 aa, Homo sapiens
VAPMTAGCLQKHLPKIRDRSTSGGKMKVNGAPREDARPVPQGSCQSELHRALERLAASQSRTHEDLQFIPIPNCDQPEQYSQTPVSTKKKKKKIGNCSGSCL

SEQ ID NO: 813722 - protein, 200 aa, Homo sapiens
KALALTSFLHFLFLFLSFSLDSQSLFLLSLALLFFLICLSTSSFTSHALEFVFSSVSSAHRAFLSPPYSVFLFQLLCFSPSLSVAVSLCLCHCWSFPVTLGISLSVFLYLCLCFSFHLRPCFALLCLCLSLSLFLVLEASIVAVRMLGLQPQASCPGTQTLHFLNPLQLVSRGEQDAGKTGRRWTPGVWASGLSALPAPG

SEQ ID NO: 813723 - protein, 336 aa, Homo sapiens
MKIDIHSHILPKEWPDLKKRFGYGGWVQLQHHSKGEAKLLKDGKVFRVVRENCWDPEVRIREMDQKGVTVQALSTVPVMFSYWAKPEDTLNLCQLLNNDLASTVVSYPRRFVGLGTLPMQAPELAVKEMERCVKELGFPGVQIGTHVNEWDLNAQELFPVYAAAERLKCSLFVHPWDMQMDGRMAKYWLPWLVGMPAETTIAICSMIMGGVFEKFPKLKVCFAHGGGAFPFTVGRISHGFSMRPDLCAQDNPMNPKKYLGSFYTDALVHDPLSLKLLTDVIGKDKVILGTDYPFPLGELEPGKLIESMEEFDEETKNKLKAGNALAFLGLERKQFE

SEQ ID NO: 813724 - protein, 278 aa, Homo sapiens
MGKSSEWCERIAGIQKFVLEKWTKKAKPEDTLNLCQLLNNDLASTVVSYPRRFVGLGTLPMQAPELAVKEMERCVKELGFPGVQIGTHVNEWDLNAQELFPVYAAAERLKCSLFVHPWDMQMDGRMAKYWLPWLVGMPAETTIAICSMIMGGVFEKFPKLKVCFAHGGGAFPFTVGRISHGFSMRPDLCAQDNPMNPKKYLGSFYTDALVHDPLSLKLLTDVIGKDKVILGTDYPFPLGELEPGKLIESMEEFDEETKNKLKAGNALAFLGLERKQFE

SEQ ID NO: 813725 - protein, 336 aa, Homo sapiens; identical to SEQ ID NO: 813723

SEQ ID NO: 813726 - protein, 162 aa, Homo sapiens
MGKSSEWCERIAGIQKFVLEKWTKKAKPEDTLNLCQLLNNDLASTVVSYPRRFVGLGTLPMQAPELAVKEMERCVKELGFPGVQIGTHVNEWDLNAQELFPVYAAAERLKCSLFVHPWDMQMDGRMAKYWLPWLVGLCLCGVWNRGPTLGFFQSSMETYYVK

SEQ ID NO: 813727 - protein, 103 aa, Homo sapiens
GRGGSGCGELQQRRRRRRRQRQRQQQQRHVQHRRGGKDAAPLPDVRRRRGRIHQQVRGEVRGNRQERDQSLRAPLTPALPPRPNLRQVAQKLAGKVGRDSESA

SEQ ID NO: 813728 - protein, 125 aa, Homo sapiens
GRGGSGCGELQQRRRRRRRQRQRQQQQRHVQHRRGGKDAAPLPDVRRRRGRIHQQALGDISLGCALFRGLGVFFPVGKGVLAACAQVGGAAPQPRGPGHQDAAARGSDLPGGLVDTPGPHREEMS

SEQ ID NO: 813729 - protein, 223 aa, Homo sapiens
FTSSADDIRGIQSLYGDPKENQRLPNPDNSEPALCDPNLSFDAVTTVGNKIFFFKDRFFWLKVSERPKTSVNLISSLWPTLPSGIEAAYEIEARNQVFLFKDDKYWLISNLRPEPNYPKSIHSFGFPNFVKKIDAAVFNPRFYRTYFFVDNQYWRYDERRQMMDPGYPKLITKNFQGIGPKIDAVFYSKNKYYYFFQGSNQFEYDFLLQRITKTLKSNSWFGC

SEQ ID NO: 813730 - protein, 109 aa, Homo sapiens
MAFPKKKLQGLVAATITPMTENGEINFSVIGQYVDYLVKEQGVKNIFVNGTTGEGLSLSVSERRQVAEEWVTKGKDKSNHHKLGTIRTTQSRRSSFRRQLKAWHSGSHL

SEQ ID NO: 813731 - protein, 320 aa, Homo sapiens
MAFPKKKLQGLVAATITPMTENGEINFSVIGQYVDYLVKEQGVKNIFVNGTTGEGLSLSVSERRQVAEEWVTKGKDKLDQVIIHVGALSLKESQELAQHAAEIGADGIAVIAPFFLKPWTKDILINFLKEVAAAAPALPFYYYHIPALTGVKIRAEELLDGILDKIPTFQGLKFSDTDLLDFGQCVDQNRQQQFAFLFGVDEQLLSALVMGATGAVGSTYNYLGKKTNQMLEAFEQKDFSLALNYQFCIQRFINFVVKLGFGVSQTKAIMTLVSGIPMGPPRLPLQKASREFTDSAEAKLKSLDFLSFTDLKDGNLEAGS

SEQ ID NO: 813732 - protein, 320 aa, Homo sapiens; identical to SEQ ID NO: 813731

SEQ ID NO: 813733 - protein, 320 aa, Homo sapiens; identical to SEQ ID NO: 813731

SEQ ID NO: 813734 - protein, 320 aa, Homo sapiens; identical to SEQ ID NO: 813731

SEQ ID NO: 813735 - protein, 230 aa, Homo sapiens
MAFPKKKLQGLVAATITPMTENGEINFSVIGQYVDYLVKEQGVKNIFVNGTTGEGLSLSVSERRQVAEEWVTKGKDKLDQVIIHVGALSLKESQELAQHAAEIGADGIAVIAPFFLKPWTKDILINFLKEVAAAAPALPFYYYHIPALTGVKIRAEELLDGILDKIPTFQGLKFSDTDLLDFGQCVDQNRQQQFAFLFGVDEQLLSALVMGATGAVGSFVSRDLSTLLSN

SEQ ID NO: 813736 - protein, 329 aa, Homo sapiens [sequence omitted]

SEQ ID NO: 813737 - protein, 305 aa, Homo sapiens
AGGKMSRAPGILASWRRAPSLSVQKGSQTARHTCHPEVPLGNCFLPVYKASPLTVTRLWAERLDQVIIHVGALSLKESQELAQHAAEIGADGIAVIAPFFLKPWTKDILINFLKEVAAAAPALPFYYYHIPALTGVKIRAEELLDGILDKIPTFQGLKFSDTDLLDFGQCVDQNRQQQFAFLFGVDEQLLSALVMGATGAVGSTYNYLGKKTNQMLEAFEQKDFSLALNYQFCIQRFINFVVKLGFGVSQTKAIMTLVSGIPMGPPRLPLQKASREFTDSAEAKLKSLDFLSFTDLKDGNLEAGS

SEQ ID NO: 813738 - protein, 284 aa, Homo sapiens
MAFPKKKLQGLVAATITPMTENGEINFSVIGQYVDYLVKEQGVKNIFVNGTTGEGLSLSVSERRQVAEEWVTKGKDKLDQVIIHVGALSLKESQELAQHAAEIGADGIAVIAPFFLKPWTKDILINFLKEVAAAAPALPFYYYHIPALTGVKIRAEELLDGILDKIPTFQGLKFSDTDLLDFGQCVDQNRQQQFAFLFGVDEQLLSALVMGATGAVGSTYNYLGKKTNQMLEAFEQKDFSLALNYQFCIQRFINFVVKLENSKLKVSKNQRTLPLGTTNFPFLH

SEQ ID NO: 813739 - protein, 122 aa, Homo sapiens
ISGIRRKELCEGAIGISVLAVEETEILKASPAAPSHTARKRNQLFSNWSVCGLSCERTGSEEHFCEWHNRRRPVPERLRASPGCRGVGDKREGQAGSGDNSRRSTELEGVTGTGPTCSRNRS

SEQ ID NO: 813740 - protein, 284 aa, Homo sapiens; identical to SEQ ID NO: 813738

SEQ ID NO: 813741 - protein, 315 aa, Homo sapiens
MAFPKKKLQGLVAATITPMTENGEINFSVIGQYVDYLVKEQGVKNIFVNGTTGEGLSLSVSERRQVAEEWVTKGKDKLDQVIIHVGALSLKESQELAQHAAEIGADGIAVIAPFFLKPWTKDILINFLKEVAAAAPALPFYYYHIPALTGVKIRAEELLDGILDKIPTFQGLKFSDTDLLDFGQCVDQNRQQQFAFLFGVDEQLLSALVMGATGAVGSTYNYLGKKTNQMLEAFEQKDFSLALNYQFCIQRFINFVVKLGKCHPSSALSAAGDCKENGIPSLSLRVQQEHFLMVCCKQSSVSLINPRGQPYKTVK

SEQ ID NO: 813742 - protein, 381 aa, Homo sapiens
DAWVRTRGSGRVGRPTRRGLQGSFVEVAKSWSLQRAVGAVAASSRVRTLRRGAEEREGARGSRSESRARTQPGPTALPSCPGRAPAMEHQLLCCEVETIRRAYPDANLLNDRVLRAMLKAEETCAPSVSYFKCVQKEVLPSMRKIVATWMLEVCEEQKCEEEVFPLAMNYLDRFLSLEPVKKSRLQLLGATCMFVASKMKETIPLTAEKLCIYTDNSIRPEELLQMELLLVNKLKWNLAAMTPHDFIEHFLSKMPEAEENKQIIRKHAQTFVALCATDVKFISNPPSMVAAGSVVAAVQGLNLRSPNNFLSYYRLTRFLSRVIKCDPDCLRACQEQIEALLESSLRQAQQNMDPKAAEEEEEEEEEVDLACTPTDVRDVDI

SEQ ID NO: 813743 - protein, 381 aa, Homo sapiens; identical to SEQ ID NO: 813742

SEQ ID NO: 813744 - protein, 381 aa, Homo sapiens; identical to SEQ ID NO: 813742

SEQ ID NO: 813745 - protein, 381 aa, Homo sapiens; identical to SEQ ID NO: 813742

SEQ ID NO: 813746 - protein, 381 aa, Homo sapiens; identical to SEQ ID NO: 813742

SEQ ID NO: 813747 - protein, 348 aa, Homo sapiens
DAWVRTRGSGRVGRPTRRGLQGSFVEVAKSWSLQRAVGAVAASSRVRTLRRGAEEHQLLCCEVETIRRAYPDANLLNDRVLRAMLKAEETCAPSVSYFKCVQKEVLPSMRKIVATWMLEVCEEQKCEEEVFPLAMNYLDRFLSLEPVKKSRLQLLGATCMFVASKMKETIPLTAEKLCIYTDNSIRPEELLQMELLLVNKLKWNLAAMTPHDFIEHFLSKMPEAEENKQIIRKHAQTFVALCATDVKFISNPPSMVAAGSVVAAVQGLNLRSPNNFLSYYRLTRFLSRVIKCDPDCLRACQEQIEALLESSLRQAQQNMDPKAAEEEEEEEEEVDLACTPTDVRDVDI

SEQ ID NO: 813748 - protein, 381 aa, Homo sapiens; identical to SEQ ID NO: 813742

SEQ ID NO: 813749 - protein, 316 aa, Homo sapiens
GCREPAGGAQGRGMGSFGGTPLGKGGPLFKQRVPGRPERAAWAGEHGELQGRVAPKTPGLDPRLQGYRLGGPSPSEPGAWEHIFRPSVCEEQKCEEEVFPLAMNYLDRFLSLEPVKKSRLQLLGATCMFVASKMKETIPLTAEKLCIYTDNSIRPEELLQMELLLVNKLKWNLAAMTPHDFIEHFLSKMPEAEENKQIIRKHAQTFVALCATDVKFISNPPSMVAAGSVVAAVQGLNLRSPNNFLSYYRLTRFLSRVIKCDPDCLRACQEQIEALLESSLRQAQQNMDPKAAEEEEEEEEEVDLACTPTDVRDVDI

SEQ ID NO: 813750 - protein, 365 aa, Homo sapiens
DAWVRTRGSGRVGRPTRRGLQGSFVEVAKSWSLQRAVGAVAASSRVRTLRRGAEEREGARGSRSESRARTQPGPTALPSCPGRAPAMEHQLLCCEVETIRRAYPDANLLNDRVLRAMLKAEETCAPSVSYFKCVQKEVLPSMRKIVATWMLEVCEEQKCEEEVFPLAMNYLDRFLSLEPVKKSRLQLLGATCMFVASKMKETIPLTAEKLCIYTDNSIRPEELLQMELLLVNKLKWNLAAMTPHDFIEHFLSKMPEAEENKQIIRKHAQTFVALCATDVKFISNPPSMVAAGSVVAAVQGLNLRSPNNFLSYYRLTRFLSRVIKCDPDCLRACQEQIEALLESSLRQGGRHRHPQRGRSRPQVLH

SEQ ID NO: 813751 - protein, 311 aa, Homo sapiens
DAWVRTRGSGRVGRPTRRGLQGSFVEVAKSWSLQRAVGAVAASSRVRTLRRGAEEREGARGSRSESRARTQPGPTALPSCPGRAPAMEHQLLCCEVETIRRAYPDANLLNDRVLRAMLKAEETCAPSVSYFKCVQKEVLPSMRKIVATWMLEVCEEQKCEEEVFPLAMNYLDRFLSLEPVKKSRLQLLGATCMFVASKMKETIPLTAEKLCIYTDNSIRPEELLQMELLLVNKLKWNLAAMTPHDFIEHFLSKMPEAEENKQIIRKHAQTFVALCATDVKFISNPPSMVAAGSVVAAVQGLNLRSPNNFLS

SEQ ID NO: 813752 - protein, 381 aa, Homo sapiens; identical to SEQ ID NO: 813742

SEQ ID NO: 813753 - protein, 381 aa, Homo sapiens; identical to SEQ ID NO: 813742

SEQ ID NO: 813754 - protein, 381 aa, Homo sapiens; identical to SEQ ID NO: 813742

SEQ ID NO: 813755 - protein, 311 aa, Homo sapiens
DAWVRTRGSGRVGRPTRRGLQGSFVEVAKSWSLQRAVGAVAASSRVRTLRRGAEEREGARGSRSESRARTQPGPTALPSCPGRAPAMEHQLLCCEVETIRRAYPDANLLNDRVLRAMLKAEETCAPSVSYFKCVQKEVLPSMRKIVATWMLEVCEEQKCEEEVFPLAMNYLDRFLSLEPVKKSRLQLLGATCMFVASKMKETIPLTAEKLCIYTDNSIRPEELLQMELLLVNKLKWNLAAMTPHDFIEHFLSKMPEAEENKQIIREEQKCEEEVFPLAMNYLDRFLSLEPVKKGGRHRHPQRGRSRPQVLH

SEQ ID NO: 813756 - protein, 154 aa, Homo sapiens
DAWVRTRGSGRVGRPTRRGLQGSFVEVAKSWSLQRAVGAVAASSRVRTLRRGAEEREGARGSRSESRARTQPGPTALPSCPGRAPAMEHQLLCCEVETIRRAYPDANLLNDRVLRAMLKAEETCAPSVSYFKCVQKEEEVDLACTPTDVRDVDI

SEQ ID NO: 813757 - protein, 380 aa, Homo sapiens
DAWVRTRGSGRVGRPTRRGLQGSFVEVAKSWSLQRAVGAVAASSRVRTLRRGAEEREGARGSRSESRARTQPGPTALPSCPGRAPAMEHQLLCCEVETIRRAYPDANLLNDRVLRAMLKAEETCAPSVSYFKCVQKEVLPSMRKIVATWMLEVCEEQKCEEEVFPLAMNYLDRFLSLEPVKKSRLQLLGATCMFVASKMKETIPLTAEKLCIYTDNSIRPEELLQMELLLVNKLKWNLAAMTPHDFIEHFLSKMPEAEENKQIIRKHAQTFVALCATDVKFISNPPSMVAAGSVVAAVQGLNLRSPNNFLSYYRLTRFLSRVIKCDPCGPLWWQWRWGVWEAACQSRRKRFAFSHCQDDKFLSFSLKKLKFRNPLVPTGV

SEQ ID NO: 813758 - protein, 381 aa, Homo sapiens; identical to SEQ ID NO: 813742

SEQ ID NO: 813759 - protein, 381 aa, Homo sapiens; identical to SEQ ID NO: 813742

SEQ ID NO: 813760 - protein, 381 aa, Homo sapiens; identical to SEQ ID NO: 813742

SEQ ID NO: 813761 - protein, 381 aa, Homo sapiens; identical to SEQ ID NO: 813742

SEQ ID NO: 813762 - protein, 381 aa, Homo sapiens; identical to SEQ ID NO: 813742

SEQ ID NO: 813763 - protein, 381 aa, Homo sapiens; identical to SEQ ID NO: 813742

SEQ ID NO: 813764 - protein, 155 aa, Homo sapiens
MELLLVNKLKWNLAAMTPHDFIEHFLSKMPEAEENKQIIRKHAQTFVALCATDVKFISNPPSMVAAGSVVAAVQGLNLRSPNNFLSYYRLTRFLSRVIKCDPCGPLWWQWRWGVWEAACQSRRKRFAFSHCQDDKFLSFSLKKLKFRNPLVPTGV

SEQ ID NO: 813765 - protein, 381 aa, Homo sapiens; identical to SEQ ID NO: 813742

SEQ ID NO: 813766 - protein, 381 aa, Homo sapiens; identical to SEQ ID NO: 813742

SEQ ID NO: 813767 - protein, 323 aa, Homo sapiens
MARGPGLAPPPLRLPLLLLVLAAVTGHTAAQDNCTCPTNKMTVCSPDGPGGRCQCRALGSGMAVDCSTLTSKCLLLKARMSAPKNARTLVRPSEHALVDNDGLYDPDCDPEGRFKARQCNQTSVCWCVNSVGVRRTDKGDLSLRCDELVRTHHILIDLRHRPTAGAFNHSDLDAELRRLFRERYRLHPKFVAAVHYEQPTIQIELRQNTSQKAAGDVDIGDAAYYFERDIKGESLFQGRGGLDLRVRGEPLQVERTLIYYLDEIPPKFSMKRLTAGLIAVIVVVVVALVAGMAVLVITNRRKSGKYKKVEIKELGELRKEPSL

SEQ ID NO: 813768 - protein, 381 aa, Homo sapiens; identical to SEQ ID NO: 813742

SEQ ID NO: 813769 - protein, 93 aa, Homo sapiens
DAWVRTRGSGRVGRPTRRRRCEEEAPEGKGRCPHRGQAAAPFSYCAATVDFQARFGNIHIASVYLFHIVCCYWRISFLFYNVIYCHVLVLVFS

SEQ ID NO: 813770 - protein, 160 aa, Homo sapiens
DAWVRTRGSGRVGRPTRRGLQGSFVEVAKSWSLQRAVGAVAASSRVRTLRRGAEEREGARGSRSESRARTQPGPTALPSCPGRAPAMEHQLLCCEVETIRRAYPDANLLNDRVLRAMLKAEETCAPSVSYFKCVQKEVLPSMRKIVATWMLEVRGFGRLS

SEQ ID NO: 813771 - protein, 159 aa, Homo sapiens
DAWVRTRGSGRVGRPTRRGLQGSFVEVAKSWSLQRAVGAVAASSRVRTLRRGAEEREGARGSRSESRARTQPGPTAPALAGSSCARRPSRAQAHPAPPLQNTAHAYLNHPGCGVCLNHAGALRDALSVVMGQGHKSWMLCVSRGQRLVASARGTAESVL

SEQ ID NO: 813772 - protein, 206 aa, Homo sapiens
DAWVRTRGSGRVGRPTRRGLQGSFVEVAKSWSLQRAVGAVAASSRVRTLRRGAEEREGARGSRSESRARTQPGPTALPSCPGRAPAMEHQLLCCEVETIRRAYPDANLLNDRVLRAMLKAEETCAPSVSYFKCVQKEVLPSMRKIVATWMLEVPSGEASARGTPMGPRVRAGRLGALCVPRLRPSPAAPQRPGAANSGGRGHRFDF

SEQ ID NO: 813773 - protein, 430 aa, Homo sapiens
MRQRQSHYCSVLFLSVNYLGGTFPGDICSEENQIVSSYASKVCFEIEEDYKNRQFLGPEGNVDVELIDKSTNRYSVWFPTAGWYLWSATGLGFLVRDEVTVTIAFGSWSQHLALDLQHHEQWLVGGPLFDVTAEPEEAVAEIHLPHFISLQGEVDVSWFLVAHFKNEGMVLEHPARVEPFYAVLESPSFSLMGILLRIASGTRLSIPITSNTLIYYHPHPEDIKFHLYLVPSDALLTKAIDDEEDRFHGVRLQTSPPMEPLNFGSSYIVSNSANLKVMPKELKLSYRSPGEIQHFSKFYAGQMKEPIQLEITEKRHGTLVWDTEVKPVDLQLVAASAPPPFSGAAFVKENHRQLQARMGDLKGVLDDLQDNEVLTENEKELVEQEKTRQSKNEALLSMVEKKGDLALDVLFRSISERDPYLVSYLRQQNL

SEQ ID NO: 813774 - protein, 430 aa, Homo sapiens; identical to SEQ ID NO: 813773

SEQ ID NO: 813775 - protein, 455 aa, Homo sapiens
MIRYTGSYPVFLRPFVTSHIFSKKMMRQRQSHYCSVLFLSVNYLGGTFPGDICSEENQIVSSYASKVCFEIEEDYKNRQFLGPEGNVDVELIDKSTNRYSVWFPTAGWYLWSATGLGFLVRDEVTVTIAFGSWSQHLALDLQHHEQWLVGGPLFDVTAEPEEAVAEIHLPHFISLQGEVDVSWFLVAHFKNEGMVLEHPARVEPFYAVLESPSFSLMGILLRIASGTRLSIPITSNTLIYYHPHPEDIKFHLYLVPSDALLTKAIDDEEDRFHGVRLQTSPPMEPLNFGSSYIVSNSANLKVMPKELKLSYRSPGEIQHFSKFYAGQMKEPIQLEITEKRHGTLVWDTEVKPVDLQLVAASAPPPFSGAAFVKENHRQLQARMGDLKGVLDDLQDNEVLTENEKELVEQEKTRQSKNEALLSMVEKKGDLALDVLFRSISERDPYLVSYLRQQNL

SEQ ID NO: 813776 - protein, 455 aa, Homo sapiens; identical to SEQ ID NO: 813775

SEQ ID NO: 813777 - protein, 455 aa, Homo sapiens; identical to SEQ ID NO: 813775

SEQ ID NO: 813778 - protein, 430 aa, Homo sapiens; identical to SEQ ID NO: 813773

SEQ ID NO: 813779 - protein, 430 aa, Homo sapiens; identical to SEQ ID NO: 813773

SEQ ID NO: 813780 - protein, 426 aa, Homo sapiens
MGIPTSSVSEEQESSEGQDSGDICSEENQIVSSYASKVCFEIEEDYKNRQFLGPEGNVDVELIDKSTNRYSVWFPTAGWYLWSATGLGFLVRDEVTVTIAFGSWSQHLALDLQHHEQWLVGGPLFDVTAEPEEAVAEIHLPHFISLQGEVDVSWFLVAHFKNEGMVLEHPARVEPFYAVLESPSFSLMGILLRIASGTRLSIPITSNTLIYYHPHPEDIKFHLYLVPSDALLTKAIDDEEDRFHGVRLQTSPPMEPLNFGSSYIVSNSANLKVMPKELKLSYRSPGEIQHFSKFYAGQMKEPIQLEITEKRHGTLVWDTEVKPVDLQLVAASAPPPFSGAAFVKENHRQLQARMGDLKGVLDDLQDNEVLTENEKELVEQEKTRQSKNEALLSMVEKKGDLALDVLFRSISERDPYLVSYLRQQNL

SEQ ID NO: 813781 - protein, 281 aa, Homo sapiens
MGIPTSSVSEEQESSEGQDSGDICSEENQIVSSYASKVCFEIEEDYKNRQFLGPEGNVDVELIDKSTNRYSVWFPTAGWYLWSATGLGFLVRDEVTVTIAFGSWSQHLALDLQHHEQWLVGGPLFDVTAEPEEAVAEIHLPHFISLQGEVDVSWFLVAHFKNEGMVLEHPARVEPFYAVLESPSFSLMGILLRIASGTRLSIPITSNTLIYYHPHPEDIKFHLYLVPSDALLTKAIDDEEDRFHGVRLQTSPPMEPLNFGSSYIVSNSANLKVMPKWISSL

SEQ ID NO: 813782 - protein, 536 aa, Homo sapiens
MEKKECPEKSSSSEEELPRRDSGSSRNIDASKLIRLQGSRKLLVDNSIRELQYTKTGIFFQAEACVTNDTVYRELPCVSETLCDISHFFQEDDETEAEPLLFRAVPECQLSGGDIPSVSEEQESSEGQDSGDICSEENQIVSSYASKVCFEIEEDYKNRQFLGPEGNVDVELIDKSTNRYSVWFPTAGWYLWSATGLGFLVRDEVTVTIAFGSWSQHLALDLQHHEQWLVGGPLFDVTAEPEEAVAEIHLPHFISLQGEVDVSWFLVAHFKNEGMVLEHPARVEPFYAVLESPSFSLMGILLRIASGTRLSIPITSNTLIYYHPHPEDIKFHLYLVPSDALLTKAIDDEEDRFHGVRLQTSPPMEPLNFGSSYIVSNSANLKVMPKELKLSYRSPGEIQHFSKFYAGQMKEPIQLEITEKRHGTLVWDTEVKPVDLQLVAASAPPPFSGAAFVKENHRQLQARMGDLKGVLDDLQDNEVLTENEKELVEQEKTRQSKNEALLSMVEKKGDLALDVLFRSISERDPYLVSYLRQQNL

SEQ ID NO: 813783 - protein, 486 aa, Homo sapiens
MEKKECPEKSSSSEEELPRRVYRELPCVSETLCDISHFFQEDDETEAEPLLFRAVPECQLSGGDIPSVSEEQESSEGQDSGDICSEENQIVSSYASKVCFEIEEDYKNRQFLGPEGNVDVELIDKSTNRYSVWFPTAGWYLWSATGLGFLVRDEVTVTIAFGSWSQHLALDLQHHEQWLVGGPLFDVTAEPEEAVAEIHLPHFISLQGEVDVSWFLVAHFKNEGMVLEHPARVEPFYAVLESPSFSLMGILLRIASGTRLSIPITSNTLIYYHPHPEDIKFHLYLVPSDALLTKAIDDEEDRFHGVRLQTSPPMEPLNFGSSYIVSNSANLKVMPKELKLSYRSPGEIQHFSKFYAGQMKEPIQLEITEKRHGTLVWDTEVKPVDLQLVAASAPPPFSGAAFVKENHRQLQARMGDLKGVLDDLQDNEVLTENEKELVEQEKTRQSKNEALLSMVEKKGDLALDVLFRSISERDPYLVSYLRQQNL

SEQ ID NO: 813784 - protein, 447 aa, Homo sapiens
QSAVIILLDLDTLVRSSIPFPEIQYSCRKIFLRSKDGSLSPATLLIQIRIQRSWGPTSLALGFSECQSTSPAEPSPPLESGGGSTSPTANRGLVLSTVGWYLWSATGLGFLVRDEVTVTIAFGSWSQHLALDLQHHEQWLVGGPLFDVTAEPEEAVAEIHLPHFISLQGEVDVSWFLVAHFKNEGMVLEHPARVEPFYAVLESPSFSLMGILLRIASGTRLSIPITSNTLIYYHPHPEDIKFHLYLVPSDALLTKAIDDEEDRFHGVRLQTSPPMEPLNFGSSYIVSNSANLKVMPKELKLSYRSPGEIQHFSKFYAGQMKEPIQLEITEKRHGTLVWDTEVKPVDLQLVAASAPPPFSGAAFVKENHRQLQARMGDLKGVLDDLQDNEVLTENEKELVEQEKTRQSKNEALLSMVEKKGDLALDVLFRSISERDPYLVSYLRQQNL

SEQ ID NO: 813785 - protein, 132 aa, Homo sapiens
MEKKECPEKSSSSEEELPRRVYRELPCVSETLCDISHFFQEDDETEAEPLLFRAVPECQLSGGDIPSVSEEQESSEGQDSGDICSEENQIVSSYASKVCFEIEEDYKNRQFLGPEGNVDVELIDKSTNRYRR

SEQ ID NO: 813786 - protein, 128 aa, Homo sapiens [sequence omitted]

SEQ ID NO: 813787 - protein, 365 aa, Homo sapiens
MGIPTSSVSEEQESSEGQDSGDICSEENQIVSSYASKVCFEIEEDYKNRQFLGPEGNVDVELIDKSTNRYSVWFPTAGWYLWSATGLGFLVRDEVTVTIAFGSWSQHLALDLQHHEQWLVGGPLFDVTAEPEEAVAEIHLPHFISLQGEVDVSWFLVAHFKNEGMVLEHPARVEPFYAVLESPSFSLMGILLRIASGTRLSIPITSNTLIYYHPHPEDIKFHLYLVPSDALLTKAIDDEEDRFHGVRLQTSPPMEPLNFGSSYIVSNSANLKVMPKELKLSYRSPGEIQHFSKFYAGQMKEPIQLEITEKRHGTLVWDTEVKPVDLQLVAASAPPPFSGVRMWPGCCPILPRTGCTCLCLNPWLP

SEQ ID NO: 813788 - protein, 365 aa, Homo sapiens; identical to SEQ ID NO: 813787

SEQ ID NO: 813789 - protein, 71 aa, Homo sapiens
KEVENQRNRPKGILPFGPSYPKVTTCCFSGALTSDQEEQNTEQPGSVQATSLRSSFLHPGAPETHMRRRAV

SEQ ID NO: 813790 - protein, 117 aa, Homo sapiens [sequence omitted]

SEQ ID NO: 813791 - protein, 281 aa, Homo sapiens; identical to SEQ ID NO: 813781

SEQ ID NO: 813792 - protein, 74 aa, Homo sapiens
KEVENQRNRPKGILPFGPSYPKVTTCCFSGALTSDQEEQNTEQPGSVQATSLRSSFLHPGAPETHMGKKDTVKT

SEQ ID NO: 813793 - protein, 151 aa, Homo sapiens [sequence omitted]

SEQ ID NO: 813794 - protein, 71 aa, Homo sapiens; identical to SEQ ID NO: 813789

SEQ ID NO: 813795 - protein, 1007 aa, Homo sapiens
MFPNPEPPPETVSINKAINTQEVAVKEKHARTCILGTHHEKGAQTFWSVVNRLPLSSNAVLCWKFCHVFHKLLRDGHPNVLKDSLRYRNELSDMSRMWGHLSEGYGQLCSIYLKLLRTKMEYHTKNPRFPGNLQMSDRQLDEAGESDVNNFFQLTVEMFDYLECELNLFQTVFNSLDMSRSVSVTAAGQCRLAPLIQVILDCSHLYDYTVKLLFKLHSCLPADTLQGHRDRFMEQFTKLKDLFYRSSNLQYFKRLIQIPQLPENPPNFLRASALSEHISPVVVIPAEASSPDSEPVLEKDDLMDMDASQQNLFDNKFDDIFGSSFSSDPFNFNSQNGVNKDEKDHLIERLYREISGLKAQLENMKTESQRVVLQLKGHVSELEADLAEQQHLRQQAADDCEFLRAELDELRRQREDTEKAQRSLSEIERKAQANEQRYSKLKEKYSELVQNHADLLRKNAEVTKQVSMARQAQVDLEREKKELEDSLERISDQGQRKTQEQLEVLESLKQELATSQRELQVLQGSLETSAQSEANWAAEFAELEKERDSLVSGAAHREEELSALRKELQDTQLKLASTEESMCQLAKDQRKMLLVGSRKAAEQVIQDALNQLEEPPLISCAGSADHLLSTVTSISSCIEQLEKSWSQYLACPEDISGLLHSITLLAHLTSDAIAHGATTCLRAPPEPADSLTEACKQYGRETLAYLASLEEEGSLENADSTAMRNCLSKIKAIGEELLPRGLDIKQEELGDLVDKEMAATSAAIETATARIEEMLSKSRAGDTGVKLEVNERILGCCTSLMQAIQVLIVASKDLQREIVESGRGTASPKEFYAKNSRWTEGLISASKAVGWGATVMVDAADLVVQGRGKFEELMVCSHEIAASTAQLVAASKVKADKDSPNLAQLQQASRGVNQATAGVVASTISGKSQIEETDNMDFSSMTLTQIKRQEMDSQVRVLELENELQKERQKLGELRKKHYELAGVAEGWEEGTEASPPTLQEVVTEKE

SEQ ID NO: 813796 - protein, 1007 aa, Homo sapiens; identical to SEQ ID NO: 813795

SEQ ID NO: 813797 - protein, 1007 aa, Homo sapiens; identical to SEQ ID NO: 813795

SEQ ID NO: 813798 - protein, 1007 aa, Homo sapiens; identical to SEQ ID NO: 813795

SEQ ID NO: 813799 - protein, 705 aa, Homo sapiens
MDMDASQQNLFDNKFDDIFGSSFSSDPFNFNSQNGVNKDEKDHLIERLYREISGLKAQLENMKTESQRVVLQLKGHVSELEADLAEQQHLRQQAADDCEFLRAELDELRRQREDTEKAQRSLSEIERKAQANEQRYSKLKEKYSELVQNHADLLRKNAEVTKQVSMARQAQVDLEREKKELEDSLERISDQGQRKTQEQLEVLESLKQELATSQRELQVLQGSLETSAQSEANWAAEFAELEKERDSLVSGAAHREEELSALRKELQDTQLKLASTEESMCQLAKDQRKMLLVGSRKAAEQVIQDALNQLEEPPLISCAGSADHLLSTVTSISSCIEQLEKSWSQYLACPEDISGLLHSITLLAHLTSDAIAHGATTCLRAPPEPADSLTEACKQYGRETLAYLASLEEEGSLENADSTAMRNCLSKIKAIGEELLPRGLDIKQEELGDLVDKEMAATSAAIETATARIEEMLSKSRAGDTGVKLEVNERILGCCTSLMQAIQVLIVASKDLQREIVESGRGTASPKEFYAKNSRWTEGLISASKAVGWGATVMVDAADLVVQGRGKFEELMVCSHEIAASTAQLVAASKVKADKDSPNLAQLQQASRGVNQATAGVVASTISGKSQIEETDNMDFSSMTLTQIKRQEMDSQVRVLELENELQKERQKLGELRKKHYELAGVAEGWEEGTEASPPTLQEVVTEKE

SEQ ID NO: 813800 - protein, 667 aa, Homo sapiens
MFPNPEPPPETVSINKAINTQEVAVKEKHARTCILGTHHEKGAQTFWSVVNRLPLSSNAVLCWKFCHVFHKLLRDGHPNVLKDSLRYRNELSDMSRMWGHLSEGYGQLCSIYLKLLRTKMEYHTKNPRFPGNLQMSDRQLDEAGESDVNNFFQLTVEMFDYLECELNLFQTVFNSLDMSRSVSVTAAGQCRLAPLIQVILDCSHLYDYTVKLLFKLHSCLPADTLQGHRDRFMEQFTKLKDLFYRSSNLQYFKRLIQIPQLPENPPNFLRASALSEHISPVVVIPAEASSPDSEPVLEKDDLMDMDASQQNLFDNKFDDIFGSSFSSDPFNFNSQNGVNKDEKDHLIERLYREISGLKAQLENMKTESQRVVLQLKGHVSELEADLAEQQHLRQQAADDCEFLRAELDELRRQREDTEKAQRSLSEIERKAQANEQRYSKLKEKYSELVQNHADLLRKNAEVTKQVSMARQAQVDLEREKKELEDSLERISDQGQRKTQEQLEVLESLKQELATSQRELQVLQGSLETSAQSEANWAAEFAELEKERDSLVSGAAHREEELSALRKELQDTQLKLASTEESMCQLAKDQRKMLLVGSRKAAEQVIQDALNQLEEPPLISCAGSADHLLSTVTSISSCIEQLEKSWSSGPAGLWNGEVHGESELSGCV

SEQ ID NO: 813801 - protein, 414 aa, Homo sapiens
MFPNPEPPPETVSINKAINTQEVAVKEKHARTCILGTHHEKGAQTFWSVVNRLPLSSNAVLCWKFCHVFHKLLRDGHPNVLKDSLRYRNELSDMSRMWGHLSEGYGQLCSIYLKLLRTKMEYHTKNPRFPGNLQMSDRQLDEAGESDVNNFFQLTVEMFDYLECELNLFQTVFNSLDMSRSVSVTAAGQCRLAPLIQVILDCSHLYDYTVKLLFKLHSCLPADTLQGHRDRFMEQFTKLKDLFYRSSNLQYFKRLIQIPQLPENPPNFLRASALSEHISPVVVIPAEASSPDSEPVLEKDDLMDMDASQQNLFDNKFDDIFGSSFSSDPFNFNSQNGVNKDEKDHLIERLYREISGLKAQLENMKTEVLNQTSRLEIQLLENSLSTYKLEKQLLQQTNEILKIHEKNRWSIYYS

SEQ ID NO: 813802 - protein, 103 aa, Homo sapiens
MNAFMSALQHKLSLSFRNRGISTYTARSGNRKRIEPNQHPICQCKSLLPISCVLFPQPQAKSLESQGQPHHCHYPVPRTCMTLPKTPSIATPFLFGPMVISVL

SEQ ID NO: 813803 - protein, 303 aa, Homo sapiens
MSSARFDSSDRSAWYMGPVSRQEAQTRLQGQRHGMFLVRDSSTCPGDYVLSVSENSRVSHYIINSLPNRRFKIGDQEFDHLPALLEFYKIHYLDTTTLIEPAPRYPSPPMGSVSAPNLPTAEDNLEYVRTLYDFPGNDAEDLPFKKGEILVIIEKPEEQWWSARNKDGRVGMIPVPYVEKLVRSSPHGKHGNRNSNSYGIPEPAHAYAQPQTTTPLPAVSGSPGAAITPLPSTQNGPVFAKAIQKRVPCAYDKTALALEVGDIVKVTRMNINGQWEGEVNGRKGLFPFTHVKIFDPQNPDENE

SEQ ID NO: 813804 - protein, 303 aa, Homo sapiens; identical to SEQ ID NO: 813803

SEQ ID NO: 813805 - protein, 303 aa, Homo sapiens; identical to SEQ ID NO: 813803

SEQ ID NO: 813806 - protein, 303 aa, Homo sapiens; identical to SEQ ID NO: 813803

SEQ ID NO: 813807 - protein, 146 aa, Homo sapiens
PLLRNCVWLFGLLTCVLPDMVAASFSSRPVRDVCPLSRRARILRRFWPSFSTWLDTFELQQLTQSARSLAILESKVSFQPCLLTNTPTHLVWRTSESDIPRVYLWFGFIINQLVTSAHENGIQGCQEIQSSKQGELEFCTPDVCQN

SEQ ID NO: 813808 - protein, 303 aa, Homo sapiens; identical to SEQ ID NO: 813803

SEQ ID NO: 813809 - protein, 303 aa, Homo sapiens; identical to SEQ ID NO: 813803

SEQ ID NO: 813810 - protein, 292 aa, Homo sapiens [sequence omitted]

SEQ ID NO: 813811 - protein, 173 aa, Homo sapiens
MAACIAAGHWAAMGLGRSFQAARTLLPPPASIACRVHAGPVRQQSTGPSEPGAFQPPPKPVIVDKHRPVEPERRFLSPEFIPRRGRTDPLKFQIERKDMLERRKVLHIPEFYVGSILRVTTADPYASGKISQFLGICIQRSGRGLGATFILRNVIEGQGPVYIHNPERWLPGP

SEQ ID NO: 813812 - protein, 292 aa, Homo sapiens [sequence omitted]

SEQ ID NO: 813813 - protein, 194 aa, Homo sapiens
MLERRKVLHIPEFYVGSILRVTTADPYASGKISQFLGICIQRSGRGLGATFILRNVIEGQGVEICFELYNPRVQEIQVVKLEKRLDDSLLYLRDALPEYSTFDVNMKPVVQEPNQKVPVNELKVKMKPKPWSKRWERPNFNIKGIRFDLCLTEQQMKEAQKWNQPWLEFDMMREYDTSKIEAAIWKEIEASKRS

SEQ ID NO: 813814 - protein, 274 aa, Homo sapiens
MAACIAAGHWAAMGLGRSFQAARTLLPPPASIACRVHAGPVRQQSTGPSEPGAFQPPPKPVIVDKHRPVEPERRFLSPEFIPRRGRTDPLKFQIERKDMLERRKVLHIPEFYVGSILRVTTADPYAIGATFILRNVIEGQGVEICFELYNPRVQEIQVVKLEKRLDDSLLYLRDALPEYSTFDVNMKPVVQEPNQKVPVNELKVKMKPKPWSKRWERPNFNIKGIRFDLCLTEQQMKEAQKWNQPWLEFDMMREYDTSKIEAAIWKEIEASKRS

SEQ ID NO: 813815 - protein, 185 aa, Homo sapiens
ARQFQDAGSREELQSCLGPQPRLAGAPVSAALLPARGTNMAQKRPACTLKPECVQQLLVCSQEAKKSAYCPYSHFPVGAALLTQEGRIFKGCNIENACYPLGICAERTAIQKAVSEGYKDFRAIAIASDMQDDFISPCGACRQVMREFGTNWPVYMTKPDGTYIVMTVQELLPSSFGPEDLQKTQ

SEQ ID NO: 813816 - protein, 203 aa, Homo sapiens
MGGSSPRPCILKAAYLRACGLAAGTHPGEELQSCLGPQPRLAGAPVSAALLPARGTNMAQKRPACTLKPECVQQLLVCSQEAKKSAYCPYSHFPVGAALLTQEGRIFKGCNIENACYPLGICAERTAIQKAVSEGYKDFRAIAIASDMQDDFISPCGACRQVMREFGTNWPVYMTKPDGTYIVMTVQELLPSSFGPEDLQKTQ

SEQ ID NO: 813817 - protein, 203 aa, Homo sapiens; identical to SEQ ID NO: 813816

SEQ ID NO: 813818 - protein, 243 aa, Homo sapiens
MGGSSPRPCILKAAYLRACGLAAGTHPGEELQSCLGPQPRLAGAPVSAALLPARGTNMAQKRPACTLKPECVQQLLVCSQEAKKSAYCPYSHFPVGAALLTQEGRIFKGRVSLLPMLEVQWREPSSLQSQTPEFKLSSCLSLPSSWDYRCNIENACYPLGICAERTAIQKAVSEGYKDFRAIAIASDMQDDFISPCGACRQVMREFGTNWPVYMTKPDGTYIVMTVQELLPSSFGPEDLQKTQ

SEQ ID NO: 813819 - protein, 107 aa, Homo sapiens
ARQFQDAGSREELQSCLGPQPRLAGAPVSAALLPARGTNMAQKRPACTLKPECVQQLLVCSQEAKKSAYCPYSHFPVGAALLTQEGRIFKEGRLRRVQGFQGNCYRQ

SEQ ID NO: 813820 - protein, 80 aa, Homo sapiens
EAPRSAEAPRSQAPRRVQGFQGNDMQDDFISPCGACRQVMREFGTNWPVYMTKPDGTYIVMTVQELLPSSFGPEDLQKTQ

SEQ ID NO: 813821 - protein, 136 aa, Homo sapiens
ARQFQDAGSREELQSCLGPQPRLAGAPVSAALLPARGTNMAQKRPACTLKPECVQQLLVCSQEAKKSAYCPYSHFPVGAALLTQEGRIFKGCNIENACYPLGICAERTAIQKAVSEGYKDFRAIAIASLAPTGPCT

SEQ ID NO: 813822 - protein, 71 aa, Homo sapiens
IPSKQGPAWQAPHWTIPQAFPLVQWAGDPILFNEVWISGPWEPPHSWICSLLGASWLLPSSFGPEDLQKTQ

SEQ ID NO: 813823 - protein, 109 aa, Homo sapiens
LGETNLSLILCFPDMQDDFISPCGACRQVMREVSSFSCCLECKYLPCRRLWEPRQVAGMAGMAGVETQLLSCLLGWLTSKASLRLHESLEIIPSFNKYLPSECLLCARP

SEQ ID NO: 813824 - protein, 260 aa, Homo sapiens
LRLVRGWVLANPAAAAAAVAAAAAVTEDREPQHEELPGLDSQWRQIENGESGRERPLRAGESWFLVEKHWYKQWEAYVQGGDQDSSTFPGCINNATLFQDEINWRLKEGLVEGEDYVLLPAAAWHYLVSWYGLEHGQPPIERKVIELPNIQKVEVYPVELLLVRHNDLGKSHTVQFSHTDSIGLVLRTARERFLVEPQEDTRLWAKNSEGSLDRLYDTHITVLDAALETGQLIIMETRKKRWHLAQRTAACHEQQHVGRG

SEQ ID NO: 813825 - protein, 673 aa, Homo sapiens
MNNNMSEEDEDFKGQPGICGLTNLGNTCFMNSALQCLSNVPQLTEYFLNNCYLEELNFRNPLGMKGEIAEAYADLVKQAWSGHHRSIVPHVFKNKVGHFASQFLGYQQHDSQELLSFLLDGLHEDLNRVKKKEYVELCDAAGRPDQEVAQEAWQNHKRRNDSVIVDTFHGLFKSTLVCPDCGNVSVTFDPFCYLSVPLPISHKRVLEVFFIPMDPRRKPEQHRLVVPKKGKISDLCVALSKHTGISPERMMVADVFSHRFYKLYQLEEPLSSILDRDDIFVYEVSGRIEAIEGSREDIVVPVYLRERTPARDYNNSYYGLMLFGHPLLVSVPRDRFTWEGLYNVLMYRLSRYVTKPNSDDEDDGDEKEDDEEDKDDVPGPSTGGSLRDPEPEQAGPSSGVTNRCPFLLDNCLGTSQWPPRRRRKQLFTLQTVNSNGTSDRTTSPEEVHAQPYIAIDWEPEMKKRYYDEVEAEGYVKHDCVGYVMKKAPVRLQECIELFTTVETLEKENPWYCPSCKQHQLATKKLDLWMLPEILIIHLKRFSYTKFSREKLDTLVEFPIRDLDFSEFVIQPQNESNPELYKYDLIAVSNHYGGMRDGHYTTFACNKDSGQWHYFDDNSVSPVNENQIESKAAYVLFYQRQDVARRLLSPAGSSGAPASPACSSPPSSEFMDVN

SEQ ID NO: 813826 - protein, 673 aa, Homo sapiens; identical to SEQ ID NO: 813825

SEQ ID NO: 813827 - protein, 673 aa, Homo sapiens; identical to SEQ ID NO: 813825

SEQ ID NO: 813828 - protein, 673 aa, Homo sapiens; identical to SEQ ID NO: 813825

SEQ ID NO: 813829 - protein, 717 aa, Homo sapiens
MNNNMSEEDEDFKGQPGICGLTNLGNTCFMNSALQCLSNVPQLTEYFLNNCYLEELNFRNPLGMKGEIAEAYADLVKQAWSGHHRSIVPHVFKNKVGHFASQFLGYQQHDSQELLSFLLDGLHEDLNRVKKKEYVELCDAAGRPDQEVAQEAWQNHKRRNDSVIVDTFHGLFKSTLVCPDCGNVSVTFDPFCYLSVPLPISHKRVLEVFFIPMDPRRKPEQVWGSGGLEEMMMDTESLISCHSSRLLALTHHKPFWSFVDTVFPLHRLVVPKKGKISDLCVALSKHTGISPERMMVADVFSHRFYKLYQLEEPLSSILDRDDIFVYEVSGRIEAIEGSREDIVVPVYLRERTPARDYNNSYYGLMLFGHPLLVSVPRDRFTWEGLYNVLMYRLSRYVTKPNSDDEDDGDEKEDDEEDKDDVPGPSTGGSLRDPEPEQAGPSSGVTNRCPFLLDNCLGTSQWPPRRRRKQLFTLQTVNSNGTSDRTTSPEEVHAQPYIAIDWEPEMKKRYYDEVEAEGYVKHDCVGYVMKKAPVRLQECIELFTTVETLEKENPWYCPSCKQHQLATKKLDLWMLPEILIIHLKRFSYTKFSREKLDTLVEFPIRDLDFSEFVIQPQNESNPELYKYDLIAVSNHYGGMRDGHYTTFACNKDSGQWHYFDDNSVSPVNENQIESKAAYVLFYQRQDVARRLLSPAGSSGAPASPACSSPPSSEFMDVN

SEQ ID NO: 813830 - protein, 673 aa, Homo sapiens; identical to SEQ ID NO: 813825

SEQ ID NO: 813831 - protein, 623 aa, Homo sapiens
MNNNMSEEDEDFKGQPGICGLTNLGNTCFMNSALQCLSNVPQLTEYFLNNCYLEELNFRNPLGMKGEIAEAYADLVKQAWSGHHRSIVPHVFKNKVGHFASQFLGYQQHDSQELLSFLLDGLHEDLNRVKKKEYVELCDAAGRPDQEVAQEAWQNHKRRNDSVIVDTFHGLFKSTLVCPDCGNVSVTFDPFCYLSVPLPISHKRVLEVFFIPMDPRRKPEQHRLVVPKKGKISDLCVALSKHTGISPERMMVADVFSHRFYKLYQLEEPLSSILDRDDIFVYEVSGRIEAIEGSREDIVVPVYLRERTPARDYNNSYYGLMLFGHPLLVSVPRDRFTWEGLYNVLMYRLSRYVTKPNSDDEDDGDEKEDDEEDKDDVPGPSTGGSLRDPEPEQAGPSSGVTNRCPFLLDNCLGTSQWPPRRRRKQLFTLQTVNSNGTSDRTTSPEEVHAQPYIAIDWEPEMKKRYYDEVEAEGYVKHDCVGYVMKKAPVRLQECIELFTTVETLEKENPWYCPSCKQHQLATKKLDLWMLPEILIIHLKRFSYTKFSREKLDTLVEFPIRDLDFSEFVIQPQNESNPELYKYDLIAVSNHYGGMRDGHCMCQAVGGACPGGSGQGGDQDLPSE

SEQ ID NO: 813832 - protein, 700 aa, Homo sapiens
MNNNMSEEDEDFKGQPGICGLTNLGNTCFMNSALQCLSNVPQLTEYFLNNCYLEELNFRNPLGMKGEIAEAYADLVKQAWSGHHRSIVPHVFKNKVGHFASQFLGYQQHDSQELLSFLLDGLHEDLNRVKKKEYVELCDAAGRPDQEVAQEAWQNHKRRNDSVIVDTFHGLFKSTLVCPDCGNVSVTFDPFCYLSVPLPISHKRVLEVFFIPMDPRRKPEQHRLVVPKKGKISDLCVALSKHTGISPERMMVADVFSHRFYKLYQLEEPLSSILDRDDIFVYEVSGRIEAIEGSREDIVVPVYLRERTPARDYNNSYYGLMLFGHPLLVSVPRDRFTWEGLYNVLMYRLSRYVTKPNSDDEDDGDEKEDDEEDKDDVPGPSTGGSLRDPEPEQAGPSSGVTNRCPFLLDNCLGTSQWPPRRRRKQLFTLQTVNSNGTSDRTTSPEEVHAQPYIAIDWEPEMKKRYYDEVEAEGYVKHDCVGYVMKKAPVRLQECIELFTTVETLEKENPWYCPSCKQHQLATKKLDLWMLPEILIIHLKRFSYTKFSREKLDTLVEFPIRSGARERMAGGRQGKEGVSSINPLPTHRDLDFSEFVIQPQNESNPELYKYDLIAVSNHYGGMRDGHYTTFACNKDSGQWHYFDDNSVSPVNENQIESKAAYVLFYQRQDVARRLLSPAGSSGAPASPACSSPPSSEFMDVN

SEQ ID NO: 813833 - protein, 580 aa, Homo sapiens
MNNNMSEEDEDFKGQPGICGLTNLGNTCFMNSALQCLSNVPQLTEYFLNNCYLEELNFRNPLGMKGEIAEAYADLVKQAWSGHHRSIVPHVFKNKVGHFASQFLGYQQHDSQELLSFLLDGLHEDLNRVKKKEYVELCDAAGRPDQEVAQEAWQNHKRRNDSVIVDTFHGLFKSTLVCPDCGNVSVTFDPFCYLSVPLPISHKRVLEVFFIPMDPRRKPEQHRLVVPKKGKISDLCVALSKHTGISPERMMVADVFSHRFYKLYQLEEPLSSILDRDDIFVYEVSGRIEAIEGSREDIVVPVYLRERTPARDYNNSYYGLMLFGHPLLVSVPRDRFTWEGLYNVLMYRLSRYVTKPNSDDEDDGDEKEDDEEDKDDVPGPSTGGSLRDPEPEQAGPSSGVTNRCPFLLDNCLGTSQWPPRRRRKQLFTLQTVNSNGTSDRTTSPEEVHAQPYIAIDWEPEMKKRYYDEVEAEGYVKHDCVGYVMKKAPVRLQECIELFTTVETLEKENPWYCPSCKQHQLATKKLDLWMLPEILIIHLKRFSYTKFSREKLDTLVEFPIRSGARERMAGGRQGKEGVYQY

SEQ ID NO: 813834 - protein, 666 aa, Homo sapiens
MNNNMSEEDEDFKGQPGICGLTNLGNTCFMNSALQCLSNVPQLTEYFLNNCYLEELNFRNPLGMKGEIAEAYADLVKQAWSGHHRSIVPHVFKNKVGHFASQFLGYQQHDSQELLSFLLDGLHEDLNRVKKKEYVELCDAAGRPDQEVAQEAWQNHKRRNDSVIVDTFHGLFKSTLVCPDCGNVSVTFDPFCYLSVPLPISHKRVLEVFFIPMDPRRKPEQHRLVVPKKGKISDLCVALSKHTGISPERMMVADVFSHRFYKLYQLEEPLSSILDRDDIFVYEVSGRIEAIEGSREDIVVPVYLRERTPARDYNNSYYGLMLFGHPLLVSVPRDRFTWEGLYNVLMYRLSRYVTKPNSDDEDDGDEKEDDEEDKDDVPGPSTGGSLRDPEPEQAGPSSGVTNRCPFLLDNCLGTSQWPPRRRRKQLFTLQTVNSNGTSDRTTSPEEVHAQPYIAIDWEPEMKKRYYDEVEAEGYVKHDCVGYVMKKAPVRLQECIELFTTVETLEKENPWYCPSCKQHQLATKKLDLWMLPEILIIHLKRFSYTKFSREKLDTLVEFPIRDLDFSEFVIQPQNESNPELYKYDLIAVSNHYGGMRDGHYTTFACNKDSGQWHYFDDNSVSPVNENQIESKAAYVLFYQRQDVARRLLSPAGSSGAPASPACSSPLT

SEQ ID NO: 813835 - protein, 510 aa, Homo sapiens
MNNNMSEEDEDFKGQPGICGLTNLGNTCFMNSALQCLSNVPQLTEYFLNNCYLEELNFRNPLGMKGEIAEAYADLVKQAWSGHHRSIVPHVFKNKVGHFASQFLGYQQHDSQELLSFLLDGLHEDLNRVKKKEYVELCDAAGRPDQEVAQEAWQNHKRRNDSVIVDTFHGLFKSTLVCPDCGNVSVTFDPFCYLSVPLPISHKRVLEVFFIPMDPRRKPEQHRLVVPKKGKISDLCVALSKHTGISPERMMVADVFSHRFYKLYQLEEPLSSILDRDDIFVYEVSGRIEAIEGSREDIVVPVYLRERTPARDYNNSYYGLMLFGHPLLVSVPRDRFTWEGLYNVLMYRLSRYVTKPNSDDEDDGDEKEDDEEDKDDVPGPSTGGSLRDPEPEQAGPSSGVTNRCPFLLDNCLGTSQWPPRRRRKQLFTLQTVNSNGTSDRTTSPEEVHAQPYIAIDWEPEMKKRYYDEVEAEGYVKHDCVGYVMKKAPVRLQECIELFTTVETLEKENPW

SEQ ID NO: 813836 - protein, 457 aa, Homo sapiens
MNNNMSEEDEDFKGQPGICGLTNLGNTCFMNSALQCLSNVPQLTEYFLNNCYLEELNFRNPLGMKGEIAEAYADLVKQAWSGHHRSIVPHVFKNKVGHFASQFLGYQQHDSQELLSFLLDGLHEDLNRVKKKEYVELCDAAGRPDQEVAQEAWQNHKRRNDSVIVDTFHGLFKSTLVCPDCGNVSVTFDPFCYLSVPLPISHKRVLEVFFIPMDPRRKPEQHRLVVPKKGKISDLCVALSKHTGISPERMMVADVFSHRFYKLYQLEEPLSSILDRDDIFVYEVSGRIEAIEGSREDIVVPVYLRERTPARDYNNSYYGLMLFGHPLLVSVPRDRFTWEGLYNVLMYRLSRYVTKPNSDDEDDGDEKEDDEEDKDDVPGPSTGGSLRDPEPEQAGPSSGVTNRCPFLLDNCLGTSQWPPRRRRKQLFTLQTVNSNGTSDRTTSPEEVHASSEFMDVN

SEQ ID NO: 813837 - protein, 673 aa, Homo sapiens; identical to SEQ ID NO: 813825

SEQ ID NO: 813838 - protein, 673 aa, Homo sapiens; identical to SEQ ID NO: 813825

SEQ ID NO: 813839 - protein, 673 aa, Homo sapiens; identical to SEQ ID NO: 813825

SEQ ID NO: 813840 - protein, 673 aa, Homo sapiens; identical to SEQ ID NO: 813825

SEQ ID NO: 813841 - protein, 673 aa, Homo sapiens; identical to SEQ ID NO: 813825

SEQ ID NO: 813842 - protein, 673 aa, Homo sapiens; identical to SEQ ID NO: 813825

SEQ ID NO: 813843 - protein, 299 aa, Homo sapiens
MNNNMSEEDEDFKGQPGICGLTNLGNTCFMNSALQCLSNVPQLTEYFLNNCYLEELNFRNPLGMKGEIAEAYADLVKQAWSGHHRSIVPHVFKNKVGHFASQFLGYQQHDSQELLSFLLDGLHEDLNRVKKKEYVELCDAAGRPDQEVAQEAWQNHKRRNDSVIVDTFHGLFKSTLVCPDCGNVSVTFDPFCYLSVPLPISHKRVLEVFFIPMDPRRKPEQHRLVVPKKGKISDLCVALSKHTGISPERMMVADVFSHRFYKLYQLEEPLSSILDRDDIFVYEVSARIEAIEEINLTKE

SEQ ID NO: 813844 - protein, 673 aa, Homo sapiens; identical to SEQ ID NO: 813825

SEQ ID NO: 813845 - protein, 244 aa, Homo sapiens
MNNNMSEEDEDFKGQPGICGLTNLGNTCFMNSALQCLSNVPQLTEYFLNNCYLEELNFRNPLGMKGEIAEAYADLVKQAWSGHHRSIVPHVFKNKVGHFASQFLGYQQHDSQELLSFLLDGLHEDLNRVKKKEYVELCDAAGRPDQEVAQEAWQNHKRRNDSVIVDTFHGLFKSTLVCPDCGNVSVTFDPFCYLSVPLPISHKRVLEVFFIPMDPRRKPEQTGLVQKGTRLLWPGNTAPKEGGL

SEQ ID NO: 813846 - protein, 595 aa, Homo sapiens
VGPMIVHAHCATCVKNKVGHFASQFLGYQQHDSQELLSFLLDGLHEDLNRVKKKEYVELCDAAGRPDQEVAQEAWQNHKRRNDSVIVDTFHGLFKSTLVCPDCGNVSVTFDPFCYLSVPLPISHKRVLEVFFIPMDPRRKPEQHRLVVPKKGKISDLCVALSKHTGISPERMMVADVFSHRFYKLYQLEEPLSSILDRDDIFVYEVSGRIEAIEGSREDIVVPVYLRERTPARDYNNSYYGLMLFGHPLLVSVPRDRFTWEGLYNVLMYRLSRYVTKPNSDDEDDGDEKEDDEEDKDDVPGPSTGGSLRDPEPEQAGPSSGVTNRCPFLLDNCLGTSQWPPRRRRKQLFTLQTVNSNGTSDRTTSPEEVHAQPYIAIDWEPEMKKRYYDEVEAEGYVKHDCVGYVMKKAPVRLQECIELFTTVETLEKENPWYCPSCKQHQLATKKLDLWMLPEILIIHLKRFSYTKFSREKLDTLVEFPIRDLDFSEFVIQPQNESNPELYKYDLIAVSNHYGGMRDGHYTTFACNKDSGQWHYFDDNSVSPVNENQIESKAAYVLFYQRQDVARRLLSPAGSSGAPASPACSSPPSSEFMDVN

SEQ ID NO: 813847 - protein, 609 aa, Homo sapiens
DSTLGTPDPLRLLALLTPSLSDDPAHLLQNKVGHFASQFLGYQQHDSQELLSFLLDGLHEDLNRVKKKEYVELCDAAGRPDQEVAQEAWQNHKRRNDSVIVDTFHGLFKSTLVCPDCGNVSVTFDPFCYLSVPLPISHKRVLEVFFIPMDPRRKPEQHRLVVPKKGKISDLCVALSKHTGISPERMMVADVFSHRFYKLYQLEEPLSSILDRDDIFVYEVSGRIEAIEGSREDIVVPVYLRERTPARDYNNSYYGLMLFGHPLLVSVPRDRFTWEGLYNVLMYRLSRYVTKPNSDDEDDGDEKEDDEEDKDDVPGPSTGGSLRDPEPEQAGPSSGVTNRCPFLLDNCLGTSQWPPRRRRKQLFTLQTVNSNGTSDRTTSPEEVHAQPYIAIDWEPEMKKRYYDEVEAEGYVKHDCVGYVMKKAPVRLQECIELFTTVETLEKENPWYCPSCKQHQLATKKLDLWMLPEILIIHLKRFSYTKFSREKLDTLVEFPIRDLDFSEFVIQPQNESNPELYKYDLIAVSNHYGGMRDGHYTTFACNKDSGQWHYFDDNSVSPVNENQIESKAAYVLFYQRQDVARRLLSPAGSSGAPASPACSSPPSSEFMDVN

SEQ ID NO: 813848 - protein, 547 aa, Homo sapiens
TATFLGNAGLSFVCGENRGQEVAQEAWQNHKRRNDSVIVDTFHGLFKSTLVCPDCGNVSVTFDPFCYLSVPLPISHKRVLEVFFIPMDPRRKPEQHRLVVPKKGKISDLCVALSKHTGISPERMMVADVFSHRFYKLYQLEEPLSSILDRDDIFVYEVSGRIEAIEGSREDIVVPVYLRERTPARDYNNSYYGLMLFGHPLLVSVPRDRFTWEGLYNVLMYRLSRYVTKPNSDDEDDGDEKEDDEEDKDDVPGPSTGGSLRDPEPEQAGPSSGVTNRCPFLLDNCLGTSQWPPRRRRKQLFTLQTVNSNGTSDRTTSPEEVHAQPYIAIDWEPEMKKRYYDEVEAEGYVKHDCVGYVMKKAPVRLQECIELFTTVETLEKENPWYCPSCKQHQLATKKLDLWMLPEILIIHLKRFSYTKFSREKLDTLVEFPIRDLDFSEFVIQPQNESNPELYKYDLIAVSNHYGGMRDGHYTTFACNKDSGQWHYFDDNSVSPVNENQIESKAAYVLFYQRQDVARRLLSPAGSSGAPASPACSSPPSSEFMDVN

SEQ ID NO: 813849 - protein, 409 aa, Homo sapiens
MCCSQQLLGITWSAGMVYEVSGRIEAIEGSREDIVVPVYLRERTPARDYNNSYYGLMLFGHPLLVSVPRDRFTWEGLYNVLMYRLSRYVTKPNSDDEDDGDEKEDDEEDKDDVPGPSTGGSLRDPEPEQAGPSSGVTNRCPFLLDNCLGTSQWPPRRRRKQLFTLQTVNSNGTSDRTTSPEEVHAQPYIAIDWEPEMKKRYYDEVEAEGYVKHDCVGYVMKKAPVRLQECIELFTTVETLEKENPWYCPSCKQHQLATKKLDLWMLPEILIIHLKRFSYTKFSREKLDTLVEFPIRDLDFSEFVIQPQNESNPELYKYDLIAVSNHYGGMRDGHYTTFACNKDSGQWHYFDDNSVSPVNENQIESKAAYVLFYQRQDVARRLLSPAGSSGAPASPACSSPPSSEFMDVN

SEQ ID NO: 813850 - protein, 416 aa, Homo sapiens
GTRAAQRLLYLIELIEAVTEDIFVYEVSGRIEAIEGSREDIVVPVYLRERTPARDYNNSYYGLMLFGHPLLVSVPRDRFTWEGLYNVLMYRLSRYVTKPNSDDEDDGDEKEDDEEDKDDVPGPSTGGSLRDPEPEQAGPSSGVTNRCPFLLDNCLGTSQWPPRRRRKQLFTLQTVNSNGTSDRTTSPEEVHAQPYIAIDWEPEMKKRYYDEVEAEGYVKHDCVGYVMKKAPVRLQECIELFTTVETLEKENPWYCPSCKQHQLATKKLDLWMLPEILIIHLKRFSYTKFSREKLDTLVEFPIRDLDFSEFVIQPQNESNPELYKYDLIAVSNHYGGMRDGHYTTFACNKDSGQWHYFDDNSVSPVNENQIESKAAYVLFYQRQDVARRLLSPAGSSGAPASPACSSPPSSEFMDVN

SEQ ID NO: 813851 - protein, 420 aa, Homo sapiens
IVPEFVVLCRNFSSSCRNSSSCRNSSSCYEVSGRIEAIEGSREDIVVPVYLRERTPARDYNNSYYGLMLFGHPLLVSVPRDRFTWEGLYNVLMYRLSRYVTKPNSDDEDDGDEKEDDEEDKDDVPGPSTGGSLRDPEPEQAGPSSGVTNRCPFLLDNCLGTSQWPPRRRRKQLFTLQTVNSNGTSDRTTSPEEVHAQPYIAIDWEPEMKKRYYDEVEAEGYVKHDCVGYVMKKAPVRLQECIELFTTVETLEKENPWYCPSCKQHQLATKKLDLWMLPEILIIHLKRFSYTKFSREKLDTLVEFPIRDLDFSEFVIQPQNESNPELYKYDLIAVSNHYGGMRDGHYTTFACNKDSGQWHYFDDNSVSPVNENQIESKAAYVLFYQRQDVARRLLSPAGSSGAPASPACSSPPSSEFMDVN

SEQ ID NO: 813852 - protein, 311 aa, Homo sapiens
MPPVLEDDEEDKDDVPGPSTGGSLRDPEPEQAGPSSGVTNRCPFLLDNCLGTSQWPPRRRRKQLFTLQTVNSNGTSDRTTSPEEVHAQPYIAIDWEPEMKKRYYDEVEAEGYVKHDCVGYVMKKAPVRLQECIELFTTVETLEKENPWYCPSCKQHQLATKKLDLWMLPEILIIHLKRFSYTKFSREKLDTLVEFPIRDLDFSEFVIQPQNESNPELYKYDLIAVSNHYGGMRDGHYTTFACNKDSGQWHYFDDNSVSPVNENQIESKAAYVLFYQRQDVARRLLSPAGSSGAPASPACSSPPSSEFMDVN

SEQ ID NO: 813853 - protein, 269 aa, Homo sapiens
NTAAGSVPKLNVKTGVAERGLGIYITFRYSNFKFAVTTSPEEVHAQPYIAIDWEPEMKKRYYDEVEAEGYVKHDCVGYVMKKAPVRLQECIELFTTVETLEKENPWYCPSCKQHQLATKKLDLWMLPEILIIHLKRFSYTKFSREKLDTLVEFPIRDLDFSEFVIQPQNESNPELYKYDLIAVSNHYGGMRDGHYTTFACNKDSGQWHYFDDNSVSPVNENQIESKAAYVLFYQRQDVARRLLSPAGSSGAPASPACSSPPSSEFMDVN

SEQ ID NO: 813854 - protein, 230 aa, Homo sapiens
LWQDPGLSINIHELSSWVKKRYYDEVEAEGYVKHDCVGYVMKKAPVRLQECIELFTTVETLEKENPWYCPSCKQHQLATKKLDLWMLPEILIIHLKRFSYTKFSREKLDTLVEFPIRDLDFSEFVIQPQNESNPELYKYDLIAVSNHYGGMRDGHYTTFACNKDSGQWHYFDDNSVSPVNENQIESKAAYVLFYQRQDVARRLLSPAGSSGAPASPACSSPPSSEFMDVN

SEQ ID NO: 813855 - protein, 238 aa, Homo sapiens
MAARQFRDWTDCALQAVEEGGRGRARWLTPVIPALWEAEAGRSRGQEMETILANTVKPCIELFTTVETLEKENPWYCPSCKQHQLATKKLDLWMLPEILIIHLKRFSYTKFSREKLDTLVEFPIRDLDFSEFVIQPQNESNPELYKYDLIAVSNHYGGMRDGHYTTFACNKDSGQWHYFDDNSVSPVNENQIESKAAYVLFYQRQDVARRLLSPAGSSGAPASPACSSPPSSEFMDVN

SEQ ID NO: 813856 - protein, 191 aa, Homo sapiens
NPEVAVEGRLPISHSCVGCRRERTAMATVAANPAAAAAAVAAAAAVTEDREPQHEELPGLDSQWRQIENGESGRERPLRAGESWFLVEKHWYKQWEAYVQGGDQDSSTFPGCINNATLFQDEINWRLKEGLVEGEDYVLLPAAAWHYLVSWYGLEHGQPPIERKVIELPNIQKVEVYCPSLSSAQSVLRGW

SEQ ID NO: 813857 - protein, 160 aa, Homo sapiens [sequence omitted]

SEQ ID NO: 813858 - protein, 165 aa, Homo sapiens
YGLSSTTPSVSLSMRIRSSPRQPMSSSTNARTWRDACCPRPAHLAPQPPLPAAPHPALSSWMLIESPGSCHRKKKKKALSAISLLVSAPLLLFVLGAPARHCRLSRGYCSPVPLHRSLPGKNRSCLLLAVRAPPVFALPAVTLPSSLYLWSCPSLSSAQSVLRGW

SEQ ID NO: 813859 - protein, 268 aa, Homo sapiens
NPEVAVEGRLPISHSCVGCRRERTAMATVAANPAAAAAAVAAAAAVTEDREPQHEELPGLDSQWRQIENGESGRERPLRAGESWFLVEKHWYKQWEAYVQGGDQDSSTFPGCINNATLFQGTRPLPPSHPSPGVLVPSVPTDDHKPILCARSLVGWPESFVSFLCGFFLCHLHPRPTDEINWRLKEGLVEGEDYVLLPAAAWHYLVSWYGLEHGQPPIERKVIELPNIQKVEVYPVELLLVRHNDLGKSHTVQFSHTDSIGESKGHAM

SEQ ID NO: 813860 - protein, 206 aa, Homo sapiens
MLQQDSNDDTEDVSLFDAEEETTNRPRKAKIRHPVASFFHLFFRVSAIIVYLLCELLSSSFITCMVTIILLLSCDFWAVKNVTGRLMVGLRWWNHIDEDGKSHWVFESRKESSQENKTVSEAESRIFWLGLIACPVLWVIFAFSALFSFRVKWLAVVIMGVVLQGANLYGYIRCKVRSRKHLTSMATSYFGKQFLRQTLEMIRLPE

SEQ ID NO: 813861 - protein, 276 aa, Homo sapiens
MLQQDSNDDTEDVSLFDAEEETTNRPRKAKIRHPVASFFHLFFRVSAIIVYLLCELLSSSFITCMVTIILLLSCDFWAVKNVTGRLMVGLRWWNHIDEDGKSHWVFESRKESSQENKTVSEAESRIFWLGLIACPVLWVIFAFSALFSFRVKWLRRSRHIAQTGLKVLGSRDPPASAFQSAGITGVSRCPGHPSRKFHQVDINSFTRITDRALYWKPAPRLSSPPLRAAPGNCQQMAPARLFLSLRLWAWRGGGESPNSRGTGEPGPKFHLASGMH

SEQ ID NO: 813862 - protein, 367 aa, Homo sapiens
MLQQDSNDDTEDVSLFDAEEETTNRPRKAKIRHPVASFFHLFFRVSAIIVYLLCELLSSSFITCMVTIILLLSCDFWAVKNVTGRLMVGLRWWNHIDEDGKSHWVFESRKESSQENKTVSEAESRIFWLGLIACPVLWVIFAFSALFSFRVKWLRRSRHIAQTGLKVLGSRDPPASAFQSAGITGVSRCPGHPSRKFHQESEPVMFKKSVNIKKKMDARRMKKEEGLTENTGLPRKLLEKHDPWPAYVTYTSQTVKRLIEKSKTRELECMRALEERPWASRQNKPSSVIQPKRRKSSKSSGKAVFRDTLSESTLSMWGAYSVLAMAPTMIPEPTHLHADSRDCPTENYNKIIFARKPMMRMLPTVRY

SEQ ID NO: 813863 - protein, 182 aa, Homo sapiens
MLQQDSNDDTEDVSLFDAEEETTNRPRKAKIRHPVASFFHLFFRVSAIIVYLLCELLSSSFITCMVTIILLLSCDFWAVKNVTGRLMVGLRWWNHIDEDGKSHWVFESRKESSQENKTVSEAESRIFWLGLIACPVLWVIFAFSALFSFRVKWLEPSEMSCTRNFKREFSAGRRGRQDIRTS

SEQ ID NO: 813864 - protein, 152 aa, Homo sapiens
MDARRMKKEEGLTENTGLPRKLLEKHDPWPAYVTYTSQTVKRLIEKSKTRELECMRALEERPWASRQNKPSSVIQPKRRKSSKSSGKAVFRDTLSESTLSMWGAYSVLAMAPTMIPEPTHLHADSRDCPTENYNKIIFARKPMMRMLPTVRY

SEQ ID NO: 813865 - protein, 152 aa, Homo sapiens; identical to SEQ ID NO: 813864

SEQ ID NO: 813866 - protein, 152 aa, Homo sapiens; identical to SEQ ID NO: 813864

SEQ ID NO: 813867 - protein, 165 aa, Homo sapiens
VHRDSYSRSRVSPGMQLGIKNEEGLTENTGLPRKLLEKHDPWPAYVTYTSQTVKRLIEKSKTRELECMRALEERPWASRQNKPSSVIQPKRRKSSKSSGKAVFRDTLSESTLSMWGAYSVLAMAPTMIPEPTHLHADSRDCPTENYNKIIFARKPMMRMLPTVRY

SEQ ID NO: 813868 - protein, 170 aa, Homo sapiens
MLQQDSNDDTEDVSLFDAEEETTNRPRKAKIRHPVASFFHLFFRVSAIIVYLLCELLSSSFITCMVTIILLLSCDFWAVKNVTGRLMVGLRWWNHIDEDGKSHWVFESRKESSQENKTVSEAESRIFWLGLIACPVLWVIFAFSALFSFRVKWLVTVFGDRTFKDMIKIK

SEQ ID NO: 813869 - protein, 118 aa, Homo sapiens
MLQQDSNDDTEDVSLFDAEEETTNRPRKAKIRHPVASFFHLFFRVSAIIVYLLCELLSSSFITCMVTIILLLSCDFWAVKNVTGRLMVGLRWWNHIDEDGKSHWVFESRKLLPVQYCG

SEQ ID NO: 813870 - protein, 1414 aa, Homo sapiens
MDSAPCVRTSSLLLTAPAFGLHVRGGRVTAEGGPQVCFSIPSSCCMPSTVSESNVVRRAGGIRPTCLRWDMLLLHPGFALSIILESAEFNQTFLSTTRSLSLQGPSDTSAPAEGKPGSTVGFWSLRCLITTDSKSLGPTSEPPGPSTAWSHPEGGRCGTEAEPLRVPTGAVGTPTALKQNPLSIPETAARGPAQADQRALLTTTLAEKGGHGARRPSLCLPRWHFLNSLFTVSQCPTVIEKPGACPLHPFCYAPRFMVLLPLMGATRDGCFLGKTNVCELSHLCHSPTSRAHNWPAGPCTSDCLPRLSPWPRGDSLVGARWPTCLWCCHLSWVCLRPSACWKCPPSHPCALSSREGPAAPFRGRSVPLFLSAFPFPALLGLLWGNEYPWFCPVRESCVPAHKGRTSCRSCGKLLFPRRCPPPEACPLPALQVVFLRPGVNNRDIPGNFPFTKCIILDEGYATSWSSKNRFLPSGLKSWCGPQKQQCVSLGRLQSPSQADAPGGTPWGPPEGPTDVTWVTGVLEDGMAYVTHFVLEPEVMGVLEDGMACVTRFVFVFGCIGVSVLSVSSSHVLNTVGSSLGRRPLSLAAGKPCAAPPSAWAPSLGAGHLGQPGAMVSLQLRPSGPLGSDRPSPHHRALAASGKWGRTLCAWGCCLFTTHDQTPSRTELLSTLQKPTESFVHELSLVCFPVTFVTKQRPLSPRLEQFLQDTVARAAPCCQARWLAGLGPAHVKGTGSCDHTEPRASRSRAWKPDPLVLGLVPRSLQSKTLGCVRDDMGARLGVGPFYRVGWLSEGVEVGDPRGLALGLDNASPSWAGGSLSEPRHTLGLSARRALVTHRRPGWDLCQFQEPSSMKVVLSPERKPRRTPGRRPGLADVCSLCGWTEGALMTHIAAPFHHPSSPEQSLPRDSTCVPSMPQQPVEQGSPLLRQLLLPLPPFSFPAPSPCPSWPVALGSHGVAYWGSCSLGHFLSPGPTGPPPARAPTALAVAGGFPMTRVAQLGEDAVLGTAPGTASCLPDHVSLLQGPQSPWARGHVSHGCRPCQRHIPAPLLLDGVLVVVSMVDPHPTARGDVGQRKGSLDGSLNDHSVRSGVIPVSAQGRAGEYTDPNSWADTSFLPCTGRIGLRTVTLCTAPVGWQCHCLLGPLQDWAGADSPCGPLAQSPALPDSSLYWGYICVSEGLWQSCKILFFKNFSPDLYLLDCRRRARESGGSPLAFVICEVNEGLSPKSTSQPMTIVLFSFANLSSSVFSKVECAHRGPSQARSVSAGYLVIIAASSRLMLMVTGTVASGSRASRRREAGPAAHCKGIFHLILVCPTCGGRADVWSLGRLGAGRCAGEEAPVAKQSLRFISPAALCLVCLVNSHREKRLEVQDRCTAPVIEVMTGFDNFSPLRQVRYTSNSKFNDLIGKHTSWHDVR

SEQ ID NO: 813871 - protein, 1369 aa, Homo sapiens
MPSTVSESNVVRRAGGIRPTCLRWDMLLLHPGFALSIILESAEFNQTFLSTTRSLSLQGPSDTSAPAEGKPGSTVGFWSLRCLITTDSKSLGPTSEPPGPSTAWSHPEGGRCGTEAEPLRVPTGAVGTPTALKQNPLSIPETAARGPAQADQRALLTTTLAEKGGHGARRPSLCLPRWHFLNSLFTVSQCPTVIEKPGACPLHPFCYAPRFMVLLPLMGATRDGCFLGKTNVCELSHLCHSPTSRAHNWPAGPCTSDCLPRLSPWPRGDSLVGARWPTCLWCCHLSWVCLRPSACWKCPPSHPCALSSREGPAAPFRGRSVPLFLSAFPFPALLGLLWGNEYPWFCPVRESCVPAHKGRTSCRSCGKLLFPRRCPPPEACPLPALQVVFLRPGVNNRDIPGNFPFTKCIILDEGYATSWSSKNRFLPSGLKSWCGPQKQQCVSLGRLQSPSQADAPGGTPWGPPEGPTDVTWVTGVLEDGMAYVTHFVLEPEVMGVLEDGMACVTRFVFVFGCIGVSVLSVSSSHVLNTVGSSLGRRPLSLAAGKPCAAPPSAWAPSLGAGHLGQPGAMVSLQLRPSGPLGSDRPSPHHRALAASGKWGRTLCAWGCCLFTTHDQTPSRTELLSTLQKPTESFVHELSLVCFPVTFVTKQRPLSPRLEQFLQDTVARAAPCCQARWLAGLGPAHVKGTGSCDHTEPRASRSRAWKPDPLVLGLVPRSLQSKTLGCVRDDMGARLGVGPFYRVGWLSEGVEVGDPRGLALGLDNASPSWAGGSLSEPRHTLGLSARRALVTHRRPGWDLCQFQEPSSMKVVLSPERKPRRTPGRRPGLADVCSLCGWTEGALMTHIAAPFHHPSSPEQSLPRDSTCVPSMPQQPVEQGSPLLRQLLLPLPPFSFPAPSPCPSWPVALGSHGVAYWGSCSLGHFLSPGPTGPPPARAPTALAVAGGFPMTRVAQLGEDAVLGTAPGTASCLPDHVSLLQGPQSPWARGHVSHGCRPCQRHIPAPLLLDGVLVVVSMVDPHPTARGDVGQRKGSLDGSLNDHSVRSGVIPVSAQGRAGEYTDPNSWADTSFLPCTGRIGLRTVTLCTAPVGWQCHCLLGPLQDWAGADSPCGPLAQSPALPDSSLYWGYICVSEGLWQSCKILFFKNFSPDLYLLDCRRRARESGGSPLAFVICEVNEGLSPKSTSQPMTIVLFSFANLSSSVFSKVECAHRGPSQARSVSAGYLVIIAASSRLMLMVTGTVASGSRASRRREAGPAAHCKGIFHLILVCPTCGGRADVWSLGRLGAGRCAGEEAPVAKQSLRFISPAALCLVCLVNSHREKRLEVQDRCTAPVIEVMTGFDNFSPLRQVRYTSNSKFNDLIGKHTSWHDVR

SEQ ID NO: 813872 - protein, 1398 aa, Homo sapiens
MVRGGRVTAEGGPQVCFSIPSSCCMPSTVSESNVVRRAGGIRPTCLRWDMLLLHPGFALSIILESAEFNQTFLSTTRSLSLQGPSDTSAPAEGKPGSTVGFWSLRCLITTDSKSLGPTSEPPGPSTAWSHPEGGRCGTEAEPLRVPTGAVGTPTALKQNPLSIPETAARGPAQADQRALLTTTLAEKGGHGARRPSLCLPRWHFLNSLFTVSQCPTVIEKPGACPLHPFCYAPRFMVLLPLMGATRDGCFLGKTNVCELSHLCHSPTSRAHNWPAGPCTSDCLPRLSPWPRGDSLVGARWPTCLWCCHLSWVCLRPSACWKCPPSHPCALSSREGPAAPFRGRSVPLFLSAFPFPALLGLLWGNEYPWFCPVRESCVPAHKGRTSCRSCGKLLFPRRCPPPEACPLPALQVVFLRPGVNNRDIPGNFPFTKCIILDEGYATSWSSKNRFLPSGLKSWCGPQKQQCVSLGRLQSPSQADAPGGTPWGPPEGPTDVTWVTGVLEDGMAYVTHFVLEPEVMGVLEDGMACVTRFVFVFGCIGVSVLSVSSSHVLNTVGSSLGRRPLSLAAGKPCAAPPSAWAPSLGAGHLGQPGAMVSLQLRPSGPLGSDRPSPHHRALAASGKWGRTLCAWGCCLFTTHDQTPSRTELLSTLQKPTESFVHELSLVCFPVTFVTKQRPLSPRLEQFLQDTVARAAPCCQARWLAGLGPAHVKGTGSCDHTEPRASRSRAWKPDPLVLGLVPRSLQSKTLGCVRDDMGARLGVGPFYRVGWLSEGVEVGDPRGLALGLDNASPSWAGGSLSEPRHTLGLSARRALVTHRRPGWDLCQFQEPSSMKVVLSPERKPRRTPGRRPGLADVCSLCGWTEGALMTHIAAPFHTPSSPEQSLPRDSTCVPSMPQQPVEQGSPLLRQLLLPLPPFSFPAPSPCPSWPVALGSHGVAYWGSCSLGHFLSPGPTGPPPARAPTALAVAGGFPMTPCGPAGEDAVLGTAPGTASCLPDHVSLLQGPQSPWARGHVSHGCRPCQRHIPAPLLLDGVLVVVSMVDPHPTARGDVGQRKGSLDGSLNDHSVRSGVIPCQPKGGPGSTLIPTAGLTPPFSPAREDWPEDRHPVHSPSRVAVPLSPWAVAGLGGCRLPLRAPCSIPGPPRLLPLLGVICVSEGLWQSCKILFFKNFSPDLYLLDCRRRARESGGSPLAFVICEVNEGLSPKSTSQPMTIVLFSFANLSSSVFSKVECAHRGPSQARSVSAGYLVIIAASSRLMLMVTGTVASGSRASRRREAGPAAHCKGIFHLILVCPTCGGRADVWSLGRLGAGRCAGEEAPVAKQSLRFISPAALCLVCLVNSHREKRLEVQDRCTAPVIKVMTGFDNLSPQTSKIPSNSKFNDLIGKHTAGMMSGDFCKKCL

SEQ ID NO: 813873 - protein, 1463 aa, Homo sapiens
MTDFTILNGASLMDAVHHFQIYNCFHPKIGHPLNFGVLNKILRCLDSAPCVRTSSLLLTAPAFGLHVRGGRVTAEGGPQVCFSIPSSCCMPSTVSESNVVRRAGGIRPTCLRWDMLLLHPGFALSIILESAEFNQTFLSTTRSLSLQGPSDTSAPAEGKPGSTVGFWSLRCLITTDSKSLGPTSEPPGPSTAWSHPEGGRCGTEAEPLRVPTGAVGTTHSPKQNPLSIPETAARGPAQADQRALLTTTLAGRVATGPVSQPVPAQMAFSQLTVYCLSVSNCDEKPGACPLHPFCYAPRFMVLLPLMGATRDGCFLGKTNVCELSHLCHSPTSRAHNWPAGPCTSDCLPRLSPWPRGDSLVGARWPTCLWCCHLSWVCLRPSACWKCPPSHPCALSSREGPAAPFRGRSVPLFLSAFPFPALLGLLWGNEYPWFCPVRESCVPAHKGRTSCRSCGKLLFPRRCPPPEACPLPALQVVFLRPGVNNRDIPGNFPFTKCIILDEGYATSWSSKNRFLPSGLKSWCGPQKQQCVSLGRLQSPSQADAPGGTPWGPPEGPTDVTWVTGVLEDGMAYVTHFVLEPEVMGVLEDGMACVTRFVFVFGCIGVSVLSVSSSHVLNTVGSSLGRRPLSLAAGKPCAAPPSAWAPSLGAGHLGQPGAMVSLQLRPSGPLGSDRPSPHHRALAASGKWGRTLCAWGCCLFTTHDQTPSRTELLSTLQKPTESFVHELSLVCFPVTFVTKQRPLSPRLEQFLQDTVARAAPCCQARWLAGLGPAHVKGTGSCDHTEPRASRSRAWKPDPLVLGLVPRSLQSKTLGCVRDDMGARLGVGPFYRVGWLSEGVEVGDPRGLALGLDNASPSWAGGSLSEPRHTLGLSARRALVTHRRPGWDLCQFQEPSSMKVVLSPERKPRRTPGRRPGLADVCSLCGWTEGALMTHIAAPFHHPSSPEQSLPRDSTCVPSMPQQPVEQGSPLLRQLLLPLPPFSFPAPSPCPSWPVALGSHGVAYWGSCSLGHFLSPGPTGPPPARAPTALAVAGGFPMTRVAQLGEDAVLGTAPGTASCLPDHVSLLQGPQSPWARGHVSHGCRPCQRHIPAPLLLDGVLVVVSMVDPHPTARGDVGQRKGSLDGSLNDHSVRSGVIPVSAQGRAGEYTDPNSWADTSFLPCTGRIGLRTVTLCTAPVGWQCHCLLGPLQDWAGADSPCGPLAQSPALPDSSLYWGYICVSEGLWQSCKILFFKNFSPDLYLLDCRRRARESGGSPLAFVICEVNEGLSPKSTSQPMTIVLFSFANLSSSVFSKVECAHRGPSQARSVSAGYLVIIAASSRLMLMVTGTVASGSRASRRREAGPAAHCKGIFHLILVCPTCGGRADVWSLGRLGAGRCAGEEAPVAKQSLRFISPAALCLVCLVNSHREKRLEVQDRCTAPVIEVMTGFDNLSPQTSKIPSNSKFNDLIGKHTAGMMSGDFCKKCL

SEQ ID NO: 813874 - protein, 1222 aa, Homo sapiens
MGAPDHHPGGKGGHGARRPSLCLPRWHFLNSLFTVSQCPTVIEKPGACPLHPFCYAPRFMVLLPLMGATRDGCFLGKTNVCELSHLCHSPTSRAHNWPAGPCTSDCLPRLSPWPRGDSLVGARWPTCLWCCHLSWVCLRPSACWKCPPSHPCALSSREGPAAPFRGRSVPLFLSAFPFPALLGLLWGNEYPWFCPVRESCVPAHKGRTSCRSCGKLLFPRRCPPPEACPLPALQVVFLRPGVNNRDIPGNFPFTKCIILDEGYATSWSSKNRFLPSGLKSWCGPQKQQCVSLGRLQSPSQADAPGGTPWGPPEGPTDVTWVTGVLEDGMAYVTHFVLEPEVMGVLEDGMACVTRFVFVFGCIGVSVLSVSSSHVLNTVGSSLGRRPLSLAAGKPCAAPPSAWAPSLGAGHLGQPGAMVSLQLRPSGPLGSDRPSPHHRALAASGKWGRTLCAWGCCLFTTHDQTPSRTELLSTLQKPTESFVHELSLVCFPVTFVTKQRPLSPRLEQFLQDTVARAAPCCQARWLAGLGPAHVKGTGSCDHTEPRASRSRAWKPDPLVLGLVPRSLQSKTLGCVRDDMGARLGVGPFYRVGWLSEGVEVGDPRGLALGLDIASPSWAGGSLSEPRHTLGLSARRALVTHRRPGWDLCQFQEPSSMKVVLSPERKPRRTPGRRPGLADVCSLCGWTEGALMTHIAAPFHHPSSPEQSLPRDSTCVPSMPQQPVEQGSPLLRQLLLPLPPFSFPAPSPCPSWPVALGSHGVAYWGSCSLGHFLSPGPTGPPPARAPTALAVAGGFPMTRVAQLGEDAVLGTAPGTASCLPDHVSLLQGPQSPWARGHVSHGCRPCQRHIPAPLLLDGVLVVVSMVDPHPTARGDVGQRKGSLDGSLNDHSVRSGVIPCQPKGGPGSTLIPTAGLTPPFSPAREDWPEDRHPVHSPSRVAVPLSPWAVAGLGGCRLPLRAPCSIPGPPRLLPLLGVICVSEGLWQSCKILFFKNFSPDLYLLDCRRRARESGGSPLAFVICEVNEGLSPKSTSQPMTIVLFSFANLSSSVFSKVECAHRGPSQARSVSAGYLVIIAASSRLMLMVTGTVASGSRASRRREAGPAAHCKGIFHLILVCPTCGGRADVGSLGRLGAGRCAGEEAPVAKQSLRFISPAALCLVCLVNSHREKRLEVQDRCTAPVIEVMTGFDNLVPSTSKIPSNSKFNDLIGKHTAGMMSGDFCKKCL

SEQ ID NO: 813875 - protein, 1272 aa, Homo sapiens
MVQVRPGPTLREAGVEQKPSLSVSPPGPWAPPQPEAEPSEHSRDRCSGACPGRPTGAPDHHPGGKGGHGARRPSLCLPRWHFLNSLFTVSQCPTVIEKPGACPLHPFCYAPRFMVLLPLMGATRDGCFLGKTNVCELSHLCHSPTSRAHNWPAGPCTSDCLPRLSPWPRGDSLVGARWPTCLWCCHLSWVCLRPSACWKCPPSHPCALSSREGPAAPFRGRSVPLFLSAFPFPALLGLLWGNEYPWFCPVRESCVPAHKGRTSCRSCGKLLFPRRCPPPEACPLPALQVVFLRPGVNNRDIPGNFPFTKCIILDEGYATSWSSKNRFLPSGLKSWCGPQKQQCVSLGRLQYPSQADAPGGTPWGPPEGPTDVTWVTGVLEDGMAYVTHFVLEPEVMGVLEDGMACVTRFVFVFGCIGVSVLSVSSSHVLNTVGSSLGRRPLSLAAGKPCAAPPSAWAPSLGAGHLGQPGAMVSLQLRPSGPLGSDRPSPHHRALAASGKWGRTLCAWGCCLFTTHDQTPSRTELLSTLQKPTESFVHELSLVCFPVTFVTKQRPLSPRLEQFLQDTVARAAPCCQARWLAGLGPAHVKGTGSCDHTEPRASRSRAWKPDPLVLGLVPRSLQSYDVGGVSVMIWGPGWEYGLSSRVGWLSEGVEVGDPRGLALGLDNASPSWAGGSLSEPRHTLGLSARRALVTHRRPGWDLCQFQEPSSMKVVLSPERKPRRTPGRRPGLADVCSLCGWTEGALMTHIAAPFHHPSSPEQSLPRDSTCVPSMPQQPVEQGSPLLRQLLLPLPPFSFPAPSPCPSWPVALGSHGVAYWGSCSLGHFLSPGPTGPPPARAPTALAVAGGFPMTRVAQLGEDAVLGTAPGTASCLPDHVSLLQGPQSPWARGHVSHGCRPCQRHIPAPLLLDGVLVVVSMVDPHPTARGDVGQRKGSLDGSLNDHSVRSGVISLSAQGRAGEYTDPNSWADTSFLPCTGRIGLRTVTLCTAPVGWQCHCLLGPLQDWAGADSPCGPLAQSPALPDSSLYWGYICVSEGLWQSCKILFFKNFSPDLYLLDCRRRARESGGSPLAFVICEVNEGLSPKSTSQPMTIVLFSVCNLSSSVFSKVECAHRGPSQARSVSAGYLVIIAASSRLMLMVTGTVASGSRASRRREAGPAAHCKGIFHLILVCPTCGGRADVWSLGRLGAGRCAGEEAPVAKQSLRFISPAALCLVCLVNSHREKRLEVQDRCTAPVIEVMTGFDNFSPLRQVRYTSNSKFNDLIGKHTSWHDVR

SEQ ID NO: 813876 - protein, 227 aa, Homo sapiens
MESSKKMDSPGALQTNPPLKLHTDRSAGTPVFVPEQGGYKEKFVKTVEDKYKCEKCHLVLCSPKQTECGHRFCESCMAALLSSSSPKCTACQESIVKDKVFKDNCCKREILALQIYCRNESRGCAEQLTLGHLLVHLKNDCHFEELPCVRPDCKEKVLRKDLRDHVEKACKYREATCSHCKSQVPMIALQVRVLPFHRPSTQFLYDTFHRPSAQFVDNPFHRPSLNS

SEQ ID NO: 813877 - protein, 170 aa, Homo sapiens
MPVPASWPHPPGPFLLLTLLLGLTEVAGEEELQMIQPEKLLLVTVGKTATLHCTVTSLLPVGPVLWFRGVGPGRELIYNQKEGHFPRVTTVSDLTKRNNMDFSIRISSITPADVGTYYCVKFRKGSPENVEFKSGPGTEMALGGPASSLTALLLIAVLLGPIYVPWKQKT

SEQ ID NO: 813878 - protein, 354 aa, Homo sapiens
MIQPEKLLLVTVGKTATLHCTVTSLLPVGPVLWFRGVGPGRELIYNQKEGHFPRVTTVSDLTKRNNMDFSIRISSITPADVGTYYCVKFRKGSPENVEFKSGPGTEMALGAKPSAPVVLGPAARTTPEHTVSFTCESHGFSPRDITLKWFKNGNELSDFQTNVDPTGQSVAYSIRSTARVVLDPWDVRSQVICEVAHVTLQGDPLRGTANLSEAIRVPPTLEVTQQPMRAGNQVNVTCQVRKFYPQSLQLTWLENGNVCQRETASTLTENKDGTYNWTSWFLVNISDQRDDVVLTCQVKHDGQLAVSKRLALEVTVHQKDQSSDATPGPASSLTALLLIAVLLGPIYVPWKQKT

SEQ ID NO: 813879 - protein, 250 aa, Homo sapiens
MALRAGLVLGFHTLMTLLSPQEAGATKADHMGSYGPAFYQSYGASGQFTHEFDEEQLFSVDLKKSEAVWRLPEFGDFARFDPQGGLAGIAAIKAHLDILVERSNRSRAINVPPRVTVLPKSRVELGQPNILICIVDNIFPPVINITWLRNGQTVTEGVAQTSFYSQPDHLFRKFHYLPFVPSAEDVYDCQVEHWGLDAPLLRHWELQVPIPPPDAMETLVCALGLAIGLVGFLVGTVLIIMGTYVSSVPR

SEQ ID NO: 813880 - protein, 250 aa, Homo sapiens; identical to SEQ ID NO: 813879

SEQ ID NO: 813881 - protein, 250 aa, Homo sapiens; identical to SEQ ID NO: 813879

SEQ ID NO: 813882 - protein, 323 aa, Homo sapiens
LLLYLRLVPVLTTRTETDLIKAPECNGPQSRAGPGVPHPDDPPEPAGGRGHQGASPVSEQDSVPTQNPGRGPGSGTQQSHIVDETDTFFSLSLTLNSPNTADHMGSYGPAFYQSYGASGQFTHEFDEEQLFSVDLKKSEAVWRLPEFGDFARFDPQGGLAGIAAIKAHLDILVERSNRSRAINVPPRVTVLPKSRVELGQPNILICIVDNIFPPVINITWLRNGQTVTEGVAQTSFYSQPDHLFRKFHYLPFVPSAEDVYDCQVEHWGLDAPLLRHWELQVPIPPPDAMETLVCALGLAIGLVGFLVGTVLIIMGTYVSSVPR

SEQ ID NO: 813883 - protein, 418 aa, Homo sapiens
LLLYLRLVPVLTTRTETDLIKAPECNGPQSRAGPGVPHPDDPPEPAGGRGHQGASPVSEQDSVPTQNPGRGPGSGTQQSHIVDETDTFFSLSLTLNSPNTADHMGSYGPAFYQSYGASGQFTHEFDEEQLFSVDLKKSEAVWRLPEFGDFARFDPQGGLAGIAAIKAHLDILVERSNRSRAINGGSRSSQTPLAPLSLRNDTSHPDSAQGPVKYRSSWRPHSLPSLLSLCFPPLLPQWIPQSIPCPQMATKGERPLIPVLVRPWGEGMSLWTQGPFLLVPPRVTVLPKSRVELGQPNILICIVDNIFPPVINITWLRNGQTVTEGVAQTSFYSQPDHLFRKFHYLPFVPSAEDVYDCQVEHWGLDAPLLRHWELQVPIPPPDAMETLVCALGLAIGLVGFLVGTVLIIMGTYVSSVPR

SEQ ID NO: 813884 - protein, 282 aa, Homo sapiens
MALRAGLVLGFHTLMTLLSPQEAGATKADHMGSYGPAFYQSYGASGQFTHEFDEEQLFSVDLKKSEAVWRLPEFGDFARFDPQGGLAGIAAIKAHLDILVERSNRSRAINVPPRVTVLPKSRVELGQPNILICIVDNIFPPVINITWLRNGQTVTEGVAQTSFYSQPDHLFRKFHYLPFVPSAEDVYDCQVEHWGLDAPLLRHWGTEPPPHAPSWPQVSFTLESFHITTDSFLSLLELQVPIPPPDAMETLVCALGLAIGLVGFLVGTVLIIMGTYVSSVPR

SEQ ID NO: 813885 - protein, 74 aa, Homo sapiens
TWMELVPARLSFLTGLDDSDAAILDLGCGLVTGTQCPQVMILLREMTCGRHPADPHGFVTAPACSVPFKCIPLC

SEQ ID NO: 813886 - protein, 187 aa, Homo sapiens
LLLYLRLVPVLTTRTETDLIKAPECNGPQSRAGPGVPHPDDPPEPAGGRGHQGASPVSEQDSVPTQNPGRGPGSGTQQSHIVDETDTFFSLSLTLNSPNTADHMGSYGPAFYQSYGASGQFTHEFDEEQLFSVDLKKSEAVWRLPEFGDFARFDPQGGLAGIAAIKAHLDILVERSNRSRAINALCS

SEQ ID NO: 813887 - protein, 172 aa, Homo sapiens [sequence omitted]

SEQ ID NO: 813888 - protein, 177 aa, Homo sapiens
NSRPRRRRRQKGGGEVEMRQEVEGRGRGSHELIITDKRCGVCGGSLSCIVYLCISLNFSRIKKLKKYTWPGPTRDSPNASLQPGRAKFAFSHASHTPLHSQLGELQTGKPQALLASANPLSRSMGPPDHHLTTLILISLYTPFPGLLSSGCFSLTLTLQLDHGGLGNRCLPRCWRYR

SEQ ID NO: 813889 - protein, 576 aa, Homo sapiens
FATTGQWEVTTERDGKKETAQTVGQDVDTQKKRRQRTGRKIRVTMGKKVAIIGAGVSGLASIRSCLEEGLEPTCFEKSNDIGGLWKFSDHAEEGRASIYKSVFSNSSKEMMCFPDFPFPDDFPNFMHNSKIQEYIIAFAKEKNLLKYIQFKTFVSSVNKHPDFATTGQWDVTTERDGKKESAVFDAVMVCSGHHVYPNLPKESFPGLNHFKGKCFHSRDYKEPGVFNGKRVLVVGLGNSGCDIATELSRTAEQVMISSRSGSWVMSRVWDNGYPWDMLLVTRFGTFLKNNLPTAISDWLYVKQMNARFKHENYGLMPLNGVLRKEPVFNDELPASILCGIVSVKPNVKEFTETSAIFEDGTIFEGIDCVIFATGYSFAYPFLDESIIKSRNNEIILFKGVFPPLLEKSTIAVIGFVQSLGAAIPTVDLQSRWAAQVIKGTCTLPSMEDMMNDINEKMEKKRKWFGKSETIQTDYIVYMDELSSFIGAKPNIPWLFLTDPKLAMEVYFGPCSPYQFRLVGPGQWPGARNAILTQWDRSLKPMQTRVVGRLQKPCFFFHWLKLFAIPILLIAVFLVLT

SEQ ID NO: 813890 - protein, 154 aa, Homo sapiens
VIYNVLRKKKRTREKLRTCTLPSMEDMMNDINEKMEKKRKWFGKSETIQTDYIVYMDELSSFIGAKPNIPWLFLTDPKLAMEVYFGPCSPYQFRLVGPGQWPGARNAILTQWDRSLKPMQTRVVGRLQKPCFFFHWLKLFAIPILLIAVFLVLT

SEQ ID NO: 813891 - protein, 546 aa, Homo sapiens
LEHFLFQTAQTVGQDVDTQKKRRQRTGRKIRVTMGKKVAIIGAGVSGLASIRSCLEEGLEPTCFEKSNDIGGLWKFSDHAEEGRASIYKSVFSNSSKEMMCFPDFPFPDDFPNFMHNSKIQEYIIAFAKDPDFATTGQWDVTTERDGKKESAVFDAVMVCSGHHVYPNLPKESFPGLNHFKGKCFHSRDYKEPGVFNGKRVLVVGLGNSGCDIATELSRTAEQVMISSRSGSWVMSRVWDNGYPWDMLLVTRFGTFLKNNLPTAISDWLYVKQMNARFKHENYGLMPLNGVLRKEPVFNDELPASILCGIVSVKPNVKEFTETSAIFEDGTIFEGIDCVIFATGYSFAYPFLDESIIKSRNNEIILFKGVFPPLLEKSTIAVIGFVQSLGAAIPTVDLQSRWAAQVIKGTCTLPSMEDMMNDINEKMEKKRKWFGKSETIQTDYIVYMDELSSFIGAKPNIPWLFLTDPKLAMEVYFGPCSPYQFRLVGPGQWPGARNAILTQWDRSLKPMQTRVVGRLQKPCFFFHWLKLFAIPILLIAVFLVLT

SEQ ID NO: 813892 - protein, 528 aa, Homo sapiens
LEHFLFQTAQTVGQDVDTQKKRRQRTGRKIRVTMGKKVAIIGAGVSGLASIRSCLEEGLEPTCFEKSNDIGGLWKFSDHAEEGRASIYKSVFSNSSKEMMCFPDFPFPDDFPNFMHNSKIQEYIIAFAKDPDFATTGQWDVTTERDGKKESAVFDAVMVCSGHHVYPNLPKESFPGLNHFKGKCFHSRDYKEPGVFNGKRVLVVGLGNSGCDIATELSRTAEQVMISSRSGSWVMSRVWDNGYPWDMLLVTRFGTFLKNNLPTAISDWLYVKQMNARFKHENYGLMPLNGVLRKEPVFNDELPASILCGIVSVKPNVKEFTETSAIFEDGTIFEGIDCVIFATGYSFAYPFLDESIIEKSTIAVIGFVQSLGAAIPTVDLQSRWAAQVIKGTCTLPSMEDMMNDINEKMEKKRKWFGKSETIQTDYIVYMDELSSFIGAKPNIPWLFLTDPKLAMEVYFGPCSPYQFRLVGPGQWPGARNAILTQWDRSLKPMQTRVVGRLQKPCFFFHWLKLFAIPILLIAVFLVLT

SEQ ID NO: 813893 - protein, 552 aa, Homo sapiens
LEHFLFQTAQTVGQDVDTQKKRRQRTGRKIRVTMGKKVAIIGAGVSGLASIRSCLEEGLEPTCFEKSNDIGGLWKFSDHAEEGRASIYKSVFSNSSKEMMCFPDFPFPDDFPNFMHNSKIQEYIIAFAKEKNLLKYIQFKTFVSSVNKHPDFATTGQWDVTTERDGKKESAVFDAVMVCSGHHVYPNLPKELSRDYKEPGVFNGKRVLVVGLGNSGCDIATELSRTAEQVMISSRSGSWVMSRVWDNGYPWDMLLVTRFGTFLKNNLPTAISDWLYVKQMNARFKHENYGLMPLNGVLRKEPVFNDELPASILCGIVSVKPNVKEFTETSAIFEDGTIFEGIDCVIFATGYSFAYPFLDESIIKSRNNEIILFKGVFPPLLEKSTIAVIGFVQSLGAAIPTVDLQSRWAAQVIKGTCTLPSMEDMMNDINEKMEKKRKWFGKSETIQTDYIVYMDELSSFIGAKPNIPWLFLTDPKLAMEVYFGPCSPYQFRLVGPGQWPGARNAILTQWDRSLKPMQTRVVGRLQKPCFFFHWLKLFAIPILLIAVFLVLT

SEQ ID NO: 813894 - protein, 512 aa, Homo sapiens
MPASTRSQKRQGMDSLLEPLKMNMDHAEEGRASIYKSVFSNSSKEMMCFPDFPFPDDFPNFMHNSKIQEYIIAFAKEKNLLKYIQFKTFVSSVNKHPDFATTGQWDVTTERDGKKESAVFDAVMVCSGHHVYPNLPKESFPGLNHFKGKCFHSRDYKEPGVFNGKRVLVVGLGNSGCDIATELSRTAEQVMISSRSGSWVMSRVWDNGYPWDMLLVTRFGTFLKNNLPTAISDWLYVKQMNARFKHENYGLMPLNGVLRKEPVFNDELPASILCGIVSVKPNVKEFTETSAIFEDGTIFEGIDCVIFATGYSFAYPFLDESIIKSRNNEIILFKGVFPPLLEKSTIAVIGFVQSLGAAIPTVDLQSRWAAQVIKGTCTLPSMEDMMNDINEKMEKKRKWFGKSETIQTDYIVYMDELSSFIGAKPNIPWLFLTDPKLAMEVYFGPCSPYQFRLVGPGQWPGARNAILTQWDRSLKPMQTRVVGRLQKPCFFFHWLKLFAIPILLIAVFLVLT

SEQ ID NO: 813895 - protein, 547 aa, Homo sapiens
GRRHTEEKKTKNGVTMGKKVAIIGAGVSGLASIRSCLEEGLEPTCFEKSNDIGGLWKFSDHAEEGRASIYKSVFSNSSKEMMCFPDFPFPDDFPNFMHNSKIQEYIIAFAKEKNLLKYIQFKTFVSSVNKHPDFATTGQWDVTTERDGKKESAVFDAVMVCSGHHVYPNLPKESFPGLNHFKGKCFHSRDYKEPGVFNGKRVLVVGLGNSGCDIATELSRTAEQVMISSRSGSWVMSRVWDNGYPWDMLLVTRFGTFLKNNLPTAISDWLYVKQMNARFKHENYGLMPLNGVLRKEPVFNDELPASILCGIVSVKPNVKEFTETSAIFEDGTIFEGIDCVIFATGYSFAYPFLDESIIKSRNNEIILFKGVFPPLLEKSTIAVIGFVQSLGAAIPTVDLQSRWAAQVIKGTCTLPSMEDMMNDINEKMEKKRKWFGKSETIQTDYIVYMDELSSFIGAKPNIPWLFLTDPKLAMEVYFGPCSPYQFRLVGPGQWPGARNAILTQWDRSLKPMQTRVVGRLQKPCFFFHWLKLFAIPILLIAVFLVLT

SEQ ID NO: 813896 - protein, 512 aa, Homo sapiens; identical to SEQ ID NO: 813894

SEQ ID NO: 813897 - protein, 513 aa, Homo sapiens
FATTGQWEVTTERDGKKETAQTVGQDVDTQKKRRQRTGRKIRVTMGKKVAIIGAGVSGLASIRSCLEEGLEPTCFEKSNDIGGLWKFSTFVSSVNKHPDFATTGQWDVTTERDGKKESAVFDAVMVCSGHHVYPNLPKESFPGLNHFKGKCFHSRDYKEPGVFNGKRVLVVGLGNSGCDIATELSRTAEQVMISSRSGSWVMSRVWDNGYPWDMLLVTRFGTFLKNNLPTAISDWLYVKQMNARFKHENYGLMPLNGVLRKEPVFNDELPASILCGIVSVKPNVKEFTETSAIFEDGTIFEGIDCVIFATGYSFAYPFLDESIIKSRNNEIILFKGVFPPLLEKSTIAVIGFVQSLGAAIPTVDLQSRWAAQVIKGTCTLPSMEDMMNDINEKMEKKRKWFGKSETIQTDYIVYMDELSSFIGAKPNIPWLFLTDPKLAMEVYFGPCSPYQFRLVGPGQWPGARNAILTQWDRSLKPMQTRVVGRLQKPCFFFHWLKLFAIPILLIAVFLVLT

SEQ ID NO: 813898 - protein, 139 aa, Homo sapiens
MGTCTLPSMEDMMNDINEKMEKKRKWFGKSETIQTDYIVYMDELSSFIGAKPNIPWLFLTDPKLAMEVYFGPCSPYQFRLVGPGQWPGARNAILTQWDRSLKPMQTRVVGRLQKPCFFFHWLKLFAIPILLIAVFLVLT

SEQ ID NO: 813899 - protein, 546 aa, Homo sapiens; identical to SEQ ID NO: 813891

SEQ ID NO: 813900 - protein, 111 aa, Homo sapiens
MEDMMNDINEKMEKKRKCFIGAKPNIPWLFLTDPKLAMEVYFGPCSPYQFRLVGPGQWPGARNAILTQWDRSLKPMQTRVVGRLQKPCFFFHWLKLFAIPILLIAVFLVLT

SEQ ID NO: 813901 - protein, 757 aa, Homo sapiens
MVPDTACVLLLTLAALGASGQGQSPLGSDLGPQMLRELQETNAALQDVRELLRQQVREITFLKNTVMECDACGMQQSVRTGLPSVRPLLHCAPGFCFPGVACIQTESGARCGPCPAGFTGNGSHCTDVNECNAHPCFPRVRCINTSPGFRCEACPPGYSGPTHQGVGLAFAKANKQVCTDINECETGQHNCVPNSVCINTRGSFQCGPCQPGFVGDQASGCQRRAQRFCPDGSPSECHEHADCVLERDGSRSCVCAVGWAGNGILCGRDTDLDGFPDEKLRCPERQCRKDNCVTVPNSGQEDVDRDGIGDACDPDADGDGVPNEKDNCPLVRNPDQRNTDEDKWGDACDNCRSQKNDDQKDTDQDGRGDACDDDIDGDRIRNQADNCPRVPNSDQKDSDGDGIGDACDNCPQKSNPDQADVDHDFVGDACDSDQDQDGDGHQDSRDNCPTVPNSAQEDSDHDGQGDACDDDDDNDGVPDSRDNCRLVPNPGQEDADRDGVGDVCQDDFDADKVVDKIDVCPENAEVTLTDFRAFQTVVLDPEGDAQIDPNWVVLNQGREIVQTMNSDPGLAVGYTAFNGVDFEGTFHVNTVTDDDYAGFIFGYQDSSSFYVVMWKQMEQTYWQANPFRAVAEPGIQLKAVKSSTGPGEQLRNALWHTGDTESQVRLLWKDPRNVGWKDKKSYRWFLQHRPQVGYIRVRFYEGPELVADSNVVLDTTMRGGRLGVFCFSQENIIWANLRYRCNDTIPEDYETHQLRQA

SEQ ID NO: 813902 - protein, 158 aa, Homo sapiens
MLRELQETNAALQDVRELLRQQVKGDHWFLNKHGDGELVNSVRNLHAEQISTPGITPEVDGPVSKCAGPRSIRAFHQERMDTMQIPRKRQRTETAARNEEHHHGHQTGSKENQEQTRRIRNRANQNRYKRNVGKQDKKHSEIRTARNHEWHSKQPRNH

SEQ ID NO: 813903 - protein, 802 aa, Homo sapiens
MGHPPLEFSDCYLDSPDFRERLKCYEQELERTNKFIKDVIKDGNALISAMRNYSSAVQKFSQTLQSFQFDFIGDTLTDDEINIAESFKEFAELLNEVENERMMMVHNASDLLIKPLENFRKEQIGFTKERKKKFEKDGERFYSLLDRHLHLSSKKKESQLQEADLQVDKERHNFFESSLDYVYQIQEVQESKKFNIVEPVLAFLHSLFISNSLTVELTQDFLPYKQQLQLSLQNTRNHFSSTREEMEELKKRMKEAPQTCKLPGQPTIEGYLYTQEKWALGISWVKYYCQYEKETKTLTMTPMEQKPGAKQGPLDLTLKYCVRRKTESIDKRFCFDIETNERPGTITLQALSEANRRLWMEAMDGKEPIYHSPITKQQEMELNEVGFKFVRKCINIIETKGIKTEGLYRTVGSNIQVQKLLNAFFDPKCPGDVDFHNSDWDIKTITSSLKFYLRNLSEPVMTYRLHKELVSAAKSDNLDYRLGAIHSLVYKLPEKNREMLELLIRHLVNVCEHSKENLMTPSNMGVIFGPTLMRAQEDTVAAMMNIKFQNIVVEILIEHFGKIYLGPPEESAAPPVPPPRVTARRHKPITISKRLLRERTVFYTSSLDESEDEIQHQTPNGTITSSIEPPKPPQHPKLPIQRSGETDPGRKSPSRPILDGKLEPCPEVDVGKLVSRLQDGGTKITPKATNGPMPGSGPTKTPSFHIKRPAPRPLAHHKEGDADSFSKVRPPGEKPTIIRPPVRPPDPPCRAATPQKPEPKPDIVAGNAGEITSSVVASRTRFFETASRKTGSSQGRLPGDES

SEQ ID NO: 813904 - protein, 304 aa, Homo sapiens
MLELLIRHLVNVCEHSKENLMTPSNMGVIFGPTLMRAQEDTVAAMMNIKFQNIVVEILIEHFGKIYLGPPEESAAPPVPPPRVTARRHKPITISKRLLRERTVFYTSSLDESEDEIQHQTPNGTITSSIEPPKPPQHPKLPIQRSGETDPGRKSPSRPILDGKLEPCPEVDVGKLVSRLQDGGTKITPKATNGPMPGSGPTKTPSFHIKRPAPRPLAHHKEGDADSFSKVRPPGEKPTIIRPPVRPPDPPCRAATPQKPEPKPDIVAGNAGEITSSVVASRTRFFETASRKTGSSQGRLPGDES

SEQ ID NO: 813905 - protein, 304 aa, Homo sapiens; identical to SEQ ID NO: 813904

SEQ ID NO: 813906 - protein, 304 aa, Homo sapiens; identical to SEQ ID NO: 813904

SEQ ID NO: 813907 - protein, 169 aa, Homo sapiens
MRSKGRARKLATNNECVYGNYPEIPLEEMPDADGVASTPSLNIQEPCSPATSSEAFTPKEGSPYKAPIYIPDDIPIPAEFELRESNMPGAGLGIWTKRKIEVGEKFGPYVGEQRSNLKDPSYGWEVHLPRSRRVSVHSWLYLGKRSSDVGIAFSQADVYMPGLQCAFLS

SEQ ID NO: 813908 - protein, 1395 aa, Homo sapiens
MRIPVDASTSRRFTPPSTALSPGKMSEALPLGAPDAGAALAGKLRSGDRSMVEVLADHPGELVRTDSPNFLCSVLPTHWRCNKTLPIAFKVVALGDVPDGTLVTVMAGNDENYSAELRNATAAMKNQVARFNDLRFVGRSGRGKSFTLTITVFTNPPQVATYHRAIKITVDGPREPRNNECVYGNYPEIPLEEMPDADGVASTPSLNIQEPCSPATSSEAFTPKEGSPYKAPIYIPDDIPIPAEFELRESNMPGAGLGIWTKRKIEVGEKFGPYVGEQRSNLKDPSYGWEILDEFYNVKFCIDASQPDVGSWLKYIRFAGCYDQHNLVACQINDQIFYRVVADIAPGEELLLFMKSEDYPHETMAPDIHEERQYRCEDCDQLFESKAELADHQKFPCSTPHSAFSMVEEDFQQKLESENDLQEIHTIQECKECDQVFPDLQSLEKHMLSHTEEREYKCDQCPKAFNWKSNLIRHQMSHDSGKHYECENCAKVFTDPSNLQRHIRSQHVGARAHACPECGKTFATSSGLKQHKHIHSSVKPFICEVCHKSYTQFSNLCRHKRMHADCRTQIKCKDCGQMFSTTSSLNKHRRFCEGKNHFAAGGFFGQGISLPGTPAMDKTSMVNMSHANPGLADYFGANRHPAGLTFPTAPGFSFSFPGLFPSGLYHRPPLIPASSPVKGLSSTEQTNKSQSPLMTHPQILPATQDILKALSKHPSVGDNKPVELQPERSSEERPFEKISDQSESSDLDDVSTPSGSDLETTSGSDLESDIESDKEKFKENGKMFKDKVSPLQNLASINNKKEYSNHSIFSPSLEEQTAVSGAVNDSIKAIASIAEKYFGSTGLVGLQDKKVGALPYPSMFPLPFFPAFSQSMYPFPDRDLRSLPLKMEPQSPGEVKKLQKGSSESPFDLTTKRKDEKPLTPVPSKPPVTPATSQDQPLDLSMGSRSRASGTKLTEPRKNHVFGGKKGSNVESRPASDGSLQHARPTPFFMDPIYRVEKRKLTDPLEALKEKYLRPSPGFLFHPQMSAIENMAEKLESFSALKPEASELLQSVPSMFNFRAPPNALPENLLRKGKERYTCRYCGKIFPRSANLTRHLRTHTGEQPYRCKYCDRSFSISSNLQRHVRNIHNKEKPFKCHLCDRCFGQQTNLDRHLKKHENGNMSGTATSSPHSELESTGAILDDKEDAYFTEIRNFIGNSNHGSQSPRNVEERMNGSHFKDEKALVTSQNSDLLDDEEVEDEVLLDEEDEDNDITGKTGKEPVTSNLHEGNPEDDYEETSALEMSCKTSPVRYKEEEYKSGLSALDHIRHFTDSLKMRKMEDNQYSEAELSSFSTSHVPEELKQPLHRKSKSQAYAMMLSLSDKESLHSTSHSSSNVWHSMARAAAESSAIQSISHV

SEQ ID NO: 813909 - protein, 1115 aa, Homo sapiens
MILDEFYNVKFCIDASQPDVGSWLKYIRFAGCYDQHNLVACQINDQIFYRVVADIAPGEELLLFMKSEDYPHETMAPDIHEERQYRCEDCDQLFESKAELADHQKFPCSTPHSAFSMVEEDFQQKLESENDLQEIHTIQECKECDQVFPDLQSLEKHMLSHTEEREYKCDQCPKAFNWKSNLIRHQMSHDSGKHYECENCAKVFTDPSNLQRHIRSQHVGARAHACPECGKTFATSSGLKQHKHIHSSVKPFICEVCHKSYTQFSNLCRHKRMHADCRTQIKCKDCGQMFSTTSSLNKHRRFCEGKNHFAAGGFFGQGISLPGTPAMDKTSMVNMSHANPGLADYFGANRHPAGLTFPTAPGFSFSFPGLFPSGLYHRPPLIPASSPVKGLSSTEQTNKSQSPLMTHPQILPATQDILKALSKHPSVGDNKPVELQPERSSEERPFEKISDQSESSDLDDVSTPSGSDLETTSGSDLESDIESDKEKFKENGKMFKDKVSPLQNLASINNKKEYSNHSIFSPSLEEQTAVSGAVNDSIKAIASIAEKYFGSTGLVGLQDKKVGALPYPSMFPLPFFPAFSQSMYPFPDRDLRSLPLKMEPQSPGEVKKLQKGSSESPFDLTTKRKDEKPLTPVPSKPPVTPATSQDQPLDLSMGSRSRASGTKLTEPRKNHVFGGKKGSNVESRPASDGSLQHARPTPFFMDPIYRVEKRKLTDPLEALKEKYLRPSPGFLFHPQFQLPDQRTWMSAIENMAEKLESFSALKPEASELLQSVPSMFNFRAPPNALPENLLRKGKERYTCRYCGKIFPRSANLTRHLRTHTGEQPYRCKYCDRSFSISSNLQRHVRNIHNKEKPFKCHLCDRCFGQQTNLDRHLKKHENGNMSGTATSSPHSELESTGAILDDKEDAYFTEIRNFIGNSNHGSQSPRNVEERMNGSHFKDEKALVTSQNSDLLDDEEVEDEVLLDEEDEDNDITGKTGKEPVTSNLHEGNPEDDYEETSALEMSCKTSPVRYKEEEYKSGLSALDHIRHFTDSLKMRKMEDNQYSEAELSSFSTSHVPEELKQPLHRKSKSQAYAMMLSLSDKESLHSTSHSSSNVWHSMARAAAESSAIQSISHV

SEQ ID NO: 813910 - protein, 1115 aa, Homo sapiens; identical to SEQ ID NO: 813909

SEQ ID NO: 813911 - protein, 791 aa, Homo sapiens
MILDEFYNVKFCIDASQPDVGSWLKYIRFAGCYDQHNLVACQINDQIFYRVVADIAPGEELLLFMKSEDYPHETMAPDIHEERQYRCEDCDQLFESKAELADHQKFPCSTPHSAFSMVEEDFQQKLESENDLQEIHTIQECKECDQVFPDLQSLEKHMLSHTEEREYKCDQCPKAFNWKSNLIRHQMSHDSGKHYECENCAKVFTDPSNLQRHIRSQHVGARAHACPECGKTFATSSGLKQHKHIHSSVKPFISFSQSMYPFPDRDLRSLPLKMEPQSPGEVKKLQKGSSESPFDLTTKRKDEKPLTPVPSKPPVTPATSQDQPLDLSMGSRSRASGTKLTEPRKNHVFGGKKGSNVESRPASDGSLQHARPTPFFMDPIYRVEKRKLTDPLEALKEKYLRPSPGFLFHPQFQLPDQRTWMSAIENMAEKLESFSALKPEASELLQSVPSMFNFRAPPNALPENLLRKGKERYTCRYCGKIFPRSANLTRHLRTHTGEQPYRCKYCDRSFSISSNLQRHVRNIHNKEKPFKCHLCDRCFGQQTNLDRHLKKHENGNMSGTATSSPHSELESTGAILDDKEDAYFTEIRNFIGNSNHGSQSPRNVEERMNGSHFKDEKALVTSQNSDLLDDEEVEDEVLLDEEDEDNDITGKTGKEPVTSNLHEGNPEDDYEETSALEMSCKTSPVRYKEEEYKSGLSALDHIRHFTDSLKMRKMEDNQYSEAELSSFSTSHVPEELKQPLHRKSKSQAYAMMLSLSDKESLHSTSHSSSNVWHSMARAAAESSAIQSISHV

SEQ ID NO: 813912 - protein, 1115 aa, Homo sapiens; identical to SEQ ID NO: 813909

SEQ ID NO: 813913 - protein, 1115 aa, Homo sapiens; identical to SEQ ID NO: 813909

SEQ ID NO: 813914 - protein, 1239 aa, Homo sapiens
MRSKGRARKLATNNECVYGNYPEIPLEEMPDADGVASTPSLNIQEPCSPATSSEAFTPKEGSPYKAPIYIPDDIPIPAEFELRESNMPGAGLGIWTKRKIEVGEKFGPYVGEQRSNLKDPSYGWEILDEFYNVKFCIDASQPDVGSWLKYIRFAGCYDQHNLVACQINDQIFYRVVADIAPGEELLLFMKSEDYPHETMAPDIHEERQYRCEDCDQLFESKAELADHQKFPCSTPHSAFSMVEEDFQQKLESENDLQEIHTIQECKECDQVFPDLQSLEKHMLSHTEEREYKCDQCPKAFNWKSNLIRHQMSHDSGKHYECENCAKVFTDPSNLQRHIRSQHVGARAHACPECGKTFATSSGLKQHKHIHSSVKPFICEVCHKSYTQFSNLCRHKRMHADCRTQIKCKDCGQMFSTTSSLNKHRRFCEGKNHFAAGGFFGQGISLPGTPAMDKTSMVNMSHANPGLADYFGANRHPAGLTFPTAPGFSFSFPGLFPSGLYHRPPLIPASSPVKGLSSTEQTNKSQSPLMTHPQILPATQDILKALSKHPSVGDNKPVELQPERSSEERPFEKISDQSESSDLDDVSTPSGSDLETTSGSDLESDIESDKEKFKENGKMFKDKVSPLQNLASINNKKEYSNHSIFSPSLEEQTAVSGAVNDSIKAIASIAEKYFGSTGLVGLQDKKVGALPYPSMFPLPFFPAFSQSMYPFPDRDLRSLPLKMEPQSPGEVKKLQKGSSESPFDLTTKRKDEKPLTPVPSKPPVTPATSQDQPLDLSMGSRSRASGTKLTEPRKNHVFGGKKGSNVESRPASDGSLQHARPTPFFMDPIYRVEKRKLTDPLEALKEKYLRPSPGFLFHPQFQLPDQRTWMSAIENMAEKLESFSALKPEASELLQSVPSMFNFRAPPNALPENLLRKGKERYTCRYCGKIFPRSANLTRHLRTHTGEQPYRCKYCDRSFSISSNLQRHVRNIHNKEKPFKCHLCDRCFGQQTNLDRHLKKHENGNMSGTATSSPHSELESTGAILDDKEDAYFTEIRNFIGNSNHGSQSPRNVEERMNGSHFKDEKALVTSQNSDLLDDEEVEDEVLLDEEDEDNDITGKTGKEPVTSNLHEGNPEDDYEETSALEMSCKTSPVRYKEEEYKSGLSALDHIRHFTDSLKMRKMEDNQYSEAELSSFSTSHVPEELKQPLHRKSKSQAYAMMLSLSDKESLHSTSHSSSNVWHSMARAAAESSAIQSISHV

SEQ ID NO: 813915 - protein, 310 aa, Homo sapiens
YYQLMCGLCGNYNGDPKDDFRCKYCDRSFSISSNLQRHVRNIHNKEKPFKCHLCDRCFGQQTNLDRHLKKHENGNMSGTATSSPHSELESTGAILDDKEDAYFTEIRNFIGNSNHGSQSPRNVEERMNGSHFKDEKALVTSQNSDLLDDEEVEDEVLLDEEDEDNDITGKTGKEPVTSNLHEGNPEDDYEETSALEMSCKTSPVRYKEEEYKSGLSALDHIRHFTDSLKMRKMEDNQYSEAELSSFSTSHVPEELKQPLHRKSKSQAYAMMLSLSDKESLHSTSHSSSNVWHSMARAAAESSAIQSISHV

SEQ ID NO: 813916 - protein, 1067 aa, Homo sapiens
MILDEFYNVKFCIDASQPDVGSWLKYIRFAGCYDQHNLVACQINDQIFYRVVADIAPGEELLLFMKSEDYPHETMAPDIHEERQYRCEDCDQLFESKAELADHQKFPCSTPHSAFSMVEEDFQQKLESENDLQEIHTIQECKECDQVFPDLQSLEKHMLSHTEEREYKCDQCPKAFNWKSNLIRHQMSHDSGKHYECENCAKVFTDPSNLQRHIRSQHVGARAHACPECGKTFATSSGLKQHKHIHSSVKPFICEVCHKSYTQFSNLCRHKRMHADCRTQIKCKDCGQMFSTTSSLNKHRRFCEGKNHFAAGGFFGQGISLPGTPAMDKTSMVNMSHANPGLADYFGANRHPAGLTFPTAPGFSFSFPGLFPSGLYHRPPLIPASSPVKGLSSTEQTNKSQSPLMTHPQILPATQDILKALSKHPSVGDNKPVELQPERSSEERPFEKISDQSESSDLDDVSTPSGSDLETTSGSDLESDIESDKEKFKENGKMFKDKVSPLQNLASINNKKEYSNHSIFSPSLEEQTAVSGAVNDSIKAIASIAEKYFGSTGLVGLQDKKVGALPYPSMFPLPFFPAFSQSMYPFPDRDLRSLPLKMEPQSPGEVKKLQKGSSESPFDLTTKRKDEKPLTPVPSKPPVTPATSQDQPLDLSMGSRSRASGTKLTEPRKNHVFGGKKGSNVESRPASDGSLQHARPTPFFMDPIYRVEKRKLTDPLEALKEKYLRPSPGFLFHPQMSAIENMAEKLESFSALKPEASELLQSVPSMFNFRAPPNALPENLLRKGKERYTCRYCGKIFPRSANLTRHLRTHTGEQPYRCKYCDRSFSISSNLQRHVRNIHNKEKPFKCHLCDRCFGQQTNLDRHLKKHENGNMSGTATSSPHSELESTGAILDDKEDAYFTEIRNFIGNSNHGSQSPRNVEERMNGSHFKDEKALVTSQNSDLLDDEEVEDEVLLDEEDEDNDITGKTGKEPVTSNLHEGNPEDDYEETSALEMSCKTSPVRYKEEEYKSGLSALDHIRHFTDSLKMRKMEDNQYSEAELSSFSTSHVPEELKQPLHRKSKSQVQIFP

SEQ ID NO: 813917 - protein, 305 aa, Homo sapiens
MRIPVDASTSRRFTPPSTALSPGKMSEALPLGAPDAGAALAGKLRSGDRSMVEVLADHPGELVRTDSPNFLCSVLPTHWRCNKTLPIAFKVVALGDVPDGTLVTVMAGNDENYSAELRNATAAMKNQVARFNDLRFVGRSGRGKSFTLTITVFTNPPQVATYHRAIKITVDGPREPRNNECVYGNYPEIPLEEMPDADGVASTPSLNIQEPCSPATSSEAFTPKEGSPYKAPIYIPDDIPIPAEFELRESNMPGAGLGIWTKRKIEVGEKFGPYVGEQRSNLKDPSYGWEVRMYFELTHLYIAAV

SEQ ID NO: 813918 - protein, 1050 aa, Homo sapiens
MLCWGYWSLGQPGISTNLQGIVAEPQVCGFISDRSVKEVACGGNHSVFLLEDGEVYTCGLNTKGQLGHEREGNKPEQIGALADQHIIHVACGESHSLALSDRGQLFSWGAGSDGQLGLMTTEDSVAVPRLIQKLNQQTILQVSCGNWHCLALAADGQFFTWGKNSHGQLGLGKEFPSQASPQRVRSLEGIPLAQVAAGGAHSFALSLSGAVFGWGMNNAGQLGLSDEKDRESPCHVKLLRTQKVVYISCGEEHTAVLTKSGGVFTFGAGSCGQLGHDSMNDEVNPRRVLELMGSEVTQIACGRQHTLAFVPSSGLIYAFGCGARGQLGTGHTCNVKCPSPVKGYWAAHSGQLSARADRFKYHIVKQIFSGGDQTFVLCSKYENYSPAVDFRTMNQAHYTSLINDETIAVWRQKLSEHNNANTINGVVQILSSAACWNGSFLEKKIDEHFKTSPKIPGIDLNSTRVLFEKLMNSQHSMILEQILNSFESCLIPQLSSSPPDVEAMRIYLILPEFPLLQDSKYYITLTIPLAMAILRLDTNPSKVLDNWWSQVCPKYFMKLVNLYKGAVLYLLRGRKTFLIPVLFNNYITAALKLLEKLYKVNLKVKHVEYDTFYIPEISNLVDIQEDYLMWFLHQAGMKARPSIIQDTVTLCSYPFIFDAQAKTKMLQTDAELQMQVAVNGANLQNVFMLLTLEPLLARSPFLVLHVRRNNLVGDALRELSIHSDIDLKKPLKVIFDGEEAVDAGGVTKEFFLLLLKELLNPIYGMFTYYQDSNLLWFSDTCFVEHNWFHLIGITCGLAIYNSTVVDLHFPLALYKKLLNVKPGLEDLKELSPTEGRSLQELLDYPGEDVEETFCLNFTICRESYGVIEQKKLIPGGDNVTVCKDNRQEFVDAYVNYVFQISVHEWYTAFSSGFLKVCGGKVLELFQPSELRAMMVGNSNYNWEELEETAIYKGDYSATHPTVKLFWETFHEFPLEKKKKFLLFLTGSDRIPIYGMASLQIVIQSTASGEEYLPVAHTCYNLLDLPKYSSKEILSARLTQALDNYEGFSLA

SEQ ID NO: 813919 - protein, 1037 aa, Homo sapiens
MLCWGYWSLGQPGISTNLQGIVAEPQVCGFISDRSVKEVACGGNHSVFLLEDGEVYTCGLNTKGQLGHEREGNKPEQIGALADQHIIHVACGESHSLALSDRGQLFSWGAGSDGQLGLMTTEDSVAVPRLIQKLNQQTILQVSCGNWHCLALAADGQFFTWGKNSHGQLGLGKEFPSQASPQRVRSLEGIPLAQVAAGGAHSFALSLSGAVFGWGMNNAGQLGLSDEKDRESPCHVKLLRTQKVVYISCGEEHTAVLTKSGGVFTFGAGSCGQLGHDSMNDEVNPRRVLELMGSEVTQIACGRQHTLAFVPSSGLIYAFGCGARGQLGTGHTCNVKCPSPVKGYWAAHSGQLSARADRFKYHIVKQIFSGGDQTFVLCSKYENYSPAVDFRTMNQAHYTSLINDETIAVWRQKLSEHNNANTINGVVQILSSAACWNGSFLEKKIDEHFKTSPKIPGIDLNSTRVLFEKLMNSQHSMILEQILNSFESCLIPQLSSSPPDVEAMRIYLILPEFPLLQDSKYYITLTIPLAMAILRLDTNPSKVLDNWWSQVCPKYFMKLVNLYKGAVLYLLRGRKTFLIPVLFNNYITAALKLLEKLYKVNLKVKHVEYDTFYIPEISNLVDIQEDYLMWFLHQAGMKARPSIIQDTVTLCSYPFIFDAQAKMAVNGANLQNVFMLLTLEPLLARSPFLVLHVRRNNLVGDALRELSIHSDIDLKKPLKVIFDGEEAVDAGGVTKEFFLLLLKELLNPIYGMFTYYQDSNLLWFSDTCFVEHNWFHLIGITCGLAIYNSTVVDLHFPLALYKKLLNVKPGLEDLKELSPTEGRSLQELLDYPGEDVEETFCLNFTICRESYGVIEQKKLIPGGDNVTVCKDNRQEFVDAYVNYVFQISVHEWYTAFSSGFLKVCGGKVLELFQPSELRAMMVGNSNYNWEELEETAIYKGDYSATHPTVKLFWETFHEFPLEKKKKFLLFLTGSDRIPIYGMASLQIVIQSTASGEEYLPVAHTCYNLLDLPKYSSKEILSARLTQALDNYEGFSLA

SEQ ID NO: 813920 - protein, 822 aa, Homo sapiens
MNNAGQLGLSDEKDRESPCHVKLLRTQKVVYISCGEEHTAVLTKSGGVFTFGAGSCGQLGHDSMNDEVNPRRVLELMGSEVTQIACGRQHTLAFVPSSGLIYAFGCGARGQLGTGHTCNVKCPSPVKGYWAAHSGQLSARADRFKYHIVKQIFSGGDQTFVLCSKYENYSPAVDFRTMNQAHYTSLINDETIAVWRQKLSEHNNANTINGVVQILSSAACWNGSFLEKKIDEHFKTSPKIPGIDLNSTRVLFEKLMNSQHSMILEQILNSFESCLIPQLSSSPPDVEAMRIYLILPEFPLLQDSKYYITLTIPLAMAILRLDTNPSKVLDNWWSQVCPKYFMKLVNLYKGAVLYLLRGRKTFLIPVLFNNYITAALKLLEKLYKVNLKVKHVEYDTFYIPEISNLVDIQEDYLMWFLHQAGMKARPSIIQDTVTLCSYPFIFDAQAKMAVNGANLQNVFMLLTLEPLLARSPFLVLHVRRNNLVGDALRELSIHSDIDLKKPLKVIFDGEEAVDAGGVTKEFFLLLLKELLNPIYGMFTYYQDSNLLWFSDTCFVEHNWFHLIGITCGLAIYNSTVVDLHFPLALYKKLLNVKPGLEDLKELSPTEGRSLQELLDYPGEDVEETFCLNFTICRESYGVIEQKKLIPGGDNVTVCKDNRQEFVDAYVNYVFQISVHEWYTAFSSGFLKVCGGKVLELFQPSELRAMMVGNSNYNWEELEETAIYKGDYSATHPTVKLFWETFHEFPLEKKKKFLLFLTGSDRIPIYGMASLQIVIQSTASGEEYLPVAHTCYNLLDLPKYSSKEILSARLTQALDNYEGFSLA

SEQ ID NO: 813921 - protein, 1037 aa, Homo sapiens; identical to SEQ ID NO: 813919

SEQ ID NO: 813922 - protein, 665 aa, Homo sapiens
FFLLLHLILQNYSPAVDFRTMNQAHYTSLINDETIAVWRQKLSEHNNANTINGVVQILSSAACWNGSFLEKKIDEHFKTSPKIPGIDLNSTRVLFEKLMNSQHSMILEQILNSFESCLIPQLSSSPPDVEAMRIYLILPEFPLLQDSKYYITLTIPLAMAILRLDTNPSKVLDNWWSQVCPKYFMKLVNLYKGAVLYLLRGRKTFLIPVLFNNYITAALKLLEKLYKVNLKVKHVEYDTFYIPEISNLVDIQEDYLMWFLHQAGMKARPSIIQDTVTLCSYPFIFDAQAKMAVNGANLQNVFMLLTLEPLLARSPFLVLHVRRNNLVGDALRELSIHSDIDLKKPLKVIFDGEEAVDAGGVTKEFFLLLLKELLNPIYGMFTYYQDSNLLWFSDTCFVEHNWFHLIGITCGLAIYNSTVVDLHFPLALYKKLLNVKPGLEDLKELSPTEGRSLQELLDYPGEDVEETFCLNFTICRESYGVIEQKKLIPGGDNVTVCKDNRQEFVDAYVNYVFQISVHEWYTAFSSGFLKVCGGKVLELFQPSELRAMMVGNSNYNWEELEETAIYKGDYSATHPTVKLFWETFHEFPLEKKKKFLLFLTGSDRIPIYGMASLQIVIQSTASGEEYLPVAHTCYNLLDLPKYSSKEILSARLTQALDNYEGFSLA

SEQ ID NO: 813923 - protein, 1037 aa, Homo sapiens; identical to SEQ ID NO: 813919

SEQ ID NO: 813924 - protein, 1037 aa, Homo sapiens; identical to SEQ ID NO: 813919

SEQ ID NO: 813925 - protein, 839 aa, Homo sapiens
MLCWGYWSLGQPGISTNLQGIVAEPQVCGFISDRSVKEVACGGNHSVFLLEDGEVYTCGLNTKGQLGHEREGNKPEQIGALADQHIIHVACGESHSLALSDRGQLFSWGAGSDGQLGLMTTEDSVAVPRLIQKLNQQTILQVSCGNWHCLALAADGQFFTWGKNSHGQLGLGKEFPSQASPQRVRSLEGIPLAQVAAGGAHSFALSLSGAVFGWGMNNAGQLGLSDEKDRESPCHVKLLRTQKVVYISCGEEHTAVLTKSGGVFTFGAGSCGQLGHDSMNDEVNPRRVLELMGSEVTQIACGRQHTLAFVPSSGLIYAFGCGARGQLGTGHTCNVKCPSPVKGYWAAHSGQLSARADRFKYHIVKQIFSGGDQTFVLCSKYENYSPAVDFRTMNQAHYTSLINDETIAVWRQKLSEHNNANTINGVVQILSSAACWNGSFLEKKIDEHFKTSPKIPGIDLNSTRVLFEKLMNSQHSMILEQILNSFESCLIPQLSSSPPDVEAMRIYLILPEFPLLQDSKYYITLTIPLAMAILRLDTNPSKVLDNWWSQVCPKYFMKLVNLYKGAVLYLLRGRKTFLIPVLFNNYITAALKLLEKLYKVNLKVKHVEYDTFYIPEISNLVDIQEDYLMWFLHQAGMKARPSIIQDTVTLCSYPFIFDAQAKMAVNGANLQNVFMLLTLEPLLARSPFLVLHVRRNNLVGDALRELSIHSDIDLKKPLKVIFDGEEAVDAGGVTKEFFLLLLKELLNPIYGMFTYYQDSNLLWFSDTCFVEHNWFHLIGITCGLAIYNSTVVDLHFPLALYKKLLNVKPGLEDLKELSPTEGSPSSLPLFSPFRTLCPP

SEQ ID NO: 813926 - protein, 443 aa, Homo sapiens
MLCWGYWSLGQPGISTNLQGIVAEPQVCGFISDRSVKEVACGGNHSVFLLEDGEVYTCGLNTKGQLGHEREGNKPEQIGALADQHIIHVACGESHSLALSDRGQLFSWGAGSDGQLGLMTTEDSVAVPRLIQKLNQQTILQVSCGNWHCLALAADGQFFTWGKNSHGQLGLGKEFPSQASPQRVRSLEGIPLAQVAAGGAHSFALSLSGAVFGWGMNNAGQLGLSDEKDRESPCHVKLLRTQKVVYISCGEEHTAVLTKSGGVFTFGAGSCGQLGHDSMNDEVNPRRVLELMGSEVTQIACGRQHTLAFVPSSGLIYAFGCGARGQLGTGHTCNVKCPSPVKGYWAAHSGQLSARADRFKYHIVKQIFSGGDQTFVLCSKYENYSPAVDFRTMNQAHYTSLINDETIAVWRQKLSEHNNANTIKYVAACLHFFFHKVCYNFLA

SEQ ID NO: 813927 - protein, 411 aa, Homo sapiens
QRAGGSGRNSVVLRARLPAAGEPRAWRGNSSLLRCFGLREPKGGGETKEKQTLRSGTVRGLRSCVRALARAGSVLAREAEAGGGGGPARSDSVDGSQGRRRREAEEAAAAMEVKRLKVTELRSELQRRGLDSRGLKVDLAQRLQEALDAEMLEDEAGGGGAGPGGACKAEPRPVAASGGGPGGDEEEDEEEEEEDEEALLEDEDEEPPPAQALGQAAQPPPEPPEAAAMEAAAEPDASEKPAEATAGSGGVNGGEEQGLGKREEDEPEERSGAVTRRRDPRCRVTRPPRNREMTRIVKSQNLRLPLFYPETAHTCAHACTHTFSILKECFLGAIFILFYFLILGGGNKGIRPRKMYSFSFSLATWRIHIPCVLNPRKRKRSNQPCGRSMVSGVYFKTAGKETGPILYIVAT

SEQ ID NO: 813928 - protein, 78 aa, Homo sapiens
GYRREEQGDDQDSEKSKPAGSDGERRGVKRQRDEKDEHGRAYYEFREEAYHSRSKSPLPPEEEAKDEEEDQTLVNLDT

SEQ ID NO: 813929 - protein, 444 aa, Homo sapiens [sequence omitted]

SEQ ID NO: 813930 - protein, 859 aa, Homo sapiens
RGREEAGGTPSSSARACPRLGNQGPGGETAPCCVVLGSVSRKGEGRRRRSKHCAAGPCAASAPACVRSLARAQCWRVRRRRAAAAAPARSDSVDGSQGRRRREAEEAAAAMEVKRLKVTELRSELQRRGLDSRGLKVDLAQRLQEALDAEMLEDEAGGGGAGPGGACKAEPRPVAASGGGPGGDEEEDEEEEEEDEEALLEDEDEEPPPAQALGQAAQPPPEPPEAAAMEAAAEPDASEKPAEATAGSGGVNGGEEQGLGKREEDEPEELERSGDETPGSEVPGDKAAEEQGDDQDSEKSKPAGSDGERRGVKRQRDEKDEHGRAYYEFREEAYHSRSKSPLPPEEEAKDEEEDQTLVNLDTYTSDLHFQVSKDRYGGQPLFSEKFPTLWSGARSTYGVTKGKVCFEAKVTQNLPMKEGCTEVSLLRVGWSVDFSRPQLGEDEFSYGFDGRGLKAENGQFEEFGQTFGENDVIGCFANFETEEVELSFSKNGEDLGVAFWISKDSLADRALLPHVLCKNCVVELNFGQKEEPFFPPPEEFVFIHAVPVEERVRTAVPPKTIEECEVILMVGLPGSGKTQWALKYAKENPEKRYNVLGAETVLNQMRMKGLEEPEMDPKSRDLLVQQASQCLSKLVQIASRTKRNFILDQCNVYNSGQRRKLLLFKTFSRKVVVVVPNEEDWKKRLELRKEVEGDDVPESIMLEMKANFSLPEKCDYMDEVTYGELEKEEAQPIVTKYKEEARKLLPPSEKRTNRRNNRNKRNRQNRSRGQGYVGGQRRGYDNRAYGQQYWGQPGNRGGYRNFYDRYRGDYDRFYGRDYEYNRYRDYYRQYNRDWQSYYYHHPQDRDRYYRNYYGYQGYR

SEQ ID NO: 813931 - protein, 444 aa, Homo sapiens [sequence omitted]

SEQ ID NO: 813932 - protein, 657 aa, Homo sapiens
RREMLCRHPLSLIDAESIQKLPDQPSHHTQKRPFPSGEKLPDQPFTHHSQEGPFPPGEKLPDRPLIPQPRGAFLTWRETSRPSPLTTARRGLSHRKKKMIRIIFFFRRGVKRQRDEKDEHGRAYYEFREEAYHSRSKSPLPPEEEAKDEEEDQTLVNLDTYTSDLHFQVSKDRYGGQPLFSEKFPTLWSGARSTYGVTKGKVCFEAKVTQNLPMKEGCTEVSLLRVGWSVDFSRPQLGEDEFSYGFDGRGLKAENGQFEEFGQTFGENDVIGCFANFETEEVELSFSKNGEDLGVAFWISKDSLADRALLPHVLCKNCVVELNFGQKEEPFFPPPEEFVFIHAVPVEERVRTAVPPKTIEECEVILMVGLPGSGKTQWALKYAKENPEKRYNVLGAETVLNQMRMKGLEEPEMDPKSRDLLVQQASQCLSKLVQIASRTKRNFILDQCNVYNSGQRRKLLLFKTFSRKVVVVVPNEEDWKKRLELRKEVEGDDVPESIMLEMKANFSLPEKCDYMDEVTYGELEKEEAQPIVTKYKEEARKLLPPSEKRTNRRNNRNKRNRQNRSRGQGYVGGQRRGYDNRAYGQQYWGQPGNRGGYRNFYDRYRGDYDRFYGRDYEYNRYRDYYRQYNRDWQSYYYHHPQDRDRYYRNYYGYQGYR

SEQ ID NO: 813933 - protein, 518 aa, Homo sapiens
MLCWRLTSIGHWSKLIASFFTDTSDLHFQVSKDRYGGQPLFSEKFPTLWSGARSTYGVTKGKVCFEAKVTQNLPMKEGCTEVSLLRVGWSVDFSRPQLGEDEFSYGFDGRGLKAENGQFEEFGQTFGENDVIGCFANFETEEVELSFSKNGEDLGVAFWISKDSLADRALLPHVLCKNCVVELNFGQKEEPFFPPPEEFVFIHAVPVEERVRTAVPPKTIEECEVILMVGLPGSGKTQWALKYAKENPEKRYNVLGAETVLNQMRMKGLEEPEMDPKSRDLLVQQASQCLSKLVQIASRTKRNFILDQCNVYNSGQRRKLLLFKTFSRKVVVVVPNEEDWKKRLELRKEVEGDDVPESIMLEMKANFSLPEKCDYMDEVTYGELEKEEAQPIVTKYKEEARKLLPPSEKRTNRRNNRNKRNRQNRSRGQGYVGGQRRGYDNRAYGQQYWGQPGNRGGYRNFYDRYRGDYDRFYGRDYEYNRYRDYYRQYNRDWQSYYYHHPQDRDRYYRNYYGYQGYR

SEQ ID NO: 813934 - protein, 245 aa, Homo sapiens
LARGRTCGCRQSKQQVYCCWCCCKVAIRIGRERRKCNVYNSGQRRKLLLFKTFSRKVVVVVPNEEDWKKRLELRKEVEGDDVPESIMLEMKANFSLPEKCDYMDEVTYGELEKEEAQPIVTKYKEEARKLLPPSEKRTNRRNNRNKRNRQNRSRGQGYVGGQRRGYDNRAYGQQYWGQPGNRGGYRNFYDRYRGDYDRFYGRDYEYNRYRDYYRQYNRDWQSYYYHHPQDRDRYYRNYYGYQGYR

SEQ ID NO: 813935 - protein, 106 aa, Homo sapiens
SLSAQSIRALTEAPITGIRVGGQRRGYDNRAYGQQYWGQPGNRGGYRNFYDRYRGDYDRFYGRDYEYNRYRDYYRQYNRDWQSYYYHHPQDRDRYYRNYYGYQGYR

SEQ ID NO: 813936 - protein, 311 aa, Homo sapiens
QRAGGSGRNSVVLRARLPAAGEPRAWRGNSSLLRCFGLREPKGGGETKEKQTLRSGTVRGLRSCVRALARAGSVLAREAEAGGGGGPARSDSVDGSQGRRRREAEEAAAAMEVKRLKVTELRSELQRRGLDSRGLKVDLAQRLQEALDAEMLEDEAGGGGAGPGGACKAEPRPVAASGGGPGGDEEEDEEEEEEDEEALLEDEDEEPPPAQALGQAAQPPPEPPEAAAMEAAAEPDASEKPAEATAGSGGVNGGEEQGLGKREEDEPEERSGAVTRRRDPRCRVTRPPRNREMTRIVKSQNQQAQMVSGGG

SEQ ID NO: 813937 - protein, 48 aa, Homo sapiens
MDEVTYGELEKEEAQPIVTKYKEEARKLLPPSEKRTNRRNNRNKRNRQ

SEQ ID NO: 813938 - protein, 695 aa, Homo sapiens
MASKVTDAIVWYQKKIGAYDQQIWEKSVEQREIKGLRNKPKKTAHVKPDLIDVDLVRGSAFAKAKPESPWTSLTRKGIVRVVFFPFFFRWWLQVTSKVIFFWLLVLYLLQVAAIVLFCSTSSPHSIPLTEVIGPIWLMLLLGTVHCQIVSTRTPKPPLSTGGKRRRKLRKAAHLEVHREGDGSSTTDNTQEGAVQNHGTSTSHSVGTVFRDLWHAAFFLSGSKKAKNSIDKSTETDNGYVSLDGKKTVKSGEDGIQNHEPQCETIRPEETAWNTGTLRNGPSKDTQRTITNVSDEVSSEEGPETGYSLRRHVDRTSEGVLRNRKSHHYKKHYPNEDAPKSGTSCSSRCSSSRQDSESARPESETEDVLWEDLLHCAECHSSCTSETDVENHQINPCVKKEYRDDPFHQSHLPWLHSSHPGLEKISAIVWEGNDCKKADMSVLEISGMIMNRVNSHIPGIGYQIFGNAVSLILGLTPFVFRLSQATDLEQLTAHSASELYVIAFGSNEDVIVLSMVIISFVVRVSLVWIFFFLLCVAERTYKQRLLFAKLFGHLTSARRARKSEVPHFRLKKVQNIKMWLSLRSYLKRRGPQRSVDVIVSSAFLLTISVVFICCAQINLYLKMEKKPNKKEELTLVNNVLKLATKLLKELDSPFRLYGLTMNPLLYNITQVVILSAVSGVISDLLGFNLKLWKIKS

SEQ ID NO: 813939 - protein, 677 aa, Homo sapiens
MASKVTDAIVWYQKKIGAYDQQIWEKSVEQREIKGLRNKPKKTAHVKPDLIDVDLVRGSAFAKAKPESPWTSLTRKGIVRVVFFPFFFRWWLQVTSKVIFFWLLVLYLLQVAAIVLFCSTSSPHSIPLTEVIGPIWLMLLLGTVHCQIVSTRTPKPPLSTGGKRRRKLRKAAHLEVHREGDGSSTTDNTQEGAVQNHGTSTSHSVGTVFRDLWHAAFFLSGSKKAKNSIDKSTETDNGYVSLDGKKTVKSGEDGIQNHEPQCETIRPEETAWNTGTLRNGPSKDTQRTITNVSDEVSSEEGPETGYSLRRHVDRTSEGVLRNRKSHHYKKHYPNEDAPKSGTSCSSRCSSSRQDSESARPESETEDVLWEDLLHCAECHSSCTSETDVENHQINPCVKKEYRDDPFHQSHLPWLHSSHPGLEKISAIVWEGNDCKKADMSVLEISGMIMNRVNSHIPGIGYQIFGNAVSLILGLTPFVFRLSQATDLEQLTAHSASELYVIAFGSNEDVIVLSMVIISFVVRVSLVWIFFFLLCVAERTYKQRLLFAKLFGHLTSARRARKSEVPHFRLKKVQNIKMWLSLRSYLKRRGPQRSVDVIVSSAFLLTISVVFICCAQLLHVHEIFLDCHYNWELVIWCISLTLFLLRFVTLGSETSKKYSNTSILLTEHKPLLENGEKT

SEQ ID NO: 813940 - protein, 633 aa, Homo sapiens
MASKVTDAIVWYQKKIGAYDQQIWEKSVEQREIKGLRNKPKKTAHVKPDLIDVDLVRGSAFAKAKPESPWTSLTRKGIVRVVFFPFFFRWWLQVTSKVIFFWLLVLYLLQVAAIVLFCSTSSPHSIPLTEVIGPIWLMLLLGTVHCQIVSTRTPKPPLSTGGKRRRKLRKAAHLEVHREGDGSSTTDNTQEGAVQNHGTSTSHSVGTVFRDLWHAAFFLSGSKKAKNSIDKSTETDNGYVSLDGKKTVKSGEDGIQNHEPQCETIRPEETAWNTGTLRNGPSKDTQRTITNVSDEVSSEEGPETGYSLRRHVDRTSEGVLRNRKSHHYKKHYPNEDAPKSGTSCSSRCSSSRQDSESARPESETEDVLWEDLLHCAECHSSCTSETDVENHQINPCVKKEYRDDPFHQSHLPWLHSSHPGLEKISAIVWEGNDCKKADMSVLEISGMIMNRVNSHIPGIGYQIFGNAVSLILGLTPFVFRLSQATDLEQLTAHSASELYVIAFGSNEDVIVLSMVIISFVVRVSLVWIFFFLLCVAERTYKQRRGPQRSVDVIVSSAFLLTISVVFICCAQLLHVHEIFLDCHYNWELVIWCISLTLFLLRFVTLGSETSKKYSNTSILLTEHKPLLENGEKT

SEQ ID NO: 813941 - protein, 677 aa, Homo sapiens; identical to SEQ ID NO: 813939

SEQ ID NO: 813942 - protein, 540 aa, Homo sapiens
MLLLGTVHCQIVSTRTPKPPLSTGGKRRRKLRKAAHLEVHREGDGSSTTDNTQEGAVQNHGTSTSHSVGTVFRDLWHAAFFLSGSKKAKNSIDKSTETDNGYVSLDGKKTVKSGEDGIQNHEPQCETIRPEETAWNTGTLRNGPSKDTQRTITNVSDEVSSEEGPETGYSLRRHVDRTSEGVLRNRKSHHYKKHYPNEDAPKSGTSCSSRCSSSRQDSESARPESETEDVLWEDLLHCAECHSSCTSETDVENHQINPCVKKEYRDDPFHQSHLPWLHSSHPGLEKISAIVWEGNDCKKADMSVLEISGMIMNRVNSHIPGIGYQIFGNAVSLILGLTPFVFRLSQATDLEQLTAHSASELYVIAFGSNEDVIVLSMVIISFVVRVSLVWIFFFLLCVAERTYKQRLLFAKLFGHLTSARRARKSEVPHFRLKKVQNIKMWLSLRSYLKRRGPQRSVDVIVSSAFLLTISVVFICCAQLLHVHEIFLDCHYNWELVIWCISLTLFLLRFVTLGSETSKKYSNTSILLTEHKPLLENGEKT

SEQ ID NO: 813943 - protein, 677 aa, Homo sapiens; identical to SEQ ID NO: 813939

SEQ ID NO: 813944 - protein, 546 aa, Homo sapiens
MASKVTDAIVWYQKKIGAYDQQIWEKSVEQREIKGLRNKPKKTAHVKPDLIDVDLVRGSAFAKAKPESPWTSLTRKGIVRVVFFPFFFRWWLQVTSKVIFFWLLVLYLLQVAAIVLFCSTSSPHSIPLTEVIGPIWLMLLLGTVHCQIVSTRTPKPPLSTGGKRRRKLRKAAHLEVHREGDGSSTTDNTQEGAVQNHGTSTSHSVGTVFRDLWHAAFFLSGSKKAKNSIDKSTETDNGYVSLDGKKTVKSGEDGIQNHEPQCETIRPEETAWNTGTLRNGPSKDTQRTITNVSDEVSSEEGPETGYSLRRHVDRTSEGVLRNRKSHHYKKHYPNEDAPKSGTSCSSRCSSSRQDSESARPESETEDVLWEDLLHCAECHSSCTSETDVENHQINPCVKKEYRDDPFHQSHLPWLHSSHPGLEKISAIVWEGNDCKKADMSVLEISGMIMNRVNSHIPGIGYQIFGNAVSLILGLTPFVFRLSQATDLEQLTAHSASELYVIAFGSNEDVIVLSMVIISFVVRVSLVWIFFFLLCVAERTYKQVGIM

SEQ ID NO: 813945 - protein, 454 aa, Homo sapiens
MASKVTDAIVWYQKKIGAYDQQIWEKSVEQREIKGLRNKPKKTAHVKPDLIDVDLVRGSAFAKAKPESPWTSLTRKGIVRVVFFPFFFRWWLQVTSKVIFFWLLVLYLLQVAAIVLFCSTSSPHSIPLTEVIGPIWLMLLLGTVHCQIVSTRTPKPPLSTGGKRRRKLRKAAHLEVHREGDGSSTTDNTQEGAVQNHGTSTSHSVGTVFRDLWHAAFFLSGSKKAKNSIDKSTETDNGYVSLDGKKTVKSGEDGIQNHEPQCETIRPEETAWNTGTLRNGPSKDTQRTITNVSDEVSSEEGPETGYSLRRHVDRTSEGVLRNRKSHHYKKHYPNEDAPKSGTSCSSRCSSSRQDSESARPESETEDVLWEDLLHCAECHSSCTSETDVENHQINPCVKKEYRDDPFHQSHLPWLHSSHPGLEKISAIVWEGNDCKKADMSVLEISGMIMNRVSF

SEQ ID NO: 813946 - protein, 352 aa, Homo sapiens
MASKVTDAIVWYQKKIGAYDQQIWEKSVEQREIKGLRNKPKKTAHVKPDLIDVDLVRGSAFAKAKPESPWTSLTRKGIVRVVFFPFFFRWWLQVTSKVIFFWLLVLYLLQVAAIVLFCSTSSPHSIPLTEVIGPIWLMLLLGTVHCQIVSTRTPKPPLSTGGKRRRKLRKAAHLEVHREGDGSSTTDNTQEGAVQNHGTSTSHSVGTVFRDLWHAAFFLSGSKKAKNSIDKSTETDNGYVSLDGKKTVKSGEDGIQNHEPQCETIRPEETAWNTGTLRNGPSKDTQRTITNVSDEVSSEEGPETGYSLRRHVDRTSEGVLRNRKSHHYKKHYPNEVYTLSLSVYIRIYFICY

SEQ ID NO: 813947 - protein, 205 aa, Homo sapiens
MSIMSYNGGAVMAMKGKNCVAIAADRRFGIQAQMVTTDFQKIFPMGDRLYIGLAGLATDVQTVAQRLKFRLNLYELKEGRQIKPYTLMSMVANLLYEKRFGPYYTEPVIAGLDPKTFKPFICSLDLIGCPMVTDDFVVSGTCAEQMYGMCESLWEPNMDPDHLFETISQAMLNAVDRDAVSGMGVIVHIIEKDKITTRTLKARMD

SEQ ID NO: 813948 - protein, 66 aa, Homo sapiens
IYLSLILIRDYYFLRKRLHDPDHLFETISQAMLNAVDRDAVSGMGVIVHIIEKDKITTRTLKARMD

SEQ ID NO: 813949 - protein, 66 aa, Homo sapiens
VGGEVCYYASSKKTFRTTTDPDHLFETISQAMLNAVDRDAVSGMGVIVHIIEKDKITTRTLKARMD

SEQ ID NO: 813950 - protein, 155 aa, Homo sapiens
MAVKRGASVAMLLACGASPHTGTVRVSTLTSVTAHHWIGGGTTSLYEKRFGPYYTEPVIAGLDPKTFKPFICSLDLIGCPMVTDDFVVSGTCAEQMYGMCESLWEPNMDPDHLFETISQAMLNAVDRDAVSGMGVIVHIIEKDKITTRTLKARMD

SEQ ID NO: 813951 - protein, 98 aa, Homo sapiens
CYLHKQNATSTDRRFGIQAQMVTTDFQKIFPMGDRLYIGLAGLATDVQTVAQRLKFRLNLYELKEGRQIKPYTLMSMVANLLYEKRIRITCLWSTISP

SEQ ID NO: 813952 - protein, 205 aa, Homo sapiens; identical to SEQ ID NO: 813947

SEQ ID NO: 813953 - protein, 205 aa, Homo sapiens; identical to SEQ ID NO: 813947

SEQ ID NO: 813954 - protein, 205 aa, Homo sapiens; identical to SEQ ID NO: 813947

SEQ ID NO: 813955 - protein, 205 aa, Homo sapiens; identical to SEQ ID NO: 813947

SEQ ID NO: 813956 - protein, 112 aa, Homo sapiens
MSIMSYNGGAVMAMKGKNCVAIAADRRFGIQAQMVTTDFQKIFPMGDRLYIGLAGLATDVQTVAQRLKFRLNLYELKEGRQIKPYTLMSMVANLLYEKRIRITCLKPSPKPC

SEQ ID NO: 813957 - protein, 123 aa, Homo sapiens
SREWLSVVRANLLYEKRFGPYYTEPVIAGLDPKTFKPFICSLDLIGCPMVTDDFVVSGTCAEQMYGMCESLWEPNMDPDHLFETISQAMLNAVDRDAVSGMGVIVHIIEKDKITTRTLKARMD
